United States Patent 7,745,391 (HUMAN THROMBOSPONDIN POLYPEPTIDE) - sequence listing, part 88

SEQ ID NO: 294932 - DNA, 1251 bp, Homo sapiens
gaggagcgttggccttggggttaaacgaactggatgatggccgccagctactaacagacctcaacttgcttacccctggaatgtggtgatggatggttccttgcagggcatttagggtggaaggcagtgatgtggatgtacctcgcagagcggatgttccactgtgtagcctggcttctaccctctacaagcttaagagggaaaacttagggaactatgacctaagcagtcaagcaagaaaccacacatatgcacatacccagaatcgaacaccactagaactacccaaaaactgagatggttgggggaggtatcatttattcatattactttctcccatgtactttttgaaagacagcttattctttcccttttagagatgagggaccagatttaagagcttattttgtgctttacattcattaactcacttgatctccacagcaactccatgagaagggtgctaatattaccactgggtactgagtagtacctctctttcactagttgcataataagaattaacccagagagtgacctgagggcgggattttggacacacttgacaagagaggaagaggctggagcgcaggaggtagctggtgctgggctcctagtcttggcagaggagcccaaagcacttggctgccctgcgtgtcactcatctccctttgcctccctggagtccctggatgccctagagcctgaggagaaggctgaggactgctgggagctacagatcagcccggagctactggctcatgggcgccaaaaaatactggatctgctgaacgaaggctcagcccgagatctccgcagtcttcagcgcattggcccgaagaaggcccagctaatcgtgggctggcgggagctccacggccccttcagccaggtagcagcccactggactgggggagggcgggggcgggggagaccgggtacccccgagaccctgtcccctatcgatcctgtcccgccaggtggaggacctggaacgcgtggagggcataacggggaaacagatggagtccttcctgaaggtgaagtcacggccctgcccctcctctgcctgtcctgcgccccgcgcccctctctaacgtcgctgtctccctccctcctgtgttgcaggcaaacatcctgggtctcgccgccggccagcgctgtggcgcctcctgaccgtcgtctcctcactccgccttttcaaatttttgtataaccccgtgttgtgtaaatacagtttttgctccggtg

SEQ ID NO: 294933 - DNA, 300 bp, Homo sapiens
cgcacacaatgctgggcagcccagagcaacctggggtgatcccgcgggctctcatggacctcctgcagctcacaagggaggagggtgccgagggccggccatgggccctttctgtcaccatgtcttacctagagatctaccaggagaaggaggccccgtgctggttgggagaggagcaacaaagggtcaaagtaagacctggttctagaacatgaagctctgctgtagcagggaggtaaggtgagacctagaaagacagagactggggtagcagatggtacaactccgagaatagaacag

SEQ ID NO: 294934 - DNA, 863 bp, Homo sapiens
ttacactaagaactctttgttacatcaggtattgcactctcagtctcgccatgttgaagtcagaatggcctgtattcactatcttcgagagaacagagagaaatttgaagcgtttatagaaggatcatttgaagaatatttaaagcgtttggaaaatccacaggaatgggtaggacaagtggaaataagtgccctttctcttatgtacaggaaagattttataatttatcgggaaccaaatgtttctccttcacaagtaacagaaaataattttcctgaaaaggtgttactgtgtttttcaaatggaaatcattatgatattgtgtatcccataaagtataaagaaagctctgctatgtgtcagtctctcctttatgaattgctgtatgagaaggtatttaaaactgatgttagtaaaattgtgatggaactagacacgttggaagtagctgatgaagataacagtgaaatatcagattcagaggatgacagttgcaagtaagaatgaaatcctaaaatacctttcttagtgccatacaaggaaagttaagtaaatgtctttacatttcagtaaatgtctttctataacatatattgaggtattaatggtattcataaaatacagcagtctgctgaagtttctttatccctgtcactaattttacctaatttctattatgggactgtttgttttgaaagttggtgtttttggttgatgagaatttacgtctgcaatctagatgcatatttgtagaataaatttggtcctacctatatgtgtgtgtattgtaaaattttaaagttaacttgtcaattgttcacatacccagtaatgaaataaaatggccgtttggatttccttc

SEQ ID NO: 294935 - DNA, 1083 bp, Homo sapiens
cggccgcgtgcggacagccatgcattaggcagggcttccctatgcgcccggagagcgcggaccgctgcctcgggccgccgccgcctgccgccgctcgcggagcccgagccccagcccgagccgccgcctgccccaggccggggcgtcgagcagccggcggcctggccatgtggggctagccctcgccgcgcctggcctgcagcaggaccagcaacatggaggctgccgtcggcgtccccgacggcggggaccagggcggcgcggggccccgcgaggacgcgacgcccatggacgcctatctgcggaaactgggcttgtatcggaaactggtcgccaaggacgggtcgtgcctgttccgggccgtggcggagcaggtattgcactctcagtctcgccatgttgaagtcagaatggcctgtattcactatcttcgagagaacagagagaaatttgaagcgtttatagaaggatcatttgaagaatatttaaagcgtttggaaaatccacaggaatgggtaggacaagtggaaataagtgccctttctcttatgtacaggaaagattttataatttatcgggaaccaaatgtttctccttcacaagtaacagaaaataattttcctgaaaaggtgttactgtgtttttcaaatggaaatcattatgatattgtgtatcccataaagtataaagaaagctctgctatgtgtcagtctctcctttatgaattgctgtatgagaaggtatttaaaactgatgttagtaaaattgtgatggaactagacacgttggaagtagctgatgaagataacagtgaaatatcagattcagaggatgacagttgcaagagtaagactgctgctgctgctgctgatgtgaatggatttaaacctttgtcaggcaatgagcagctgaagaacaatgggaactctactagcctgcctttgtctagaaaggttcttaagtcactcaatcctgcagtctatagaatatgaaatttggctgaagtctaaacaagctcagcaaaaacgtgattattccattgctgctggcttacaatatgaagttggagacaaatgtcaagta

SEQ ID NO: 294936 - DNA, 511 bp, Homo sapiens
tgacctccggaagaggccagagaaaaaatgaagccagtgttagcatgtagtaatgatgttagtaaaattgtgatggaactagacacgttggaagtagctgatgaagataacagtgaaatatcagattcagaggatgacagttgcaagtaagaatgaaatcctaaaatacctttcttagtgccatacaaggaaagttaagtaaatgtctttacatttcagtaaatgtctttctataacatatattgaggtattaatggtattcataaaatacagcagtctgctgaagtttctttatccctgtcactaattttacctaatttctattatgggactgtttgttttgaaagttggtgtttttggttgatgagaatttacgtctgcaatctagatgcatatttgtagaataaatttggtcctacctatatgtgtgtgtattgtaaaattttaaagttaacttgtcaattgttcacatacccagtaatgaaataaaatggccgtttggatttccttc

SEQ ID NO: 294937 - DNA, 1378 bp, Homo sapiens
ccaaagtgctgagattacaggcgtgagccaccatgcccagccttaagttttaaacatcaagttttatcattatagcagcatttatatagttggttattaatatattttacttttaactattttcaaattcatactgttatttcatagtccaattcatcatgattcttgacatccatcccccaactgacgtcttaaatattaaagagttagaaattttttatattaggctaagcaaaatatagaaaagaaaatccactcttccttccctgcaatatgaataaatacttccgaagtcaaagtcaaataggaacctttttttttttttttaagacaggctctcactctatctcccaggctggaatgtagtggtgcagcctcaacctccagaattcaggtgatccttccacctcccacctcaggtctcaggttccagagtagctaggactacaggtgtgtactatcacacccagctttttttgtttgtttgtttgcagagatgggatctcactttgttgccctggctggtcttgaactcctggtctcaagtgatcctcctgctttggcctcctaaagtgctgcgtttacaggtgtgagccactgcaccaaggctaggaatatctttttaaaatttttattccgtaagaatccactttttcaaaaagatagaaaaatattaatttaatttctaaaatatgattcttaagaaacaatggtatgaatttttgatatttacagctctagaataaaatctactcagactgttattcaattttaaattttatcagtgtttgagaaaattaatcttcctgagttctcttctgtcctaacaaaaatgaccttgaaaatcacatatcactgcttgattaaacatcagactgttttcaaagaactgctcctggcaatgtgaacaattcttgagattttaatgaaaacagcagaaggagctttggctttaaaaaaataataatttttttttactttggaaacaagccaagtatgtttcacatccctaaaatcctctgcctgttttaaaaaaacaaaccaaaaaaaagtttaaaactaatcagtgattaaaataaaatgaataacaaagcacacacagtaatcccaaactaccccttaaaactaaataaaaatataaatttgccttatcagatatgtttacttattaacaaatgggagggtcacacagtttttaaaaaatagtttatgtaaatttatttaaatatttatgtattagaagtaccataatatcaataaaaataagaattgatgcttttggaactttgttttttaagggaaaagcacagattctcccaaaccaaatgaataatcatatcaatttttccctttttatctgtgaaacacaatcccatct

SEQ ID NO: 294938 - DNA, 1241 bp, Homo sapiens
ccaaagtgctgagattacaggcgtgagccaccatgcccagccttaagttttaaacatcaagttttatcattatagcagcatttatatagttggttattaatatattttacttttaactattttcaaattcatactgttatttcatagtccaattcatcatgattcttgacatccatcccccaactgacgtcttaaatattaaagagttagaaattttttatattaggctaagcaaaatatagaaaagaaaatccactcttccttccctgcaatatgaataaatacttccgaagtcaaagtcaaataggaacctttttttttttttttaagacaggctctcactctatctcccaggctggaatgtagtggtgcagcctcaacctccagaattcaggtgatccttccacctcccacctcaggtctcaggttccagagtagctaggactacaggtgtgagccactgcaccaaggctaggaatatctttttaaaatttttattccgtaagaatccactttttcaaaaagatagaaaaatattaatttaatttctaaaatatgattcttaagaaacaatggtatgaatttttgatatttacagctctagaataaaatctactcagactgttattcaattttaaattttatcagtgtttgagaaaattaatcttcctgagttctcttctgtcctaacaaaaatgaccttgaaaatcacatatcactgcttgattaaacatcagactgttttcaaagaactgctcctggcaatgtgaacaattcttgagattttaatgaaaacagcagaaggagctttggctttaaaaaaataataatttttttttactttggaaacaagccaagtatgtttcacatccctaaaatcctctgcctgttttaaaaaaacaaaccaaaaaaaagtttaaaactaatcagtgattaaaataaaatgaataacaaagcacacacagtaatcccaaactaccccttaaaactaaataaaaatataaatttgccttatcagatatgtttacttattaacaaatgggagggtcacacagtttttaaaaaatagtttatgtaaatttatttaaatatttatgtattagaagtaccataatatcaataaaaataagaattgatgcttttggaactttgttttttaagggaaaagcacagattctcccaaaccaaatgaataatcatatcaatttttccctttttatctgtgaaacacaatcccatct

SEQ ID NO: 294939 - DNA, 10495 bp, Homo sapiens
  misc_feature (69)..(69): n is a, c, g, or t
  misc_feature (1160)..(1160): n is a, c, g, or t
agagcacaggctttgaccgatagtaacctctgcgctcggtgcagccgaatctataaaaggaactagtcncggcaaaaaccccgtaattgcgagcgagagtgagtggggccgggacccgcagagccgagccgacccttctctcccgggctgcggcagggcagggcggggagctccgcgcaccaacagagccggttctcagggcgctttgctccttgttttttccccggttctgttttctccccttctccggaaggcttgtcaaggggtaggagaaagagacgcaaacacaaaagtggaaaacagttaatgaccagccacggcgtccctgctgtgagctctggccgctgccttccagggctcccgagccacacgctgggggtgctggctgagggaacatggcttgttggcctcagctgaggttgctgctgtggaagaacctcactttcagaagaagacaaacatgtcagctgctgctggaagtggcctggcctctatttatcttcctgatcctgatctctgttcggctgagctacccaccctatgaacaacatgaatgccattttccaaataaagccatgccctctgcaggaacacttccttgggttcaggggattatctgtaatgccaacaacccctgtttccgttacccgactcctggggaggctcccggagttgttggaaactttaacaaatccattgtggctcgcctgttctcagatgctcggaggcttcttttatacagccagaaagacaccagcatgaaggacatgcgcaaagttctgagaacattacagcagatcaagaaatccagctcaaacttgaagcttcaagatttcctggtggacaatgaaaccttctctgggttcctgtatcacaacctctctctcccaaagtctactgtggacaagatgctgagggctgatgtcattctccacaaggtatttttgcaaggctaccagttacatttgacaagtctgtgcaatggatcaaaatcagaagagatgattcaacttggtgaccaagaagtttctgagctttgtggcctaccaagggagaaactggctgcagcagagcgagtacttcgttccaacatggacatcctgaagccaatcctgagaacactaaactctacatctcccttcccgagcaaggagctggcngaagccacaaaaacattgctgcatagtcttgggactctggcccaggagctgttcagcatgagaagctggagtgacatgcgacaggaggtgatgtttctgaccaatgtgaacagctccagctcctccacccaaatctaccaggctgtgtctcgtattgtctgcgggcatcccgagggaggggggctgaagatcaagtctctcaactggtatgaggacaacaactacaaagccctctttggaggcaatggcactgaggaagatgctgaaaccttctatgacaactctacaactccttactgcaatgatttgatgaagaatttggagtctagtcctctttcccgcattatctggaaagctctgaagccgctgctcgttgggaagatcctgtatacacctgacactccagccacaaggcaggtcatggctgaggtgaacaagaccttccaggaactggctgtgttccatgatctggaaggcatgtgggaggaactcagccccaagatctggaccttcatggagaacagccaagaaatggaccttgtccggatgctgttggacagcagggacaatgaccacttttgggaacagcagttggatggcttagattggacagcccaagacatcgtggcgtttttggccaagcacccagaggatgtccagtccagtaatggttctgtgtacacctggagagaagctttcaacgagactaaccaggcaatccggaccatatctcgcttcatggagtgtgtcaacctgaacaagctagaacccatagcaacagaagtctggctcatcaacaagtccatggagctgctggatgagaggaagttctgggctggtattgtgttcactggaattactccaggcagcattgagctgccccatcatgtcaagtacaagatccgaatggacattgacaatgtggagaggacaaataaaatcaaggatgggtactgggaccctggtcctcgagctgacccctttgaggacatgcggtacgtctgggggggcttcgcctacttgcaggatgtggtggagcaggcaatcatcagggtgctgacgggcaccgagaagaaaactggtgtctatatgcaacagatgccctatccctgttacgttgatgacatctttctgcgggtgatgagccggtcaatgcccctcttcatgacgctggcctggatttactcagtggctgtgatcatcaagggcatcgtgtatgagaaggaggcacggctgaaagagaccatgcggatcatgggcctggacaacagcatcctctggtttagctggttcattagtagcctcattcctcttcttgtgagcgctggcctgctagtggtcatcctgaagttaggaaacctgctgccctacagtgatcccagcgtggtgtttgtcttcctgtccgtgtttgctgtggtgacaatcctgcagtgcttcctgattagcacactcttctccagagccaacctggcagcagcctgtgggggcatcatctacttcacgctgtacctgccctacgtcctgtgtgtggcatggcaggactacgtgggcttcacactcaagatcttcgctagcctgctgtctcctgtggcttttgggtttggctgtgagtactttgccctttttgaggagcagggcattggagtgcagtgggacaacctgtttgagagtcctgtggaggaagatggcttcaatctcaccacttcggtctccatgatgctgtttgacaccttcctctatggggtgatgacctggtacattgaggctgtctttccaggccagtacggaattcccaggccctggtattttccttgcaccaagtcctactggtttggcgaggaaagtgatgagaagagccaccctggttccaaccagaagagaatatcagaaatctgcatggaggaggaacccacccacttgaagctgggcgtgtccattcagaacctggtaaaagtctaccgagatgggatgaaggtggctgtcgatggcctggcactgaatttttatgagggccagatcacctccttcctgggccacaatggagcggggaagacgaccaccatgtcaatcctgaccgggttgttccccccgacctcgggcaccgcctacatcctgggaaaagacattcgctctgagatgagcaccatccggcagaacctgggggtctgtccccagcataacgtgctgtttgacatgctgactgtcgaagaacacatctggttctatgcccgcttgaaagggctctctgagaagcacgtgaaggcggagatggagcagatggccctggatgttggtttgccatcaagcaagctgaaaagcaaaacaagccagctgtcaggtggaatgcagagaaagctatctgtggccttggcctttgtcgggggatctaaggttgtcattctggatgaacccacagctggtgtggacccttactcccgcaggggaatatgggagctgctgctgaaataccgacaaggccgcaccattattctctctacacaccacatggatgaagcggacgtcctgggggacaggattgccatcatctcccatgggaagctgtgctgtgtgggctcctccctgtttctgaagaaccagctgggaacaggctactacctgaccttggtcaagaaagatgtggaatcctccctcagttcctgcagaaacagtagtagcactgtgtcatacctgaaaaaggaggacagtgtttctcagagcagttctgatgctggcctgggcagcgaccatgagagtgacacgctgaccatcgatgtctctgctatctccaacctcatcaggaagcatgtgtctgaagcccggctggtggaagacatagggcatgagctgacctatgtgctgccatatgaagctgctaaggagggagcctttgtggaactctttcatgagattgatgaccggctctcagacctgggcatttctagttatggcatctcagagacgaccctggaagaaatattcctcaaggtggccgaagagagtggggtggatgctgagacctcagatggtaccttgccagcaagacgaaacaggcgggccttcggggacaagcagagctgtcttcgcccgttcactgaagatgatgctgctgatccaaatgattctgacatagacccagaatccagagagacagacttgctcagtgggatggatggcaaagggtcctaccaggtgaaaggctggaaacttacacagcaacagtttgtggcccttttgtggaagagactgctaattgccagacggagtcggaaaggattttttgctcagattgtcttgccagctgtgtttgtctgcattgcccttgtgttcagcctgatcgtgccaccctttggcaagtaccccagcctggaacttcagccctggatgtacaacgaacagtacacatttgtcagcaatgatgctcctgaggacacgggaaccctggaactcttaaacgccctcaccaaagaccctggcttcgggacccgctgtatggaaggaaacccaatcccagacacgccctgccaggcaggggaggaagagtggaccactgccccagttccccagaccatcatggacctcttccagaatgggaactggacaatgcagaacccttcacctgcatgccagtgtagcagcgacaaaatcaagaagatgctgcctgtgtgtcccccaggggcaggggggctgcctcctccacaaagaaaacaaaacactgcagatatccttcaggacctgacaggaagaaacatttcggattatctggtgaagacgtatgtgcagatcatagccaaaagcttaaagaacaagatctgggtgaatgagtttaggtatggcggcttttccctgggtgtcagtaatactcaagcacttcctccgagtcaagaagttaatgatgccatcaaacaaatgaagaaacacctaaagctggccaaggacagttctgcagatcgatttctcaacagcttgggaagatttatgacaggactggacaccagaaataatgtcaaggtgtggttcaataacaagggctggcatgcaatcagctctttcctgaatgtcatcaacaatgccattctccgggccaacctgcaaaagggagagaaccctagccattatggaattactgctttcaatcatcccctgaatctcaccaagcagcagctctcagaggtggctctgatgaccacatcagtggatgtccttgtgtccatctgtgtcatctttgcaatgtccttcgtcccagccagctttgtcgtattcctgatccaggagcgggtcagcaaagcaaaacacctgcagttcatcagtggagtgaagcctgtcatctactggctctctaattttgtctgggatatgtgcaattacgttgtccctgccacactggtcattatcatcttcatctgcttccagcagaagtcctatgtgtcctccaccaatctgcctgtgctagcccttctacttttgctgtatgggtggtcaatcacacctctcatgtacccagcctcctttgtgttcaagatccccagcacagcctatgtggtgctcaccagcgtgaacctcttcattggcattaatggcagcgtggccacctttgtgctggagctgttcaccgacaataagctgaataatatcaatgatatcctgaagtccgtgttcttgatcttcccacatttttgcctgggacgagggctcatcgacatggtgaaaaaccaggcaatggctgatgccctggaaaggtttggggagaatcgctttgtgtcaccattatcttgggacttggtgggacgaaacctcttcgccatggccgtggaaggggtggtgttcttcctcattactgttctgatccagtacagattcttcatcaggcccagacctgtaaatgcaaagctatctcctctgaatgatgaagatgaagatgtgaggcgggaaagacagagaattcttgatggtggaggccagaatgacatcttagaaatcaaggagttgacgaagatatatagaaggaagcggaagcctgctgttgacaggatttgcgtgggcattcctcctggtgagtgctttgggctcctgggagttaatggggctggaaaatcatcaactttcaagatgttaacaggagataccactgttaccagaggagatgctttccttaacaaaaatagtatcttatcaaacatccatgaagtacatcagaacatgggctactgccctcagtttgatgccatcacagagctgttgactgggagagaacacgtggagttctttgcccttttgagaggagtcccagagaaagaagttggcaaggttggtgagtgggcgattcggaaactgggcctcgtgaagtatggagaaaaatatgctggtaactatagtggaggcaacaaacgcaagctctctacagccatggctttgatcggcgggcctcctgtggtgtttctggatgaacccaccacaggcatggatcccaaagcccggcggttcttgtggaattgtgccctaagtgttgtcaaggaggggagatcagtagtgcttacatctcatagtatggaagaatgtgaagctctttgcactaggatggcaatcatggtcaatggaaggttcaggtgccttggcagtgtccagcatctaaaaaataggtttggagatggttatacaatagttgtacgaatagcagggtccaacccggacctgaagcctgtccaggatttctttggacttgcatttcctggaagtgttctaaaagagaaacaccggaacatgctacaataccagcttccatcttcattatcttctctggccaggatattcagcatcctctcccagagcaaaaagcgactccacatagaagactactctgtttctcagacaacacttgaccaagtatttgtgaactttgccaaggaccaaagtgatgatgaccacttaaaagacctctcattacacaaaaaccagacagtagtggacgttgcagttctcacatcttttctacaggatgagaaagtgaaagaaagctatgtatgaagaatcctgttcatacggggtggctgaaagtaaagaggaactagactttcctttgcaccatgtgaagtgttgtggagaaaagagccagaagttgatgtgggaagaagtaaactggatactgtactgatactattcaatgcaatgcaattcaatgcaatgaaaacaaaattccattacaggggcagtgcctttgtagcctatgtcttgtatggctctcaagtgaaagacttgaatttagttttttacctatacctatgtgaaactctattatggaacccaatggacatatgggtttgaactcacactttttttttttttttgttcctgtgtattctcattggggttgcaacaataattcatcaagtaatcatggccagcgattattgatcaaaatcaaaaggtaatgcacatcctcattcactaagccatgccatgcccaggagactggtttcccggtgacacatccattgctggcaatgagtgtgccagagttattagtgccaagtttttcagaaagtttgaagcaccatggtgtgtcatgctcacttttgtgaaagctgctctgctcagagtctatcaacattgaatatcagttgacagaatggtgccatgcgtggctaacatcctgctttgattccctctgataagctgttctggtggcagtaacatgcaacaaaaatgtgggtgtctctaggcacgggaaacttggttccattgttatattgtcctatgcttcgagccatgggtctacagggtcatccttatgagactcttaaatatacttagatcctggtaagaggcaaagaatcaacagccaaactgctggggctgcaagctgctgaagccagggcatgggattaaagagattgtgcgttcaaacctagggaagcctgtgcccatttgtcctgactgtctgctaacatggtacactgcatctcaagatgtttatctgacacaagtgtattatttctggctttttgaattaatctagaaaatgaaaagatggagttgtattttgacaaaaatgtttgtactttttaatgttatttggaattttaagttctatcagtgacttctgaatccttagaatggcctctttgtagaaccctgtggtatagaggagtatggccactgccccactatttttattttcttatgtaagtttgcatatcagtcatgactagtgcctagaaagcaatgtgatggtcaggatctcatgacattatatttgagtttctttcagatcatttaggatactcttaatctcacttcatcaatcaaatattttttgagtgtatgctgtagctgaaagagtatgtacgtacgtataagactagagagatattaagtctcagtacacttcctgtgccatgttattcagctcactggtttacaaatataggttgtcttgtggttgtaggagcccactgtaacaatactgggcagcctttttttttttttttaaattgcaacaatgcaaaagccaagaaagtataagggtcacaagtctaaacaatgaattcttcaacagggaaaacagctagcttgaaaacttgctgaaaaacacaacttgtgtttatggcatttagtaccttcaaataattggctttgcagatattggataccccattaaatctgacagtctcaaatttttcatctcttcaatcactagtcaagaaaaatataaaaacaacaaatacttccatatggagcatttttcagagttttctaacccagtcttatttttctagtcagtaaacatttgtaaaaatactgtttcactaatacttactgttaactgtcttgagagaaaagaaaaatatgagagaactattgtttggggaagttcaagtgatctttcaatatcattactaacttcttccactttttccaaaatttgaatattaacgctaaaggtgtaagacttcagatttcaaattaatctttctatattttttaaatttacagaatattatataacccactgctgaaaaagaaaaaaatgattgttttagaagttaaagtcaatattgattttaaatataagtaatgaaggcatatttccaataactagtgatatggcatcgttgcattttacagtatcttcaaaaatacagaatttatagaataatttctcctcatttaatatttttcaaaatcaaagttatggtttcctcattttactaaaatcgtattctaattcttcattatagtaaatctatgagcaactccttacttcggttcctctgatttcaaggccatattttaaaaaatcaaaaggcactgtgaactattttgaagaaaacacaacattttaatacagattgaaaggacctcttctgaagctagaaacaatctatagttatacatcttcattaatactgtgttaccttttaaaatagtaattttttacattttcctgtgtaaacctaattgtggtagaaatttttaccaactctatactcaatcaagcaaaatttctgtatattccctgtggaatgtacctatgtgagtttcagaaattctcaaaatacgtgttcaaaaatttctgcttttgcatctttgggacacctcagaaaacttattaacaactgtgaatatgagaaatacagaagaaaataataagccctctatacataaatgcccagcacaattcattgttaaaaaacaaccaaacctcacactactgtatttcattatctgtactgaaagcaaatgctttgtgactattaaatgttgcacatcattcattcactgtatagtaatcattgactaaagccatttgtctgtgttttcttcttgtggttgtatatatcaggtaaaatattttccaaagagccatgtgtcatgtaatactgaaccactttgatattgagacattaatttgtacccttgttattatctactagtaataatgtaatactgtagaaatattgctctaattcttttcaaaattgttgcatcccccttagaatgtttctatttccataaggatttaggtatgctattatcccttcttataccctaagatgaagctgtttttgtgctctttgttcatcattggccctcattccaagcactttacgctgtctgtaatgggatctatttttgcactggaatatctgagaattgcaaaactagacaaaagtttcacaacagatttctaagttaaatcattttcattaaaaggaaaaaagaaaaaaaattttgtatgtcaataactttatatgaagtattaaaatgcatatttctatgttgtaatataatgagtcacaaaataaagctgtgacagttctgttggtctacaaaaaaaa

SEQ ID NO: 294940 - DNA, 1638 bp, Homo sapiens
  misc_feature (69)..(69): n is a, c, g, or t
agagcacaggctttgaccgatagtaacctctgcgctcggtgcagccgaatctataaaaggaactagtcncggcaaaaaccccgtaattgcgagcgagagtgagtggggccgggacccgcagagccgagccgacccttctctcccgggctgcggcagggcagggcggggagctccgcgcaccaacagagccggttctcagggcgctttgctccttgttttttccccggttctgttttctccccttctccggaaggcttgtcaaggggtaggagaaagagacgcaaacacaaaagtggaaaacagttaatgaccagccacggcgtccctgctgtgagctctggccgctgccttccagggctcccgagccacacgctgggggtgctggctgagggaacatggcttgttggcctcagctgaggttgctgctgtggaagaacctcactttcagaagaagacaaacatgtcagctgctgctggaagtggcctggcctctatttatcttcctgatcctgatctctgttcggctgagctacccaccctatgaacaacatgaatgccattttccaaataaagccatgccctctgcaggaacacttccttgggttcaggggattatctgtaatgccaacaacccctgtttccgttacccgactcctggggaggctcccggagttgttggaaactttaacaaatccattgtggctcgcctgttctcagatgctcggaggcttcttttatacagccagaaagacaccagcatgaaggacatgcgcaaagttctgagaacattacagcagatcaagaaatccagctcaaacttgaagcttcaagatttcctggtggacaatgaaaccttctctgggttcctgtatcacaacctctctctcccaaagtctactgtggacaagatgctgagggctgatgtcattctccacaaggtatttttgcaaggctaccagttacatttgacaagtctgtgcaatggatcaaaatcagaagagatgattcaacttggtgaccaagaagtttctgagctttgtggcctaccaagggagaaactggctgcagcagagcgagtacttcgttccaacatggacatcctgaagccaatcctgatggatgtggcatgtgatgacattgcacatgggcagttaactgtgccaagaagtgcagcagtagcagcaaccggagatgcaaagcccaacatgatggggagagaaactcttctttcaatatgtgcttctgtaccaaaagtggaatttcacgagagacatattttggaacatttttccttttgtgtgtgcgtgagtgtttccctgtttccagccaagggtattgtgagtttctcctgggcctccttcagaatctgggtgctctggaaagcagtgttttggcaacatggggaaagtatggcagtgtgggagggtcagctgggtctgggtttgaatattgcatttgaatattttaccagcattgatgtcggataaattatttagtccctgtaagcctcagttttctcttcttctacatacacataatatatttgactctttgttgtgattattggttacacatatgaagagcctggtgtggggcctggcacacaataggtgctcaataaataaaagttgataattt

SEQ ID NO: 294941 - DNA, 1834 bp, Homo sapiens
  misc_feature (69)..(69): n is a, c, g, or t
  misc_feature (1017)..(1017): n is a, c, g, or t
  misc_feature (1167)..(1167): n is a, c, g, or t
  misc_feature (1183)..(1183): n is a, c, g, or t
  misc_feature (1269)..(1269): n is a, c, g, or t
agagcacaggctttgaccgatagtaacctctgcgctcggtgcagccgaatctataaaaggaactagtcncggcaaaaaccccgtaattgcgagcgagagtgagtggggccgggacccgcagagccgagccgacccttctctcccgggctgcggcagggcagggcggggagctccgcgcaccaacagagccggttctcagggcgctttgctccttgttttttccccggttctgttttctccccttctccggaaggcttgtcaaggggtaggagaaagagacgcaaacacaaaagtggaaaacaggtaagaggctctccagtgacttacttgggcgttattgttttgtttcgaggccaaggaggcttcgggaagtgctcggtttcggggactttgatccggagccccacatccccaccacttgcaactcagatgggaccggaggcggtgttaaatggggagacgatgtcctagtacgagctctggtgaccccaggactctgcgctgctgcgcttggggcttgcccgacggtggagaccggggagcatctctgggcgtggagacccgggcgcagtaccccgggctcagaggggtcgggggttcccgggcgtgctgagggcgctgctgccgggtggggagagctgcaggtccggcaccgagcgctgctttgttcggagggccctgagctggctagaaacccttctggttgcaggtcggccagtacctacggagacaaatgccagcactgagtcttcactcggttcttaagaagctggtctgttctgacctgggaattggctatatgctccccgggactggagcggcacagtcccggactgtgaatccgggaactcgagttggaggtgtcccaaacggtccgtggtgctattgctcactagaggccttgggtctttgtttgacctgaggggtagggaggtcctgcctacagtctccgtgcgctcagctgagctggtgtccctggcgcagagcgcggacgagttttgtttccttttctttttnttttttttctttcctttaagtctcggtctgtcgcccaggctggagtgcaatggaacgatctccgctcactgcaacctccgcctcccgggttcaagcgattctcctgcctcagcctcctgagtagctgggattacaggcgcgtcaccacanccagctaatttttgtntttttagtagagacggggtttcaacttgttggccaggctggtctcgaaccctcgacctcaggtgatccaccggcctcggcctcccnaagtgctgggattataggcgtgagccaccgcgcgcggccgagttttgtttcttttaaaaacaagacttaggagagcctgcggagacccggaggtggggtgcccaatcctccctctcccacgttccctgcagccccatcttccagaccgttgctgctggtctctcggggcagcttctgcctgggcgcagatggggaagctgggccgagttggtgcagtggaatgaccgggagtaaccccggcgggcggcgcagaactcggagctccgccgcggggctgggctgggctctgccgtgagggtgggggtgctgggcgcgcgggctgcggtggccccccggagactggcccgcagcgcctcctagccggaggacctaggaatcggccggctctactaggtgtctttgctcgcggttccgactgtgaatccggtgaagaccggtggttgcagacggggaggaactatgaggctgaggcaggagaatcccttgaacctgggaggccgaggttgcagtgagccgggatcgcactaccgtactccagactgggcgacagagcgagactcctctc

SEQ ID NO: 294942 - DNA, 785 bp, Homo sapiens
gggaagtgaggcttgtagggaattggtagctgattcaaggtcacccagcaggtaaataacagtggtgggaccagacccaattaccaggtatgttttcctctgtaccgcagtacatgcctgagatttatttgtgtgttgaagccagtggtacctaatgtatttacatcccaacctgaaactcctatccacttatttaccttttaatgagcctcttaactcaagtgcagtctgaggaccagcagcatcaggatcacttgggaacttgttagaaattcagcaacctgggcacagctcagacctaccgaatcagaatctgtgcattttaacaagattcttgagtggttgaacacacattaaagcatgagaagcattgaactagacatgtagccaggtaaaggccttgcctgagatggttggcaaaggcctcattgcagcattcattggcaggccacagttcttttggcagctctgcttcctgacctctcaccctcaggaagcgaggctgttcacacggcacacacatgccagacagggtcctctgaagccacggctgccagtgcatgtgtcccagggaaagctttttcctttagttctcacacaacagagcttcttggaagccctccccggcgaaggtgctggtggctctgccttgctccgtccctgacccgttctcacctccttctttgccaccaggaggacagtgtttctcagagcagttctgatgctggtggcgctgactcaaggtttgctgctgggctggggctgggtggatggggtgtgggagc

SEQ ID NO: 294943 - DNA, 1035 bp, Homo sapiens
  misc_feature (69)..(69): n is a, c, g, or t
agagcacaggctttgaccgatagtaacctctgcgctcggtgcagccgaatctataaaaggaactagtcncggcaaaaaccccgtaattgcgagcgagagtgagtggggccgggacccgcagagccgagccgacccttctctcccgggctgcggcagggcagggcggggagctccgcgcaccaacagagccggttctcagggcgctttgctccttgttttttccccggttctgttttctccccttctccggaaggcttgtcaaggggtaggagaaagagacgcaaacacaaaagtggaaaacagtgtcagctgctgctggaagtggcctggcctctatttatcttcctgatcctgatctctgttcggctgagctacccaccctatgaacaacatgaatgccattttccaaataaagccatgccctctgcaggaacacttccttgggttcaggggattatctgtaatgccaacaacccctgtttccgttacccgactcctggggaggctcccggagttgttggaaactttaacaaatccattgtggctcgcctgttctcagatgctcggaggcttcttttatacagccagaaagacaccagcatgaaggacatgcgcaaagttctgagaacattacagcagatcaagaaatccagctcaaacttgaagcttcaagatttcctggtggacaatgaaaccttctctgggttcctgtatcacaacctctctctcccaaagtctactgtggacaagatgctgagggctgatgtcattctccacaaggtaagctgatgcctccagcttcctcagtagggctgatggcaattacgttgtgcagctactggaaagaaatgaataaacccttgtccttgtaatggtggtgaaggggagggaggtagtttgaatacaacttcacttaattttacttccctattcaggcaggaattgccaaaccatccaggagtggaatatgcaacctggcgtcatgggccagctggttaaaataaaattgatttctggcttatcacttggcatttg

SEQ ID NO: 294944 - DNA, 576 bp, Homo sapiens
  misc_feature (17)..(17): n is a, c, g, or t
  misc_feature (39)..(39): n is a, c, g, or t
ggtgcagccgggggganaattttttcaaaaaggaaatcnggaaccaatcctggatggatgtggcatgtgatgacattgcacatgggcagttaactgtgccaagaagtgcagcagtagcagcaaccggagatgcaaagcccaacatgatggggagagaaactcttctttcaatatgtgcttctgtaccaaaagtggaatttcacgagagacatattttggaacatttttccttttgtgtgtgcgtgagtgtttccctgtttccagccaagggtattgtgagtttctcctgggcctccttcagaatctgggtgctctggaaagcagtgttttggcaacatggggaaagtatggcagtgtgggagggtcagctgggtctgggtttgaatattgcatttgaatattttaccagcattgatgtcggataaattatttagtccctgtaagcctcagttttctcttcttctacatacacataatatatttgactctttgttgtgattattggttacacatatgaagagcctggtgtggggcctggcacacaataggtgctcaataaataaaagttgataattt

SEQ ID NO: 294945 - DNA, 9934 bp, Homo sapiens
  misc_feature (69)..(69): n is a, c, g, or t
  misc_feature (1160)..(1160): n is a, c, g, or t
agagcacaggctttgaccgatagtaacctctgcgctcggtgcagccgaatctataaaaggaactagtcncggcaaaaaccccgtaattgcgagcgagagtgagtggggccgggacccgcagagccgagccgacccttctctcccgggctgcggcagggcagggcggggagctccgcgcaccaacagagccggttctcagggcgctttgctccttgttttttccccggttctgttttctccccttctccggaaggcttgtcaaggggtaggagaaagagacgcaaacacaaaagtggaaaacagttaatgaccagccacggcgtccctgctgtgagctctggccgctgccttccagggctcccgagccacacgctgggggtgctggctgagggaacatggcttgttggcctcagctgaggttgctgctgtggaagaacctcactttcagaagaagacaaacatgtcagctgctgctggaagtggcctggcctctatttatcttcctgatcctgatctctgttcggctgagctacccaccctatgaacaacatgaatgccattttccaaataaagccatgccctctgcaggaacacttccttgggttcaggggattatctgtaatgccaacaacccctgtttccgttacccgactcctggggaggctcccggagttgttggaaactttaacaaatccattgtggctcgcctgttctcagatgctcggaggcttcttttatacagccagaaagacaccagcatgaaggacatgcgcaaagttctgagaacattacagcagatcaagaaatccagctcaaacttgaagcttcaagatttcctggtggacaatgaaaccttctctgggttcctgtatcacaacctctctctcccaaagtctactgtggacaagatgctgagggctgatgtcattctccacaaggtatttttgcaaggctaccagttacatttgacaagtctgtgcaatggatcaaaatcagaagagatgattcaacttggtgaccaagaagtttctgagctttgtggcctaccaagggagaaactggctgcagcagagcgagtacttcgttccaacatggacatcctgaagccaatcctgagaacactaaactctacatctcccttcccgagcaaggagctggcngaagccacaaaaacattgctgcatagtcttgggactctggcccaggagctgttcagcatgagaagctggagtgacatgcgacaggaggtgatgtttctgaccaatgtgaacagctccagctcctccacccaaatctaccaggctgtgtctcgtattgtctgcgggcatcccgagggaggggggctgaagatcaagtctctcaactggtatgaggacaacaactacaaagccctctttggaggcaatggcactgaggaagatgctgaaaccttctatgacaactctacaactccttactgcaatgatttgatgaagaatttggagtctagtcctctttcccgcattatctggaaagctctgaagccgctgctcgttgggaagatcctgtatacacctgacactccagccacaaggcaggtcatggctgaggtgaacaagaccttccaggaactggctgtgttccatgatctggaaggcatgtgggaggaactcagccccaagatctggaccttcatggagaacagccaagaaatggaccttgtccggatgctgttggacagcagggacaatgaccacttttgggaacagcagttggatggcttagattggacagcccaagacatcgtggcgtttttggccaagcacccagaggatgtccagtccagtaatggttctgtgtacacctggagagaagctttcaacgagactaaccaggcaatccggaccatatctcgcttcatggagtgtgtcaacctgaacaagctagaacccatagcaacagaagtctggctcatcaacaagtccatggagctgctggatgagaggaagttctgggctggtattgtgttcactggaattactccaggcagcattgagctgccccatcatgtcaagtacaagatccgaatggacattgacaatgtggagaggacaaataaaatcaaggatgggtactgggaccctggtcctcgagctgacccctttgaggacatgcggtacgtctgggggggcttcgcctacttgcaggatgtggtggagcaggcaatcatcagggtgctgacgggcaccgagaagaaaactggtgtctatatgcaacagatgccctatccctgttacgttgatgacatctttctgcgggtgatgagccggtcaatgcccctcttcatgacgctggcctggatttactcagtggctgtgatcatcaagggcatcgtgtatgagaaggaggcacggctgaaagagaccatgcggatcatgggcctggacaacagcatcctctggtttagctggttcattagtagcctcattcctcttcttgtgagcgctggcctgctagtggtcatcctgaagttaggaaacctgctgccctacagtgatcccagcgtggtgtttgtcttcctgtccgtgtttgctgtggtgacaatcctgcagtgcttcctgattagcacactcttctccagagccaacctggcagcagcctgtgggggcatcatctacttcacgctgtacctgccctacgtcctgtgtgtggcatggcaggactacgtgggcttcacactcaagatcttcgctagcctgctgtctcctgtggcttttgggtttggctgtgagtactttgccctttttgaggagcagggcattggagtgcagtgggacaacctgtttgagagtcctgtggaggaagatggcttcaatctcaccacttcggtctccatgatgctgtttgacaccttcctctatggggtgatgacctggtacattgaggctgtctttccaggccagtacggaattcccaggccctggtattttccttgcaccaagtcctactggtttggcgaggaaagtgatgagaagagccaccctggttccaaccagaagagaatatcagaaatctgcatggaggaggaacccacccacttgaagctgggcgtgtccattcagaacctggtaaaagtctaccgagatgggatgaaggtggctgtcgatggcctggcactgaatttttatgagggccagatcacctccttcctgggccacaatggagcggggaagacgaccaccatgtcaatcctgaccgggttgttccccccgacctcgggcaccgcctacatcctgggaaaagacattcgctctgagatgagcaccatccggcagaacctgggggtctgtccccagcataacgtgctgtttgacatgctgactgtcgaagaacacatctggttctatgcccgcttgaaagggctctctgagaagcacgtgaaggcggagatggagcagatggccctggatgttggtttgccatcaagcaagctgaaaagcaaaacaagccagctgtcaggtggaatgcagagaaagctatctgtggccttggcctttgtcgggggatctaaggttgtcattctggatgaacccacagctggtgtggacccttactcccgcaggggaatatgggagctgctgctgaaataccgacaaggccgcaccattattctctctacacaccacatggatgaagcggacgtcctgggggacaggattgccatcatctcccatgggaagctgtgctgtgtgggctcctccctgtttctgaagaaccagctgggaacaggctactacctgaccttggtcaagaaagatgtggaatcctccctcagttcctgcagaaacagtagtagcactgtgtcatacctgaaaaaggaggacagtgtttctcagagcagttctgatgctggcctgggcagcgaccatgagagtgacacgctgaccatcgatgtctctgctatctccaacctcatcaggaagcatgtgtctgaagcccggctggtggaagacatagggcatgagctgacctatgtgctgccatatgaagctgctaaggagggagcctttgtggaactctttcatgagattgatgaccggctctcagacctgggcatttctagttatggcatctcagagacgaccctggaagaaatattcctcaaggtggccgaagagagtggggtggatgctgagacctcagatggtaccttgccagcaagacgaaacaggcgggccttcggggacaagcagagctgtcttcgcccgttcactgaagatgatgctgctgatccaaatgattctgacatagacccagaatccagagagacagacttgctcagtgggatggatggcaaagggtcctaccaggtgaaaggctggaaacttacacagcaacagtttgtggcccttttgtggaagagactgctaattgccagacggagtcggaaaggattttttgctcagattgtcttgccagctgtgtttgtctgcattgcccttgtgttcagcctgatcgtgccaccctttggcaagtaccccagcctggaacttcagccctggatgtacaacgaacagtacacatttgtcagcaatgatgctcctgaggacacgggaaccctggaactcttaaacgccctcaccaaagaccctggcttcgggacccgctgtatggaaggaaacccaatcccagacacgccctgccaggcaggggaggaagagtggaccactgccccagttccccagaccatcatggacctcttccagaatgggaactggacaatgcagaacccttcacctgcatgccagtgtagcagcgacaaaatcaagaagatgctgcctgtgtgtcccccaggggcaggggggctgcctcctccacaaagaaaacaaaacactgcagatatccttcaggacctgacaggaagaaacatttcggattatctggtgaagacgtatgtgcagatcatagccaaaagcttaaagaacaagatctgggtgaatgagtttaggtatggcggcttttccctgggtgtcagtaatactcaagcacttcctccgagtcaagaagttaatgatgccatcaaacaaatgaagaaacacctaaagctggccaaggacagttctgcagatcgatttctcaacagcttgggaagatttatgacaggactggacaccagaaataatgtcaaggtgtggttcaataacaagggctggcatgcaatcagctctttcctgaatgtcatcaacaatgccattctccgggccaacctgcaaaagggagagaaccctagccattatggaattactgctttcaatcatcccctgaatctcaccaagcagcagctctcagaggtggctctgatgaccacatcagtggatgtccttgtgtccatctgtgtcatctttgcaatgtccttcgtcccagccagctttgtcgtattcctgatccaggagcgggtcagcaaagcaaaacacctgcagttcatcagtggagtgaagcctgtcatctactggctctctaattttgtctgggatatgtgcaattacgttgtccctgccacactggtcattatcatcttcatctgcttccagcagaagtcctatgtgtcctccaccaatctgcctgtgctagcccttctacttttgctgtatgggtggtcaatcacacctctcatgtacccagcctcctttgtgttcaagatccccagcacagcctatgtggtgctcaccagcgtgaacctcttcattggcattaatggcagcgtggccacctttgtgctggagctgttcaccgacaataagctgaataatatcaatgatatcctgaagtccgtgttcttgatcttcccacatttttgcctgggacgagggctcatcgacatggtgaaaaaccaggcaatggctgatgccctggaaaggtttggggagaatcgctttgtgtcaccattatcttgggacttggtgggacgaaacctcttcgccatggccgtggaaggggtggtgttcttcctcattactgttctgatccagtacagattcttcatcaggcccagacctgtaaatgcaaagctatctcctctgaatgatgaagatgaagatgtgaggcgggaaagacagagaattcttgatggtggaggccagaatgacatcttagaaatcaaggagttgacgaagatatatagaaggaagcggaagcctgctgttgacaggatttgcgtgggcattcctcctggtgagtgctttgggctcctgggagttaatggggctggaaaatcatcaactttcaagatgttaacaggagataccactgttaccagaggagatgctttccttaacaaaaatagtatcttatcaaacatccatgaagtacatcagaacatgggctactgccctcagtttgatgccatcacagagctgttgactgggagagaacacgtggagttctttgcccttttgagaggagtcccagagaaagaagttggcaaggttggtgagtgggcgattcggaaactgggcctcgtgaagtatggagaaaaatatgctggtaactatagtggaggcaacaaacgcaagctctctacagccatggctttgatcggcgggcctcctgtggtgtttctggatgaacccaccacaggcatggatcccaaagcccggcggttcttgtggaattgtgccctaagtgttgtcaaggaggggagatcagtagtgcttacatctcatagtatggaagaatgtgaagctctttgcactaggatggcaatcatggtcaatggaaggttcaggtgccttggcagtgtccagcatctaaaaaataggtttggagatggttatacaatagttgtacgaatagcagggtccaacccggacctgaagcctgtccaggatttctttggacttgcatttcctggaagtgttctaaaagagaaacaccggaacatgctacaataccagcttccatcttcattatcttctctggccaggatattcagcatcctctcccagagcaaaaagcgactccacatagaagactactctgtttctcagacaacacttgaccaagtatttgtgaactttgccaaggaccaaagtgatgatgaccacttaaaagacctctcattacacaaaaaccagacagtagtggacgttgcagttctcacatcttttctacaggatgagaaagtgaaagaaagctatgtatgaagaatcctgttcatacggggtggctgaaagtaaagaggaactagactttcctttgcaccatgtgaagtgttgtggagaaaagagccagaagttgatgtgggaagaagtaaactggatactgtactgatactattcaatgcaatgcaattcaatgcaatgaaaacaaaattccattacaggggcagtgcctttgtagcctatgtcttgtatggctctcaagtgaaagacttgaatttagttttttacctatacctatgtgaaactctattatggaacccaatggacatatgggtttgaactcacactttttttttttttttgttcctgtgtattctcattggggttgcaacaataattcatcaagtaatcatggccagcgattattgatcaaaatcaaaaggtaatgcacatcctcattcactaagccatgccatgcccaggagactggtttcccggtgacacatccattgctggcaatgagtgtgccagagttattagtgccaagtttttcagaaagtttgaagcaccatggtgtgtcatgctcacttttgtgaaagctgctctgctcagagtctatcaacattgaatatcagttgacagaatggtgccatgcgtggctaacatcctgctttgattccctctgataagctgttctggtggcagtaacatgcaacaaaaatgtgggtgtctctaggcacgggaaacttggttccattgttatattgtcctatgcttcgagccatgggtctacagggtcatccttatgagactcttaaatatacttagatcctggtaagaggcaaagaatcaacagccaaactgctggggctgcaagctgctgaagccagggcatgggattaaagagattgtgcgttcaaacctagggaagcctgtgcccatttgtcctgactgtctgctaacatggtacactgcatctcaagatgtttatctgacacaagtgtattatttctggctttttgaattaatctagaaaatgaaaagatggagttgtattttgacaaaaatgtttgtactttttaatgttatttggaattttaagttctatcagtgacttctgaatccttagaatggcctctttgtagaaccctgtggtatagaggagtatggccactgccccactatttttattttcttatgtaagtttgcatatcagtcatgactagtgcctagaaagcaatgtgatggtcaggatctcatgacattatatttgagtttctttcagatcatttaggatactcttaatctcacttcatcaatcaaatattttttgagtgtatgctgtagctgaaagagtatgtacgtacgtataagactagagagatattaagtctcagtacacttcctgtgccatgttattcagctcactggtttacaaatataggttgtcttgtggttgtaggagcccactgtaacaatactgggcagcctttttttttttttttaaattgcaacaatgcaaaagccaagaaagtataagggtcacaagtctaaacaatgaattcttcaacagggaaaacagctagcttgaaaacttgctgaaaaacacaacttgtgtttatggcatttagtaccttcaaataattggctttgcagatattggataccccattaaatctgacagtctcaaatttttcatctcttcaatcactagtcaagaaaaatataaaaacaacaaatacttccatatggagcatttttcagagttttctaacccagtcttatttttctagtcagtaaacatttgtaaaaatactgtttcactaatacttactgttaactgtcttgagagaaaagaaaaatatgagagaactattgtttggggaagttcaagtgatctttcaatatcattactaacttcttccactttttccaaaatttgaatattaacgctaaaggtgtaagacttcagatttcaaattaatctttctatattttttaaatttacagaatattatataacccactgctgaaaaagaaaaaaatgattgttttagaagttaaagtcaatattgattttaaatataagtaatgaaggcatatttccaataactagtgatatggcatcgttgcattttacagtatcttcaaaaatacagaatttatagaataatttctcctcatttaatatttttcaaaatcaaagttatggtttcctcattttactaaaatcgtattctaattcttcattatagtaaatctatgagcaactccttacttcggttcctctgatttcaaggccatattttaaaaaatcaaaaggcactgtgaactattttgaagaaaacacaacattttaatacagattgaaaggacctcttctgaagctagaaacaatctatagttatacatcttcattaatactgtgttaccttttaaaatagtaattttttacattttcctgtgtaaacctaattgtggtagaaatttttaccaactctatactcaatcaagcaaaatttctgtatattccctgtggaatgtacctatgtgagtttcagaaattctcaaaatacgtgttcaaaaatttctgcttttgcatctttgggacacctcagaaaacttattaacaactgtgaatatgagaaatacagaagaaaataataagccctctatacataaatgcccagcacaattcattgttaaaaaacaaccaaacctcacactactgtatttcattatctgtactgaaagcaaatgctttgtgactattaaatgttgcacatcattcattc

SEQ ID NO: 294946 - DNA, 8640 bp, Homo sapiens
  misc_feature (69)..(69): n is a, c, g, or t
  misc_feature (1160)..(1160): n is a, c, g, or t
agagcacaggctttgaccgatagtaacctctgcgctcggtgcagccgaatctataaaaggaactagtcncggcaaaaaccccgtaattgcgagcgagagtgagtggggccgggacccgcagagccgagccgacccttctctcccgggctgcggcagggcagggcggggagctccgcgcaccaacagagccggttctcagggcgctttgctccttgttttttccccggttctgttttctccccttctccggaaggcttgtcaaggggtaggagaaagagacgcaaacacaaaagtggaaaacagttaatgaccagccacggcgtccctgctgtgagctctggccgctgccttccagggctcccgagccacacgctgggggtgctggctgagggaacatggcttgttggcctcagctgaggttgctgctgtggaagaacctcactttcagaagaagacaaacatgtcagctgctgctggaagtggcctggcctctatttatcttcctgatcctgatctctgttcggctgagctacccaccctatgaacaacatgaatgccattttccaaataaagccatgccctctgcaggaacacttccttgggttcaggggattatctgtaatgccaacaacccctgtttccgttacccgactcctggggaggctcccggagttgttggaaactttaacaaatccattgtggctcgcctgttctcagatgctcggaggcttcttttatacagccagaaagacaccagcatgaaggacatgcgcaaagttctgagaacattacagcagatcaagaaatccagctcaaacttgaagcttcaagatttcctggtggacaatgaaaccttctctgggttcctgtatcacaacctctctctcccaaagtctactgtggacaagatgctgagggctgatgtcattctccacaaggtatttttgcaaggctaccagttacatttgacaagtctgtgcaatggatcaaaatcagaagagatgattcaacttggtgaccaagaagtttctgagctttgtggcctaccaagggagaaactggctgcagcagagcgagtacttcgttccaacatggacatcctgaagccaatcctgagaacactaaactctacatctcccttcccgagcaaggagctggcngaagccacaaaaacattgctgcatagtcttgggactctggcccaggagctgttcagcatgagaagctggagtgacatgcgacaggaggtgatgtttctgaccaatgtgaacagctccagctcctccacccaaatctaccaggctgtgtctcgtattgtctgcgggcatcccgagggaggggggctgaagatcaagtctctcaactggtatgaggacaacaactacaaagccctctttggaggcaatggcactgaggaagatgctgaaaccttctatgacaactctacaactccttactgcaatgatttgatgaagaatttggagtctagtcctctttcccgcattatctggaaagctctgaagccgctgctcgttgggaagatcctgtatacacctgacactccagccacaaggcaggtcatggctgaggtgaacaagaccttccaggaactggctgtgttccatgatctggaaggcatgtgggaggaactcagccccaagatctggaccttcatggagaacagccaagaaatggaccttgtccggatgctgttggacagcagggacaatgaccacttttgggaacagcagttggatggcttagattggacagcccaagacatcgtggcgtttttggccaagcacccagaggatgtccagtccagtaatggttctgtgtacacctggagagaagctttcaacgagactaaccaggcaatccggaccatatctcgcttcatggagtgtgtcaacctgaacaagctagaacccatagcaacagaagtctggctcatcaacaagtccatggagctgctggatgagaggaagttctgggctggtattgtgttcactggaattactccaggcagcattgagctgccccatcatgtcaagtacaagatccgaatggacattgacaatgtggagaggacaaataaaatcaaggatgggtactgggaccctggtcctcgagctgacccctttgaggacatgcggtacgtctgggggggcttcgcctacttgcaggatgtggtggagcaggcaatcatcagggtgctgacgggcaccgagaagaaaactggtgtctatatgcaacagatgccctatccctgttacgttgatgacatctttctgcgggtgatgagccggtcaatgcccctcttcatgacgctggcctggatttactcagtggctgtgatcatcaagggcatcgtgtatgagaaggaggcacggctgaaagagaccatgcggatcatgggcctggacaacagcatcctctggtttagctggttcattagtagcctcattcctcttcttgtgagcgctggcctgctagtggtcatcctgaagttaggaaacctgctgccctacagtgatcccagcgtggtgtttgtcttcctgtccgtgtttgctgtggtgacaatcctgcagtgcttcctgattagcacactcttctccagagccaacctggcagcagcctgtgggggcatcatctacttcacgctgtacctgccctacgtcctgtgtgtggcatggcaggactacgtgggcttcacactcaagatcttcgctagcctgctgtctcctgtggcttttgggtttggctgtgagtactttgccctttttgaggagcagggcattggagtgcagtgggacaacctgtttgagagtcctgtggaggaagatggcttcaatctcaccacttcggtctccatgatgctgtttgacaccttcctctatggggtgatgacctggtacattgaggctgtctttccaggccagtacggaattcccaggccctggtattttccttgcaccaagtcctactggtttggcgaggaaagtgatgagaagagccaccctggttccaaccagaagagaatatcagaaatctgcatggaggaggaacccacccacttgaagctgggcgtgtccattcagaacctggtaaaagtctaccgagatgggatgaaggtggctgtcgatggcctggcactgaatttttatgagggccagatcacctccttcctgggccacaatggagcggggaagacgaccaccatgtcaatcctgaccgggttgttccccccgacctcgggcaccgcctacatcctgggaaaagacattcgctctgagatgagcaccatccggcagaacctgggggtctgtccccagcataacgtgctgtttgacatgctgactgtcgaagaacacatctggttctatgcccgcttgaaagggctctctgagaagcacgtgaaggcggagatggagcagatggccctggatgttggtttgccatcaagcaagctgaaaagcaaaacaagccagctgtcaggtggaatgcagagaaagctatctgtggccttggcctttgtcgggggatctaaggttgtcattctggatgaacccacagctggtgtggacccttactcccgcaggggaatatgggagctgctgctgaaataccgacaaggccgcaccattattctctctacacaccacatggatgaagcggacgtcctgggggacaggattgccatcatctcccatgggaagctgtgctgtgtgggctcctccctgtttctgaagaaccagctgggaacaggctactacctgaccttggtcaagaaagatgtggaatcctccctcagttcctgcagaaacagtagtagcactgtgtcatacctgaaaaaggaggacagtgtttctcagagcagttctgatgctggcctgggcagcgaccatgagagtgacacgctgaccatcgatgtctctgctatctccaacctcatcaggaagcatgtgtctgaagcccggctggtggaagacatagggcatgagctgacctatgtgctgccatatgaagctgctaaggagggagcctttgtggaactctttcatgagattgatgaccggctctcagacctgggcatttctagttatggcatctcagagacgaccctggaagaaatattcctcaaggtggccgaagagagtggggtggatgctgagacctcagatggtaccttgccagcaagacgaaacaggcgggccttcggggacaagcagagctgtcttcgcccgttcactgaagatgatgctgctgatccaaatgattctgacatagacccagaatccagagagacagacttgctcagtgggatggatggcaaagggtcctaccaggtgaaaggctggaaacttacacagcaacagtttgtggcccttttgtggaagagactgctaattgccagacggagtcggaaaggattttttgctcagattgtcttgccagctgtgtttgtctgcattgcccttgtgttcagcctgatcgtgccaccctttggcaagtaccccagcctggaacttcagccctggatgtacaacgaacagtacacatttgtcagcaatgatgctcctgaggacacgggaaccctggaactcttaaacgccctcaccaaagaccctggcttcgggacccgctgtatggaaggaaacccaatcccagacacgccctgccaggcaggggaggaagagtggaccactgccccagttccccagaccatcatggacctcttccagaatgggaactggacaatgcagaacccttcacctgcatgccagtgtagcagcgacaaaatcaagaagatgctgcctgtgtgtcccccaggggcaggggggctgcctcctccacaaagaaaacaaaacactgcagatatccttcaggacctgacaggaagaaacatttcggattatctggtgaagacgtatgtgcagatcatagccaaaagcttaaagaacaagatctgggtgaatgagtttaggtatggcggcttttccctgggtgtcagtaatactcaagcacttcctccgagtcaagaagttaatgatgccatcaaacaaatgaagaaacacctaaagctggccaaggacagttctgcagatcgatttctcaacagcttgggaagatttatgacaggactggacaccagaaataatgtcaaggtgtggttcaataacaagggctggcatgcaatcagctctttcctgaatgtcatcaacaatgccattctccgggccaacctgcaaaagggagagaaccctagccattatggaattactgctttcaatcatcccctgaatctcaccaagcagcagctctcagaggtggctctgatgaccacatcagtggatgtccttgtgtccatctgtgtcatctttgcaatgtccttcgtcccagccagctttgtcgtattcctgatccaggagcgggtcagcaaagcaaaacacctgcagttcatcagtggagtgaagcctgtcatctactggctctctaattttgtctgggatatgtgcaattacgttgtccctgccacactggtcattatcatcttcatctgcttccagcagaagtcctatgtgtcctccaccaatctgcctgtgctagcccttctacttttgctgtatgggtggtcaatcacacctctcatgtacccagcctcctttgtgttcaagatccccagcacagcctatgtggtgctcaccagcgtgaacctcttcattggcattaatggcagcgtggccacctttgtgctggagctgttcaccgacaataagctgaataatatcaatgatatcctgaagtccgtgttcttgatcttcccacatttttgcctgggacgagggctcatcgacatggtgaaaaaccaggcaatggctgatgccctggaaaggtttggggagaatcgctttgtgtcaccattatcttgggacttggtgggacgaaacctcttcgccatggccgtggaaggggtggtgttcttcctcattactgttctgatccagtacagattcttcatcaggcccagacctgtaaatgcaaagctatctcctctgaatgatgaagatgaagatgtgaggcgggaaagacagagaattcttgatggtggaggccagaatgacatcttagaaatcaaggagttgacgaagatatatagaaggaagcggaagcctgctgttgacaggatttgcgtgggcattcctcctggtgagtgctttgggctcctgggagttaatggggctggaaaatcatcaactttcaagatgttaacaggagataccactgttaccagaggagatgctttccttaacaaaaatagtatcttatcaaacatccatgaagtacatcagaacatgggctactgccctcagtttgatgccatcacagagctgttgactgggagagaacacgtggagttctttgcccttttgagaggagtcccagagaaagaagttggcaaggttggtgagtgggcgattcggaaactgggcctcgtgaagtatggagaaaaatatgctggtaactatagtggaggcaacaaacgcaagctctctacagccatggctttgatcggcgggcctcctgtggtgtttctggatgaacccaccacaggcatggatcccaaagcccggcggttcttgtggaattgtgccctaagtgttgtcaaggaggggagatcagtagtgcttacatctcatagtatggaagaatgtgaagctctttgcactaggatggcaatcatggtcaatggaaggttcaggtgccttggcagtgtccagcatctaaaaaataggtttggagatggttatacaatagttgtacgaatagcagggtccaacccggacctgaagcctgtccaggatttctttggacttgcatttcctggaagtgttctaaaagagaaacaccggaacatgctacaataccagcttccatcttcattatcttctctggccaggatattcagcatcctctcccagagcaaaaagcgactccacatagaagactactctgtttctcagacaacacttgaccaagtatttgtgaactttgccaaggaccaaagtgatgatgaccacttaaaagacctctcattacacaaaaaccagacagtagtggacgttgcagttctcacatcttttctacaggatgagaaagtgaaagaaagctatgtatgaagaatcctgttcatacggggtggctgaaagtaaagaggaactagactttcctttgcaccatgtgaagtgttgtggagaaaagagccagaagttgatgtgggaagaagtaaactggatactgtactgatactattcaatgcaatgcaattcaatgcaatgaaaacaaaattccattacaggggcagtgcctttgtagcctatgtcttgtatggctctcaagtgaaagacttgaatttagttttttacctatacctatgtgaaactctattatggaacccaatggacatatgggtttgaactcacactttttttttttttttgttcctgtgtattctcattggggttgcaacaataattcatcaagtaatcatggccagcgattattgatcaaaatcaaaaggtaatgcacatcctcattcactaagccatgccatgcccaggagactggtttcccggtgacacatccattgctggcaatgagtgtgccagagttattagtgccaagtttttcagaaagtttgaagcaccatggtgtgtcatgctcacttttgtgaaagctgctctgctcagagtctatcaacattgaatatcagttgacagaatggtgccatgcgtggctaacatcctgctttgattccctctgataagctgttctggtggcagtaacatgcaacaaaaatgtgggtgtctctaggcacgggaaacttggttccattgttatattgtcctatgcttcgagccatgggtctacagggtcatccttatgagactcttaaatatacttagatcctggtaagaggcaaagaatcaacagccaaactgctggggctgcaagctgctgaagccagggcatgggattaaagagattgtgcgttcaaacctagggaagcctgtgcccatttgtcctgactgtctgctaacatggtacactgcatctcaagatgtttatctgacacaagtgtattatttctggctttttgaattaatctagaaaatgaaaagatggagttgtattttgacaaaaatgtttgtactttttaatgttatttggaattttaagttctatcagtgacttctgaatccttagaatggcctctttgtagaaccctgtggtatagaggagtatggccactgccccactatttttattttcttatgtaagtttgcatatcagtcatgactagtgcctagaaagcaatgtgatggtcaggatctcatgacattatatttgagtttctttcagatcatttaggatactcttaatctcacttcatcaatcaaatattttttgagtgtatgctgtagctgaaagagtatgtacgtacgtataagactagagagatattaagtctcagtacacttcctgtgccatgttattcagctcactggtttacaaatataggttgtcttgtgacccttatactttcttggcttttgcattgttgcaattaaaaaaaaa

SEQ ID NO: 294947 - DNA, 9966 bp, Homo sapiens
ctcccaaagtactgggattacaggtgtgagccactgcacccggcccagactcgagtttttcatcttaatgctttttcattgcctgacactttactgagaccaagatagggaacttcacatacagtaccttttctcccaaggcggaagagggctgttcaatttctacactagagttcggggagttttagaaatgagtcagttatcgaggatgagagcagttcctgataggctcaaccacaatgagatgtagctgttcagagaaagcattcttttatctataaactggaagataatcccggtgaaacgaagcccagccccaggggcttcactaactccaggctgtgcttctcaaactttagtgagcataggaatcacctgggcatcttgtgaagctgtagatttgaattctgcaggtcggcagaggggtctcagaatccgcatttccaacaatgtctccagtaatgctgatgctgctcgtccctggaccacagattgggtagccaggttctggcaagctcatcccaaggctttgagatgacatcagacaaaatatgttctgggacatggcttttgagaggtcaagaaaataagatgtttctttctcttctcatccccaacccttgcactgcccttttctcccttcccctaccctcctttctgtccccatccctgacgccagctgttcagcatgagaagctggagtgacatgcgacaggaggtgatgtttctgaccaatgtgaacagctccagctcctccacccaaatctaccaggctgtgtctcgtattgtctgcgggcatcccgagggaggggggctgaagatcaagtctctcaactggtatgaggacaacaactacaaagccctctttggaggcaatggcactgaggaagatgctgaaaccttctatgacaactctacaactccttactgcaatgatttgatgaagaatttggagtctagtcctctttcccgcattatctggaaagctctgaagccgctgctcgttgggaagatcctgtatacacctgacactccagccacaaggcaggtcatggctgaggtgaacaagaccttccaggaactggctgtgttccatgatctggaaggcatgtgggaggaactcagccccaagatctggaccttcatggagaacagccaagaaatggaccttgtccggatgctgttggacagcagggacaatgaccacttttgggaacagcagttggatggcttagattggacagcccaagacatcgtggcgtttttggccaagcacccagaggatgtccagtccagtaatggttctgtgtacacctggagagaagctttcaacgagactaaccaggcaatccggaccatatctcgcttcatggagtgtgtcaacctgaacaagctagaacccatagcaacagaagtctggctcatcaacaagtccatggagctgctggatgagaggaagttctgggctggtattgtgttcactggaattactccaggcagcattgagctgccccatcatgtcaagtacaagatccgaatggacattgacaatgtggagaggacaaataaaatcaaggatgggtactgggaccctggtcctcgagctgacccctttgaggacatgcggtacgtctgggggggcttcgcctacttgcaggatgtggtggagcaggcaatcatcagggtgctgacgggcaccgagaagaaaactggtgtctatatgcaacagatgccctatccctgttacgttgatgacatctttctgcgggtgatgagccggtcaatgcccctcttcatgacgctggcctggatttactcagtggctgtgatcatcaagggcatcgtgtatgagaaggaggcacggctgaaagagaccatgcggatcatgggcctggacaacagcatcctctggtttagctggttcattagtagcctcattcctcttcttgtgagcgctggcctgctagtggtcatcctgaagttaggaaacctgctgccctacagtgatcccagcgtggtgtttgtcttcctgtccgtgtttgctgtggtgacaatcctgcagtgcttcctgattagcacactcttctccagagccaacctggcagcagcctgtgggggcatcatctacttcacgctgtacctgccctacgtcctgtgtgtggcatggcaggactacgtgggcttcacactcaagatcttcgctagcctgctgtctcctgtggcttttgggtttggctgtgagtactttgccctttttgaggagcagggcattggagtgcagtgggacaacctgtttgagagtcctgtggaggaagatggcttcaatctcaccacttcggtctccatgatgctgtttgacaccttcctctatggggtgatgacctggtacattgaggctgtctttccaggccagtacggaattcccaggccctggtattttccttgcaccaagtcctactggtttggcgaggaaagtgatgagaagagccaccctggttccaaccagaagagaatatcagaaatctgcatggaggaggaacccacccacttgaagctgggcgtgtccattcagaacctggtaaaagtctaccgagatgggatgaaggtggctgtcgatggcctggcactgaatttttatgagggccagatcacctccttcctgggccacaatggagcggggaagacgaccaccatgtcaatcctgaccgggttgttccccccgacctcgggcaccgcctacatcctgggaaaagacattcgctctgagatgagcaccatccggcagaacctgggggtctgtccccagcataacgtgctgtttgacatgctgactgtcgaagaacacatctggttctatgcccgcttgaaagggctctctgagaagcacgtgaaggcggagatggagcagatggccctggatgttggtttgccatcaagcaagctgaaaagcaaaacaagccagctgtcaggtggaatgcagagaaagctatctgtggccttggcctttgtcgggggatctaaggttgtcattctggatgaacccacagctggtgtggacccttactcccgcaggggaatatgggagctgctgctgaaataccgacaaggccgcaccattattctctctacacaccacatggatgaagcggacgtcctgggggacaggattgccatcatctcccatgggaagctgtgctgtgtgggctcctccctgtttctgaagaaccagctgggaacaggctactacctgaccttggtcaagaaagatgtggaatcctccctcagttcctgcagaaacagtagtagcactgtgtcatacctgaaaaaggaggacagtgtttctcagagcagttctgatgctggcctgggcagcgaccatgagagtgacacgctgaccatcgatgtctctgctatctccaacctcatcaggaagcatgtgtctgaagcccggctggtggaagacatagggcatgagctgacctatgtgctgccatatgaagctgctaaggagggagcctttgtggaactctttcatgagattgatgaccggctctcagacctgggcatttctagttatggcatctcagagacgaccctggaagaaatattcctcaaggtggccgaagagagtggggtggatgctgagacctcagatggtaccttgccagcaagacgaaacaggcgggccttcggggacaagcagagctgtcttcgcccgttcactgaagatgatgctgctgatccaaatgattctgacatagacccagaatccagagagacagacttgctcagtgggatggatggcaaagggtcctaccaggtgaaaggctggaaacttacacagcaacagtttgtggcccttttgtggaagagactgctaattgccagacggagtcggaaaggattttttgctcagattgtcttgccagctgtgtttgtctgcattgcccttgtgttcagcctgatcgtgccaccctttggcaagtaccccagcctggaacttcagccctggatgtacaacgaacagtacacatttgtcagcaatgatgctcctgaggacacgggaaccctggaactcttaaacgccctcaccaaagaccctggcttcgggacccgctgtatggaaggaaacccaatcccagacacgccctgccaggcaggggaggaagagtggaccactgccccagttccccagaccatcatggacctcttccagaatgggaactggacaatgcagaacccttcacctgcatgccagtgtagcagcgacaaaatcaagaagatgctgcctgtgtgtcccccaggggcaggggggctgcctcctccacaaagaaaacaaaacactgcagatatccttcaggacctgacaggaagaaacatttcggattatctggtgaagacgtatgtgcagatcatagccaaaagcttaaagaacaagatctgggtgaatgagtttaggtatggcggcttttccctgggtgtcagtaatactcaagcacttcctccgagtcaagaagttaatgatgccatcaaacaaatgaagaaacacctaaagctggccaaggacagttctgcagatcgatttctcaacagcttgggaagatttatgacaggactggacaccagaaataatgtcaaggtgtggttcaataacaagggctggcatgcaatcagctctttcctgaatgtcatcaacaatgccattctccgggccaacctgcaaaagggagagaaccctagccattatggaattactgctttcaatcatcccctgaatctcaccaagcagcagctctcagaggtggctctgatgaccacatcagtggatgtccttgtgtccatctgtgtcatctttgcaatgtccttcgtcccagccagctttgtcgtattcctgatccaggagcgggtcagcaaagcaaaacacctgcagttcatcagtggagtgaagcctgtcatctactggctctctaattttgtctgggatatgtgcaattacgttgtccctgccacactggtcattatcatcttcatctgcttccagcagaagtcctatgtgtcctccaccaatctgcctgtgctagcccttctacttttgctgtatgggtggtcaatcacacctctcatgtacccagcctcctttgtgttcaagatccccagcacagcctatgtggtgctcaccagcgtgaacctcttcattggcattaatggcagcgtggccacctttgtgctggagctgttcaccgacaataagctgaataatatcaatgatatcctgaagtccgtgttcttgatcttcccacatttttgcctgggacgagggctcatcgacatggtgaaaaaccaggcaatggctgatgccctggaaaggtttggggagaatcgctttgtgtcaccattatcttgggacttggtgggacgaaacctcttcgccatggccgtggaaggggtggtgttcttcctcattactgttctgatccagtacagattcttcatcaggcccagacctgtaaatgcaaagctatctcctctgaatgatgaagatgaagatgtgaggcgggaaagacagagaattcttgatggtggaggccagaatgacatcttagaaatcaaggagttgacgaagatatatagaaggaagcggaagcctgctgttgacaggatttgcgtgggcattcctcctggtgagtgctttgggctcctgggagttaatggggctggaaaatcatcaactttcaagatgttaacaggagataccactgttaccagaggagatgctttccttaacaaaaatagtatcttatcaaacatccatgaagtacatcagaacatgggctactgccctcagtttgatgccatcacagagctgttgactgggagagaacacgtggagttctttgcccttttgagaggagtcccagagaaagaagttggcaaggttggtgagtgggcgattcggaaactgggcctcgtgaagtatggagaaaaatatgctggtaactatagtggaggcaacaaacgcaagctctctacagccatggctttgatcggcgggcctcctgtggtgtttctggatgaacccaccacaggcatggatcccaaagcccggcggttcttgtggaattgtgccctaagtgttgtcaaggaggggagatcagtagtgcttacatctcatagtatggaagaatgtgaagctctttgcactaggatggcaatcatggtcaatggaaggttcaggtgccttggcagtgtccagcatctaaaaaataggtttggagatggttatacaatagttgtacgaatagcagggtccaacccggacctgaagcctgtccaggatttctttggacttgcatttcctggaagtgttctaaaagagaaacaccggaacatgctacaataccagcttccatcttcattatcttctctggccaggatattcagcatcctctcccagagcaaaaagcgactccacatagaagactactctgtttctcagacaacacttgaccaagtatttgtgaactttgccaaggaccaaagtgatgatgaccacttaaaagacctctcattacacaaaaaccagacagtagtggacgttgcagttctcacatcttttctacaggatgagaaagtgaaagaaagctatgtatgaagaatcctgttcatacggggtggctgaaagtaaagaggaactagactttcctttgcaccatgtgaagtgttgtggagaaaagagccagaagttgatgtgggaagaagtaaactggatactgtactgatactattcaatgcaatgcaattcaatgcaatgaaaacaaaattccattacaggggcagtgcctttgtagcctatgtcttgtatggctctcaagtgaaagacttgaatttagttttttacctatacctatgtgaaactctattatggaacccaatggacatatgggtttgaactcacactttttttttttttttgttcctgtgtattctcattggggttgcaacaataattcatcaagtaatcatggccagcgattattgatcaaaatcaaaaggtaatgcacatcctcattcactaagccatgccatgcccaggagactggtttcccggtgacacatccattgctggcaatgagtgtgccagagttattagtgccaagtttttcagaaagtttgaagcaccatggtgtgtcatgctcacttttgtgaaagctgctctgctcagagtctatcaacattgaatatcagttgacagaatggtgccatgcgtggctaacatcctgctttgattccctctgataagctgttctggtggcagtaacatgcaacaaaaatgtgggtgtctctaggcacgggaaacttggttccattgttatattgtcctatgcttcgagccatgggtctacagggtcatccttatgagactcttaaatatacttagatcctggtaagaggcaaagaatcaacagccaaactgctggggctgcaagctgctgaagccagggcatgggattaaagagattgtgcgttcaaacctagggaagcctgtgcccatttgtcctgactgtctgctaacatggtacactgcatctcaagatgtttatctgacacaagtgtattatttctggctttttgaattaatctagaaaatgaaaagatggagttgtattttgacaaaaatgtttgtactttttaatgttatttggaattttaagttctatcagtgacttctgaatccttagaatggcctctttgtagaaccctgtggtatagaggagtatggccactgccccactatttttattttcttatgtaagtttgcatatcagtcatgactagtgcctagaaagcaatgtgatggtcaggatctcatgacattatatttgagtttctttcagatcatttaggatactcttaatctcacttcatcaatcaaatattttttgagtgtatgctgtagctgaaagagtatgtacgtacgtataagactagagagatattaagtctcagtacacttcctgtgccatgttattcagctcactggtttacaaatataggttgtcttgtggttgtaggagcccactgtaacaatactgggcagcctttttttttttttttaaattgcaacaatgcaaaagccaagaaagtataagggtcacaagtctaaacaatgaattcttcaacagggaaaacagctagcttgaaaacttgctgaaaaacacaacttgtgtttatggcatttagtaccttcaaataattggctttgcagatattggataccccattaaatctgacagtctcaaatttttcatctcttcaatcactagtcaagaaaaatataaaaacaacaaatacttccatatggagcatttttcagagttttctaacccagtcttatttttctagtcagtaaacatttgtaaaaatactgtttcactaatacttactgttaactgtcttgagagaaaagaaaaatatgagagaactattgtttggggaagttcaagtgatctttcaatatcattactaacttcttccactttttccaaaatttgaatattaacgctaaaggtgtaagacttcagatttcaaattaatctttctatattttttaaatttacagaatattatataacccactgctgaaaaagaaaaaaatgattgttttagaagttaaagtcaatattgattttaaatataagtaatgaaggcatatttccaataactagtgatatggcatcgttgcattttacagtatcttcaaaaatacagaatttatagaataatttctcctcatttaatatttttcaaaatcaaagttatggtttcctcattttactaaaatcgtattctaattcttcattatagtaaatctatgagcaactccttacttcggttcctctgatttcaaggccatattttaaaaaatcaaaaggcactgtgaactattttgaagaaaacacaacattttaatacagattgaaaggacctcttctgaagctagaaacaatctatagttatacatcttcattaatactgtgttaccttttaaaatagtaattttttacattttcctgtgtaaacctaattgtggtagaaatttttaccaactctatactcaatcaagcaaaatttctgtatattccctgtggaatgtacctatgtgagtttcagaaattctcaaaatacgtgttcaaaaatttctgcttttgcatctttgggacacctcagaaaacttattaacaactgtgaatatgagaaatacagaagaaaataataagccctctatacataaatgcccagcacaattcattgttaaaaaacaaccaaacctcacactactgtatttcattatctgtactgaaagcaaatgctttgtgactattaaatgttgcacatcattcattcactgtatagtaatcattgactaaagccatttgtctgtgttttcttcttgtggttgtatatatcaggtaaaatattttccaaagagccatgtgtcatgtaatactgaaccactttgatattgagacattaatttgtacccttgttattatctactagtaataatgtaatactgtagaaatattgctctaattcttttcaaaattgttgcatcccccttagaatgtttctatttccataaggatttaggtatgctattatcccttcttataccctaagatgaagctgtttttgtgctctttgttcatcattggccctcattccaagcactttacgctgtctgtaatgggatctatttttgcactggaatatctgagaattgcaaaactagacaaaagtttcacaacagatttctaagttaaatcattttcattaaaaggaaaaaagaaaaaaaattttgtatgtcaataactttatatgaagtattaaaatgcatatttctatgttgtaatataatgagtcacaaaataaagctgtgacagttctgttggtctacaaaaaaaa

SEQ ID NO: 294948 - DNA, 7331 bp, Homo sapiens
gggaagtgaggcttgtagggaattggtagctgattcaaggtcacccagcaggtaaataacagtggtgggaccagacccaattaccaggtatgttttcctctgtaccgcagtacatgcctgagatttatttgtgtgttgaagccagtggtacctaatgtatttacatcccaacctgaaactcctatccacttatttaccttttaatgagcctcttaactcaagtgcagtctgaggaccagcagcatcaggatcacttgggaacttgttagaaattcagcaacctgggcacagctcagacctaccgaatcagaatctgtgcattttaacaagattcttgagtggttgaacacacattaaagcatgagaagcattgaactagacatgtagccaggtaaaggccttgcctgagatggttggcaaaggcctcattgcagcattcattggcaggccacagttcttttggcagctctgcttcctgacctctcaccctcaggaagcgaggctgttcacacggcacacacatgccagacagggtcctctgaagccacggctgccagtgcatgtgtcccagggaaagctttttcctttagttctcacacaacagagcttcttggaagccctccccggcgaaggtgctggtggctctgccttgctccgtccctgacccgttctcacctccttctttgccaccaggaggacagtgtttctcagagcagttctgatgctggcctgggcagcgaccatgagagtgacacgctgaccatcgatgtctctgctatctccaacctcatcaggaagcatgtgtctgaagcccggctggtggaagacatagggcatgagctgacctatgtgctgccatatgaagctgctaaggagggagcctttgtggaactctttcatgagattgatgaccggctctcagacctgggcatttctagttatggcatctcagagacgaccctggaagaaatattcctcaaggtggccgaagagagtggggtggatgctgagacctcagatggtaccttgccagcaagacgaaacaggcgggccttcggggacaagcagagctgtcttcgcccgttcactgaagatgatgctgctgatccaaatgattctgacatagacccagaatccagagagacagacttgctcagtgggatggatggcaaagggtcctaccaggtgaaaggctggaaacttacacagcaacagtttgtggcccttttgtggaagagactgctaattgccagacggagtcggaaaggattttttgctcagattgtcttgccagctgtgtttgtctgcattgcccttgtgttcagcctgatcgtgccaccctttggcaagtaccccagcctggaacttcagccctggatgtacaacgaacagtacacatttgtcagcaatgatgctcctgaggacacgggaaccctggaactcttaaacgccctcaccaaagaccctggcttcgggacccgctgtatggaaggaaacccaatcccagacacgccctgccaggcaggggaggaagagtggaccactgccccagttccccagaccatcatggacctcttccagaatgggaactggacaatgcagaacccttcacctgcatgccagtgtagcagcgacaaaatcaagaagatgctgcctgtgtgtcccccaggggcaggggggctgcctcctccacaaagaaaacaaaacactgcagatatccttcaggacctgacaggaagaaacatttcggattatctggtgaagacgtatgtgcagatcatagccaaaagcttaaagaacaagatctgggtgaatgagtttaggtatggcggcttttccctgggtgtcagtaatactcaagcacttcctccgagtcaagaagttaatgatgccatcaaacaaatgaagaaacacctaaagctggccaaggacagttctgcagatcgatttctcaacagcttgggaagatttatgacaggactggacaccagaaataatgtcaaggtgtggttcaataacaagggctggcatgcaatcagctctttcctgaatgtcatcaacaatgccattctccgggccaacctgcaaaagggagagaaccctagccattatggaattactgctttcaatcatcccctgaatctcaccaagcagcagctctcagaggtggctctgatgaccacatcagtggatgtccttgtgtccatctgtgtcatctttgcaatgtccttcgtcccagccagctttgtcgtattcctgatccaggagcgggtcagcaaagcaaaacacctgcagttcatcagtggagtgaagcctgtcatctactggctctctaattttgtctgggatatgtgcaattacgttgtccctgccacactggtcattatcatcttcatctgcttccagcagaagtcctatgtgtcctccaccaatctgcctgtgctagcccttctacttttgctgtatgggtggtcaatcacacctctcatgtacccagcctcctttgtgttcaagatccccagcacagcctatgtggtgctcaccagcgtgaacctcttcattggcattaatggcagcgtggccacctttgtgctggagctgttcaccgacaataagctgaataatatcaatgatatcctgaagtccgtgttcttgatcttcccacatttttgcctgggacgagggctcatcgacatggtgaaaaaccaggcaatggctgatgccctggaaaggtttggggagaatcgctttgtgtcaccattatcttgggacttggtgggacgaaacctcttcgccatggccgtggaaggggtggtgttcttcctcattactgttctgatccagtacagattcttcatcaggcccagacctgtaaatgcaaagctatctcctctgaatgatgaagatgaagatgtgaggcgggaaagacagagaattcttgatggtggaggccagaatgacatcttagaaatcaaggagttgacgaagatatatagaaggaagcggaagcctgctgttgacaggatttgcgtgggcattcctcctggtgagtgctttgggctcctgggagttaatggggctggaaaatcatcaactttcaagatgttaacaggagataccactgttaccagaggagatgctttccttaacaaaaatagtatcttatcaaacatccatgaagtacatcagaacatgggctactgccctcagtttgatgccatcacagagctgttgactgggagagaacacgtggagttctttgcccttttgagaggagtcccagagaaagaagttggcaaggttggtgagtgggcgattcggaaactgggcctcgtgaagtatggagaaaaatatgctggtaactatagtggaggcaacaaacgcaagctctctacagccatggctttgatcggcgggcctcctgtggtgtttctggatgaacccaccacaggcatggatcccaaagcccggcggttcttgtggaattgtgccctaagtgttgtcaaggaggggagatcagtagtgcttacatctcatagtatggaagaatgtgaagctctttgcactaggatggcaatcatggtcaatggaaggttcaggtgccttggcagtgtccagcatctaaaaaataggtttggagatggttatacaatagttgtacgaatagcagggtccaacccggacctgaagcctgtccaggatttctttggacttgcatttcctggaagtgttctaaaagagaaacaccggaacatgctacaataccagcttccatcttcattatcttctctggccaggatattcagcatcctctcccagagcaaaaagcgactccacatagaagactactctgtttctcagacaacacttgaccaagtatttgtgaactttgccaaggaccaaagtgatgatgaccacttaaaagacctctcattacacaaaaaccagacagtagtggacgttgcagttctcacatcttttctacaggatgagaaagtgaaagaaagctatgtatgaagaatcctgttcatacggggtggctgaaagtaaagaggaactagactttcctttgcaccatgtgaagtgttgtggagaaaagagccagaagttgatgtgggaagaagtaaactggatactgtactgatactattcaatgcaatgcaattcaatgcaatgaaaacaaaattccattacaggggcagtgcctttgtagcctatgtcttgtatggctctcaagtgaaagacttgaatttagttttttacctatacctatgtgaaactctattatggaacccaatggacatatgggtttgaactcacactttttttttttttttgttcctgtgtattctcattggggttgcaacaataattcatcaagtaatcatggccagcgattattgatcaaaatcaaaaggtaatgcacatcctcattcactaagccatgccatgcccaggagactggtttcccggtgacacatccattgctggcaatgagtgtgccagagttattagtgccaagtttttcagaaagtttgaagcaccatggtgtgtcatgctcacttttgtgaaagctgctctgctcagagtctatcaacattgaatatcagttgacagaatggtgccatgcgtggctaacatcctgctttgattccctctgataagctgttctggtggcagtaacatgcaacaaaaatgtgggtgtctctaggcacgggaaacttggttccattgttatattgtcctatgcttcgagccatgggtctacagggtcatccttatgagactcttaaatatacttagatcctggtaagaggcaaagaatcaacagccaaactgctggggctgcaagctgctgaagccagggcatgggattaaagagattgtgcgttcaaacctagggaagcctgtgcccatttgtcctgactgtctgctaacatggtacactgcatctcaagatgtttatctgacacaagtgtattatttctggctttttgaattaatctagaaaatgaaaagatggagttgtattttgacaaaaatgtttgtactttttaatgttatttggaattttaagttctatcagtgacttctgaatccttagaatggcctctttgtagaaccctgtggtatagaggagtatggccactgccccactatttttattttcttatgtaagtttgcatatcagtcatgactagtgcctagaaagcaatgtgatggtcaggatctcatgacattatatttgagtttctttcagatcatttaggatactcttaatctcacttcatcaatcaaatattttttgagtgtatgctgtagctgaaagagtatgtacgtacgtataagactagagagatattaagtctcagtacacttcctgtgccatgttattcagctcactggtttacaaatataggttgtcttgtggttgtaggagcccactgtaacaatactgggcagcctttttttttttttttaaattgcaacaatgcaaaagccaagaaagtataagggtcacaagtctaaacaatgaattcttcaacagggaaaacagctagcttgaaaacttgctgaaaaacacaacttgtgtttatggcatttagtaccttcaaataattggctttgcagatattggataccccattaaatctgacagtctcaaatttttcatctcttcaatcactagtcaagaaaaatataaaaacaacaaatacttccatatggagcatttttcagagttttctaacccagtcttatttttctagtcagtaaacatttgtaaaaatactgtttcactaatacttactgttaactgtcttgagagaaaagaaaaatatgagagaactattgtttggggaagttcaagtgatctttcaatatcattactaacttcttccactttttccaaaatttgaatattaacgctaaaggtgtaagacttcagatttcaaattaatctttctatattttttaaatttacagaatattatataacccactgctgaaaaagaaaaaaatgattgttttagaagttaaagtcaatattgattttaaatataagtaatgaaggcatatttccaataactagtgatatggcatcgttgcattttacagtatcttcaaaaatacagaatttatagaataatttctcctcatttaatatttttcaaaatcaaagttatggtttcctcattttactaaaatcgtattctaattcttcattatagtaaatctatgagcaactccttacttcggttcctctgatttcaaggccatattttaaaaaatcaaaaggcactgtgaactattttgaagaaaacacaacattttaatacagattgaaaggacctcttctgaagctagaaacaatctatagttatacatcttcattaatactgtgttaccttttaaaatagtaattttttacattttcctgtgtaaacctaattgtggtagaaatttttaccaactctatactcaatcaagcaaaatttctgtatattccctgtggaatgtacctatgtgagtttcagaaattctcaaaatacgtgttcaaaaatttctgcttttgcatctttgggacacctcagaaaacttattaacaactgtgaatatgagaaatacagaagaaaataataagccctctatacataaatgcccagcacaattcattgttaaaaaacaaccaaacctcacactactgtatttcattatctgtactgaaagcaaatgctttgtgactattaaatgttgcacatcattcattcactgtatagtaatcattgactaaagccatttgtctgtgttttcttcttgtggttgtatatatcaggtaaaatattttccaaagagccatgtgtcatgtaatactgaaccactttgatattgagacattaatttgtacccttgttattatctactagtaataatgtaatactgtagaaatattgctctaattcttttcaaaattgttgcatcccccttagaatgtttctatttccataaggatttaggtatgctattatcccttcttataccctaagatgaagctgtttttgtgctctttgttcatcattggccctcattccaagcactttacgctgtctgtaatgggatctatttttgcactggaatatctgagaattgcaaaactagacaaaagtttcacaacagatttctaagttaaatcattttcattaaaaggaaaaaagaaaaaaaattttgtatgtcaataactttatatgaagtattaaaatgcatatttctatgttgtaatataatgagtcacaaaataaagctgtgacagttctgttggtctacaaaaaaaa

SEQ ID NO: 294949 - DNA, 10455 bp, Homo sapiens
  misc_feature (69)..(69): n is a, c, g, or t
  misc_feature (1160)..(1160): n is a, c, g, or t
agagcacaggctttgaccgatagtaacctctgcgctcggtgcagccgaatctataaaaggaactagtcncggcaaaaaccccgtaattgcgagcgagagtgagtggggccgggacccgcagagccgagccgacccttctctcccgggctgcggcagggcagggcggggagctccgcgcaccaacagagccggttctcagggcgctttgctccttgttttttccccggttctgttttctccccttctccggaaggcttgtcaaggggtaggagaaagagacgcaaacacaaaagtggaaaacagttaatgaccagccacggcgtccctgctgtgagctctggccgctgccttccagggctcccgagccacacgctgggggtgctggctgagggaacatggcttgttggcctcagctgaggttgctgctgtggaagaacctcactttcagaagaagacaaacatgtcagctgctgctggaagtggcctggcctctatttatcttcctgatcctgatctctgttcggctgagctacccaccctatgaacaacatgaatgccattttccaaataaagccatgccctctgcaggaacacttccttgggttcaggggattatctgtaatgccaacaacccctgtttccgttacccgactcctggggaggctcccggagttgttggaaactttaacaaatccattgtggctcgcctgttctcagatgctcggaggcttcttttatacagccagaaagacaccagcatgaaggacatgcgcaaagttctgagaacattacagcagatcaagaaatccagctcaaacttgaagcttcaagatttcctggtggacaatgaaaccttctctgggttcctgtatcacaacctctctctcccaaagtctactgtggacaagatgctgagggctgatgtcattctccacaaggtatttttgcaaggctaccagttacatttgacaagtctgtgcaatggatcaaaatcagaagagatgattcaacttggtgaccaagaagtttctgagctttgtggcctaccaagggagaaactggctgcagcagagcgagtacttcgttccaacatggacatcctgaagccaatcctgagaacactaaactctacatctcccttcccgagcaaggagctggcngaagccacaaaaacattgctgcatagtcttgggactctggcccaggagctgttcagcatgagaagctggagtgacatgcgacaggaggtgatgtttctgaccaatgtgaacagctccagctcctccacccaaatctaccaggctgtgtctcgtattgtctgcgggcatcccgagggaggggggctgaagatcaagtctctcaactggtatgaggacaacaactacaaagccctctttggaggcaatggcactgaggaagatgctgaaaccttctatgacaactctacaactccttactgcaatgatttgatgaagaatttggagtctagtcctctttcccgcattatctggaaagctctgaagccgctgctcgttgggaagatcctgtatacacctgacactccagccacaaggcaggtcatggctgaggtgaacaagaccttccaggaactggctgtgttccatgatctggaaggcatgtgggaggaactcagccccaagatctggaccttcatggagaacagccaagaaatggaccttgtccggatgctgttggacagcagggacaatgaccacttttgggaacagcagttggatggcttagattggacagcccaagacatcgtggcgtttttggccaagcacccagaggatgtccagtccagtaatggttctgtgtacacctggagagaagctttcaacgagactaaccaggcaatccggaccatatctcgcttcatggagtgtgtcaacctgaacaagctagaacccatagcaacagaagtctggctcatcaacaagtccatggagctgctggatgagaggaagttctgggctggtattgtgttcactggaattactccaggcagcattgagctgccccatcatgtcaagtacaagatccgaatggacattgacaatgtggagaggacaaataaaatcaaggatgggtactgggaccctggtcctcgagctgacccctttgaggacatgcggtacgtctgggggggcttcgcctacttgcaggatgtggtggagcaggcaatcatcagggtgctgacgggcaccgagaagaaaactggtgtctatatgcaacagatgccctatccctgttacgttgatgacatctttctgcgggtgatgagccggtcaatgcccctcttcatgacgctggcctggatttactcagtggctgtgatcatcaagggcatcgtgtatgagaaggaggcacggctgaaagagaccatgcggatcatgggcctggacaacagcatcctctggtttagctggttcattagtagcctcattcctcttcttgtgagcgctggcctgctagtggtcatcctgaagttaggaaacctgctgccctacagtgatcccagcgtggtgtttgtcttcctgtccgtgtttgctgtggtgacaatcctgcagtgcttcctgattagcacactcttctccagagccaacctggcagcagcctgtgggggcatcatctacttcacgctgtacctgccctacgtcctgtgtgtggcatggcaggactacgtgggcttcacactcaagatcttcgctagcctgctgtctcctgtggcttttgggtttggctgtgagtactttgccctttttgaggagcagggcattggagtgcagtgggacaacctgtttgagagtcctgtggaggaagatggcttcaatctcaccacttcggtctccatgatgctgtttgacaccttcctctatggggtgatgacctggtacattgaggctgtctttccaggccagtacggaattcccaggccctggtattttccttgcaccaagtcctactggtttggcgaggaaagtgatgagaagagccaccctggttccaaccagaagagaatatcagaaatctgcatggaggaggaacccacccacttgaagctgggcgtgtccattcagaacctggtaaaagtctaccgagatgggatgaaggtggctgtcgatggcctggcactgaatttttatgagggccagatcacctccttcctgggccacaatggagcggggaagacgaccaccatgtcaatcctgaccgggttgttccccccgacctcgggcaccgcctacatcctgggaaaagacattcgctctgagatgagcaccatccggcagaacctgggggtctgtccccagcataacgtgctgtttgacatgctgactgtcgaagaacacatctggttctatgcccgcttgaaagggctctctgagaagcacgtgaaggcggagatggagcagatggccctggatgttggtttgccatcaagcaagctgaaaagcaaaacaagccagctgtcaggtggaatgcagagaaagctatctgtggccttggcctttgtcgggggatctaaggttgtcattctggatgaacccacagctggtgtggacccttactcccgcaggggaatatgggagctgctgctgaaataccgacaaggccgcaccattattctctctacacaccacatggatgaagcggacgtcctgggggacaggattgccatcatctcccatgggaagctgtgctgtgtgggctcctccctgtttctgaagaaccagctgggaacaggctactacctgaccttggtcaagaaagatgtggaatcctccctcagttcctgcagaaacagtagtagcactgtgtcatacctgaaaaaggaggacagtgtttctcagagcagttctgatgctggcctgggcagcgaccatgagagtgacacgctgaccatcgatgtctctgctatctccaacctcatcaggaagcatgtgtctgaagcccggctggtggaagacatagggcatgagctgacctatgtgctgccatatgaagctgctaaggagggagcctttgtggaactctttcatgagattgatgaccggctctcagacctgggcatttctagttatggcatctcagagacgaccctggaagaaatattcctcaaggtggccgaagagagtggggtggatgctgagacctcagatggtaccttgccagcaagacgaaacaggcgggccttcggggacaagcagagctgtcttcgcccgttcactgaagatgatgctgctgatccaaatgattctgacatagacccagaatccagagagacagacttgctcagtgggatggatggcaaagggtcctaccaggtgaaaggctggaaacttacacagcaacagtttgtggcccttttgtggaagagactgctaattgccagacggagtcggaaaggattttttgctcagattgtcttgccagctgtgtttgtctgcattgcccttgtgttcagcctgatcgtgccaccctttggcaagtaccccagcctggaacttcagccctggatgtacaacgaacagtacacatttgtcagcaatgatgctcctgaggacacgggaaccctggaactcttaaacgccctcaccaaagaccctggcttcgggacccgctgtatggaaggaaacccaatcccagacacgccctgccaggcaggggaggaagagtggaccactgccccagttccccagaccatcatggacctcttccagaatgggaactggacaatgcagaacccttcacctgcatgccagtgtagcagcgacaaaatcaagaagatgctgcctgtgtgtcccccaggggcaggggggctgcctcctccacaaagaaaacaaaacactgcagatatccttcaggacctgacaggaagaaacatttcggattatctggtgaagacgtatgtgcagatcatagccaaaagcttaaagaacaagatctgggtgaatgagtttaggtatggcggcttttccctgggtgtcagtaatactcaagcacttcctccgagtcaagaagttaatgatgccatcaaacaaatgaagaaacacctaaagctggccaaggacagttctgcagatcgatttctcaacagcttgggaagatttatgacaggactggacaccagaaataatgtcaaggtgtggttcaataacaagggctggcatgcaatcagctctttcctgaatgtcatcaacaatgccattctccgggccaacctgcaaaagggagagaaccctagccattatggaattactgctttcaatcatcccctgaatctcaccaagcagcagctctcagaggtggctctgatgaccacatcagtggatgtccttgtgtccatctgtgtcatctttgcaatgtccttcgtcccagccagctttgtcgtattcctgatccaggagcgggtcagcaaagcaaaacacctgcagttcatcagtggagtgaagcctgtcatctactggctctctaattttgtctgggatatgtgcaattacgttgtccctgccacactggtcattatcatcttcatctgcttccagcagaagtcctatgtgtcctccaccaatctgcctgtgctagcccttctacttttgctgtatgggtggtcaatcacacctctcatgtacccagcctcctttgtgttcaagatccccagcacagcctatgtggtgctcaccagcgtgaacctcttcattggcattaatggcagcgtggccacctttgtgctggagctgttcaccgacaataagctgaataatatcaatgatatcctgaagtccgtgttcttgatcttcccacatttttgcctgggacgagggctcatcgacatggggagaatcgctttgtgtcaccattatcttgggacttggtgggacgaaacctcttcgccatggccgtggaaggggtggtgttcttcctcattactgttctgatccagtacagattcttcatcaggcccagacctgtaaatgcaaagctatctcctctgaatgatgaagatgaagatgtgaggcgggaaagacagagaattcttgatggtggaggccagaatgacatcttagaaatcaaggagttgacgaagatatatagaaggaagcggaagcctgctgttgacaggatttgcgtgggcattcctcctggtgagtgctttgggctcctgggagttaatggggctggaaaatcatcaactttcaagatgttaacaggagataccactgttaccagaggagatgctttccttaacaaaaatagtatcttatcaaacatccatgaagtacatcagaacatgggctactgccctcagtttgatgccatcacagagctgttgactgggagagaacacgtggagttctttgcccttttgagaggagtcccagagaaagaagttggcaaggttggtgagtgggcgattcggaaactgggcctcgtgaagtatggagaaaaatatgctggtaactatagtggaggcaacaaacgcaagctctctacagccatggctttgatcggcgggcctcctgtggtgtttctggatgaacccaccacaggcatggatcccaaagcccggcggttcttgtggaattgtgccctaagtgttgtcaaggaggggagatcagtagtgcttacatctcatagtatggaagaatgtgaagctctttgcactaggatggcaatcatggtcaatggaaggttcaggtgccttggcagtgtccagcatctaaaaaataggtttggagatggttatacaatagttgtacgaatagcagggtccaacccggacctgaagcctgtccaggatttctttggacttgcatttcctggaagtgttctaaaagagaaacaccggaacatgctacaataccagcttccatcttcattatcttctctggccaggatattcagcatcctctcccagagcaaaaagcgactccacatagaagactactctgtttctcagacaacacttgaccaagtatttgtgaactttgccaaggaccaaagtgatgatgaccacttaaaagacctctcattacacaaaaaccagacagtagtggacgttgcagttctcacatcttttctacaggatgagaaagtgaaagaaagctatgtatgaagaatcctgttcatacggggtggctgaaagtaaagaggaactagactttcctttgcaccatgtgaagtgttgtggagaaaagagccagaagttgatgtgggaagaagtaaactggatactgtactgatactattcaatgcaatgcaattcaatgcaatgaaaacaaaattccattacaggggcagtgcctttgtagcctatgtcttgtatggctctcaagtgaaagacttgaatttagttttttacctatacctatgtgaaactctattatggaacccaatggacatatgggtttgaactcacactttttttttttttttgttcctgtgtattctcattggggttgcaacaataattcatcaagtaatcatggccagcgattattgatcaaaatcaaaaggtaatgcacatcctcattcactaagccatgccatgcccaggagactggtttcccggtgacacatccattgctggcaatgagtgtgccagagttattagtgccaagtttttcagaaagtttgaagcaccatggtgtgtcatgctcacttttgtgaaagctgctctgctcagagtctatcaacattgaatatcagttgacagaatggtgccatgcgtggctaacatcctgctttgattccctctgataagctgttctggtggcagtaacatgcaacaaaaatgtgggtgtctctaggcacgggaaacttggttccattgttatattgtcctatgcttcgagccatgggtctacagggtcatccttatgagactcttaaatatacttagatcctggtaagaggcaaagaatcaacagccaaactgctggggctgcaagctgctgaagccagggcatgggattaaagagattgtgcgttcaaacctagggaagcctgtgcccatttgtcctgactgtctgctaacatggtacactgcatctcaagatgtttatctgacacaagtgtattatttctggctttttgaattaatctagaaaatgaaaagatggagttgtattttgacaaaaatgtttgtactttttaatgttatttggaattttaagttctatcagtgacttctgaatccttagaatggcctctttgtagaaccctgtggtatagaggagtatggccactgccccactatttttattttcttatgtaagtttgcatatcagtcatgactagtgcctagaaagcaatgtgatggtcaggatctcatgacattatatttgagtttctttcagatcatttaggatactcttaatctcacttcatcaatcaaatattttttgagtgtatgctgtagctgaaagagtatgtacgtacgtataagactagagagatattaagtctcagtacacttcctgtgccatgttattcagctcactggtttacaaatataggttgtcttgtggttgtaggagcccactgtaacaatactgggcagcctttttttttttttttaaattgcaacaatgcaaaagccaagaaagtataagggtcacaagtctaaacaatgaattcttcaacagggaaaacagctagcttgaaaacttgctgaaaaacacaacttgtgtttatggcatttagtaccttcaaataattggctttgcagatattggataccccattaaatctgacagtctcaaatttttcatctcttcaatcactagtcaagaaaaatataaaaacaacaaatacttccatatggagcatttttcagagttttctaacccagtcttatttttctagtcagtaaacatttgtaaaaatactgtttcactaatacttactgttaactgtcttgagagaaaagaaaaatatgagagaactattgtttggggaagttcaagtgatctttcaatatcattactaacttcttccactttttccaaaatttgaatattaacgctaaaggtgtaagacttcagatttcaaattaatctttctatattttttaaatttacagaatattatataacccactgctgaaaaagaaaaaaatgattgttttagaagttaaagtcaatattgattttaaatataagtaatgaaggcatatttccaataactagtgatatggcatcgttgcattttacagtatcttcaaaaatacagaatttatagaataatttctcctcatttaatatttttcaaaatcaaagttatggtttcctcattttactaaaatcgtattctaattcttcattatagtaaatctatgagcaactccttacttcggttcctctgatttcaaggccatattttaaaaaatcaaaaggcactgtgaactattttgaagaaaacacaacattttaatacagattgaaaggacctcttctgaagctagaaacaatctatagttatacatcttcattaatactgtgttaccttttaaaatagtaattttttacattttcctgtgtaaacctaattgtggtagaaatttttaccaactctatactcaatcaagcaaaatttctgtatattccctgtggaatgtacctatgtgagtttcagaaattctcaaaatacgtgttcaaaaatttctgcttttgcatctttgggacacctcagaaaacttattaacaactgtgaatatgagaaatacagaagaaaataataagccctctatacataaatgcccagcacaattcattgttaaaaaacaaccaaacctcacactactgtatttcattatctgtactgaaagcaaatgctttgtgactattaaatgttgcacatcattcattcactgtatagtaatcattgactaaagccatttgtctgtgttttcttcttgtggttgtatatatcaggtaaaatattttccaaagagccatgtgtcatgtaatactgaaccactttgatattgagacattaatttgtacccttgttattatctactagtaataatgtaatactgtagaaatattgctctaattcttttcaaaattgttgcatcccccttagaatgtttctatttccataaggatttaggtatgctattatcccttcttataccctaagatgaagctgtttttgtgctctttgttcatcattggccctcattccaagcactttacgctgtctgtaatgggatctatttttgcactggaatatctgagaattgcaaaactagacaaaagtttcacaacagatttctaagttaaatcattttcattaaaaggaaaaaagaaaaaaaattttgtatgtcaataactttatatgaagtattaaaatgcatatttctatgttgtaatataatgagtcacaaaataaagctgtgacagttctgttggtctacaaaaaaaa

SEQ ID NO: 294950 - DNA, 5324 bp, Homo sapiens
tttacattgtcatatttttagacttaaaaatgatcatcttaaccctgaataaaatgtgtctggtgaacagatgtttttccttgggctgtgcctcagatatctctgtgtgtgtgtacgtgtgtgtttgtctgtgtgtccatgtcctcactgattgagccctaactgcatcaaagacccctcagattttcacacgctttttctctccaggatgaccacatcagtggatgtccttgtgtccatctgtgtcatctttgcaatgtccttcgtcccagccagctttgtcgtattcctgatccaggagcgggtcagcaaagcaaaacacctgcagttcatcagtggagtgaagcctgtcatctactggctctctaattttgtctgggatatgtgcaattacgttgtccctgccacactggtcattatcatcttcatctgcttccagcagaagtcctatgtgtcctccaccaatctgcctgtgctagcccttctacttttgctgtatgggtggtcaatcacacctctcatgtacccagcctcctttgtgttcaagatccccagcacagcctatgtggtgctcaccagcgtgaacctcttcattggcattaatggcagcgtggccacctttgtgctggagctgttcaccgacaataagctgaataatatcaatgatatcctgaagtccgtgttcttgatcttcccacatttttgcctgggacgagggctcatcgacatggggagaatcgctttgtgtcaccattatcttgggacttggtgggacgaaacctcttcgccatggccgtggaaggggtggtgttcttcctcattactgttctgatccagtacagattcttcatcaggcccagacctgtaaatgcaaagctatctcctctgaatgatgaagatgaagatgtgaggcgggaaagacagagaattcttgatggtggaggccagaatgacatcttagaaatcaaggagttgacgaagatatatagaaggaagcggaagcctgctgttgacaggatttgcgtgggcattcctcctggtgagtgctttgggctcctgggagttaatggggctggaaaatcatcaactttcaagatgttaacaggagataccactgttaccagaggagatgctttccttaacaaaaatagtatcttatcaaacatccatgaagtacatcagaacatgggctactgccctcagtttgatgccatcacagagctgttgactgggagagaacacgtggagttctttgcccttttgagaggagtcccagagaaagaagttggcaaggttggtgagtgggcgattcggaaactgggcctcgtgaagtatggagaaaaatatgctggtaactatagtggaggcaacaaacgcaagctctctacagccatggctttgatcggcgggcctcctgtggtgtttctggatgaacccaccacaggcatggatcccaaagcccggcggttcttgtggaattgtgccctaagtgttgtcaaggaggggagatcagtagtgcttacatctcatagtatggaagaatgtgaagctctttgcactaggatggcaatcatggtcaatggaaggttcaggtgccttggcagtgtccagcatctaaaaaataggtttggagatggttatacaatagttgtacgaatagcagggtccaacccggacctgaagcctgtccaggatttctttggacttgcatttcctggaagtgttctaaaagagaaacaccggaacatgctacaataccagcttccatcttcattatcttctctggccaggatattcagcatcctctcccagagcaaaaagcgactccacatagaagactactctgtttctcagacaacacttgaccaagtatttgtgaactttgccaaggaccaaagtgatgatgaccacttaaaagacctctcattacacaaaaaccagacagtagtggacgttgcagttctcacatcttttctacaggatgagaaagtgaaagaaagctatgtatgaagaatcctgttcatacggggtggctgaaagtaaagaggaactagactttcctttgcaccatgtgaagtgttgtggagaaaagagccagaagttgatgtgggaagaagtaaactggatactgtactgatactattcaatgcaatgcaattcaatgcaatgaaaacaaaattccattacaggggcagtgcctttgtagcctatgtcttgtatggctctcaagtgaaagacttgaatttagttttttacctatacctatgtgaaactctattatggaacccaatggacatatgggtttgaactcacactttttttttttttttgttcctgtgtattctcattggggttgcaacaataattcatcaagtaatcatggccagcgattattgatcaaaatcaaaaggtaatgcacatcctcattcactaagccatgccatgcccaggagactggtttcccggtgacacatccattgctggcaatgagtgtgccagagttattagtgccaagtttttcagaaagtttgaagcaccatggtgtgtcatgctcacttttgtgaaagctgctctgctcagagtctatcaacattgaatatcagttgacagaatggtgccatgcgtggctaacatcctgctttgattccctctgataagctgttctggtggcagtaacatgcaacaaaaatgtgggtgtctctaggcacgggaaacttggttccattgttatattgtcctatgcttcgagccatgggtctacagggtcatccttatgagactcttaaatatacttagatcctggtaagaggcaaagaatcaacagccaaactgctggggctgcaagctgctgaagccagggcatgggattaaagagattgtgcgttcaaacctagggaagcctgtgcccatttgtcctgactgtctgctaacatggtacactgcatctcaagatgtttatctgacacaagtgtattatttctggctttttgaattaatctagaaaatgaaaagatggagttgtattttgacaaaaatgtttgtactttttaatgttatttggaattttaagttctatcagtgacttctgaatccttagaatggcctctttgtagaaccctgtggtatagaggagtatggccactgccccactatttttattttcttatgtaagtttgcatatcagtcatgactagtgcctagaaagcaatgtgatggtcaggatctcatgacattatatttgagtttctttcagatcatttaggatactcttaatctcacttcatcaatcaaatattttttgagtgtatgctgtagctgaaagagtatgtacgtacgtataagactagagagatattaagtctcagtacacttcctgtgccatgttattcagctcactggtttacaaatataggttgtcttgtggttgtaggagcccactgtaacaatactgggcagcctttttttttttttttaaattgcaacaatgcaaaagccaagaaagtataagggtcacaagtctaaacaatgaattcttcaacagggaaaacagctagcttgaaaacttgctgaaaaacacaacttgtgtttatggcatttagtaccttcaaataattggctttgcagatattggataccccattaaatctgacagtctcaaatttttcatctcttcaatcactagtcaagaaaaatataaaaacaacaaatacttccatatggagcatttttcagagttttctaacccagtcttatttttctagtcagtaaacatttgtaaaaatactgtttcactaatacttactgttaactgtcttgagagaaaagaaaaatatgagagaactattgtttggggaagttcaagtgatctttcaatatcattactaacttcttccactttttccaaaatttgaatattaacgctaaaggtgtaagacttcagatttcaaattaatctttctatattttttaaatttacagaatattatataacccactgctgaaaaagaaaaaaatgattgttttagaagttaaagtcaatattgattttaaatataagtaatgaaggcatatttccaataactagtgatatggcatcgttgcattttacagtatcttcaaaaatacagaatttatagaataatttctcctcatttaatatttttcaaaatcaaagttatggtttcctcattttactaaaatcgtattctaattcttcattatagtaaatctatgagcaactccttacttcggttcctctgatttcaaggccatattttaaaaaatcaaaaggcactgtgaactattttgaagaaaacacaacattttaatacagattgaaaggacctcttctgaagctagaaacaatctatagttatacatcttcattaatactgtgttaccttttaaaatagtaattttttacattttcctgtgtaaacctaattgtggtagaaatttttaccaactctatactcaatcaagcaaaatttctgtatattccctgtggaatgtacctatgtgagtttcagaaattctcaaaatacgtgttcaaaaatttctgcttttgcatctttgggacacctcagaaaacttattaacaactgtgaatatgagaaatacagaagaaaataataagccctctatacataaatgcccagcacaattcattgttaaaaaacaaccaaacctcacactactgtatttcattatctgtactgaaagcaaatgctttgtgactattaaatgttgcacatcattcattcactgtatagtaatcattgactaaagccatttgtctgtgttttcttcttgtggttgtatatatcaggtaaaatattttccaaagagccatgtgtcatgtaatactgaaccactttgatattgagacattaatttgtacccttgttattatctactagtaataatgtaatactgtagaaatattgctctaattcttttcaaaattgttgcatcccccttagaatgtttctatttccataaggatttaggtatgctattatcccttcttataccctaagatgaagctgtttttgtgctctttgttcatcattggccctcattccaagcactttacgctgtctgtaatgggatctatttttgcactggaatatctgagaattgcaaaactagacaaaagtttcacaacagatttctaagttaaatcattttcattaaaaggaaaaaagaaaaaaaattttgtatgtcaataactttatatgaagtattaaaatgcatatttctatgttgtaatataatgagtcacaaaataaagctgtgacagttctgttggtctacaaaaaaaa

SEQ ID NO: 294951 - DNA, 3029 bp, Homo sapiens
  misc_feature (69)..(69): n is a, c, g, or t
  misc_feature (1160)..(1160): n is a, c, g, or t
agagcacaggctttgaccgatagtaacctctgcgctcggtgcagccgaatctataaaaggaactagtcncggcaaaaaccccgtaattgcgagcgagagtgagtggggccgggacccgcagagccgagccgacccttctctcccgggctgcggcagggcagggcggggagctccgcgcaccaacagagccggttctcagggcgctttgctccttgttttttccccggttctgttttctccccttctccggaaggcttgtcaaggggtaggagaaagagacgcaaacacaaaagtggaaaacagttaatgaccagccacggcgtccctgctgtgagctctggccgctgccttccagggctcccgagccacacgctgggggtgctggctgagggaacatggcttgttggcctcagctgaggttgctgctgtggaagaacctcactttcagaagaagacaaacatgtcagctgctgctggaagtggcctggcctctatttatcttcctgatcctgatctctgttcggctgagctacccaccctatgaacaacatgaatgccattttccaaataaagccatgccctctgcaggaacacttccttgggttcaggggattatctgtaatgccaacaacccctgtttccgttacccgactcctggggaggctcccggagttgttggaaactttaacaaatccattgtggctcgcctgttctcagatgctcggaggcttcttttatacagccagaaagacaccagcatgaaggacatgcgcaaagttctgagaacattacagcagatcaagaaatccagctcaaacttgaagcttcaagatttcctggtggacaatgaaaccttctctgggttcctgtatcacaacctctctctcccaaagtctactgtggacaagatgctgagggctgatgtcattctccacaaggtatttttgcaaggctaccagttacatttgacaagtctgtgcaatggatcaaaatcagaagagatgattcaacttggtgaccaagaagtttctgagctttgtggcctaccaagggagaaactggctgcagcagagcgagtacttcgttccaacatggacatcctgaagccaatcctgagaacactaaactctacatctcccttcccgagcaaggagctggcngaagccacaaaaacattgctgcatagtcttgggactctggcccaggagctgttcagcatgagaagctggagtgacatgcgacaggaggtgatgtttctgaccaatgtgaacagctccagctcctccacccaaatctaccaggctgtgtctcgtattgtctgcgggcatcccgagggaggggggctgaagatcaagtctctcaactggtatgaggacaacaactacaaagccctctttggaggcaatggcactgaggaagatgctgaaaccttctatgacaactctacaactccttactgcaatgatttgatgaagaatttggagtctagtcctctttcccgcattatctggaaagctctgaagccgctgctcgttgggaagatcctgtatacacctgacactccagccacaaggcaggtcatggctgaggtgaacaagaccttccaggaactggctgtgttccatgatctggaaggcatgtgggaggaactcagccccaagatctggaccttcatggagaacagccaagaaatggaccttgtccggatgctgttggacagcagggacaatgaccacttttgggaacagcagttggatggcttagattggacagcccaagacatcgtggcgtttttggccaagcacccagaggatgtccagtccagtaatggttctgtgtacacctggagagaagctttcaacgagactaaccaggcaatccggaccatatctcgcttcatggagtgtgtcaacctgaacaagctagaacccatagcaacagaagtctggctcatcaacaagtccatggagctgctggatgagaggaagttctgggctggtattgtgttcactggaattactccaggcagcattgagctgccccatcatgtcaagtacaagatccgaatggacattgacaatgtggagaggacaaataaaatcaaggatgggtactgggaccctggtcctcgagctgacccctttgaggacatgcggtacgtctgggggggcttcgcctacttgcaggatgtggtggagcaggcaatcatcagggtgctgacgggcaccgagaagaaaactggtgtctatatgcaacagatgccctatccctgttacgttgatgacatctttctgcgggtgatgagccggtcaatgcccctcttcatgacgctggcctggatttactcagtggctgtgatcatcaagggcatcgtgtatgagaaggaggcacggctgaaagagaccatgcggatcatgggcctggacaacagcatcctctggtttagctggttcattagtagcctcattcctcttcttgtgagcgctggcctgctagtggtcatcctgaagttaggaaacctgctgccctacagtgatcccagcgtggtgtttgtcttcctgtccgtgtttgctgtggtgacaatcctgcagtgcttcctgattagcacactcttctccagagccaacctggcagcagcctgtgggggcatcatctacttcacgctgtacctgccctacgtcctgtgtgtggcatggcaggactacgtgggcttcacactcaagatcttcgctagcctgctgtctcctgtggcttttgggtttggctgtgagtactttgccctttttgaggagcagggcattggagtgcagtgggacaacctgtttgagagtcctgtggaggaagatggcttcaatctcaccacttcggtctccatgatgctgtttgacaccttcctctatggggtgatgacctggtacattgaggctgtctttccaggtacactgctttgggcatctgtttggaaaatatgacttctagctgatgtcctttctttgtgctagaatctctgcagtgcatgggcttccctg

SEQ ID NO: 294952 - DNA, 2316 bp, Homo sapiens
  misc_feature (69)..(69): n is a, c, g, or t
  misc_feature (1160)..(1160): n is a, c, g, or t
agagcacaggctttgaccgatagtaacctctgcgctcggtgcagccgaatctataaaaggaactagtcncggcaaaaaccccgtaattgcgagcgagagtgagtggggccgggacccgcagagccgagccgacccttctctcccgggctgcggcagggcagggcggggagctccgcgcaccaacagagccggttctcagggcgctttgctccttgttttttccccggttctgttttctccccttctccggaaggcttgtcaaggggtaggagaaagagacgcaaacacaaaagtggaaaacagttaatgaccagccacggcgtccctgctgtgagctctggccgctgccttccagggctcccgagccacacgctgggggtgctggctgagggaacatggcttgttggcctcagctgaggttgctgctgtggaagaacctcactttcagaagaagacaaacatgtcagctgctgctggaagtggcctggcctctatttatcttcctgatcctgatctctgttcggctgagctacccaccctatgaacaacatgaatgccattttccaaataaagccatgccctctgcaggaacacttccttgggttcaggggattatctgtaatgccaacaacccctgtttccgttacccgactcctggggaggctcccggagttgttggaaactttaacaaatccattgtggctcgcctgttctcagatgctcggaggcttcttttatacagccagaaagacaccagcatgaaggacatgcgcaaagttctgagaacattacagcagatcaagaaatccagctcaaacttgaagcttcaagatttcctggtggacaatgaaaccttctctgggttcctgtatcacaacctctctctcccaaagtctactgtggacaagatgctgagggctgatgtcattctccacaaggtatttttgcaaggctaccagttacatttgacaagtctgtgcaatggatcaaaatcagaagagatgattcaacttggtgaccaagaagtttctgagctttgtggcctaccaagggagaaactggctgcagcagagcgagtacttcgttccaacatggacatcctgaagccaatcctgagaacactaaactctacatctcccttcccgagcaaggagctggcngaagccacaaaaacattgctgcatagtcttgggactctggcccaggagctgttcagcatgagaagctggagtgacatgcgacaggaggtgatgtttctgaccaatgtgaacagctccagctcctccacccaaatctaccaggctgtgtctcgtattgtctgcgggcatcccgagggaggggggctgaagatcaagtctctcaactggtatgaggacaacaactacaaagccctctttggaggcaatggcactgaggaagatgctgaaaccttctatgacaactctacaactccttactgcaatgatttgatgaagaatttggagtctagtcctctttcccgcattatctggaaagctctgaagccgctgctcgttgggaagatcctgtatacacctgacactccagccacaaggcaggtcatggctgaggtgaacaagaccttccaggaactggctgtgttccatgatctggaaggcatgtgggaggaactcagccccaagatctggaccttcatggagaacagccaagaaatggaccttgtccggatgctgttggacagcagggacaatgaccacttttgggaacagcagttggatggcttagattggacagcccaagacatcgtggcgtttttggccaagcacccagaggatgtccagtccagtaatggttctgtgtacacctggagagaagctttcaacgagactaaccaggcaatccggaccatatctcgcttcatggagtgtgtcaacctgaacaagctagaacccatagcaacagaagtctggctcatcaacaagtccatggagctgctggatgagaggaagttctgggctggtattgtgttcactggaattactccaggcagcattgagctgccccatcatgtcaagtacaagatccgaatggacattgacaatgtggagaggacaaataaaatcaaggatgggtactgggaccctggtcctcgagctgacccctttgaggacatgcggtacgtctgggggggcttcgcctacttgcaggatgtggtggagcaggcaatcatcagggtgctgacgggcaccgagaagaaaactggtgtctatatgcaacagatgccctatccctgttacgttgatgacatctatctgggcccagcctgctggtccgctc

SEQ ID NO: 294953 - DNA, 2315 bp, Homo sapiens
  misc_feature (69)..(69): n is a, c, g, or t
  misc_feature (1160)..(1160): n is a, c, g, or t
agagcacaggctttgaccgatagtaacctctgcgctcggtgcagccgaatctataaaaggaactagtcncggcaaaaaccccgtaattgcgagcgagagtgagtggggccgggacccgcagagccgagccgacccttctctcccgggctgcggcagggcagggcggggagctccgcgcaccaacagagccggttctcagggcgctttgctccttgttttttccccggttctgttttctccccttctccggaaggcttgtcaaggggtaggagaaagagacgcaaacacaaaagtggaaaacagttaatgaccagccacggcgtccctgctgtgagctctggccgctgccttccagggctcccgagccacacgctgggggtgctggctgagggaacatggcttgttggcctcagctgaggttgctgctgtggaagaacctcactttcagaagaagacaaacatgtcagctgctgctggaagtggcctggcctctatttatcttcctgatcctgatctctgttcggctgagctacccaccctatgaacaacatgaatgccattttccaaataaagccatgccctctgcaggaacacttccttgggttcaggggattatctgtaatgccaacaacccctgtttccgttacccgactcctggggaggctcccggagttgttggaaactttaacaaatccattgtggctcgcctgttctcagatgctcggaggcttcttttatacagccagaaagacaccagcatgaaggacatgcgcaaagttctgagaacattacagcagatcaagaaatccagctcaaacttgaagcttcaagatttcctggtggacaatgaaaccttctctgggttcctgtatcacaacctctctctcccaaagtctactgtggacaagatgctgagggctgatgtcattctccacaaggtatttttgcaaggctaccagttacatttgacaagtctgtgcaatggatcaaaatcagaagagatgattcaacttggtgaccaagaagtttctgagctttgtggcctaccaagggagaaactggctgcagcagagcgagtacttcgttccaacatggacatcctgaagccaatcctgagaacactaaactctacatctcccttcccgagcaaggagctggcngaagccacaaaaacattgctgcatagtcttgggactctggcccaggagctgttcagcatgagaagctggagtgacatgcgacaggaggtgatgtttctgaccaatgtgaacagctccagctcctccacccaaatctaccaggctgtgtctcgtattgtctgcgggcatcccgagggaggggggctgaagatcaagtctctcaactggtatgaggacaacaactacaaagccctctttggaggcaatggcactgaggaagatgctgaaaccttctatgacaactctacaactccttactgcaatgatttgatgaagaatttggagtctagtcctctttcccgcattatctggaaagctctgaagccgctgctcgttgggaagatcctgtatacacctgacactccagccacaaggcaggtcatggctgaggtgaacaagaccttccaggaactggctgtgttccatgatctggaaggcatgtgggaggaactcagccccaagatctggaccttcatggagaacagccaagaaatggaccttgtccggatgctgttggacagcagggacaatgaccacttttgggaacagcagttggatggcttagattggacagcccaagacatcgtggcgtttttggccaagcacccagaggatgtccagtccagtaatggttctgtgtacacctggagagaagctttcaacgagactaaccaggcaatccggaccatatctcgcttcatggagtgtgtcaacctgaacaagctagaacccatagcaacagaagtctggctcatcaacaagtccatggagctgctggatgagaggaagttctgggctggtattgtgttcactggaattactccaggcagcattgagctgccccatcatgtcaagtacaagatccgaatggacattgacaatgtggagaggacaaataaaatcaaggatgggtactgggaccctggtcctcgagctgacccctttgaggacatgcggtacgtctgggggggcttcgcctacttgcaggatgtggtggagcaggcaatcatcagggtgctgacgggcaccgagaagaaaactggtgtctatatgcaacagatcgcaggtctcttcaagtcacgacattctaatcaggggccacatgcctggtgtgga

SEQ ID NO: 294954 - DNA, 422 bp, Homo sapiens
agcacatacatcattatgctcatccctcctaatgctcatccctccttatgctcatccctccttatgctcatcccccttagaatgtttctatttccataaggatttaggtatgctattatcccttcttataccctaagatgaagctgtttttgtgctctttgttcatcattggccctcattccaagcactttacgctgtctgtaatgggatctatttttgcactggaatatctgagaattgcaaaactagacaaaagtttcacaacagatttctaagttaaatcattttcattaaaaggaaaaaagaaaaaaaattttgtatgtcaataactttatatgaagtattaaaatgcatatttctatgttgtaatataatgagtcacaaaataaagctgtgacagttctgttggtctacaaaaaaaa

SEQ ID NO: 294955 - DNA, 1618 bp, Homo sapiens
  misc_feature (801)..(801): n is a, c, g, or t
  misc_feature (951)..(951): n is a, c, g, or t
  misc_feature (967)..(967): n is a, c, g, or t
  misc_feature (1053)..(1053): n is a, c, g, or t
tttgtggcctccttcctctcaatttatgaagagaagcagtaagatgttcctctcgggtcctctgagggacctggggagctcaggctgggaatctccaaggcagtaggtcgcttgggcgttattgttttgtttcgaggccaaggaggcttcgggaagtgctcggtttcggggactttgatccggagccccacatccccaccacttgcaactcagatgggaccggaggcggtgttaaatggggagacgatgtcctagtacgagctctggtgaccccaggactctgcgctgctgcgcttggggcttgcccgacggtggagaccggggagcatctctgggcgtggagacccgggcgcagtaccccgggctcagaggggtcgggggttcccgggcgtgctgagggcgctgctgccgggtggggagagctgcaggtccggcaccgagcgctgctttgttcggagggccctgagctggctagaaacccttctggttgcaggtcggccagtacctacggagacaaatgccagcactgagtcttcactcggttcttaagaagctggtctgttctgacctgggaattggctatatgctccccgggactggagcggcacagtcccggactgtgaatccgggaactcgagttggaggtgtcccaaacggtccgtggtgctattgctcactagaggccttgggtctttgtttgacctgaggggtagggaggtcctgcctacagtctccgtgcgctcagctgagctggtgtccctggcgcagagcgcggacgagttttgtttccttttctttttnttttttttctttcctttaagtctcggtctgtcgcccaggctggagtgcaatggaacgatctccgctcactgcaacctccgcctcccgggttcaagcgattctcctgcctcagcctcctgagtagctgggattacaggcgcgtcaccacanccagctaatttttgtntttttagtagagacggggtttcaacttgttggccaggctggtctcgaaccctcgacctcaggtgatccaccggcctcggcctcccnaagtgctgggattataggcgtgagccaccgcgcgcggccgagttttgtttcttttaaaaacaagacttaggagagcctgcggagacccggaggtggggtgcccaatcctccctctcccacgttccctgcagccccatcttccagaccgttgctgctggtctctcggggcagcttctgcctgggcgcagatggggaagctgggccgagttggtgcagtggaatgaccgggagtaaccccggcgggcggcgcagaactcggagctccgccgcggggctgggctgggctctgccgtgagggtgggggtgctgggcgcgcgggctgcggtggccccccggagactggcccgcagcgcctcctagccggaggacctaggaatcggccggctctactaggtgtctttgctcgcggttccgactgtgaatccggtgaagaccggtggttgcagacggggaggaactatgaggctgaggcaggagaatcccttgaacctgggaggccgaggttgcagtgagccgggatcgcactaccgtactccagactgggcgacagagcgagactcctctc

SEQ ID NO: 294956 - DNA, 385 bp, Homo sapiens
tgacaactcaaataatatttataaatacagccacacttaaaatggtcccattatgaaatacatatttaaatatctatacgatgtgttaaaaccaagaaaatatttgattcttctctgatatttaagaattgaaggtttgaggtagttacgtgttaggggcatttatattcatgtttttagagtttgcttatacaacttaatctttccttttcagtgctttgggctcctgggagttaatggggctggaaaatcatcaactttcaagatgttaacaggagataccactgttaccagaggagatgctttccttaacaaaaataggtgagaaaagaagtggcttgtattttgctgcaaagactttgtttttaatttatttaaagaaata

SEQ ID NO: 294957 - DNA, 335 bp, Homo sapiens
tgatgtgtctcttccttcccagttaggaaacctgctgccctacagtgatcccagcgtggtgtttgtcttcctgtccgtgtttgctgtggtgacaatcctgcagtgcttcctgattagcacactcttctccagagccaacctggcagcagcctgtgggggcatcatctacttcacgctgtacctgccctacgtcctgtgtgtggcatggcaggactacgtgggcttcacactcaagatcttcgctgtgagtacctctggcctttcttcagtggctgtaggcatttgaccttcctttggagtccctgaataaaagcagcaagttgagaacagaagat

SEQ ID NO: 294958 - DNA, 524 bp, Homo sapiens
tgggcagagcagacgcaggcccctataatagccctcatgctagaaaggagccggagcctgtgtataaggccagcgcagcctactctggacagtgcagggttcccactctcccaactccccatctgcttgcctccagacccacattcacacacgagccactgggttggaggagcatctgtgagatgaaacaccattctttcctcaatgtctcagctatctaactgtgtgtgtaatcaggccaggtcctccctgctgggcagaaaccatgggagttaagagattgccaacatttattagaggaagctgacgtgtaacttctctgaggcaaaatttagccctcctttgaacaggaatttgactcagtgaaccttgtacacactcgcactgagtctgctgctgatgatactgtgcaccccactgtctgggttttaatgtcaggctgttcttttaggtatggcggcttttccctgggtgtcagtaatactcaagcacttcctccgagtcaagaagttaatgatgccatc

SEQ ID NO: 294959 - DNA, 376 bp, Homo sapiens
gtgatcactatgtcctgaacactgtaattacttcgccatattctctgatcatagtgttttgccttggtatgtgactagaatttctttctgaggtttatgggcatggttggtgggtatgcacctgcctgcaggagcccggtttgggggcattaccttgtacctggtatgttttctttcaggtgtggttcaataacaagggctggcatgcaatcagctctttcctgaatgtcatcaacaatgccattctccgggccaacctgcaaaagggagagaaccctagccattatggaattactgctttcaatcatcccctgaatctcaccaagcagcagctctcagaggtggctctgtaagtgtggctgtgtctgtatagatg

SEQ ID NO: 294960 - DNA, 294 bp, Homo sapiens
gtattgtgttcactggaattactccaggcagcattgagctgccccatcatgtcaagtacaagatccgaatggacattgacaatgtggagaggacaaataaaatcaaggatgggtaagtggaatcccatcacaccagcctggtcttggggaggtccagagcacctattatattaggacaagaggtactttattttaactaaaaatttggtagaaatttcaacaacaacaaaaaaactcaacttggtgtcatgattttggtgaaattggtacatgacttgctggaaggtttttcat

SEQ ID NO: 294961 - DNA, 964 bp, Homo sapiens
ctcgccacctccgcgacctctgctcccagcccacttctcggtcccgctcgcggcctctcccccgcggcactcgggcaggggctcactcgagaggttttgccgccagccgctgccacccgacgggacttgttgttgccgggcaaccgtggcttccgtccccggggtcagggcccactgaccccggcgcaaagcgtcctggggcttgtagtttcggccgagggtgggctccgcggtcgccggtttctcttcccagctctgccctcgcttgctggccggtctccggggtcagcgcggggccaccatccagccccttggggcccgccccaagcagctgtcgaggacgcactcagcctgcgcagccatggcctcggcaggggcggagaggcggccgggggtccaggaggcgacggtcgtggggcagggacagctcacggaggagcccggcagcgctcagacctccgagtgtccagtggcgggagaccagttcctggtgcctgcccatgaggcccgcggaacccagagtgaagaccagcgcccagcaggcgcagcttcggagtcggagctccaggaggaaggacccaagctgggggaggagcggcccaagccgcatgccggggcgctagaggagagaggccccaggcccgtggtctccattgtgaggccccgtcatggtccaaagagaaagcctgtcaagtctctcagcctcccgggccttcgtgcccatcttaaggctgaagctgagctgccacccaagctgccgctgcaggaggaggagccagaggacagccagagtgagccctcaccatctgccaaacagcacaaaaaagccaagaagcgcaagagcctgggggctcccgtgctccacgctgtggccagcatggtgtctgcacccttagagacattgaggctggagccctctgccctgccctgggtctttgcaggaaaggcccagcgcctgcggccg

SEQ ID NO: 294962 - DNA, 690 bp, Homo sapiens
ggctctcggggggaaggagctgcagccccggggttggggcacacaccacagtaggattcctaaatcctgcactcctgcagggaggattctcgtccccagccactaccatcactctcctcccgttcctcaagagcccccgtgtagggagcagcaggagagtgggagcttcagggcttgtaggggcctgggctcactggcctctaagcctcttgggcctggggtctcattgaccaggaacgggacaggcgtcgagccctggggctgtgggcaggctgggctattccctgggccagggaatgggagccagggctggagcctggctcaagtctcttgtccctggctcaggtctctcagcctcccgggccttcgtgcccatcttaaggctgaagctgagctgccacccaagctgccgctgcaggaggaggagccagaggacagccagagtgagccctcaccatctgccaaacagcacaaaaaagccaagaagcgcaagagcctgggggctcccgtgctccacgctgtggccagcatggtgtctgcacccttagagacattgaggctggagcgtgagtggcagtccctggactgttccttctccccctgcctgtggggcccgacatggcacaacctggcgctctagcctctgccctgccctgggtctttgcaggaaaggcccagcgcctgcggccg

SEQ ID NO: 294963 - DNA, 1261 bp, Homo sapiens
ctcgccacctccgcgacctctgctcccagcccacttctcggtcccgctcgcggcctctcccccgcggcactcgggcaggggctcactcgagaggttttgccgccagccgctgccacccgacgggacttgttgttgccgggcaaccgtggcttccgtccccggggtcagggcccactgaccccggcgcaaagcgtcctggggcttgtagtttcggccgagggtgggctccgcggtcgccggtttctcttcccagctctgccctcgcttgctggccggtctccggggtcagcgcggggccaccatccagccccttggggcccgccccaagcagctgtcgaggacgcactcagcctgcgcagccatggcctcggcaggggcggagaggcggccgggggtccaggaggcgacggtcgtggggcagggacagctcacggaggagcccggcagcgctcagacctccgaggtgaccgtcaggctgtttaaccttcaaacacagggccgcagcgctctgagaggtggaactgagcgccccgacccgctaactgccaggctgggccctccaggcggggaggggcacaggctggtgtccttattcccgtttcggtgtctaacgttaggtgttcagtgacggatccctatgtcctttgcccggccatggtgaccgatggcctgtgtgtcatctctagtgtccagtggcgggagaccagttcctggtgcctgcccatgaggcccgcggaacccagagtgaagaccagcgcccagcaggcgcagcttcggagtcggagctccaggaggaaggacccaagctgggggaggagcggcccaagccgcatgccggggcgctagaggagagaggccccaggcccgtggtctccattgtgaggccccgtcatggtccaaagagaaagcctgtcaagtctctcagcctcccgggccttcgtgcccatcttaaggctgaagctgagctgccacccaagctgccgctgcaggaggaggagccagaggacagccagagtgagccctcaccatctgccaaacagcacaaaaaagccaagaagcgcaagagcctgggggctcccgtgctccacgctgtggccagcatggtgtctgcacccttagagacattgaggctggagcgtgagtggcagtccctggactgttccttctccccctgcctgtggggcccgacatggcacaacctggcgctctagcctctgccctgccctgggtctttgcaggaaaggcccagcgcctgcggccg

SEQ ID NO: 294964 - DNA, 1038 bp, Homo sapiens
ctcgccacctccgcgacctctgctcccagcccacttctcggtcccgctcgcggcctctcccccgcggcactcgggcaggggctcactcgagaggttttgccgccagccgctgccacccgacgggacttgttgttgccgggcaaccgtggcttccgtccccggggtcagggcccactgaccccggcgcaaagcgtcctggggcttgtagtttcggccgagggtgggctccgcggtcgccggtttctcttcccagctctgccctcgcttgctggccggtctccggggtcagcgcggggccaccatccagccccttggggcccgccccaagcagctgtcgaggacgcactcagcctgcgcagccatggcctcggcaggggcggagaggcggccgggggtccaggaggcgacggtcgtggggcagggacagctcacggaggagcccggcagcgctcagacctccgagtgtccagtggcgggagaccagttcctggtgcctgcccatgaggcccgcggaacccagagtgaagaccagcgcccagcaggcgcagcttcggagtcggagctccaggaggaaggacccaagctgggggaggagcggcccaagccgcatgccggggcgctagaggagagaggccccaggcccgtggtctccattgtgaggccccgtcatggtccaaagagaaagcctgtcaagtctctcagcctcccgggccttcgtgcccatcttaaggctgaagctgagctgccacccaagctgccgctgcaggaggaggagccagaggacagccagagtgagccctcaccatctgccaaacagcacaaaaaagccaagaagcgcaagagcctgggggctcccgtgctccacgctgtggccagcatggtgtctgcacccttagagacattgaggctggagcgtgagtggcagtccctggactgttccttctccccctgcctgtggggcccgacatggcacaacctggcgctctagcctctgccctgccctgggtctttgcaggaaaggcccagcgcctgcggccg

SEQ ID NO: 294965 - DNA, 890 bp, Homo sapiens
cagggccagatggcgccgcctctgcccgactcagaaagagagaaacaagagccggagcagggagaggttgggaagaggcctgggctgccgcccgagcctcgcgagcagagggacgtggagcgagcgggtggaaaccaggcggccagccagctggagggaagctggcagggcggagatgctggaccacgccgtcctgcttcaggtgatcaaagaacagcaggtgcagcaaaagcgcttgctggaccagcaggagaagctgctggcggtgatcgaggagcagcacaaggagatccaccagcagaggcaggaggacgaggaggataaacccaggcaggtggaggtgcatcaagagcccggggcagcggtgcccagaggccaggaggcccctgaaggcaaggccagggagacggtggagaatctgcctcccctgcctttggaccctgtcctcagagctcctgggggccgccctgctccatcccaggaccttaaccagcgctccctggagcactctgaggggcctgtgggcagagaccctgctggccctcctgacggcggccctgacacagagcctcgggcagcccagggcaagctgagagatggccagaaggatgccgcccccagggcagctggcactgtgaaggagctccccaagggcccggagcaggtgcccgtgccagaccccgccagggaagccgggggcccagaggagcgcctcgcagaggaattccctgggcaaagtcaggacgttactggcggttcccaagacaggaaaaactggagggggggcagcagggccagatttgaggaagcacggtcgtggcggccggcacaacggggactcctagcagatgccgacggctgaggatgcggggggagggagcacccgtgtc

SEQ ID NO: 294966 - DNA, 171 bp, Homo sapiens
aattcaagcttctaacgatgtacggggtcatggtcccaacacaggctactgtgagagccagcatccaaccccacgcttgcagtgactcagaatgataattattatgactgtttatcgatgcttcccacagtgtggtagaaagtcttgaataaacacttttgccttcaccca

SEQ ID NO: 294967 - DNA, 2671 bp, Homo sapiens
tgtttttgtggagatgggggtcttgctatgtttcccaggctggtctctaactcctgggctcaagcgatctgcctgcctccgcctcccaaattgctgggattacaggcgtgagccgccgtgcccaggcttattttcttacgtgcttgtcctagaacaactgaatgtgtaaagtggaaaaaacaaaaacaaaaccccacccagcccagataaccatctctgacattctggcacattccttttgactgttgctctggacactcacttccatgggcaacgagcaggcttgctggggtcctgccgggtgcgcctggggcacagccagtgggagaactgatgcggcacagtggctggctgtgcgggagaggccatcccgggtgggcttccaggggcagtcagggcgcagcctctcccgggccctcaggcctgcgtgcatcactgagctgtccgggcttcacggtcacagtcatgatgggtgtcaccagtggccagtgttcgggcacactccctgcaggtgacctgtgcgttgccttgctgtgggccgcgccgtccctggcccagcacggtgcatgagcagcccgggcactctgactgtgtgctttccaaacccagaagctggcagggcggagatgctggaccacgccgtcctgcttcaggtgatcaaagaacagcaggtgcagcaaaagcgcttgctggaccagcaggagaagctgctggcggtgatcgaggagcagcacaaggagatccaccagcagaggcaggaggacgaggaggataaacccaggcagggtaggccgggctggcggatggagtggggtggggccaggcagggggtctcctgctgtcctcatgcggctgggtctgaggctcggtggcctctagacctgagcgtgagtctggttttggttcccaatgctgttgttgctggttcttctgagcccctccactggcagcctgtgtacagtgctgtggctaaattgatgatcgacttcatttgcagtggaggtgcatcaagagcccggggcagcggtgcccagaggccaggaggcccctgaaggcaaggccagggagacggtggagaatctgcctcccctgcctttggaccctgtcctcagagctcctgggggccgccctgctccatcccaggaccttaaccagcgctccctggagcactctgaggggcctgtgggcagagaccctgctggccctcctgacggcggccctgacacagagcctcgggcagcccagggcaagctgagagatggccagaaggatgccgcccccagggcagctggcactgtgaaggagctccccaagggcccggagcaggtgcccgtgccagaccccgccagggaagccgggggcccagaggagcgcctcgcagaggaattccctgggcaaagtcaggacgttactggcggttcccaagacaggaaaaaacctgggaaggaggtggcagccactggcaccagcattctgaaggaagccaactggctcgtggcagggccaggagcagagacgggggaccctcgcatgaagcccaagcaagtgagccgagacctgggccttgcagcggacctgcccggtggggcggaaggagcagctgcacagccccaggctgtgttacgccagccggaactgcgggtcatctctgatggcgagcagggtggacagcagggccaccggctggaccatggcggtcacctggagatgagaaaggcccgcgggggggaccatgtgcctgtgtcccacgagcagccgagaggcggggaggacgctgctgtccaggagcccaggcagaggccagagccagagctggggctcaaacgagctgtcccggggggccagaggccggacaatgccaagcccaaccgggacctgaaactgcaggctggctccgacctccggaggcgacggcgggaccttggccctcatgcagagggtcagctggccccgagggatggggtcatcattggccttaaccccctgcctgatgtccaggtgaacgacctccgtggcgccctggatgcccagctccgccaggctgcggggggagctctgcaggtggtccacagccggcagcttagacaggcgcctgggcctccagaggagtcctagcacctgctggccatgagggccacgccagccactgccctcctcggccagcagcaggtctgtctcagccgcatcccagccaaactctggaggtcacactcgcctctccccagggtttcatgtctgaggccctcaccaagtgtgagtgacagtataaaagattcactgtggcatcgtttccagaatgttcttgctgtcgttctgttgcagctcttagtctgaggtcctctgacctctagactctgagctcactccagcctgtgaggagaaacggcctccgctgcgagctggctggtgcactcccaggctcaggctggggagctgctgcgtctgtggtcaggcctcctgctcctgccagggagcacgcgtggtcttcgggttgagctcggccgtgcgtggaggtgcgcatggctgctcatggtcccaacacaggctactgtgagagccagcatccaaccccacgcttgcagtgactcagaatgataattattatgactgtttatcgatgcttcccacagtgtggtagaaagtcttgaataaacacttttgccttcaccca

SEQ ID NO: 294968 - DNA, 2526 bp, Homo sapiens
cagggccagatggcgccgcctctgcccgactcagaaagagagaaacaagagccggagcagggagaggttgggaagaggcctggacaggcccaggccttggaggaggcgggtgatcttcctgaagatccccagaaagttccagaagcagatggtcagccagctgtccagcctgcaaaggaggacctggggccaggagacaggtgcctgcatcctcggccccaggcagtgctgtctgagcagcagaacggcctggcggtgggtggaggggaaaaggccaaggggggaccgccgccaggcaacgccgccggggacacagggcagcccgcagaggacagcgaccacggtgggaagcctcccctcccagcggagaagccggctccagggcctgggctgccgcccgagcctcgcgagcagagggacgtggagcgagcgggtggaaaccaggcggccagccagctggagggaagctggcagggcggagatgctggaccacgccgtcctgcttcaggtgatcaaagaacagcaggtgcagcaaaagcgcttgctggaccagcaggagaagctgctggcggtgatcgaggagcagcacaaggagatccaccagcagaggcaggaggacgaggaggataaacccaggcagggtaggccgggctggcggatggagtggggtggggccaggcagggggtctcctgctgtcctcatgcggctgggtctgaggctcggtggcctctagacctgagcgtgagtctggttttggttcccaatgctgttgttgctggttcttctgagcccctccactggcagcctgtgtacagtgctgtggctaaattgatgatcgacttcatttgcagtggaggtgcatcaagagcccggggcagcggtgcccagaggccaggaggcccctgaaggcaaggccagggagacggtggagaatctgcctcccctgcctttggaccctgtcctcagagctcctgggggccgccctgctccatcccaggaccttaaccagcgctccctggagcactctgaggggcctgtgggcagagaccctgctggccctcctgacggcggccctgacacagagcctcgggcagcccagggcaagctgagagatggccagaaggatgccgcccccagggcagctggcactgtgaaggagctccccaagggcccggagcaggtgcccgtgccagaccccgccagggaagccgggggcccagaggagcgcctcgcagaggaattccctgggcaaagtcaggacgttactggcggttcccaagacaggaaaaaacctgggaaggaggtggcagccactggcaccagcattctgaaggaagccaactggctcgtggcagggccaggagcagagacgggggaccctcgcatgaagcccaagcaagtgagccgagacctgggccttgcagcggacctgcccggtggggcggaaggagcagctgcacagccccaggctgtgttacgccagccggaactgcgggtcatctctgatggcgagcagggtggacagcagggccaccggctggaccatggcggtcacctggagatgagaaaggcccgcgggggggaccatgtgcctgtgtcccacgagcagccgagaggcggggaggacgctgctgtccaggagcccaggcagaggccagagccagagctggggctcaaacgagctgtcccggggggccagaggccggacaatgccaagcccaaccgggacctgaaactgcaggctggctccgacctccggaggcgacggcgggaccttggccctcatgcagagggtcagctggccccgagggatggggtcatcattggccttaaccccctgcctgatgtccaggtgaacgacctccgtggcgccctggatgcccagctccgccaggctgcggggggagctctgcaggtggtccacagccggcagcttagacaggcgcctgggcctccagaggagtcctagcacctgctggccatgagggccacgccagccactgccctcctcggccagcagcaggtctgtctcagccgcatcccagccaaactctggaggtcacactcgcctctccccagggtttcatgtctgaggccctcaccaagtgtgagtgacagtataaaagattcactgtggcatcgtttccagaatgttcttgctgtcgttctgttgcagctcttagtctgaggtcctctgacctctagactctgagctcactccagcctgtgaggagaaacggcctccgctgcgagctggctggtgcactcccaggctcaggctggggagctgctgcgtctgtggtcaggcctcctgctcctgccagggagcacgcgtggtcttcgggttgagctcggccgtgcgtggaggtgcgcatggctgctcatggtcccaacacaggctactgtgagagccagcatccaaccccacgcttgcagtgactcagaatgataattattatgactgtttatcgatgcttcccacagtgtggtagaaagtcttgaataaacacttttgccttcaccca

SEQ ID NO: 294969 - DNA, 2315 bp, Homo sapiens
cagggccagatggcgccgcctctgcccgactcagaaagagagaaacaagagccggagcagggagaggttgggaagaggcctggacaggcccaggccttggaggaggcgggtgatcttcctgaagatccccagaaagttccagaagcagatggtcagccagctgtccagcctgcaaaggaggacctggggccaggagacaggtgcctgcatcctcggccccaggcagtgctgtctgagcagcagaacggcctggcggtgggtggaggggaaaaggccaaggggggaccgccgccaggcaacgccgccggggacacagggcagcccgcagaggacagcgaccacggtgggaagcctcccctcccagcggagaagccggctccagggcctgggctgccgcccgagcctcgcgagcagagggacgtggagcgagcgggtggaaaccaggcggccagccagctggagggaagctggcagggcggagatgctggaccacgccgtcctgcttcaggtgatcaaagaacagcaggtgcagcaaaagcgcttgctggaccagcaggagaagctgctggcggtgatcgaggagcagcacaaggagatccaccagcagaggcaggaggacgaggaggataaacccaggcaggtggaggtgcatcaagagcccggggcagcggtgcccagaggccaggaggcccctgaaggcaaggccagggagacggtggagaatctgcctcccctgcctttggaccctgtcctcagagctcctgggggccgccctgctccatcccaggaccttaaccagcgctccctggagcactctgaggggcctgtgggcagagaccctgctggccctcctgacggcggccctgacacagagcctcgggcagcccagggcaagctgagagatggccagaaggatgccgcccccagggcagctggcactgtgaaggagctccccaagggcccggagcaggtgcccgtgccagaccccgccagggaagccgggggcccagaggagcgcctcgcagaggaattccctgggcaaagtcaggacgttactggcggttcccaagacaggaaaaaacctgggaaggaggtggcagccactggcaccagcattctgaaggaagccaactggctcgtggcagggccaggagcagagacgggggaccctcgcatgaagcccaagcaagtgagccgagacctgggccttgcagcggacctgcccggtggggcggaaggagcagctgcacagccccaggctgtgttacgccagccggaactgcgggtcatctctgatggcgagcagggtggacagcagggccaccggctggaccatggcggtcacctggagatgagaaaggcccgcgggggggaccatgtgcctgtgtcccacgagcagccgagaggcggggaggacgctgctgtccaggagcccaggcagaggccagagccagagctggggctcaaacgagctgtcccggggggccagaggccggacaatgccaagcccaaccgggacctgaaactgcaggctggctccgacctccggaggcgacggcgggaccttggccctcatgcagagggtcagctggccccgagggatggggtcatcattggccttaaccccctgcctgatgtccaggtgaacgacctccgtggcgccctggatgcccagctccgccaggctgcggggggagctctgcaggtggtccacagccggcagcttagacaggcgcctgggcctccagaggagtcctagcacctgctggccatgagggccacgccagccactgccctcctcggccagcagcaggtctgtctcagccgcatcccagccaaactctggaggtcacactcgcctctccccagggtttcatgtctgaggccctcaccaagtgtgagtgacagtataaaagattcactgtggcatcgtttccagaatgttcttgctgtcgttctgttgcagctcttagtctgaggtcctctgacctctagactctgagctcactccagcctgtgaggagaaacggcctccgctgcgagctggctggtgcactcccaggctcaggctggggagctgctgcgtctgtggtcaggcctcctgctcctgccagggagcacgcgtggtcttcgggttgagctcggccgtgcgtggaggtgcgcatggctgctcatggtcccaacacaggctactgtgagagccagcatccaaccccacgcttgcagtgactcagaatgataattattatgactgtttatcgatgcttcccacagtgtggtagaaagtcttgaataaacacttttgccttcaccca

SEQ ID NO: 294970 - DNA, 2335 bp, Homo sapiens
cagggccagatggcgccgcctctgcccgactcagaaagagagaaacaagagccggagcagggagaggttgggaagaggcctggacaggcccaggccttggaggaggcgggtgatcttcctgaagatccccagaaagttccagaagcagatggtcagccagctgtccagcctgcaaaggaggacctggggccaggagacaggtgcctgcatcctcggccccaggcagtgctgtctgagcagcagaacggcctggcggtgggtggaggggaaaaggccaaggggggaccgccgccaggcaacgccgccggggacacagggcagcccgcagaggacagcgaccacggtgggaagcctcccctcccagcggagaagccggctccagggcctgggctgccgcccgagcctcgcgagcagagggacgtggagcgagcgggtggaaaccaggcggccagccagctggaggctgaaattaaaaagatagtagaagctggcagggcggagatgctggaccacgccgtcctgcttcaggtgatcaaagaacagcaggtgcagcaaaagcgcttgctggaccagcaggagaagctgctggcggtgatcgaggagcagcacaaggagatccaccagcagaggcaggaggacgaggaggataaacccaggcaggtggaggtgcatcaagagcccggggcagcggtgcccagaggccaggaggcccctgaaggcaaggccagggagacggtggagaatctgcctcccctgcctttggaccctgtcctcagagctcctgggggccgccctgctccatcccaggaccttaaccagcgctccctggagcactctgaggggcctgtgggcagagaccctgctggccctcctgacggcggccctgacacagagcctcgggcagcccagggcaagctgagagatggccagaaggatgccgcccccagggcagctggcactgtgaaggagctccccaagggcccggagcaggtgcccgtgccagaccccgccagggaagccgggggcccagaggagcgcctcgcagaggaattccctgggcaaagtcaggacgttactggcggttcccaagacaggaaaaaacctgggaaggaggtggcagccactggcaccagcattctgaaggaagccaactggctcgtggcagggccaggagcagagacgggggaccctcgcatgaagcccaagcaagtgagccgagacctgggccttgcagcggacctgcccggtggggcggaaggagcagctgcacagccccaggctgtgttacgccagccggaactgcgggtcatctctgatggcgagcagggtggacagcagggccaccggctggaccatggcggtcacctggagatgagaaaggcccgcgggggggaccatgtgcctgtgtcccacgagcagccgagaggcggggaggacgctgctgtccaggagcccaggcagaggccagagccagagctggggctcaaacgagctgtcccggggggccagaggccggacaatgccaagcccaaccgggacctgaaactgcaggctggctccgacctccggaggcgacggcgggaccttggccctcatgcagagggtcagctggccccgagggatggggtcatcattggccttaaccccctgcctgatgtccaggtgaacgacctccgtggcgccctggatgcccagctccgccaggctgcggggggagctctgcaggtggtccacagccggcagcttagacaggcgcctgggcctccagaggagtcctagcacctgctggccatgagggccacgccagccactgccctcctcggccagcagcaggtctgtctcagccgcatcccagccaaactctggaggtcacactcgcctctccccagggtttcatgtctgaggccctcaccaagtgtgagtgacagtataaaagattcactgtggcatcgtttccagaatgttcttgctgtcgttctgttgcagctcttagtctgaggtcctctgacctctagactctgagctcactccagcctgtgaggagaaacggcctccgctgcgagctggctggtgcactcccaggctcaggctggggagctgctgcgtctgtggtcaggcctcctgctcctgccagggagcacgcgtggtcttcgggttgagctcggccgtgcgtggaggtgcgcatggctgctcatggtcccaacacaggctactgtgagagccagcatccaaccccacgcttgcagtgactcagaatgataattattatgactgtttatcgatgcttcccacagtgtggtagaaagtcttgaataaacacttttgccttcaccca

SEQ ID NO: 294971 - DNA, 2813 bp, Homo sapiens
tgtttttgtggagatgggggtcttgctatgtttcccaggctggtctctaactcctgggctcaagcgatctgcctgcctccgcctcccaaattgctgggattacaggcgtgagccgccgtgcccaggcttattttcttacgtgcttgtcctagaacaactgaatgtgtaaagtggaaaaaacaaaaacaaaaccccacccagcccagataaccatctctgacattctggcacattccttttgactgttgctctggacactcacttccatgggcaacgagcaggcttgctggggtcctgccgggtgcgcctggggcacagccagtgggagaactgatgcggcacagtggctggctgtgcgggagaggccatcccgggtgggcttccaggggcagtcagggcgcagcctctcccgggccctcaggcctgcgtgcatcactgagctgtccgggcttcacggtcacagtcatgatgggtgtcaccagtggccagtgttcgggcacactccctgcaggtgacctgtgcgttgccttgctgtgggccgcgccgtccctggcccagcacggtgcatgagcagcccgggcactctgactgtgtgctttccaaacccagaagctggcagggcggagatgctggaccacgccgtcctgcttcaggtgatcaaagaacagcaggtgcagcaaaagcgcttgctggaccagcaggagaagctgctggcggtgatcgaggagcagcacaaggagatccaccagcagaggcaggaggacgaggaggataaacccaggcagggtaggccgggctggcggatggagtggggtggggccaggcagggggtctcctgctgtcctcatgcggctgggtctgaggctcggtggcctctagacctgagcgtgagtctggttttggttcccaatgctgttgttgctggttcttctgagcccctccactggcagcctgtgtacagtgctgtggctaaattgatgatcgacttcatttgcagtggaggtgcatcaagagcccggggcagcggtgcccagaggccaggaggcccctgaaggcaaggccagggagacggtggagaatctgcctcccctgcctttggaccctgtcctcagagctcctgggggccgccctgctccatcccaggaccttaaccagcgctccctggagcactctgaggggcctgtgggcagagaccctgctggccctcctgacggcggccctgacacagagcctcgggcagcccagggcaagctgagagatggccagaaggatgccgcccccagggcagctggcactgtgaaggagctccccaagggcccggagcaggtgcccgtgccagaccccgccagggaagccgggggcccagaggagcgcctcgcagaggaattccctgggcaaagtcaggacgttactggcggttcccaagacaggaaaaaacctgggaaggaggtggcagccactggcaccagcattctgaaggaagccaactggctcgtggcagggccaggagcagagacgggggaccctcgcatgaagcccaagcaagtgagccgagacctgggccttgcagcggacctgcccggtggggcggaaggagcagctgcacagccccaggctgtgttacgccagccggaactgcgggtcatctctgatggcgagcagggtggacagcagggccaccggctggaccatggcggtcacctggagatgagaaaggcccgcgggggggaccatgtgcctgtgtcccacgagcagccgagaggcggggaggacgctgctgtccaggagcccaggcagaggccagagccagagctggggctcaaacgagctgtcccggggggccagaggccggacaatgccaagcccaaccgggacctgaaactgcaggctggctccgacctccggaggcgacggcgggaccttggccctcatgcagagggtcagctggccccgagggatggggtcatcattggccttaaccccctgcctgatgtccaggtgaacgacctccgtggcgccctggatgcccagctccgccaggctgcggggggagctctgcaggtggtccacagccggcagcttagacaggcgcctgggcctccagaggagtcctagcacctgctggccatgagggccacgccagccactgccctcctcggccagcagcaggtctgtctcagccgcatcccagccaaactctggaggtcacactcgcctctccccagggtttcatgtctgaggccctcaccaagtgtgagtgacagtataaaagattcactgtggcatcgtttccagaatgttcttgctgtcgttctgttgcagctcttagtctgaggtcctctgacctctagactctgagctcactccagcctgtgaggagaaacggcctccgctgcgagctggctggtgcactcccaggctcaggctggggagctgctgcgtctgtggtcaggcctcctgctcctgccagggagcacgcgtggtcttcgggttgagctcggccgtgcgtggaggtgcgcatggctgctcatggtcccaacacaggctactgtgagagccagcatccaaccccacgcttgcagtgactcagaatgataattattatgactgtttatcgatgcttcccacagtgtggtagaaagtcttgaataaacacttttgccttcacccaaaaaaaaaaaaaaaaatgacaaaaaaaagggggggtcttattgtgggggggaaaaaaaggaataagggcgggtgaagttcggcacccttttgaagggggagaatgggggccaaaaaggggggaaatgaaaacggccgaaaag

SEQ ID NO: 294972 - DNA, 3645 bp, Homo sapiens
tgtttttgtggagatgggggtcttgctatgtttcccaggctggtctctaactcctgggctcaagcgatctgcctgcctccgcctcccaaattgctgggattacaggcgtgagccgccgtgcccaggcttattttcttacgtgcttgtcctagaacaactgaatgtgtaaagtggaaaaaacaaaaacaaaaccccacccagcccagataaccatctctgacattctggcacattccttttgactgttgctctggacactcacttccatgggcaacgagcaggcttgctggggtcctgccgggtgcgcctggggcacagccagtgggagaactgatgcggcacagtggctggctgtgcgggagaggccatcccgggtgggcttccaggggcagtcagggcgcagcctctcccgggccctcaggcctgcgtgcatcactgagctgtccgggcttcacggtcacagtcatgatgggtgtcaccagtggccagtgttcgggcacactccctgcaggtgacctgtgcgttgccttgctgtgggccgcgccgtccctggcccagcacggtgcatgagcagcccgggcactctgactgtgtgctttccaaacccagaagctggcagggcggagatgctggaccacgccgtcctgcttcaggtgatcaaagaacagcaggtgcagcaaaagcgcttgctggaccagcaggagaagctgctggcggtgatcgaggagcagcacaaggagatccaccagcagaggcaggaggacgaggaggataaacccaggcagggtaggccgggctggcggatggagtggggtggggccaggcagggggtctcctgctgtcctcatgcggctgggtctgaggctcggtggcctctagacctgagcgtgagtctggttttggttcccaatgctgttgttgctggttcttctgagcccctccactggcagcctgtgtacagtgctgtggctaaattgatgatcgacttcatttgcagtggaggtgcatcaagagcccggggcagcggtgcccagaggccaggaggcccctgaaggcaaggccagggagacggtggagaatctgcctcccctgcctttggaccctgtcctcagagctcctgggggccgccctgctccatcccaggaccttaaccagcgctccctggagcactctgaggggcctgtgggcagagaccctgctggccctcctgacggcggccctgacacagagcctcgggcagcccagggcaagctgagagatggccagaaggatgccgcccccagggcagctggcactgtgaaggagctccccaagggcccggagcaggtgcccgtgccagaccccgccagggaagccgggggcccagaggagcgcctcgcagaggaattccctgggcaaagtcaggacgttactggcggttcccaagacaggaaaaaacctgggaaggaggtggcagccactggcaccagcattctgaaggaagccaactggctcgtggcagggccaggagcagagacgggggaccctcgcatgaagcccaagcaagtgagccgagacctgggccttgcagcggacctgcccggtggggcggaaggagcagctgcacagccccaggctgtgttacgccagccggaactgcgggtcatctctgatggcgagcagggtggacagcagggccaccggctggaccatggcggtcacctggagatgagaaaggcccgcgggggggaccatgtgcctgtgtcccacgagcagccgagaggcggggaggacgctgctgtccaggagcccaggcagaggccagagccagagctggggctcaaacgagctgtcccggggggccagaggccggacaatgccaagcccaaccgggacctgaaactgcaggctggctccgacctccggaggcgacggcgggaccttggccctcatgcagagggtcagctggccccgagggatggggtcatcattggccttaaccccctgcctgatgtccaggtgaacgacctccgtggcgccctggatgcccagctccgccaggctgcggggggagctctgcaggtggtccacagccggcagcttagacaggcgcctgggcctccagaggagtcctagcacctgctggccatgagggccacgccagccactgccctcctcggccagcagcaggtctgtctcagccgcatcccagccaaactctggaggtcacactcgcctctccccagggtttcatgtctgaggccctcaccaagtgtgagtgacagtataaaagattcactgtggcatcgtttccagaatgttcttgctgtcgttctgttgcagctcttagtctgaggtcctctgacctctagactctgagctcactccagcctgtgaggagaaacggcctccgctgcgagctggctggtgcactcccaggctcaggctggggagctgctgcgtctgtggtcaggcctcctgctcctgccagggagcacgcgtggtcttcgggttgagctcggccgtgcgtggaggtgcgcatggctgctcatggtcccaacacaggctactgtgagagccagcatccaaccccacgcttgcagtgactcagaatgataattattatgactgtttatcgatgcttcccacagtgtggtagaaagtcttgaataaacacttttgccttcacccagcctcggtggatgctgtttggtgtccaggaagcacagggagcaggggccagacaagccgggtgtccaggggcactggccggtgccaccctttgcactcctcatggttggcccagccctccattgtctgtgtttttcaaaatccaattgtggctttttttaaaaagtaaaaaacaccactgataacctgattagtgaagttggtcctgggggagtgactgaaaggaaagcctgaggccggctcaggattccagatgtgtaaagcagaggccagaggtcatgagggaacggcgccatgacctgagcgtcgcagtgactggacactagacgcagcacagccccagagagaccctgtgagcaggcagagccgcctggtgccaggaggtggtccagcccccagggccaggctgacgggcgtgctgcctcgtgaccaggacacgctccacagccctctcacctggcgggagagaggaggtgctgctgtgtccacagcatccgagtctgctttggctcgtcctctggggagcttgcgccccaaccctgccacgaaaccctgccacgaagggcagaggaccagggcctgggtctgggggaggcccgtgttggcgaagggtccctgcatggagggccggcctcagcctctggtggtgtcttcctgcaccttttgatatccttttggctctttattatagtttcttcccttgaaggatgtcactgggcagcctgaagactggaaattttttttcttttgagacggagtctcgctctgtcacccaggctggagtgcagtggtgtgatctcggctcactgcaagctccgcctcccgggttcacgccattctcctgcctcagcctcccgagtagctgggactacaggcgcccgccaccacgcccggctaatttttttttccgtatttttagtagagactgggtttcaccatgttggtcaggctggtctcgaactcctgaccttgtga

SEQ ID NO: 294973 - DNA, 2657 bp, Homo sapiens
tgtttttgtggagatgggggtcttgctatgtttcccaggctggtctctaactcctgggctcaagcgatctgcctgcctccgcctcccaaattgctgggattacaggcgtgagccgccgtgcccaggcttattttcttacgtgcttgtcctagaacaactgaatgtgtaaagtggaaaaaacaaaaacaaaaccccacccagcccagataaccatctctgacattctggcacattccttttgactgttgctctggacactcacttccatgggcaacgagcaggcttgctggggtcctgccgggtgcgcctggggcacagccagtgggagaactgatgcggcacagtggctggctgtgcgggagaggccatcccgggtgggcttccaggggcagtcagggcgcagcctctcccgggccctcaggcctgcgtgcatcactgagctgtccgggcttcacggtcacagtcatgatgggtgtcaccagtggccagtgttcgggcacactccctgcaggtgacctgtgcgttgccttgctgtgggccgcgccgtccctggcccagcacggtgcatgagcagcccgggcactctgactgtgtgctttccaaacccagaagctggcagggcggagatgctggaccacgccgtcctgcttcaggtgatcaaagaacagcaggtgcagcaaaagcgcttgctggaccagcaggagaagctgctggcggtgatcgaggagcagcacaaggagatccaccagcagaggcaggaggacgaggaggataaacccaggcagggtaggccgggctggcggatggagtggggtggggccaggcagggggtctcctgctgtcctcatgcggctgggtctgaggctcggtggcctctagacctgagcgtgagtctggttttggttcccaatgctgttgttgctggttcttctgagcccctccactggcagcctgtgtacagtgctgtggctaaattgatgatcgacttcatttgcagtggaggtgcatcaagagcccggggcagcggtgcccagaggccaggaggcccctgaaggcaaggccagggagacggtggagaatctgcctcccctgcctttggaccctgtcctcagagctcctgggggccgccctgctccatcccaggaccttaaccagcgctccctggagcactctgaggggcctgtgggcagagaccctgctggccctcctgacggcggccctgacacagagcctcgggcagcccagggcaagctgagagatggccagaaggatgccgcccccagggcagctggcactgtgaaggagctccccaagggcccggagcaggtgcccgtgccagaccccgccagggaagccgggggcccagaggagcgcctcgcagaggaattccctgggcaaagtcaggacgttactggcggttcccaagacaggaaaaaacctgggaaggaggtggcagccactggcaccagcattctgaaggaagccaactggctcgtggcagggccaggagcagagacgggggaccctcgcatgaagcccaagcaagtgagccgagacctgggccttgcagcggacctgcccggtggggcggaaggagcagctgcacagccccaggctgtgttacgccagccggaactgcgggtcatctctgatggcgagcagggtggacagcagggccaccggctggaccatggcggtcacctggagatgagaaaggcccgcgggggggaccatgtgcctgtgtcccacgagcagccgagaggcggggaggacgctgctgtccaggagcccaggcagaggccagagccagagctggggctcaaacgagctgtcccggggggccagaggccggacaatgccaagcccaaccgggacctgaaactgcaggctggctccgacctccggaggcgacggcgggaccttggccctcatgcagagggtcagctggccccgagggatggggtcatcattggccttaaccccctgcctgatgtccaggtgaacgacctccgtggcgccctggatgcccagctccgccaggctgcggggggagctctgcaggtggtccacagccggcagcttagacaggcgcctgggcctccagaggagtcctagcacctgctggccatgagggccacgccagccactgccctcctcggccagcagcaggtctgtctcagccgcatcccagccaaactctggaggtcacactcgcctctccccagggtttcatgtctgaggccctcaccaagtgtgagtgacagtataaaagattcactgtggcatcgtttccagaatgttcttgctgtcgttctgttgcagctcttagtctgaggtcctctgacctctagactctgagctcactccagcctgtgaggagaaacggcctccgctgcgagctggctggtgcactcccaggctcaggctggggagctgctgcgtctgtggtagggccctgtccggcaggaccccggtttcgcgtgagccgcagcttagggcccaggtcttgtcacgcctttggacactccgcctgtggttgctcatatttatggttactcccgcgcgatacataatgtgtcaccaaagagggggcggccaactatatgatgagtagaggagtacccagtgagccatatttatattatttcgcgcgccgc

SEQ ID NO: 294974 - DNA, 1127 bp, Homo sapiens
gctgggattctgggagaagagacctatattctaacgactgggggcggaaggagcagctgcacagccccaggctgtgttacgccagccggaactgcgggtcatctctgatggcgagcagggtggacagcagggccaccggctggaccatggcggtcacctggagatgagaaaggcccgcgggggggaccatgtgcctgtgtcccacgagcagccgagaggcggggaggacgctgctgtccaggagcccaggcagaggccagagccagagctggggctcaaacgagctgtcccggggggccagaggccggacaatgccaagcccaaccgggacctgaaactgcaggctggctccgacctccggaggcgacggcgggaccttggccctcatgcagagggtcagctggccccgagggatggggtcatcattggccttaaccccctgcctgatgtccaggtgaacgacctccgtggcgccctggatgcccagctccgccaggctgcggggggagctctgcaggtggtccacagccggcagcttagacaggcgcctgggcctccagaggagtcctagcacctgctggccatgagggccacgccagccactgccctcctcggccagcagcaggtctgtctcagccgcatcccagccaaactctggaggtcacactcgcctctccccagggtttcatgtctgaggccctcaccaagtgtgagtgacagtataaaagattcactgtggcatcgtttccagaatgttcttgctgtcgttctgttgcagctcttagtctgaggtcctctgacctctagactctgagctcactccagcctgtgaggagaaacggcctccgctgcgagctggctggtgcactcccaggctcaggctggggagctgctgcgtctgtggtcaggcctcctgctcctgccagggagcacgcgtggtcttcgggttgagctcggccgtgcgtggaggtgcgcatggctgctcatggtcccaacacaggctactgtgagagccagcatccaaccccacgcttgcagtgactcagaatgataattattatgactgtttatcgatgcttcccacagtgtggtagaaagtcttgaataaacacttttgccttcaccca

SEQ ID NO: 294975 - DNA, 582 bp, Homo sapiens
ggatttgctggtgcagtacaactaggcttaatagggacatgagggccacgccagccactgccctcctcggccagcagcaggtctgtctcagccgcatcccagccaaactctggaggtcacactcgcctctccccagggtttcatgtctgaggccctcaccaagtgtgagtgacagtataaaagattcactgtggcatcgtttccagaatgttcttgctgtcgttctgttgcagctcttagtctgaggtcctctgacctctagactctgagctcactccagcctgtgaggagaaacggcctccgctgcgagctggctggtgcactcccaggctcaggctggggagctgctgcgtctgtggtcaggcctcctgctcctgccagggagcacgcgtggtcttcgggttgagctcggccgtgcgtggaggtgcgcatggctgctcatggtcccaacacaggctactgtgagagccagcatccaaccccacgcttgcagtgactcagaatgataattattatgactgtttatcgatgcttcccacagtgtggtagaaagtcttgaataaacacttttgccttcaccca

SEQ ID NO: 294976 - DNA, 650 bp, Homo sapiens
cgggctgcaggaattcggcacgttgtgaggattaagtgaaatgtgttaaatgcctactacagtaggtgctcagatatttatttttatttttttattatgcacattgtttttcctgcctttttatggctgtctaaagtctagggaaaagggaagactggttaatgatgagtagaaaaaacttgtaagctaatcattcactgacttattttccttccattttctggtttttaaaattagccacaccacaggaaacccacatttttagatggaaagagcaagaaaattgtgtcagtgctcttagttattttcatcttaatggtatagtgaaaagacattgacttgagatgatactaaggaagctttggctcactctcacttgaagaggggatcttggtgttgtagtacttggactgtacaaatgttttactgacttttcttactgctgtaaaggaatcaggcagttgggtattgatatgttatttggtgctctcattcatggcaaaggatttgataaataaaagttctttaaacactaaagcaaaatcaaatgagcaaaactaaggatgaaatgtaatattcatcagaacaaggatcactgagaaaaaatattcagaaacaactttaataaaacctgaattgaaataactgca

SEQ ID NO: 294977 - DNA, 992 bp, Homo sapiens
agcgttcctgtccggaagtcctgagagggaaacgcccgcaaaggctggtttttaagcgggagcatctcttcactcgcagcaagtgcgcgtgcgctgcctctcagcccaaattggaaacatggccgtacggtcgctgtgggcgggccggctgcgggtgcagcgcctactggcctggagtgccgcgtgggagagcaagggatggccgcttccattcagcactgccacccagagaactgctggtgaggactgccgttctgaggaccctcctgatgagcttgggccccctcttgctgaacgagccttaagggtaaaagctgttaaactggagaaagaagtccaagatttaacagtgagataccagagagctatagctgattgtgaaaacataaggaggcgaacccagagatgtgtggaagacgccaagatatttggaatccagagtttctgtaaggacttggtggaggtggctgacattttggagaagactacagagtgcatttctgaagaatcggagcctgaggaccaaaagctcactctggagaaggtcttccgagggttgttgcttttagaagcaaagctgaaaagtgtgtttgccaagcatggcctggagaaactgacacccattggtgacaaatatgacccccatgagcatgaactcatctgtcatgtgccagctggtgttggggtgcagcctggcaccgtggcattagtaagacaagatggctacaaacttcatggccgcaccattaggcttgcccgagtggaagtggcagtggagtctcagagaagactgtgaagaggccatcaggaactggatgttctcccagagcgcagtcacctatgtttcttttatttattaaactaggttggatggacatggagggtactcagggaactggtgcgggctacaccacacggggtcaaccaagacatcaaatggtacacgttgactggtgggctctcgaagctacacaggttgggccgggaccggt

SEQ ID NO: 294978 - DNA, 491 bp, Homo sapiens
aaaaataaaaataaatatctgagcacctactgtagtaggcatttaacacatttcacttaatcctcacaacgctgtgaaagaattattataatcattttacgaataaagaaacaggctcagaagggtgaaatcactggtgcctaaagtcctgcaggtgactgagctgagatttaagttcaagcctatgctctaatatgctgctttggctcactctcacttgaagaggggatcttggtgttgtagtacttggactgtacaaatgttttactgacttttcttactgctgtaaaggaatcaggcagttgggtattgatatgttatttggtgctctcattcatggcaaaggatttgataaataaaagttctttaaacactaaagcaaaatcaaatgagcaaaactaaggatgaaatgtaatattcatcagaacaaggatcactgagaaaaaatattcagaaacaactttaataaaacctgaattgaaataactgca

SEQ ID NO: 294979 - DNA, 624 bp, Homo sapiens
agagacggggtctcagagtctcattatgttgcccaggctggtctcaaactcctggcctaagcgatcctcccgcctgaccttccaaaatgctgggattacaggcttgagccacccccagcctccggattttctttattctgaaactcatccctaactttattttctgccagaggaagtctgtttttcacagcgtgataaactagcaagtctgagctgctgctcttgtcttcttagaggatgaaaatgggagtttatccctccttttctcctttctgaaaagagagtagatgaaaccttcccccgccttttggtttttaggaagcagaaagcagagatattaactatataaaaactgcaaacacataaataacagcagtatagaaagcatagggcttgtgtcagcatatgaatgaggtagcgtcttaccaccctggccgcatgcttggtcagcaatttccagcacttgcagacactgcaaaaggcttcccttatctcataagatggttacaaccacctagaaaggtggagcaggattcttcgtctgtgttataatagaggaaacagacacagagaagatacagagctaataacgcagaggctggacataaccgaggtcttcaaagc

SEQ ID NO: 294980 - DNA, 483 bp, Homo sapiens
gtacatggtaaggacttcgtaagtgttcatttgttactataactgaaaacactttctccagagattccatctgggaagatctctggtctctaaacttggttgtaattttggcttatgatggcatttcttcattatgtgccacctccttcctgttttaggggatggccgcttccattcagcactgccacccagagaactgctggtgaggactgccgttctgaggaccctcctgatgagcttgggccccctcttgctgaacgagccttaagggtaaaagctgttaaacaccctggccgcatgcttggtcagcaatttccagcacttgcagacactgcaaaaggcttcccttatctcataagatggttacaaccacctagaaaggtggagcaggattcttcgtctgtgttataatagaggaaacagacacagagaagatacagagctaataacgcagaggctggacataaccgaggtcttcaaagc

SEQ ID NO: 294981 - DNA, 4095 bp, Homo sapiens
agcgttcctgtccggaagtcctgagagggaaacgcccgcaaaggctggtttttaagcgggagcatctcttcactcgcagcaagtgcgcgtgcgctgcctctcagcccaaattggaaacatggccgtacggtcgctgtgggcgggccggctgcgggtgcagcgcctactggcctggagtgccgcgtgggagagcaagggatggccgcttccattcagcactgccacccagagaactgctggtgaggactgccgttctgaggaccctcctgatgagcttgggccccctcttgctgaacgagccttaagggtaaaagctgttaaactggagaaagaagtccaagatttaacagtgagataccagagagctatagctgattgtgaaaacataaggaggcgaacccagagatgtgtggaagacgccaagatatttggaatccagagtttctgtaaggacttggtggaggtggctgacattttggagaagactacagagtgcatttctgaagaatcggagcctgaggaccaaaagctcactctggagaaggtcttccgagggttgttgcttttagaagcaaagctgaaaagtgtgtttgccaagcatggcctggagaaactgacacccattggtgacaaatatgacccccatgagcatgaactcatctgtcatgtgccagctggtgttggggtgcagcctggcaccgtggcattagtaagacaagatggctacaaacttcatggccgcaccattaggcttgcccgagtggaagtggcagtggagtctcagagaagactgtgaagaggccatcaggaactggatgttctcccagagcgcagtcacctatgtttcttttatttattaaactaggtttgtattgtacatgaggtacttcatgtgatatgttttggatttagtcatattggctttatttctaagatattctattgatttaatgtgacctgtttggtctcatcagaagtcttaccattgggcatttgaacagtgtgacaggtgttccaatggcctttatcaaaacatgtttaggaaaattggtactgtgataaatttgaatccaaaatccttttaactatgggttttcaactacatgtttcttcctagcggtctctataacaggaattgtgtagtatcttgtattttgtggaaaaaggagatggtagggattggttcaacatttgggtacttagaggataaagcttcgtggtcgtataaatttagatcatttggattgatttttatacacatagattttcaggactttaccttttgttttgtttttttccttttagccatcttatgttcttgtaatcccaactagataggctttatgctcacatcattgtcccatacccacccctttctcatccccatttgcaggggctaaaggtctagatgagacttggaaggcaaggagcatcgaaatttgagatacccaggaccctttcaagcaagaatggccaaaaagccttgtgctgtctttgctcttcaaattattttcagcctccttgtcatataatcatttcaggcaaactgaggcaacactaacagctaatgacccagatggctctatttgggtaatttacctacaacttattccaccagcctttactcctctgcccttttgtcaattttaccttataatcctttattaaatgatgggaggtggtgatcaggacaaaagtgttaggttcccatgatttctcatttcatttattaatagttaatgctgaatttttttttaagtttcctctggctctatttatgttactttttgcgataagaacacttaacataagtattctctcctcttggcaatttttttttttttcctgtgttgcccaggctgacctccaactcctgggcccaagcaatcctgcctcagcctgccaagtagctaggactacaggcgttcaccactgcgcccgcaaagttttttggttgtttttttttttaagttggtactcacaaatcactacctctgttatattgacaagctctatttcctattctttgtatctgttaagtcacatctgtgtaaacattgagctcaccttttatatattaacctctagaattaatgggcctatgtggttttttttcagtcttatagctggtgttctgtaaaagatttgtccaataaacgacttaatgaatgatacatcagtcagattttaggaaggcagtcaattatggatattttaatgttggaagaggccttaatgatcaaatctcaccctttctgcttctgaagtatgaaaatctagtctttttaggactggacacaaggaaaataatctctaaactattgactaaattccagtgagagtatgaatgaagaacaactagatattaatgtcaatcatttaagattaatgggcatgcaattaagtctccatttaagattaatgggcatgcaatgaagtctccagcagacaatcagatgttgttggatgtctagattatataggtttaggttgaagttataaaataaaataaaattcattttccactggaactctatgacattcagtggagtggtggaaagttaacctcttatacattatagataattctaagacagcacacaaacttatcaataaagccatctccttgtgggccttaccatcttcatcagatttagacccttaaaaaacaagtaaatatgcacttttaaaatgcaatcaaaagactggtggttaagcttgtaaaaccagaacatcttttggcattccactaagtatatattgtaaatttaatgaacaatcaaggttcacaataggaagttgtctttttttgccttccattctgtgagatttgacagatggtgacaataagaaaatgagctgattgtaattactctctgtgtgtttttttattgctagctatcattaccagttagaattaacattaattacaattaacaataattttaggtatggaatgttatgattacctaaagagatgtctctacctaatgagctcaagtgatcctcccacctcagcctaccaagtagccaggaccacaggcaagtgcaccaccatgactggctagttttgttttttggttttggtttttggtttttggtttttttttttgggttggttggttgttttttacaggcggggtctcactatatggtccaggctagaagaattttctaatggtctattacacctcccgtttgggcaagtaaattcagaataattttaggttcttttgttattcagtagttttgcagacttaaaagtgtaaatttagaattagaagatgaagctatagtagtaagaatctcaagttgaagggcttgggggagccaaagcagcatattagagcataggcttgaacttaaatctcagctcagtcacctgcaggactttaggcaccagtgatttcacccttctgagcctgtttctttattcgtaaaatgattataataattctttcacagcgttgtgaggattaagtgaaatgtgttaaatgcctactacagtaggtgctcagatatttatttttatttttttattatgcacattgtttttcctgcctttttatggctgtctaaagtctagggaaaagggaagactggttaatgatgagtagaaaaaacttgtaagctaatcattcactgacttattttccttccattttctggtttttaaaattagccacaccacaggaaacccacatttttagatggaaagagcaagaaaattgtgtcagtgctcttagttattttcatcttaatggtatagtgaaaagacattgacttgagatgatactaaggaagctttggctcactctcacttgaagaggggatcttggtgttgtagtacttggactgtacaaatgttttactgacttttcttactgctgtaaaggaatcaggcagttgggtattgatatgttatttggtgctctcattcatggcaaaggatttgataaataaaagttctttaaacactaaagcaaaatcaaatgagcaaaactaaggatgaaatgtaatattcatcagaacaaggatcactgagaaaaaatattcagaaacaactttaataaaacctgaattgaaataactgca

SEQ ID NO: 294982 - DNA, 4015 bp, Homo sapiens
gagcgtaggccaggggaccaagcttctcggcctctacgaccgtgcactcacggccccattttacagacggggaaactgaggccatcagccgtgcctctttcttaggccgaggaaggggatggccgcttccattcagcactgccacccagagaactgctggtgaggactgccgttctgaggaccctcctgatgagcttgggccccctcttgctgaacgagccttaagggtaaaagctgttaaactggagaaagaagtccaagatttaacagtgagataccagagagctatagctgattgtgaaaacataaggaggcgaacccagagatgtgtggaagacgccaagatatttggaatccagagtttctgtaaggacttggtggaggtggctgacattttggagaagactacagagtgcatttctgaagaatcggagcctgaggaccaaaagctcactctggagaaggtcttccgagggttgttgcttttagaagcaaagctgaaaagtgtgtttgccaagcatggcctggagaaactgacacccattggtgacaaatatgacccccatgagcatgaactcatctgtcatgtgccagctggtgttggggtgcagcctggcaccgtggcattagtaagacaagatggctacaaacttcatggccgcaccattaggcttgcccgagtggaagtggcagtggagtctcagagaagactgtgaagaggccatcaggaactggatgttctcccagagcgcagtcacctatgtttcttttatttattaaactaggtttgtattgtacatgaggtacttcatgtgatatgttttggatttagtcatattggctttatttctaagatattctattgatttaatgtgacctgtttggtctcatcagaagtcttaccattgggcatttgaacagtgtgacaggtgttccaatggcctttatcaaaacatgtttaggaaaattggtactgtgataaatttgaatccaaaatccttttaactatgggttttcaactacatgtttcttcctagcggtctctataacaggaattgtgtagtatcttgtattttgtggaaaaaggagatggtagggattggttcaacatttgggtacttagaggataaagcttcgtggtcgtataaatttagatcatttggattgatttttatacacatagattttcaggactttaccttttgttttgtttttttccttttagccatcttatgttcttgtaatcccaactagataggctttatgctcacatcattgtcccatacccacccctttctcatccccatttgcaggggctaaaggtctagatgagacttggaaggcaaggagcatcgaaatttgagatacccaggaccctttcaagcaagaatggccaaaaagccttgtgctgtctttgctcttcaaattattttcagcctccttgtcatataatcatttcaggcaaactgaggcaacactaacagctaatgacccagatggctctatttgggtaatttacctacaacttattccaccagcctttactcctctgcccttttgtcaattttaccttataatcctttattaaatgatgggaggtggtgatcaggacaaaagtgttaggttcccatgatttctcatttcatttattaatagttaatgctgaatttttttttaagtttcctctggctctatttatgttactttttgcgataagaacacttaacataagtattctctcctcttggcaatttttttttttttcctgtgttgcccaggctgacctccaactcctgggcccaagcaatcctgcctcagcctgccaagtagctaggactacaggcgttcaccactgcgcccgcaaagttttttggttgtttttttttttaagttggtactcacaaatcactacctctgttatattgacaagctctatttcctattctttgtatctgttaagtcacatctgtgtaaacattgagctcaccttttatatattaacctctagaattaatgggcctatgtggttttttttcagtcttatagctggtgttctgtaaaagatttgtccaataaacgacttaatgaatgatacatcagtcagattttaggaaggcagtcaattatggatattttaatgttggaagaggccttaatgatcaaatctcaccctttctgcttctgaagtatgaaaatctagtctttttaggactggacacaaggaaaataatctctaaactattgactaaattccagtgagagtatgaatgaagaacaactagatattaatgtcaatcatttaagattaatgggcatgcaattaagtctccatttaagattaatgggcatgcaatgaagtctccagcagacaatcagatgttgttggatgtctagattatataggtttaggttgaagttataaaataaaataaaattcattttccactggaactctatgacattcagtggagtggtggaaagttaacctcttatacattatagataattctaagacagcacacaaacttatcaataaagccatctccttgtgggccttaccatcttcatcagatttagacccttaaaaaacaagtaaatatgcacttttaaaatgcaatcaaaagactggtggttaagcttgtaaaaccagaacatcttttggcattccactaagtatatattgtaaatttaatgaacaatcaaggttcacaataggaagttgtctttttttgccttccattctgtgagatttgacagatggtgacaataagaaaatgagctgattgtaattactctctgtgtgtttttttattgctagctatcattaccagttagaattaacattaattacaattaacaataattttaggtatggaatgttatgattacctaaagagatgtctctacctaatgagctcaagtgatcctcccacctcagcctaccaagtagccaggaccacaggcaagtgcaccaccatgactggctagttttgttttttggttttggtttttggtttttggtttttttttttgggttggttggttgttttttacaggcggggtctcactatatggtccaggctagaagaattttctaatggtctattacacctcccgtttgggcaagtaaattcagaataattttaggttcttttgttattcagtagttttgcagacttaaaagtgtaaatttagaattagaagatgaagctatagtagtaagaatctcaagttgaagggcttgggggagccaaagcagcatattagagcataggcttgaacttaaatctcagctcagtcacctgcaggactttaggcaccagtgatttcacccttctgagcctgtttctttattcgtaaaatgattataataattctttcacagcgttgtgaggattaagtgaaatgtgttaaatgcctactacagtaggtgctcagatatttatttttatttttttattatgcacattgtttttcctgcctttttatggctgtctaaagtctagggaaaagggaagactggttaatgatgagtagaaaaaacttgtaagctaatcattcactgacttattttccttccattttctggtttttaaaattagccacaccacaggaaacccacatttttagatggaaagagcaagaaaattgtgtcagtgctcttagttattttcatcttaatggtatagtgaaaagacattgacttgagatgatactaaggaagctttggctcactctcacttgaagaggggatcttggtgttgtagtacttggactgtacaaatgttttactgacttttcttactgctgtaaaggaatcaggcagttgggtattgatatgttatttggtgctctcattcatggcaaaggatttgataaataaaagttctttaaacactaaagcaaaatcaaatgagcaaaactaaggatgaaatgtaatattcatcagaacaaggatcactgagaaaaaatattcagaaacaactttaataaaacctgaattgaaataactgca

SEQ ID NO: 294983 - DNA, 3687 bp, Homo sapiens
aaaaataactggcttctctgcaggaatccagagtttctgtaaggacttggtggaggtggctgacattttggagaagactacagagtgcatttctgaagaatcggagcctgaggaccaaaagctcactctggagaaggtcttccgagggttgttgcttttagaagcaaagctgaaaagtgtgtttgccaagcatggcctggagaaactgacacccattggtgacaaatatgacccccatgagcatgaactcatctgtcatgtgccagctggtgttggggtgcagcctggcaccgtggcattagtaagacaagatggctacaaacttcatggccgcaccattaggcttgcccgagtggaagtggcagtggagtctcagagaagactgtgaagaggccatcaggaactggatgttctcccagagcgcagtcacctatgtttcttttatttattaaactaggtttgtattgtacatgaggtacttcatgtgatatgttttggatttagtcatattggctttatttctaagatattctattgatttaatgtgacctgtttggtctcatcagaagtcttaccattgggcatttgaacagtgtgacaggtgttccaatggcctttatcaaaacatgtttaggaaaattggtactgtgataaatttgaatccaaaatccttttaactatgggttttcaactacatgtttcttcctagcggtctctataacaggaattgtgtagtatcttgtattttgtggaaaaaggagatggtagggattggttcaacatttgggtacttagaggataaagcttcgtggtcgtataaatttagatcatttggattgatttttatacacatagattttcaggactttaccttttgttttgtttttttccttttagccatcttatgttcttgtaatcccaactagataggctttatgctcacatcattgtcccatacccacccctttctcatccccatttgcaggggctaaaggtctagatgagacttggaaggcaaggagcatcgaaatttgagatacccaggaccctttcaagcaagaatggccaaaaagccttgtgctgtctttgctcttcaaattattttcagcctccttgtcatataatcatttcaggcaaactgaggcaacactaacagctaatgacccagatggctctatttgggtaatttacctacaacttattccaccagcctttactcctctgcccttttgtcaattttaccttataatcctttattaaatgatgggaggtggtgatcaggacaaaagtgttaggttcccatgatttctcatttcatttattaatagttaatgctgaatttttttttaagtttcctctggctctatttatgttactttttgcgataagaacacttaacataagtattctctcctcttggcaatttttttttttttcctgtgttgcccaggctgacctccaactcctgggcccaagcaatcctgcctcagcctgccaagtagctaggactacaggcgttcaccactgcgcccgcaaagttttttggttgtttttttttttaagttggtactcacaaatcactacctctgttatattgacaagctctatttcctattctttgtatctgttaagtcacatctgtgtaaacattgagctcaccttttatatattaacctctagaattaatgggcctatgtggttttttttcagtcttatagctggtgttctgtaaaagatttgtccaataaacgacttaatgaatgatacatcagtcagattttaggaaggcagtcaattatggatattttaatgttggaagaggccttaatgatcaaatctcaccctttctgcttctgaagtatgaaaatctagtctttttaggactggacacaaggaaaataatctctaaactattgactaaattccagtgagagtatgaatgaagaacaactagatattaatgtcaatcatttaagattaatgggcatgcaattaagtctccatttaagattaatgggcatgcaatgaagtctccagcagacaatcagatgttgttggatgtctagattatataggtttaggttgaagttataaaataaaataaaattcattttccactggaactctatgacattcagtggagtggtggaaagttaacctcttatacattatagataattctaagacagcacacaaacttatcaataaagccatctccttgtgggccttaccatcttcatcagatttagacccttaaaaaacaagtaaatatgcacttttaaaatgcaatcaaaagactggtggttaagcttgtaaaaccagaacatcttttggcattccactaagtatatattgtaaatttaatgaacaatcaaggttcacaataggaagttgtctttttttgccttccattctgtgagatttgacagatggtgacaataagaaaatgagctgattgtaattactctctgtgtgtttttttattgctagctatcattaccagttagaattaacattaattacaattaacaataattttaggtatggaatgttatgattacctaaagagatgtctctacctaatgagctcaagtgatcctcccacctcagcctaccaagtagccaggaccacaggcaagtgcaccaccatgactggctagttttgttttttggttttggtttttggtttttggtttttttttttgggttggttggttgttttttacaggcggggtctcactatatggtccaggctagaagaattttctaatggtctattacacctcccgtttgggcaagtaaattcagaataattttaggttcttttgttattcagtagttttgcagacttaaaagtgtaaatttagaattagaagatgaagctatagtagtaagaatctcaagttgaagggcttgggggagccaaagcagcatattagagcataggcttgaacttaaatctcagctcagtcacctgcaggactttaggcaccagtgatttcacccttctgagcctgtttctttattcgtaaaatgattataataattctttcacagcgttgtgaggattaagtgaaatgtgttaaatgcctactacagtaggtgctcagatatttatttttatttttttattatgcacattgtttttcctgcctttttatggctgtctaaagtctagggaaaagggaagactggttaatgatgagtagaaaaaacttgtaagctaatcattcactgacttattttccttccattttctggtttttaaaattagccacaccacaggaaacccacatttttagatggaaagagcaagaaaattgtgtcagtgctcttagttattttcatcttaatggtatagtgaaaagacattgacttgagatgatactaaggaagctttggctcactctcacttgaagaggggatcttggtgttgtagtacttggactgtacaaatgttttactgacttttcttactgctgtaaaggaatcaggcagttgggtattgatatgttatttggtgctctcattcatggcaaaggatttgataaataaaagttctttaaacactaaagcaaaatcaaatgagcaaaactaaggatgaaatgtaatattcatcagaacaaggatcactgagaaaaaatattcagaaacaactttaataaaacctgaattgaaataactgca

SEQ ID NO: 294984 - DNA, 4543 bp, Homo sapiens
  misc_feature (4543)..(4543): n is a, c, g, or t
agcgttcctgtccggaagtcctgagagggaaacgcccgcaaaggctggtttttaagcgggagcatctcttcactcgcagcaagtgcgcgtgcgctgcctctcagcccaaattggaaacatggccgtacggtcgctgtgggcgggccggctgcgggtgcagcgcctactggcctggagtgccgcgtgggagagcaagggatggccgcttccattcagcactgccacccagagaactgctggtgaggactgccgttctgaggaccctcctgatgagcttgggccccctcttgctgaacgagccttaagggtaaaagctgttaaactggagaaagaagtccaagatttaacagtgagataccagagagctatagctgattgtgaaaacataaggaggcgaacccagagatgtgtggaagacgccaagatatttggaatccagagtttctgtaaggacttggtggaggtggctgacattttggagaagactacagagtgcatttctgaagaatcggagcctgaggaccaaaagctcactctggagaaggtcttccgagggttgttgcttttagaagcaaagctgaaaagtgtgtttgccaagcatggcctggagaaactgacacccattggtgacaaatatgacccccatgagcatgaactcatctgtcatgtgccagctggtgttggggtgcagcctggcaccgtggcattagtaagacaagatggctacaaacttcatggccgcaccattaggcttgcccgagtggaagtggcagtggagtctcagagaagactgtgaagaggccatcaggaactggatgttctcccagagcgcagtcacctatgtttcttttatttattaaactaggtttgtattgtacatgaggtacttcatgtgatatgttttggatttagtcatattggctttatttctaagatattctattgatttaatgtgacctgtttggtctcatcagaagtcttaccattgggcatttgaacagtgtgacaggtgttccaatggcctttatcaaaacatgtttaggaaaattggtactgtgataaatttgaatccaaaatccttttaactatgggttttcaactacatgtttcttcctagcggtctctataacaggaattgtgtagtatcttgtattttgtggaaaaaggagatggtagggattggttcaacatttgggtacttagaggataaagcttcgtggtcgtataaatttagatcatttggattgatttttatacacatagattttcaggactttaccttttgttttgtttttttccttttagccatcttatgttcttgtaatcccaactagataggctttatgctcacatcattgtcccatacccacccctttctcatccccatttgcaggggctaaaggtctagatgagacttggaaggcaaggagcatcgaaatttgagatacccaggaccctttcaagcaagaatggccaaaaagccttgtgctgtctttgctcttcaaattattttcagcctccttgtcatataatcatttcaggcaaactgaggcaacactaacagctaatgacccagatggctctatttgggtaatttacctacaacttattccaccagcctttactcctctgcccttttgtcaattttaccttataatcctttattaaatgatgggaggtggtgatcaggacaaaagtgttaggttcccatgatttctcatttcatttattaatagttaatgctgaatttttttttaagtttcctctggctctatttatgttactttttgcgataagaacacttaacataagtattctctcctcttggcaatttttttttttttcctgtgttgcccaggctgacctccaactcctgggcccaagcaatcctgcctcagcctgccaagtagctaggactacaggcgttcaccactgcgcccgcaaagttttttggttgtttttttttttaagttggtactcacaaatcactacctctgttatattgacaagctctatttcctattctttgtatctgttaagtcacatctgtgtaaacattgagctcaccttttatatattaacctctagaattaatgggcctatgtggttttttttcagtcttatagctggtgttctgtaaaagatttgtccaataaacgacttaatgaatgatacatcagtcagattttaggaaggcagtcaattatggatattttaatgttggaagaggccttaatgatcaaatctcaccctttctgcttctgaagtatgaaaatctagtctttttaggactggacacaaggaaaataatctctaaactattgactaaattccagtgagagtatgaatgaagaacaactagatattaatgtcaatcatttaagattaatgggcatgcaattaagtctccatttaagattaatgggcatgcaatgaagtctccagcagacaatcagatgttgttggatgtctagattatataggtttaggttgaagttataaaataaaataaaattcattttccactggaactctatgacattcagtggagtggtggaaagttaacctcttatacattatagataattctaagacagcacacaaacttatcaataaagccatctccttgtgggccttaccatcttcatcagatttagacccttaaaaaacaagtaaatatgcacttttaaaatgcaatcaaaagactggtggttaagcttgtaaaaccagaacatcttttggcattccactaagtatatattgtaaatttaatgaacaatcaaggttcacaataggaagttgtctttttttgccttccattctgtgagatttgacagatggtgacaataagaaaatgagctgattgtaattactctctgtgtgtttttttattgctagctatcattaccagttagaattaacattaattacaattaacaataattttaggtatggaatgttatgattacctaaagagatgtctctacctaatgagctcaagtgatcctcccacctcagcctaccaagtagccaggaccacaggcaagtgcaccaccatgactggctagttttgttttttggttttggtttttggtttttggtttttttttttgggttggttggttgttttttacaggcggggtctcactatatggtccaggctagaagaattttctaatggtctattacacctcccgtttgggcaagtaaattcagaataattttaggttcttttgttattcagtagttttgcagacttaaaagtgtaaatttagaattagaagatgaagctatagtagtaagaatctcaagttgaagggcttgggggagccaaagcagcatattagagcataggcttgaacttaaatctcagctcagtcacctgcaggactttaggcaccagtgatttcacccttctgagcctgtttctttattcgtaaaatgattataataattctttcacagcgttgtgaggattaagtgaaatgtgttaaatgcctactacagtaggtgctcagatatttatttttatttttttattatgcacattgtttttcctgcctttttatggctgtctaaagtctagggaaaagggaagactggttaatgatgagtagaaaaaacttgtaagctaatcattcactgacttattttccttccattttctggtttttaaaattagccacaccacaggaaacccacatttttagatggaaagagcaagaaaattgtgtcagtgctcttagttattttcatcttaatggtatagtgaaaagacattgacttgagatgatactaaggaagctttggctcactctcacttgaagaggggatcttggtgttgtagtacttggactgtacaaatgttttactgacttttcttactgctgtaaaggaatcaggcagttgggtattgatatgttatttggtgctctcattcatggcaaaggatttgataaataaaagttctttaaacactaaagcaaaatcaaatgagcaaaactaaggatgaaatgtaatattcatcagaacaaggatcactgagaaaaaatattcagaaacaactttaataaaacctgaattgaaataactgcacaaaaaaaaaaaaaaaaaaaaaaaaaaaaaccgtgtggggggcggccgcgggccccggaaaagagtttccgagaaacccatcgcgtggggggcgcgggggccccaggagggtaagggagaaaacggggcccaaaagcggtgttccccgagagggaaaccgcgggaccaggaaccagaggggcggggattctccccccaataaaaaaagcgcccggggggacaaccggaagggttctcggaaccaaattccgcaagagggaaaaccggagggcacaaaacgcgggaggcttatacacacacggggagcgcccaaaaggagggcccgaatatttaaaatttacgcccggggacgcggcgggaggaacacgcacacagagagagagagaaacaaacggacgaaaaagagcacgagacaaacaaccaaaacaaccacccaacacaaaggggn

SEQ ID NO: 294985 - DNA, 906 bp, Homo sapiens
  misc_feature (5)..(5): n is a, c, g, or t
tcctntgccatgaatgagagcaccaaataacatatcaatacccaactgcctgattcctttacagcagtaagaaaagtcagtaaaacatttgtacagtccaagtactacaacaccaagatcccctcttcaagtgagagtgagccaaagcagcatattagagcataggcttgaacttaaatctcagctcagtcacctgcaggactttaggcaccagtgatttcacccttctgagcctgtttctttattcgtaaaatgattataataattctttcacagcgttgtgaggattaagtgaaatgtgttaaatgcctactacagtaggtgctcagatatttatttttatttttttattatgcacattgtttttcctgcctttttatggctgtctaaagtctagggaaaagggaagactggttaatgatgagtagaaaaaacttgtaagctaatcattcactgacttattttccttccattttctggtttttaaaattagccacaccacaggaaacccacatttttagatggaaagagcaagaaaattgtgtcagtgctcttagttattttcatcttaatggtatagtgaaaagacattgacttgagatgatactaaggaagctttggctcactctcacttgaagaggggatcttggtgttgtagtacttggactgtacaaatgttttactgacttttcttactgctgtaaaggaatcaggcagttgggtattgatatgttatttggtgctctcattcatggcaaaggatttgataaataaaagttctttaaacactaaagcaaaatcaaatgagcaaaactaaggatgaaatgtaatattcatcagaacaaggatcactgagaaaaaatattcagaaacaactttaataaaacctgaattgaaataactgca

SEQ ID NO: 294986 - DNA, 455 bp, Homo sapiens
agcgttcctgtccggaagtcctgagagggaaacgcccgcaaaggctggtttttaagcgggagcatctcttcactcgcagcaagtgcgcgtgcgctgcctctcagcccaaattggaaacatggccgtacggtcgctgtgggcgggccggctgcgggtgcagcgcctactggcctggagtgccgcgtgggagagcaagggatggccgcttccattcagcactgccacccagagaactgctggtgaggactgccgttctgaggaccctcctgatgagcttgggccccctcttgctgaacgagccttaagggtaaaagctgttaaactggagaaagaagtccaagatttaacagtgagataccagagagctatagctgattgtgaaaacataaggaggcgaacccagagatgtgtggaagacgccaagatatttggtgagagatttatttacaataaaa

SEQ ID NO: 294987 - DNA, 510 bp, Homo sapiens
aactccaccttccgggctcaagtgatcctcccgcctcagcctcccaagtggctgggattacaggcgcctgccacgacgcccggctaacttttgtacttttagtagagacggggtttcaccacgttggccaagcaggtctcgaactcctgatctcaggtgatcccccacctcggcctccgaaagtgctgggattacaggtgtgagccaccgcgtccggccaacatgcttctttagttacttatagaacctgccacatcattagttcaactacaaactgctgcttacatgaccgaagttgtgcaaagggtccaaagttgtgcaagagtaaccactgaaatcagactctggtatattaatagttgcaacatctaaacaatctttatgtttattattagattcaaagtaatgccaaatcacaggtattaaaaatatctacgaagagtctgtttacttttctgtgaaatatactaggacgtcattttaagtgagaataactgaatttctttcagc

SEQ ID NO: 294988 - DNA, 209 bp, Homo sapiens
gcccatattcacccaggaaattcataccacacatgagagtttttcagtgggtgcattaaataccatccccctgcacacacctcccggaatcacctagtccagacctaccgaatcaggacctgtgagagtcagcacattttctaagctctttgggtaattctgatatgatttttaaaaatttgagagtcactggtttgtgctcaggcccc

SEQ ID NO: 294989 - DNA, 891 bp, Homo sapiens
acgcctgcgcagtaagtaagcctgccagacacgctgtggcggctgcctgaagctagtgagtcgcggcgccgcgcacttgtggttgggtcagtgccgcgcgccgctcggtcgttaccgcgaggcgctggtggccttcaggctggacggcgcgggtcagccctggtttgccggcttctgggtctttgaacagccgcgatgtcgatcttcacccccaccaaccagatccgcctaaccaatgtggccgtggtacggatgaagcgcgccaggaagcgcttcgaaatcgcctgctacagaaacaaggtcgtcggctggcggagcggcttggaaaaagaccttgatgaagttctgcagacccactcagtgtttgtaaatgtttcctaaggtcaggttgccaagaaggaagatctcatcagtgcgtttggaacagatgaccaaactgaaatctattttgactaaaggagaagttcaagtatcagataaagacacacacaactggagcagatgtttagggacattgcaattattgtggcagacaaatgtgtgactcctgaaacaaagagaccatacaccgtgatccttattgagagagccatgaaggacatccactatttggtgaaaaccaacaggagtacaaaacagcaggctttggaagtgataaagcagttaaaagagaaaatgaagatagaacgtgctcacatgaggcttcagttcatccttccagtgaatgaaggcaagaagctgaaagaaaagctcaagccactgatcaaggcatagaaagtaaagattatggccaacagttagaaatcgtaagagtcaaatattttctttgcttcatgttacctaaatattgtattctctagtaataaatttgtagcaaacattcagacattg

SEQ ID NO: 294990 - DNA, 1628 bp, Homo sapiens
acgcctgcgcagtaagtaagcctgccagacacgctgtggcggctgcctgaagctagtgagtcgcggcgccgcgcacttgtggttgggtcagtgccgcgcgccgctcggtcgttaccgcgaggcgctggtggccttcaggctggacggcgcgggtcagccctggtttgccggcttctgggtctttgaacagccgcgatgtcgatcttcacccccaccaaccagatccgcctaaccaatgtggccgtggtacggatgaagcgcgccaggaagcgcttcgaaatcgcctgctacagaaacaaggtcgtcggctggcggagcggcttggaaaaagaccttgatgaagttctgcagacccactcagtgtttgtaaatgtttcctaaggtcaggttgccaagaaggaagatctcatcagtgcgtttggaacagatgaccaaactgaaatctattttgactaaaggagaagttcaagtatcagataaagacacacacaactggagcagatgtttagggacattgcaattattgtggcagacaaatgtgtgactcctgaaacaaagagaccatacaccgtgatccttattgagagagccatgaaggacatccactatttggtgaaaaccaacaggagtacaaaacagcaggctttggaagtgataaagcagttaaaagagaaaatgaagatagaacgtgctcacatgaggcttcagttcatccttccagtgaatgaaggcaagaagctgaaagaaaagctcaagccactgatcaaggcatagaaagtaaagattatggccaacagttagaaatcgtatgtctgattgacctgggctgcttccgagaaattgatgagctaataaaaaaggaaaccaaaggcaaaggttctttggaagtactcaatctgaaagatttgaagaaggagatgagaaatttgaatgacacccatcagtctcttcacctctaaaacactaaagtgttttcgtttccaacagcactgtttcatgtctgtggtctgccaaatacttgctcaaactatttgacattttctatctttgtgttaacagtggacacagcaaggctttcctacataagtataataatgtgggaatgatttggttttaattataaactggggtctaaatcctaaagcaaaattgaaactccaggatgcaaaatccagagtggcattttgctactttgtctcatgccttgatagctttccaaaatgaaagttacttgaggcagctcttgtgggtgaaaagttttttgtacagtagagtaagattattaggggtatgtctatacgacaaaaggggggtctttcctaaaaaagaaaacatgatgcttcatttctacttaatggaacttgtgttctgagggtcattatggtatcgtaatataaagcttggatgatgttcctgattatctgagaaacagatatagaaaaattgtgtcggacttaaataattttcgttgaacatgctgccataacttagattattcttggttaaaaaataaaagtcacttatttctaattcttaaagtttataatatatattaatatagctaaaattgtatgtaatcaataaaaccactcttatgtttattaaactatggcttgtgtttctagaca

SEQ ID NO: 294991 - DNA, 1506 bp, Homo sapiens
acgcctgcgcagtaagtaagcctgccagacacgctgtggcggctgcctgaagctagtgagtcgcggcgccgcgcacttgtggttgggtcagtgccgcgcgccgctcggtcgttaccgcgaggcgctggtggccttcaggctggacggcgcgggtcagccctggtttgccggcttctgggtctttgaacagccgcgatgtcgatcttcacccccaccaaccagatccgcctaaccaatgtggccgtggtacggatgaagcgcgccaggaagcgcttcgaaatcgcctgctacagaaacaaggtcgtcggctggcggagcggcttattttgactaaaggagaagttcaagtatcagataaagacacacacaactggagcagatgtttagggacattgcaattattgtggcagacaaatgtgtgactcctgaaacaaagagaccatacaccgtgatccttattgagagagccatgaaggacatccactatttggtgaaaaccaacaggagtacaaaacagcaggctttggaagtgataaagcagttaaaagagaaaatgaagatagaacgtgctcacatgaggcttcagttcatccttccagtgaatgaaggcaagaagctgaaagaaaagctcaagccactgatcaaggcatagaaagtaaagattatggccaacagttagaaatcgtatgtctgattgacctgggctgcttccgagaaattgatgagctaataaaaaaggaaaccaaaggcaaaggttctttggaagtactcaatctgaaagatttgaagaaggagatgagaaatttgaatgacacccatcagtctcttcacctctaaaacactaaagtgttttcgtttccaacagcactgtttcatgtctgtggtctgccaaatacttgctcaaactatttgacattttctatctttgtgttaacagtggacacagcaaggctttcctacataagtataataatgtgggaatgatttggttttaattataaactggggtctaaatcctaaagcaaaattgaaactccaggatgcaaaatccagagtggcattttgctactttgtctcatgccttgatagctttccaaaatgaaagttacttgaggcagctcttgtgggtgaaaagttttttgtacagtagagtaagattattaggggtatgtctatacgacaaaaggggggtctttcctaaaaaagaaaacatgatgcttcatttctacttaatggaacttgtgttctgagggtcattatggtatcgtaatataaagcttggatgatgttcctgattatctgagaaacagatatagaaaaattgtgtcggacttaaataattttcgttgaacatgctgccataacttagattattcttggttaaaaaataaaagtcacttatttctaattcttaaagtttataatatatattaatatagctaaaattgtatgtaatcaataaaaccactcttatgtttattaaactatggcttgtgtttctagaca

SEQ ID NO: 294992 - DNA, 1821 bp, Homo sapiens
acgcctgcgcagtaagtaagcctgccagacacgctgtggcggctgcctgaagctagtgagtcgcggcgccgcgcacttgtggttgggtcagtgccgcgcgccgctcggtcgttaccgcgaggcgctggtggccttcaggctggacggcgcgggtcagccctggtttgccggcttctgggtctttgaacagccgcgatgtcgatcttcacccccaccaaccagatccgcctaaccaatgtggccgtggtacggatgaagcgcgccaggaagcgcttcgaaatcgcctgctacagaaacaaggtcgtcggctggcggagcggcttgtgagtagccccctccctcgggcctgggcctgggcctgagccgtcacctccgaggcggcctgtctctgcccaagtcgagtgaatgggccaggctggggtgtttgttggcccgggaggaaatggaacattcctgctgtgagcatgagacgtcgctgtccgagcttggcgcctaagccaagggtttctttatttgggaaaaagaccttgatgaagttctgcagacccactcagtgtttgtaaatgtttcctaaggtcaggttgccaagaaggaagatctcatcagtgcgtttggaacagatgaccaaactgaaatctattttgactaaaggagaagttcaagtatcagataaagacacacacaactggagcagatgtttagggacattgcaattattgtggcagacaaatgtgtgactcctgaaacaaagagaccatacaccgtgatccttattgagagagccatgaaggacatccactatttggtgaaaaccaacaggagtacaaaacagcaggctttggaagtgataaagcagttaaaagagaaaatgaagatagaacgtgctcacatgaggcttcagttcatccttccagtgaatgaaggcaagaagctgaaagaaaagctcaagccactgatcaaggcatagaaagtaaagattatggccaacagttagaaatcgtatgtctgattgacctgggctgcttccgagaaattgatgagctaataaaaaaggaaaccaaaggcaaaggttctttggaagtactcaatctgaaagatttgaagaaggagatgagaaatttgaatgacacccatcagtctcttcacctctaaaacactaaagtgttttcgtttccaacagcactgtttcatgtctgtggtctgccaaatacttgctcaaactatttgacattttctatctttgtgttaacagtggacacagcaaggctttcctacataagtataataatgtgggaatgatttggttttaattataaactggggtctaaatcctaaagcaaaattgaaactccaggatgcaaaatccagagtggcattttgctactttgtctcatgccttgatagctttccaaaatgaaagttacttgaggcagctcttgtgggtgaaaagttttttgtacagtagagtaagattattaggggtatgtctatacgacaaaaggggggtctttcctaaaaaagaaaacatgatgcttcatttctacttaatggaacttgtgttctgagggtcattatggtatcgtaatataaagcttggatgatgttcctgattatctgagaaacagatatagaaaaattgtgtcggacttaaataattttcgttgaacatgctgccataacttagattattcttggttaaaaaataaaagtcacttatttctaattcttaaagtttataatatatattaatatagctaaaattgtatgtaatcaataaaaccactcttatgtttattaaactatggcttgtgtttctagaca

SEQ ID NO: 294993 - DNA, 1330 bp, Homo sapiens
ggactttctctcctgccctcacaagggaaaaagaccttgatgaagttctgcagacccactcagtgtttgtaaatgtttcctaaggtcaggttgccaagaaggaagatctcatcagtgcgtttggaacagatgaccaaactgaaatctattttgactaaaggagaagttcaagtatcagataaagacacacacaactggagcagatgtttagggacattgcaattattgtggcagacaaatgtgtgactcctgaaacaaagagaccatacaccgtgatccttattgagagagccatgaaggacatccactatttggtgaaaaccaacaggagtacaaaacagcaggctttggaagtgataaagcagttaaaagagaaaatgaagatagaacgtgctcacatgaggcttcagttcatccttccagtgaatgaaggcaagaagctgaaagaaaagctcaagccactgatcaaggcatagaaagtaaagattatggccaacagttagaaatcgtatgtctgattgacctgggctgcttccgagaaattgatgagctaataaaaaaggaaaccaaaggcaaaggttctttggaagtactcaatctgaaagatttgaagaaggagatgagaaatttgaatgacacccatcagtctcttcacctctaaaacactaaagtgttttcgtttccaacagcactgtttcatgtctgtggtctgccaaatacttgctcaaactatttgacattttctatctttgtgttaacagtggacacagcaaggctttcctacataagtataataatgtgggaatgatttggttttaattataaactggggtctaaatcctaaagcaaaattgaaactccaggatgcaaaatccagagtggcattttgctactttgtctcatgccttgatagctttccaaaatgaaagttacttgaggcagctcttgtgggtgaaaagttttttgtacagtagagtaagattattaggggtatgtctatacgacaaaaggggggtctttcctaaaaaagaaaacatgatgcttcatttctacttaatggaacttgtgttctgagggtcattatggtatcgtaatataaagcttggatgatgttcctgattatctgagaaacagatatagaaaaattgtgtcggacttaaataattttcgttgaacatgctgccataacttagattattcttggttaaaaaataaaagtcacttatttctaattcttaaagtttataatatatattaatatagctaaaattgtatgtaatcaataaaaccactcttatgtttattaaactatggcttgtgtttctagaca

SEQ ID NO: 294994 - DNA, 1973 bp, Homo sapiens
tggaaagcgacgtagtcccagcacttggaaggctgaggcaggaggatggcttgagcttgggaggtggaggttacagtgagccgagatcacgccactgcactccagcctacacgacagagccaaaccccgactaaaaaaaagatttgaacagacacatcaccaaagaagacctacagagggaaaataagcacaaaaaaagatgctcaacatcataagtccttcgggaagtgcaaattaaaactacaatgagatatcattacatatctatcaggattgacaaagttttgtaggctggacggcgcgggtcagccctggtttgccggcttctgggtctttgaacagccgcgatgtcgatcttcacccccaccaaccagatccgcctaaccaatgtggccgtggtacggatgaagcgcgccaggaagcgcttcgaaatcgcctgctacagaaacaaggtcgtcggctggcggagcggcttgtgagtagccccctccctcgggcctgggcctgggcctgagccgtcacctccgaggcggcctgtctctgcccaagtcgagtgaatgggccaggctggggtgtttgttggcccgggaggaaatggaacattcctgctgtgagcatgagacgtcgctgtccgagcttggcgcctaagccaagggtttctttatttgggaaaaagaccttgatgaagttctgcagacccactcagtgtttgtaaatgtttcctaaggtcaggttgccaagaaggaagatctcatcagtgcgtttggaacagatgaccaaactgaaatctattttgactaaaggagaagttcaagtatcagataaagacacacacaactggagcagatgtttagggacattgcaattattgtggcagacaaatgtgtgactcctgaaacaaagagaccatacaccgtgatccttattgagagagccatgaaggacatccactatttggtgaaaaccaacaggagtacaaaacagcaggctttggaagtgataaagcagttaaaagagaaaatgaagatagaacgtgctcacatgaggcttcagttcatccttccagtgaatgaaggcaagaagctgaaagaaaagctcaagccactgatcaaggcatagaaagtaaagattatggccaacagttagaaatcgtatgtctgattgacctgggctgcttccgagaaattgatgagctaataaaaaaggaaaccaaaggcaaaggttctttggaagtactcaatctgaaagatttgaagaaggagatgagaaatttgaatgacacccatcagtctcttcacctctaaaacactaaagtgttttcgtttccaacagcactgtttcatgtctgtggtctgccaaatacttgctcaaactatttgacattttctatctttgtgttaacagtggacacagcaaggctttcctacataagtataataatgtgggaatgatttggttttaattataaactggggtctaaatcctaaagcaaaattgaaactccaggatgcaaaatccagagtggcattttgctactttgtctcatgccttgatagctttccaaaatgaaagttacttgaggcagctcttgtgggtgaaaagttttttgtacagtagagtaagattattaggggtatgtctatacgacaaaaggggggtctttcctaaaaaagaaaacatgatgcttcatttctacttaatggaacttgtgttctgagggtcattatggtatcgtaatataaagcttggatgatgttcctgattatctgagaaacagatatagaaaaattgtgtcggacttaaataattttcgttgaacatgctgccataacttagattattcttggttaaaaaataaaagtcacttatttctaattcttaaagtttataatatatattaatatagctaaaattgtatgtaatcaataaaaccactcttatgtttattaaactatggcttgtgtttctagaca

SEQ ID NO: 294995 - DNA, 1564 bp, Homo sapiens
acgcctgcgcagtaagtaagcctgccagacacgctgtggcggctgcctgaagctagtgagtcgcggcgccgcgcacttgtggttgggtcagtgccgcgcgccgctcggtcgttaccgcgaggcgctggtggccttcaggctggacggcgcgggtcagccctggtttgccggcttctgggtctttgaacagccgcgatgtcgatcttcacccccaccaaccagatccgcctaaccaatgtggccgtggtacggatgaagcgcgccaggaagcgcttcgaaatcgcctgctacagaaacaaggtcgtcggctggcggagcggcttgttgccaagaaggaagatctcatcagtgcgtttggaacagatgaccaaactgaaatctattttgactaaaggagaagttcaagtatcagataaagacacacacaactggagcagatgtttagggacattgcaattattgtggcagacaaatgtgtgactcctgaaacaaagagaccatacaccgtgatccttattgagagagccatgaaggacatccactatttggtgaaaaccaacaggagtacaaaacagcaggctttggaagtgataaagcagttaaaagagaaaatgaagatagaacgtgctcacatgaggcttcagttcatccttccagtgaatgaaggcaagaagctgaaagaaaagctcaagccactgatcaaggcatagaaagtaaagattatggccaacagttagaaatcgtatgtctgattgacctgggctgcttccgagaaattgatgagctaataaaaaaggaaaccaaaggcaaaggttctttggaagtactcaatctgaaagatttgaagaaggagatgagaaatttgaatgacacccatcagtctcttcacctctaaaacactaaagtgttttcgtttccaacagcactgtttcatgtctgtggtctgccaaatacttgctcaaactatttgacattttctatctttgtgttaacagtggacacagcaaggctttcctacataagtataataatgtgggaatgatttggttttaattataaactggggtctaaatcctaaagcaaaattgaaactccaggatgcaaaatccagagtggcattttgctactttgtctcatgccttgatagctttccaaaatgaaagttacttgaggcagctcttgtgggtgaaaagttttttgtacagtagagtaagattattaggggtatgtctatacgacaaaaggggggtctttcctaaaaaagaaaacatgatgcttcatttctacttaatggaacttgtgttctgagggtcattatggtatcgtaatataaagcttggatgatgttcctgattatctgagaaacagatatagaaaaattgtgtcggacttaaataattttcgttgaacatgctgccataacttagattattcttggttaaaaaataaaagtcacttatttctaattcttaaagtttataatatatattaatatagctaaaattgtatgtaatcaataaaaccactcttatgtttattaaactatggcttgtgtttctagaca

SEQ ID NO: 294996 - DNA, 921 bp, Homo sapiens
tggaaagcgacgtagtcccagcacttggaaggctgaggcaggaggatggcttgagcttgggaggtggaggttacagtgagccgagatcacgccactgcactccagcctacacgacagagccaaaccccgactaaaaaaaagatttgaacagacacatcaccaaagaagacctacagagggaaaataagcacaaaaaaagatgctcaacatcataagtccttcgggaagtgcaaattaaaactacaatgagatatcattacatatctatcaggattgacaaagttttgtaggctggacggcgcgggtcagccctggtttgccggcttctgggtctttgaacagccgcgatgtcgatcttcacccccaccaaccagatccgcctaaccaatgtggccgtggtacggatgaagcgcgccaggaagcgcttcgaaatcgcctgctacagaaacaaggtcgtcggctggcggagcggcttattttgactaaaggagaagttcaagtatcagataaagacacacacaactggagcagatgtttagggacattgcaattattgtggcagacaaatgtgtgactcctgaaacaaagagaccatacaccgtgatccttattgagagagccatgaaggacatccactatttggtgaaaaccaacaggagtacaaaacagcaggctttggaagtgataaagcagttaaaagagaaaatgaagatagaacgtgctcacatgaggcttcagttcatccttccagtgaatgaaggcaagaagctgaaagaaaagctcaagccactgatcaaggcatagaaagtaaagattatggccaacagttagaaatcgtaagagtcaaatattttctttgcttcatgttacctaaatattgtattctctagtaataaatttgtagcaaacattcagacattg

SEQ ID NO: 294997 - DNA, 329 bp, Homo sapiens
cctaatccaactacatggaaactactttgtttttgaaaaccttatgaaataatatagtagaagaaattgcattctcgattttgtcttggtaggctttggaagtgataaagcagttaaaagagaaaatgaagatagaacgtgctcacatgaggcttcagttcatccttccagtgaatgaaggcaagaagctgaaagaaaagctcaagccactgatcaaggcatagaaagtaaagattatggccaacagttagaaatcgtaagagtcaaatattttctttgcttcatgttacctaaatattgtattctctagtaataaatttgtagcaaac

SEQ ID NO: 294998 - DNA, 2107 bp, Homo sapiens
ggtgggggcggggtatggcgcgctgtgcggcgcagggcggctggcacaaacggcggcgccggggccggaggaaaaagctcgccaccctgaagggtcccttcccaagcccttagggaccgcagaggacttggggaccagcaagcaacccccagggcacgagaagagctcttgctgtctgccctgcctcaccctgccccacgccaggcccggtggcccccagctgcatcaagtggaggcggaggaggaggcggaggagggtggcaccatgggcccgggcggtgccctccatgcccgggggatgaagacactgctgccatggacagcccgtgccagccgcagcccctaagtcaggctctccctcagttaccagggtcttcgtcagagcccttggagcctgagcctggccgggccaggatgggagtggagagttacctgccctgtcccctgctcccctcctaccactgtccaggagtgcctagtgaggcctcggcagggagtgggacccccagagccacagccacctctaccactgccagccctcttcgggacggttttggcgggcaggatggtggtgagctgcggccgctgcagagtgaaggcgctgcagcgctggtcaccaaggggtgccagcgattggcagcccagggcgcacggcctgaggcccccaaacggaaatgggccgaggatggtggggatgccccttcacccagcaaacggccctgggccaggcaagagaaccaggaggcagagcgggagggtggcatgagctgcagctgcagcagtggcagtggtgaggccagtgctgggctgatggaggaggcgctgccctctgcgcccgagcgcctggccctggactatatcgtgccctgcatgcggtactacggcatctgcgtcaaggacagcttcctgggggcagcactgggcggtcgcgtgctggccgaggtggaggccctcaaacggggtgggcgcctgcgagacgggcagctagtgagccagagggcgatcccgccgcgcagcatccgtggggaccagattgcctgggtggaaggccatgaaccaggctgtcgaagcattggtgccctcatggcccatgtggacgccgtcatccgccactgcgcagggcggctgggcagctatgtcatcaacgggcgcaccaaggccatggtggcgtgttacccaggcaacgggctcgggtacgtaaggcacgttgacaatccccacggcgatgggcgctgcatcacctgtatctattacctgaatcagaactgggacgttaaggtgcatggcggcctgctgcagatcttccctgagggccggcccgtggtagccaacatcgagccactctttgaccggttgctcattttctggtctgaccggcggaacccccacgaggtgaagccagcctatgccaccaggtacgccatcactgtctggtattttgatgccaaggagcgggcagcagccaaagacaagtatcagctagcatcaggacagaaaggtgtccaagtacctgtatcacagccgcctacgcccacctagtggccagtcccagagccgcatggcagacagcttaaatgacttcaggagagccctgggcctgtgctggctgctccttccctgccaccgctgctgcttctgactttgcctctgtcctgcctggtgtggagggctctgtctgttgctgaggaccaaggaggagaagagacctttgctgccccatcatgggggctggggttgtcacctggacagggggcagccgtggaggccaccgttaccaactgaagctgggggcctgggtcctaccctgtctggtcatgaccccattaggtatggagagctgggaggaggcattgtcacttcccaccaggatgcaggacttggggttgaggtgagtcatggcctcttgctggcaatggggtgggaggagtacccccaagtcctctcactcctccagcctggaatgtgaagtgactccccaacccctttggccatggcaggcaccttttggactgggctgccactgcttgggcagagtaaaaggtgccaggaggagcatgggtgtggaagtcctgtcagccaagaaataaaagtttacctcagagctgca

SEQ ID NO: 294999 - DNA, 2089 bp, Homo sapiens
gctttcccctgcctgcctgtctctagtttctctcacatccctttttttttttcctttctctagccaccctgaagggtcccttcccaagcccttagggaccgcagaggacttggggaccagcaagcaacccccagggcacgagaagagctcttgctgtctgccctgcctcaccctgccccacgccaggcccggtggcccccagctgcatcaagtggaggcggaggaggaggcggaggagggtggcaccatgggcccgggcggtgccctccatgcccgggggatgaagacactgctgccatggacagcccgtgccagccgcagcccctaagtcaggctctccctcagttaccagggtcttcgtcagagcccttggagcctgagcctggccgggccaggatgggagtggagagttacctgccctgtcccctgctcccctcctaccactgtccaggagtgcctagtgaggcctcggcagggagtgggacccccagagccacagccacctctaccactgccagccctcttcgggacggttttggcgggcaggatggtggtgagctgcggccgctgcagagtgaaggcgctgcagcgctggtcaccaaggggtgccagcgattggcagcccagggcgcacggcctgaggcccccaaacggaaatgggccgaggatggtggggatgccccttcacccagcaaacggccctgggccaggcaagagaaccaggaggcagagcgggagggtggcatgagctgcagctgcagcagtggcagtggtgaggccagtgctgggctgatggaggaggcgctgccctctgcgcccgagcgcctggccctggactatatcgtgccctgcatgcggtactacggcatctgcgtcaaggacagcttcctgggggcagcactgggcggtcgcgtgctggccgaggtggaggccctcaaacggggtgggcgcctgcgagacgggcagctagtgagccagagggcgatcccgccgcgcagcatccgtggggaccagattgcctgggtggaaggccatgaaccaggctgtcgaagcattggtgccctcatggcccatgtggacgccgtcatccgccactgcgcagggcggctgggcagctatgtcatcaacgggcgcaccaaggccatggtggcgtgttacccaggcaacgggctcgggtacgtaaggcacgttgacaatccccacggcgatgggcgctgcatcacctgtatctattacctgaatcagaactgggacgttaaggtgcatggcggcctgctgcagatcttccctgagggccggcccgtggtagccaacatcgagccactctttgaccggttgctcattttctggtctgaccggcggaacccccacgaggtgaagccagcctatgccaccaggtacgccatcactgtctggtattttgatgccaaggagcgggcagcagccaaagacaagtatcagctagcatcaggacagaaaggtgtccaagtacctgtatcacagccgcctacgcccacctagtggccagtcccagagccgcatggcagacagcttaaatgacttcaggagagccctgggcctgtgctggctgctccttccctgccaccgctgctgcttctgactttgcctctgtcctgcctggtgtggagggctctgtctgttgctgaggaccaaggaggagaagagacctttgctgccccatcatgggggctggggttgtcacctggacagggggcagccgtggaggccaccgttaccaactgaagctgggggcctgggtcctaccctgtctggtcatgaccccattaggtatggagagctgggaggaggcattgtcacttcccaccaggatgcaggacttggggttgaggtgagtcatggcctcttgctggcaatggggtgggaggagtacccccaagtcctctcactcctccagcctggaatgtgaagtgactccccaacccctttggccatggcaggcaccttttggactgggctgccactgcttgggcagagtaaaaggtgccaggaggagcatgggtgtggaagtcctgtcagccaagaaataaaagtttacctcagagctgca

SEQ ID NO: 295000 - DNA, 3917 bp, Homo sapiens
gtgggacagtcacaggcttctgactggggtgtgtgtgtagtgggggtggggctcttggcaggcagattgtcaccaatagcctttaagtctttggtctcctggccctggtcccacctgtccctcccctaggtgggaggggtggagagcaagtttcctgaggccttcccctgtgagggcaggaagtagatactttccttggggccagaggatgctttcacccccaaggtgtgtatatgtgggggaagggtggggccctaaagagcaggttcctgtttctgtgtgagtcccatgtgcttggtgggaggcgctgtgtgagaatgtacagggcaggaggaaacatagcagggctggggtgcagaggaggcccagagcagtgcactccagtctgcaggtactgcactgggcactggggagaccaacctggccccaggggcttccctgtggctgccttccagggcagtactaggtaaacaggtgcctgtgctgatgccatgttgctaggagtggaacggacaatcagccggagtactcaaggtgacccttggtctctgaatcctgaataacaaagagggtcagaaggaagagtgtcccaggccagtgctgaggccttgtggtggcgatgagctcagcctgttgaggcatggagcagagtgatgggagaggcacatgaggttgggggcctttgaggctgtggttgggaatttgtattttctcaggatggagtgaagacctggagaggaggggctctggctgctgtgtggggatgaattgtgggaagagggtgcagcactggaccccttccctgccacccatccacgtgcatcatcagtgtaatctctgattggattcctaattggggaggtcttgcccatctctagtcagtaactcactgtttctaagcctcctggaccatggcccaattcttctcccagtgaggtggttgctcagagtgccgacccttccatagggagtgagcagtgcaaagaaggtgccccctcctgaaccttgaagtgtagccattagggttttccctggggggccttctcactaattgtactctggtgctgccagagagaaggttgtcagcttcccactgctaggtggcagtagatggtggcagccctctctttccagggcaaggtctggtggatgaggtgcacatggttaatgcagagcagcttaacatccaccacagagggtgagccctgggataatgtgttgggaggcgtcctggggagggtgaggattgaagcagcccagtctgctgtggcgtgcgtgcttggcaagcatcctgttgtggcagtggccactgatgtttgatcgtgaatgtttatcttgggactgtcttgctgggccgggcccataggtgtagctgagcattcgtggggaatggacgccagcagagttgtaccagggcagagaggtcagggcagagaggtcaagacagatggtccgggctggggagaagttgaagggtccttgtgccagtcctcccctttttgtgtgctacctcatcttgccactgcagtgactttgggcagagggtgggacagggaccttttaaaatttttaaatggcatttcagcctgtgctccagttctccatgtggcaggcactgtgctggctgtcttcccagacacttgttatcttgttcacttgttccacaacaacctgtgaaatagctgtgagctccattggatccatggatgaggaacctgagaccaggaagtcacctgcctgatgccacagctcatgtggcagcactgagacttgaaccagggaattgtgtctgcagaagtggctgggccatttcctttacctctcagccacctttctgccagctccctgatgacaaacatcccggggccctggccacagcattgtagggctgggtcaggggagtggcaactgtcaggcagaggaaagaaccctgtagacagagaaaccaagccctgcaatgagtcctgttagatctccaggagttggggctccagaacctcccaagttatgttctcagagagattaattgctaccgctgtaaacagcagtgtttattacccctgctgtacacatcaggcagttgaggcccattcaggtgttggaactggctagggttacccagcaaattatccttggagttggaattaggtctttctattcagactgtagcttttggctcctgttcggaggtctatgggacagataatttagtggggattctttgtagtccagggcagcagttcttaacattgctgcatggtagaattacctgggaagctttaccaatttcaggcccttccttaggccaggtacttcagaacctcagagctccccagggggctccactccacagccaagggtaagaattcctggtctagggctgtgaggccacctccttgcacacctgaaaatgtttaaattggtattattctactgaaatggctgaggtggggtttggggtatcttgaaacaaatcaaactctgttactaattgagccctagctgggtgccaggccccaggtatgtgtgttgggagggagtgggctcttgaggcccaggagctgaggtttctgatagacttggggatgggattttggctgaaaaagaaagtcttttggggcaggagcttggaacccttgacccaaggagtcatggggaagatggggcaaggaggggtgggaaaataggtaattcatggctgcttctctaagatgtgcctgcctagccccagtaaacctacctccctccatccctgccaggccatggtggcgtgttacccaggcaacgggctcgggtacgtaaggcacgttgacaatccccacggcgatgggcgctgcatcacctgtatctattacctgaatcagaactgggacgttaaggtgcatggcggcctgctgcagatcttccctgagggccggcccgtggtagccaacatcgagccactctttgaccggttgctcattttctggtctgaccggcggaacccccacgaggtgaagccagcctatgccaccaggtatgacctgtacttctggagacgcacccaggtgctccccctgtgacaatgtcctgtcagagcctcagagtgactagggagcgacgaagtattgagagggggcctaggtgggagcagaaccgggtggctcaaaaggatggccgcctagtgtgtgtggatatggtagctggaattgcagaaaactaatgtccaaccaccctggtctccaggtacgccatcactgtctggtattttgatgccaaggagcgggcagcagccaaagacaagtatcagctagcatcaggacagaaaggtgtccaagtacctgtatcacagccgcctacgcccacctagtggccagtcccagagccgcatggcagacagcttaaatgacttcaggagagccctgggcctgtgctggctgctccttccctgccaccgctgctgcttctgactttgcctctgtcctgcctggtgtggagggctctgtctgttgctgaggaccaaggaggagaagagacctttgctgccccatcatgggggctggggttgtcacctggacagggggcagccgtggaggccaccgttaccaactgaagctgggggcctgggtcctaccctgtctggtcatgaccccattaggtatggagagctgggaggaggcattgtcacttcccaccaggatgcaggacttggggttgaggtgagtcatggcctcttgctggcaatggggtgggaggagtacccccaagtcctctcactcctccagcctggaatgtgaagtgactccccaacccctttggccatggcaggcaccttttggactgggctgccactgcttgggcagagtaaaaggtgccaggaggagcatgggtgtggaagtcctgtcagccaagaaataaaagtttacctcagagctgca

SEQ ID NO: 295001 - DNA, 537 bp, Homo sapiens
gcggaccccacaccctgcccctgctggactcagttggctgacctcgcccaggggctgctcatgatttgaaagttgtcattgataaggcggataatggtgagcagacgctcatcatcatagtcgaagcggctgccgaagagcacggaacagataatgttggaccgtgagcgactcagcacaaacgtggggtcaaagggctcgcctgagggtgaagaatggaatgggtcaggaagacgcgatgtgcagcacaccagacctcatgcagcaacaccattaatttgcacaacatccgactcaaccatggcaacgtgtcttacggtgcaaacacgggcacatggtcacaacatgctgcttaacaacaccccaaaagcatctgtcaatgccagatccttaacctgctgtgtcacaagagaattaatgtgtagtttaaggctggtgcttccatattaattttctgtctgtacgatctatccagtgatgtaagtaggatgtttaagtctactgctataattgtactgagccagccacctgtggggg

SEQ ID NO: 295002 - DNA, 2396 bp, Homo sapiens
ggtgggggcggggtatggcgcgctgtgcggcgcagggcggctggcacaaacggcggcgccggggccggaggaaaaagctcgccaccctgaagggtcccttcccaagcccttagggaccgcagaggacttggggaccagcaagcaacccccagggcacgagaagagctcttgctgtctgccctgcctcaccctgccccacgccaggcccggtggcccccagctgcatcaagtggaggcggaggaggaggcggaggagggtggcaccatgggcccgggcggtgccctccatgcccgggggatgaagacactgctgccatggacagcccgtgccagccgcagcccctaagtcaggctctccctcagttaccagggtcttcgtcagagcccttggagcctgagcctggccgggccaggatgggagtggagagttacctgccctgtcccctgctcccctcctaccactgtccaggagtgcctagtgaggcctcggcagggagtgggacccccagagccacagccacctctaccactgccagccctcttcgggacggttttggcgggcaggatggtggtgagctgcggccgctgcagagtgaaggcgctgcagcgctggtcaccaaggggtgccagcgattggcagcccagggcgcacggcctgaggcccccaaacggaaatgggccgaggatggtggggatgccccttcacccagcaaacggccctgggccaggcaagagaaccaggaggcagagcgggagggtggcatgagctgcagctgcagcagtggcagtggtgaggccagtgctgggctgatggaggaggcgctgccctctgcgcccgagcgcctggccctggactatatcgtgccctgcatgcggtactacggcatctgcgtcaaggacagcttcctgggggcagcactgggcggtcgcgtgctggccgaggtggaggccctcaaacggggtgggcgcctgcgagacgggcagctagtgagccagagggcgatcccgccgcgcagcatccgtggggaccagattgcctgggtggaaggccatgaaccaggctgtcgaagcattggtgccctcatggcccatgtggacgccgtcatccgccactgcgcagggcggctgggcagctatgtcatcaacgggcgcaccaaggccatggtggcgtgttacccaggcaacgggctcgggtacgtaaggcacgttgacaatccccacggcgatgggcgctgcatcacctgtatctattacctgaatcagaactgggacgttaaggtgcatggcggcctgctgcagatcttccctgagggccggcccgtggtagccaacatcgagccactctttgaccggttgctcattttctggtctgaccggcggaacccccacgaggtgaagccagcctatgccaccaggtacgccatcactgtctggtattttgatgccaaggagcgggcagcagccaaagacaagtatcagctagcatcaggacagaaaggtgtccaagtacctgtatcacagccgcctacgcccacctagtggccagtcccagagccgcatggcagacagcttaaatgacttcaggagagccctgggcctgtgctggctgctccttccctgccaccgctgctgcttctgactttgcctctgtcctgcctggtgtggagggctctgtctgttgctgaggaccaaggaggagaagagacctttgctgccccatcatgggggctggggttgtcacctggacagggggcagccgtggaggccaccgttaccaactgaagctgggggcctgggtcctaccctgtctggtcatgaccccattaggtatggagagctgggaggaggcattgtcacttcccaccaggatgcaggacttggggttgaggtgagtcatggcctcttgctggcaatggggtgggaggagtacccccaagtcctctcactcctccagcctggaatgtgaagtgactccccaacccctttggccatggcaggcaccttttggactgggctgccactgcttgggcagagtaaaaggtgccaggaggagcatgggtgtggaagtcctgtcagccaagaaataaaagtttacctcagagctgcaaaaaaaaaaaaaaacaacaaaaaaaaaaaaaaaaaaaaaaaaaagcgaagggagagaaacaaaaagaaagttaaaacaagggacgaaaagagagaaagagaagcgaggaggcgcgaccggccagaggcggtttttaggacccaccgggggtatacttctctcggcggaccccactatgggtttgtgcacattagcactattataatgcgccaggagctacacggtgtattacgtctcagactacagcagagtcacacgcgtaaatgcagaaacgcggacagagagtgga

SEQ ID NO: 295003 - DNA, 2240 bp, Homo sapiens
acgttgggtgccggccgttgtgggggttggggtgggggcggggagcgcgcgccgggcggaggccgagtggagggggaggggagggggtccgagcggcccttaggccctgcccctgtcgcctactgcgctcagaaggggcctcagggcctgccccgggttgggggcgttggggtgccctggatgggggcacctttatctctcgtcctgtctccggccaccctgaagggtcccttcccaagcccttagggaccgcagaggacttggggaccagcaagcaacccccagggcacgagaagagctcttgctgtctgccctgcctcaccctgccccacgccaggcccggtggcccccagctgcatcaagtggaggcggaggaggaggcggaggagggtggcaccatgggcccgggcggtgccctccatgcccgggggatgaagacactgctgccatggacagcccgtgccagccgcagcccctaagtcaggctctccctcagttaccagggtcttcgtcagagcccttggagcctgagcctggccgggccaggatgggagtggagagttacctgccctgtcccctgctcccctcctaccactgtccaggagtgcctagtgaggcctcggcagggagtgggacccccagagccacagccacctctaccactgccagccctcttcgggacggttttggcgggcaggatggtggtgagctgcggccgctgcagagtgaaggcgctgcagcgctggtcaccaaggggtgccagcgattggcagcccagggcgcacggcctgaggcccccaaacggaaatgggccgaggatggtggggatgccccttcacccagcaaacggccctgggccaggcaagagaaccaggaggcagagcgggagggtggcatgagctgcagctgcagcagtggcagtggtgaggccagtgctgggctgatggaggaggcgctgccctctgcgcccgagcgcctggccctggactatatcgtgccctgcatgcggtactacggcatctgcgtcaaggacagcttcctgggggcagcactgggcggtcgcgtgctggccgaggtggaggccctcaaacggggtgggcgcctgcgagacgggcagctagtgagccagagggcgatcccgccgcgcagcatccgtggggaccagattgcctgggtggaaggccatgaaccaggctgtcgaagcattggtgccctcatggcccatgtggacgccgtcatccgccactgcgcagggcggctgggcagctatgtcatcaacgggcgcaccaaggccatggtggcgtgttacccaggcaacgggctcgggtacgtaaggcacgttgacaatccccacggcgatgggcgctgcatcacctgtatctattacctgaatcagaactgggacgttaaggtgcatggcggcctgctgcagatcttccctgagggccggcccgtggtagccaacatcgagccactctttgaccggttgctcattttctggtctgaccggcggaacccccacgaggtgaagccagcctatgccaccaggtacgccatcactgtctggtattttgatgccaaggagcgggcagcagccaaagacaagtatcagctagcatcaggacagaaaggtgtccaagtacctgtatcacagccgcctacgcccacctagtggccagtcccagagccgcatggcagacagcttaaatgacttcaggagagccctgggcctgtgctggctgctccttccctgccaccgctgctgcttctgactttgcctctgtcctgcctggtgtggagggctctgtctgttgctgaggaccaaggaggagaagagacctttgctgccccatcatgggggctggggttgtcacctggacagggggcagccgtggaggccaccgttaccaactgaagctgggggcctgggtcctaccctgtctggtcatgaccccattaggtatggagagctgggaggaggcattgtcacttcccaccaggatgcaggacttggggttgaggtgagtcatggcctcttgctggcaatggggtgggaggagtacccccaagtcctctcactcctccagcctggaatgtgaagtgactccccaacccctttggccatggcaggcaccttttggactgggctgccactgcttgggcagagtaaaaggtgccaggaggagcatgggtgtggaagtcctgtcagccaagaaataaaagtttacctcagagctgca

SEQ ID NO: 295004 - DNA, 2308 bp, Homo sapiens
acgttgggtgccggccgttgtgggggttggggtgggggcggggagcgcgcgccgggcggaggccgagtggagggggaggggagggggtccgagcggcccttaggccctgcccctgtcgcctactgcgctcagaaggggcctcagggcctgccccgggttgggggcgttggggtgccctggatgggggcacctttatctctcgtcctgtctccgggtgcgtgcaccctcctccgtcctttcctctgtcgccgcggaccctctccccgagggcccctcccgtcgccaccctgaagggtcccttcccaagcccttagggaccgcagaggacttggggaccagcaagcaacccccagggcacgagaagagctcttgctgtctgccctgcctcaccctgccccacgccaggcccggtggcccccagctgcatcaagtggaggcggaggaggaggcggaggagggtggcaccatgggcccgggcggtgccctccatgcccgggggatgaagacactgctgccatggacagcccgtgccagccgcagcccctaagtcaggctctccctcagttaccagggtcttcgtcagagcccttggagcctgagcctggccgggccaggatgggagtggagagttacctgccctgtcccctgctcccctcctaccactgtccaggagtgcctagtgaggcctcggcagggagtgggacccccagagccacagccacctctaccactgccagccctcttcgggacggttttggcgggcaggatggtggtgagctgcggccgctgcagagtgaaggcgctgcagcgctggtcaccaaggggtgccagcgattggcagcccagggcgcacggcctgaggcccccaaacggaaatgggccgaggatggtggggatgccccttcacccagcaaacggccctgggccaggcaagagaaccaggaggcagagcgggagggtggcatgagctgcagctgcagcagtggcagtggtgaggccagtgctgggctgatggaggaggcgctgccctctgcgcccgagcgcctggccctggactatatcgtgccctgcatgcggtactacggcatctgcgtcaaggacagcttcctgggggcagcactgggcggtcgcgtgctggccgaggtggaggccctcaaacggggtgggcgcctgcgagacgggcagctagtgagccagagggcgatcccgccgcgcagcatccgtggggaccagattgcctgggtggaaggccatgaaccaggctgtcgaagcattggtgccctcatggcccatgtggacgccgtcatccgccactgcgcagggcggctgggcagctatgtcatcaacgggcgcaccaaggccatggtggcgtgttacccaggcaacgggctcgggtacgtaaggcacgttgacaatccccacggcgatgggcgctgcatcacctgtatctattacctgaatcagaactgggacgttaaggtgcatggcggcctgctgcagatcttccctgagggccggcccgtggtagccaacatcgagccactctttgaccggttgctcattttctggtctgaccggcggaacccccacgaggtgaagccagcctatgccaccaggtacgccatcactgtctggtattttgatgccaaggagcgggcagcagccaaagacaagtatcagctagcatcaggacagaaaggtgtccaagtacctgtatcacagccgcctacgcccacctagtggccagtcccagagccgcatggcagacagcttaaatgacttcaggagagccctgggcctgtgctggctgctccttccctgccaccgctgctgcttctgactttgcctctgtcctgcctggtgtggagggctctgtctgttgctgaggaccaaggaggagaagagacctttgctgccccatcatgggggctggggttgtcacctggacagggggcagccgtggaggccaccgttaccaactgaagctgggggcctgggtcctaccctgtctggtcatgaccccattaggtatggagagctgggaggaggcattgtcacttcccaccaggatgcaggacttggggttgaggtgagtcatggcctcttgctggcaatggggtgggaggagtacccccaagtcctctcactcctccagcctggaatgtgaagtgactccccaacccctttggccatggcaggcaccttttggactgggctgccactgcttgggcagagtaaaaggtgccaggaggagcatgggtgtggaagtcctgtcagccaagaaataaaagtttacctcagagctgca

SEQ ID NO: 295005 - DNA, 2570 bp, Homo sapiens
ggtgggggcggggtatggcgcgctgtgcggcgcagggcggctggcacaaacggcggcgccggggccggaggaaaaagctcgccaccctgaagggtcccttcccaagcccttagggaccgcagaggacttggggaccagcaagcaacccccagggcacgagaagagctcttgctgtctgccctgcctcaccctgccccacgccaggcccggtggcccccagctgcatcaagtggaggcggaggaggaggcggaggagggtggcaccatgggcccgggcggtgccctccatgcccgggggatgaagacactgctgccatggacagcccgtgccagccgcagcccctaagtcaggctctccctcagttaccagggtcttcgtcagagcccttggagcctgagcctggccgggccaggatgggagtggagagttacctgccctgtcccctgctcccctcctaccactgtccaggagtgcctagtgaggcctcggcagggagtgggacccccagagccacagccacctctaccactgccagccctcttcgggacggttttggcgggcaggatggtggtgagctgcggccgctgcagagtgaaggcgctgcagcgctggtcaccaaggggtgccagcgattggcagcccagggcgcacggcctgaggcccccaaacggaaatgggccgaggatggtggggatgccccttcacccagcaaacggccctgggccaggcaagagaaccaggaggcagagcgggagggtggcatgagctgcagctgcagcagtggcagtggtgaggccagtgctgggctgatggaggaggcgctgccctctgcgcccgagcgcctggccctggactatatcgtgccctgcatgcggtactacggcatctgcgtcaaggacagcttcctgggggcagcactgggcggtcgcgtgctggccgaggtggaggccctcaaacggggtgggcgcctgcgagacgggcagctagtgagccagagggcgatcccgccgcgcagcatccgtggggaccagattgcctgggtggaaggccatgaaccaggctgtcgaagcattggtgccctcatggcccatgtggacgccgtcatccgccactgcgcagggcggctgggcagctatgtcatcaacgggcgcaccaaggccatggtggcgtgttacccaggcaacgggctcgggtacgtaaggcacgttgacaatccccacggcgatgggcgctgcatcacctgtatctattacctgaatcagaactgggacgttaaggtaggggtgagggtgagggtgagggtggcgctggggctagggctggggcgggggtggcgtgcgtccactccattttccactctcagcccagattctggcattctcctgtttctcttctcaacacacagcgggcagtgcgatctgccggctcttcctgggaaatggcacctcctcctctctagcggactgtgtggtgggaactcccctctttccgggaatggtgctgtctgcccagccccacccggccttgtaatgaacactttcccccttttcctgtctttagtagcttcctgcccatctccatggtgatgcagtctctgggttgtcattcactttgagagcccgaggggtgggagggagtgatgcaggcagacgctgcgcctcctagtgggctcccggggcaccgtgggaggcagcggctcctggccgtaccagctagcctcatcctttggcctgcccccaggtgcatggcggcctgctgcagatcttccctgagggccggcccgtggtagccaacatcgagccactctttgaccggttgctcattttctggtctgaccggcggaacccccacgaggtgaagccagcctatgccaccaggtacgccatcactgtctggtattttgatgccaaggagcgggcagcagccaaagacaagtatcagctagcatcaggacagaaaggtgtccaagtacctgtatcacagccgcctacgcccacctagtggccagtcccagagccgcatggcagacagcttaaatgacttcaggagagccctgggcctgtgctggctgctccttccctgccaccgctgctgcttctgactttgcctctgtcctgcctggtgtggagggctctgtctgttgctgaggaccaaggaggagaagagacctttgctgccccatcatgggggctggggttgtcacctggacagggggcagccgtggaggccaccgttaccaactgaagctgggggcctgggtcctaccctgtctggtcatgaccccattaggtatggagagctgggaggaggcattgtcacttcccaccaggatgcaggacttggggttgaggtgagtcatggcctcttgctggcaatggggtgggaggagtacccccaagtcctctcactcctccagcctggaatgtgaagtgactccccaacccctttggccatggcaggcaccttttggactgggctgccactgcttgggcagagtaaaaggtgccaggaggagcatgggtgtggaagtcctgtcagccaagaaataaaagtttacctcagagctgca

SEQ ID NO: 295006 - DNA, 2039 bp, Homo sapiens
ggtgggggcggggtatggcgcgctgtgcggcgcagggcggctggcacaaacggcggcgccggggccggaggaaaaagctcgccaccctgaagggtcccttcccaagcccttagggaccgcagaggacttggggaccagcaagcaacccccagggcacgagaagagctcttgctgtctgccctgcctcaccctgccccacgccaggcccggtggcccccagctgcatcaagtggaggcggaggaggaggcggaggagggtggcaccatgggcccgggcggtgccctccatgcccgggggatgaagacactgctgccatggacagcccgtgccagccgcagcccctaagtcaggctctccctcagttaccagggtcttcgtcagagcccttggagcctgagcctggccgggccaggatgggagtggagagttacctgccctgtcccctgctcccctcctaccactgtccaggagtgcctagtgaggcctcggcagggagtgggacccccagagccacagccacctctaccactgccagccctcttcgggacggttttggcgggcaggatggtggtgagctgcggccgctgcagagtgaaggcgctgcagcgctggtcaccaaggggtgccagcgattggcagcccagggcgcacggcctgaggcccccaaacggaaatgggccgaggatggtggggatgccccttcacccagcaaacggccctgggccaggcaagagaaccaggaggcagagcgggagggtggcatgagctgcagctgcagcagtggcagtggtgaggccagtgctgggctgatggaggaggcgctgccctctgcgcccgagcgcctggccctggactatatcgtgccctgcatgcggtactacggcatctgcgtcaaggacagcttcctgggggcagcactgggcggtcgcgtgctggccgaggtggaggccctcaaacggggtgggcgcctgcgagacgggcagctagtgagccagagggcgatcccgccgcgcagcatccgtggggaccagattgcctgggtggaaggccatgaaccaggctgtcgaagcattggtgccctcatggcccatgtggacgccgtcatccgccactgcgcagggcggctgggcagctatgtcatcaacgggcgcaccaaggccatggtggcgtgttacccaggcaacgggctcgggtacgtaaggcacgttgacaatccccacggcgatgggcgctgcatcacctgtatctattacctgaatcagaactgggacgttaaggtgcatggcggcctgctgcagatcttccctgagggccggcccgtggtagccaacatcgagccactctttgaccggttgctcattttctggtctgaccggcggaacccccacgaggtgaagccagcctatgccaccagcatcaggacagaaaggtgtccaagtacctgtatcacagccgcctacgcccacctagtggccagtcccagagccgcatggcagacagcttaaatgacttcaggagagccctgggcctgtgctggctgctccttccctgccaccgctgctgcttctgactttgcctctgtcctgcctggtgtggagggctctgtctgttgctgaggaccaaggaggagaagagacctttgctgccccatcatgggggctggggttgtcacctggacagggggcagccgtggaggccaccgttaccaactgaagctgggggcctgggtcctaccctgtctggtcatgaccccattaggtatggagagctgggaggaggcattgtcacttcccaccaggatgcaggacttggggttgaggtgagtcatggcctcttgctggcaatggggtgggaggagtacccccaagtcctctcactcctccagcctggaatgtgaagtgactccccaacccctttggccatggcaggcaccttttggactgggctgccactgcttgggcagagtaaaaggtgccaggaggagcatgggtgtggaagtcctgtcagccaagaaataaaagtttacctcagagctgca

SEQ ID NO: 295007 - DNA, 2043 bp, Homo sapiens
ggtgggggcggggtatggcgcgctgtgcggcgcagggcggctggcacaaacggcggcgccggggccggaggaaaaagctcgccaccctgaagggtcccttcccaagcccttagggaccgcagaggacttggggaccagcaagcaacccccagggcacgagaagagctcttgctgtctgccctgcctcaccctgccccacgccaggcccggtggcccccagctgcatcaagtggaggcggaggaggaggcggaggagggtggcaccatgggcccgggcggtgccctccatgcccgggggatgaagacactgctgccatggacagcccgtgccagccgcagcccctaagtcaggctctccctcagttaccagggtcttcgtcagagcccttggagcctgagcctggccgggccaggatgggagtggagagttacctgccctgtcccctgctcccctcctaccactgtccaggagtgcctagtgaggcctcggcagggagtgggacccccagagccacagccacctctaccactgccagccctcttcgggacggttttggcgggcaggatggtggtgagctgcggccgctgcagagtgaaggcgctgcagcgctggtcaccaaggggtgccagcgattggcagcccagggcgcacggcctgaggcccccaaacggaaatgggccgaggatggtggggatgccccttcacccagcaaacggccctgggccaggcaagagaaccaggaggcagagcgggagggtggcatgagctgcagctgcagcagtggcagtggtgaggccagtgctgggctgatggaggaggcgctgccctctgcgcccgagcgcctggccctggactatatcgtgccctgcatgcggtactacggcatctgcgtcaaggacagcttcctgggggcagcactgggcggtcgcgtgctggccgaggtggaggccctcaaacggggtgggcgcctgcgagacgggcagctagtgagccagagggcgatcccgccgcgcagcatccgtggggaccagattgcctgggtggaaggccatgaaccaggctgtcgaagcattggtgccctcatggcccatgtggacgccgtcatccgccactgcgcagggcggctgggcagctatgtcatcaacgggcgcaccaaggcgatgggcgctgcatcacctgtatctattacctgaatcagaactgggacgttaaggtgcatggcggcctgctgcagatcttccctgagggccggcccgtggtagccaacatcgagccactctttgaccggttgctcattttctggtctgaccggcggaacccccacgaggtgaagccagcctatgccaccaggtacgccatcactgtctggtattttgatgccaaggagcgggcagcagccaaagacaagtatcagctagcatcaggacagaaaggtgtccaagtacctgtatcacagccgcctacgcccacctagtggccagtcccagagccgcatggcagacagcttaaatgacttcaggagagccctgggcctgtgctggctgctccttccctgccaccgctgctgcttctgactttgcctctgtcctgcctggtgtggagggctctgtctgttgctgaggaccaaggaggagaagagacctttgctgccccatcatgggggctggggttgtcacctggacagggggcagccgtggaggccaccgttaccaactgaagctgggggcctgggtcctaccctgtctggtcatgaccccattaggtatggagagctgggaggaggcattgtcacttcccaccaggatgcaggacttggggttgaggtgagtcatggcctcttgctggcaatggggtgggaggagtacccccaagtcctctcactcctccagcctggaatgtgaagtgactccccaacccctttggccatggcaggcaccttttggactgggctgccactgcttgggcagagtaaaaggtgccaggaggagcatgggtgtggaagtcctgtcagccaagaaataaaagtttacctcagagctgca

SEQ ID NO: 295008 - DNA, 2129 bp, Homo sapiens
ggtgggggcggggtatggcgcgctgtgcggcgcagggcggctggcacaaacggcggcgccggggccggaggaaaaagctcgccaccctgaagggtcccttcccaagcccttagggaccgcagaggacttggggaccagcaagcaacccccagggcacgagaagagctcttgctgtctgccctgcctcaccctgccccacgccaggcccggtggcccccagctgcatcaagtggaggcggaggaggaggcggaggagggtggcaccatgggcccgggcggtgccctccatgcccgggggatgaagacactgctgccatggacagcccgtgccagccgcagcccctaagtcaggctctccctcagttaccagggtcttcgtcagagcccttggagcctgagcctggccgggccaggatgggagtggagagttacctgccctgtcccctgctcccctcctaccactgtccaggagtgcctagtgaggcctcggcagggagtgggacccccagagccacagccacctctaccactgccagccctcttcgggacggttttggcgggcaggatggtggtgagctgcggccgctgcagagtgaaggcgctgcagcgctggtcaccaaggggtgccagcgattggcagcccagggcgcacggcctgaggcccccaaacggaaatgggccgaggatggtggggatgccccttcacccagcaaacggccctgggccaggcaagagaaccaggaggcagagcgggagggtggcatgagctgcagctgcagcagtggcagtggtgaggccagtgctgggctgatggaggaggcgctgccctctgcgcccgagcgcctggccctggactatatcgtgccctgcatgcggtactacggcatctgcgtcaaggacagcttcctgggggcagcactgggcggtcgcgtgctggccgaggtggaggccctcaaacggggtgggcgcctgcgagacgggcagctagtgagccagagggcgatcccgccgcgcagcatccgtggggaccagattgcctgggtggaaggccatgaaccaggctgtcgaagcattggtgccctcatggcccatgtggacgccgtcatccgccactgcgcagggcggctgggcagctatgtcatcaacgggcgcaccaaggccatggtggcgtgttacccaggcaacgggctcgggtacgtaaggcacgttgacaatccccacggcgatgggcgctgcatcacctgtatctattacctgaatcagaactgggacgttaaggtgcatggcggcctgctgcagatcttccctgagggccggcccgtggtagccaacatcgagccactctttgaccggttgctcattttctggtctgaccggcggaacccccacgaggtgaagccagcctatgccaccaggtacgccatcactgtctggtattttgatgccaaggagcgggcagcagccaaagacaagtatcagctagcatcaggacagaaaggtgtccaagtacctgtatcacagccgcctacgcccacctagtggccagtcccagagccgcatggcagacagcttaaatgacttcaggagagccctgggcctgtgctggctgctccttccctgccaccgctgctgcttctgactttgcctctgtcctgcctggtgtggagggctctgtctgttgctgaggaccaaggaggagaagagacctttgctgccccatcatgggggctggggttgtcacctggacagggggcagccgtggaggccaccgttaccaactgaagctgggggcctgggtcctaccctgtctggtcatgaccccattaggtatggagagctgggaggaggcattgtcacttcccaccaggatgcaggacttggggttgaggtgagtcatggcctcttgctggcaatggggtgggaggagtacccccaagtcctctcactcctccagcctggaatgtgaagtgactccccaacccctttggccatggcaggcaccttttggactgggctgccactgcttgggcagagtaaaaggtgccaggaggagcatgggtgtggaagtcctgtcagccaagaaataaaagtttacctcagagctgcaacaaaaaacctcatgctgcaat

SEQ ID NO: 295009 - DNA, 1839 bp, Homo sapiens
ggtgggggcggggtatggcgcgctgtgcggcgcagggcggctggcacaaacggcggcgccggggccggaggaaaaagctcgccaccctgaagggtcccttcccaagcccttagggaccgcagaggacttggggaccagcaagcaacccccagggcacgagaagagctcttgctgtctgccctgcctcaccctgccccacgccaggcccggtggcccccagctgcatcaatgggacccccagagccacagccacctctaccactgccagccctcttcgggacggttttggcgggcaggatggtggtgagctgcggccgctgcagagtgaaggcgctgcagcgctggtcaccaaggggtgccagcgattggcagcccagggcgcacggcctgaggcccccaaacggaaatgggccgaggatggtggggatgccccttcacccagcaaacggccctgggccaggcaagagaaccaggaggcagagcgggagggtggcatgagctgcagctgcagcagtggcagtggtgaggccagtgctgggctgatggaggaggcgctgccctctgcgcccgagcgcctggccctggactatatcgtgccctgcatgcggtactacggcatctgcgtcaaggacagcttcctgggggcagcactgggcggtcgcgtgctggccgaggtggaggccctcaaacggggtgggcgcctgcgagacgggcagctagtgagccagagggcgatcccgccgcgcagcatccgtggggaccagattgcctgggtggaaggccatgaaccaggctgtcgaagcattggtgccctcatggcccatgtggacgccgtcatccgccactgcgcagggcggctgggcagctatgtcatcaacgggcgcaccaaggccatggtggcgtgttacccaggcaacgggctcgggtacgtaaggcacgttgacaatccccacggcgatgggcgctgcatcacctgtatctattacctgaatcagaactgggacgttaaggtgcatggcggcctgctgcagatcttccctgagggccggcccgtggtagccaacatcgagccactctttgaccggttgctcattttctggtctgaccggcggaacccccacgaggtgaagccagcctatgccaccaggtacgccatcactgtctggtattttgatgccaaggagcgggcagcagccaaagacaagtatcagctagcatcaggacagaaaggtgtccaagtacctgtatcacagccgcctacgcccacctagtggccagtcccagagccgcatggcagacagcttaaatgacttcaggagagccctgggcctgtgctggctgctccttccctgccaccgctgctgcttctgactttgcctctgtcctgcctggtgtggagggctctgtctgttgctgaggaccaaggaggagaagagacctttgctgccccatcatgggggctggggttgtcacctggacagggggcagccgtggaggccaccgttaccaactgaagctgggggcctgggtcctaccctgtctggtcatgaccccattaggtatggagagctgggaggaggcattgtcacttcccaccaggatgcaggacttggggttgaggtgagtcatggcctcttgctggcaatggggtgggaggagtacccccaagtcctctcactcctccagcctggaatgtgaagtgactccccaacccctttggccatggcaggcaccttttggactgggctgccactgcttgggcagagtaaaaggtgccaggaggagcatgggtgtggaagtcctgtcagccaagaaataaaagtttacctcagagctgca

SEQ ID NO: 295010 - DNA, 1860 bp, Homo sapiens
ggtgggggcggggtatggcgcgctgtgcggcgcagggcggctggcacaaacggcggcgccggggccggaggaaaaagctcgccaccctgaagggtcccttcccaagcccttagggaccgcagaggacttggggaccagcaagcaacccccagggcacgagaagagctcttgctgtctgccctgcctcaccctgccccacgccaggcccggtggcccccagctgcatcaagtggaggcggaggaggaggcggaggagggtggcaccatgggcccgggcggtgccctccatgcccgggggatgaagacactgctgccatggacagcccgtgccagccgcagcccctaagtcaggctctccctcagttaccagggtcttcgtcagagcccttggagcctgagcctggccgggccaggatgggagtggagagttacctgccctgtcccctgctcccctcctaccactgtccaggagtgcctagtgaggcctcggcagggagtgggacccccagagccacagccacctctaccactgccagccctcttcgggacggttttggcgggcaggatggtggtgagctgcggccgctgcagagtgaaggcgctgcagcgctggtcaccaaggggtgccagcgattggcagcccagggcgcacggcctgaggcccccaaacggaaatgggccgaggatggtggggatgccccttcacccagcaaacggccctgggccaggcaagagaaccaggaggcagagcgggagggtggcatgagctgcagctgcagcagtggcagtggtgaggccagtgctgggctgatggaggaggcgctgccctctgcgcccgagcgcctggccctggactatatcgtgccctgcatgcggtactacggcatctgcgtcaaggacagcttcctgggggcagcactgggcggtcgcgtgctggccgaggtggaggccctcaaacggggtgggcgcctgcgagacgggcagctagtgagccagagggcgatcccgccgcgcagcatccgtggggaccagattgcctgggtggaaggccatgaaccaggctgtcgaagcattggtgccctcatggcccatgtggacgccgtcatccgccactgcgcagggcggctgggcagctatgtcatcaacgggcgcaccaaggccatggtggcgtgttacccaggcaacgggctcgggtacgtaaggcacgttgacaatccccacggcgatgggcgctgcatcacctgtatctattacctgaatcagaactgggacgttaaggtgcatggcggcctgctgcagatcttccctgagggccggcccgtggtagccaacatcgagccactctttgaccggttgctcattttctggtctgaccggcggaacccccacgaggtgaagccagcctatgccaccaggtacgccatcactgtctggtattttgatgccaaggagcgggcagcagccaaagacaagtatcagctagcatcaggacagaaaggtgtccaagtacctgtatcacagccgcctacgcccacctagtggccagtcccagagccgcatggcagacagcttaaatgacttcaggagaagctgggaggaggcattgtcacttcccaccaggatgcaggacttggggttgaggtgagtcatggcctcttgctggcaatggggtgggaggagtacccccaagtcctctcactcctccagcctggaatgtgaagtgactccccaacccctttggccatggcaggcaccttttggactgggctgccactgcttgggcagagtaaaaggtgccaggaggagcatgggtgtggaagtcctgtcagccaagaaataaaagtttacctcagagctgca

SEQ ID NO: 295011 - DNA, 1631 bp, Homo sapiens
ggtgggggcggggtatggcgcgctgtgcggcgcagggcggctggcacaaacggcggcgccggggccggaggaaaaagctcgccaccctgaagggtcccttcccaagcccttagggaccgcagaggacttggggaccagcaagcaacccccagggcacgagaagagctcttgctgtctgccctgcctcaccctgccccacgccaggcccggtggcccccagctgcatcaagtggaggcggaggaggaggcggaggagggtggcaccatgggcccgggcggtgccctccatgcccgggggatgaagacactgctgccatggacagcccgtgccagccgcagcccctaagtcaggctctccctcagttaccagggtcttcgtcagagcccttggagcctgagcctggccgggccaggatgggagtggagagttacctgccctgtcccctgctcccctcctaccactgtccaggagtgcctagtgaggcctcggcagggagtgggacccccagagccacagccacctctaccactgccagccctcttcgggacggttttggcgggcaggatggtggtgagctgcggccgctgcagagtgaaggcgctgcagcgctggtcaccaaggggtgccagcgattggcagcccagggcgcacggcctgaggcccccaaacggaaatgggccgaggatggtggggatgccccttcacccagcaaacggccctgggccaggcaagagaaccaggaggcagagcgggagggtggcatgagctgcagctgcagcagtggcagtggtgaggccagtgctgggctgatggaggaggcgctgccctctgcgcccgagcgcctggccctggactatatcgtgccctgcatgcggtactacggcatctgcgtcaaggacagcttcctgggggcagcactgggcggtcgcgtgctggccgaggtggaggccctcaaacggggtgggcgcctgcgagacgggcagctagtgagccagagggcgatcccgccgcgcagcatccgtggggaccagattgcctgggtggaaggccatgaaccaggctgtcgaagcattggtgccctcatggcccatgtggacgccgtcatccgccactgcgcagggcggctgggcagctatgtcatcaacgggcgcaccaaggccatggtggcgtgttacccaggcaacgggctcgggtacgtaaggcacgttgacaatccccacggcgatgggcgctgcatcacctgtatctattacctgaatcagaactgggacgttaaggtgcatggcggcctgctgcagatcttccctgagggccggcccgtggtagccaacatcgagccactctttgaccggttgctcattttctggtctgaccggcggaacccccacgaggtgaagccagcctatgccaccaggtacgccatcactgtctggtattttgatgccaaggagcgggcagcagccaaagacaagtatcagctagcatcaggacagaaaggtgtccaagtacctgtatcacagccgccttttggactgggctgccactgcttgggcagagtaaaaggtgccaggaggagcatgggtgtggaagtcctgtcagccaagaaataaaagtttacctcagagctgca

SEQ ID NO: 295012 - DNA, 1357 bp, Homo sapiens
ggtgggggcggggtatggcgcgctgtgcggcgcagggcggctggcacaaacggcggcgccggggccggaggaaaaagctcgccaccctgaagggtcccttcccaagcccttagggaccgcagaggacttggggaccagcaagcaacccccagggcacgagaagagctcttgctgtctgccctgcctcaccctgccccacgccaggcccggtggcccccagctgcatcaagtggaggcggaggaggaggcggaggagggtggcaccatgggcccgggcggtgccctccatgcccgggggatgaagacactgctgccatggacagcccgtgccagccgcagcccctaagtcaggctctccctcagttaccagggtcttcgtcagagcccttggagcctgagcctggccgggccaggatgggagtggagagttacctgccctgtcccctgctcccctcctaccactgtccaggagtgcctagtgaggcctcggcagggagtgggacccccagagccacagccacctctaccactgccagccctcttcgggacggttttggcgggcaggatggtggtgagctgcggccgctgcagagtgaaggcgctgcagcgctggtcaccaaggggtgccagcgattggcagcccagggcgcacggcctgaggcccccaaacggaaatgggccgaggatggtggggatgccccttcacccagcaaacggccctgggccaggcaagagaaccaggaggcagagcgggagggtggcatgagctgcagctgcagcagtggcagtggtgaggccagtgctgggctgatggaggaggcgctgccctctgcgcccgagcgcctggccctggactatatcgtgccctgcatgcggtactacggcatctgcgtcaaggacagcttcctgggggcagcactgggcggtcgcgtgctggccgaggtggaggccctcaaacggggtgggcgcctgcgagacgggcagctagtgagccagagggcgatcccgccgcgcagcatccgtggggaccagattgcctgggtggaaggccatgaaccaggctgtcgaagcattggtgccctcatggcccatgtggacgccgtcatccgccactgcgcagggcggctgggcagctatgtcatcaacgggcgcaccaaggccatggtggcgtgttacccaggcaacgggctcgggtacgtaaggcacgttgacaatccccacgtccccaacccctttggccatggcaggcaccttttggactgggctgccactgcttgggcagagtaaaaggtgccaggaggagcatgggtgtggaagtcctgtcagccaagaaataaaagtttacctcagagctgca

SEQ ID NO: 295013 - DNA, 3708 bp, Homo sapiens
gtgggacagtcacaggcttctgactggggtgtgtgtgtagtgggggtggggctcttggcaggcagattgtcaccaatagcctttaagtctttggtctcctggccctggtcccacctgtccctcccctaggtgggaggggtggagagcaagtttcctgaggccttcccctgtgagggcaggaagtagatactttccttggggccagaggatgctttcacccccaaggtgtgtatatgtgggggaagggtggggccctaaagagcaggttcctgtttctgtgtgagtcccatgtgcttggtgggaggcgctgtgtgagaatgtacagggcaggaggaaacatagcagggctggggtgcagaggaggcccagagcagtgcactccagtctgcaggtactgcactgggcactggggagaccaacctggccccaggggcttccctgtggctgccttccagggcagtactaggtaaacaggtgcctgtgctgatgccatgttgctaggagtggaacggacaatcagccggagtactcaaggtgacccttggtctctgaatcctgaataacaaagagggtcagaaggaagagtgtcccaggccagtgctgaggccttgtggtggcgatgagctcagcctgttgaggcatggagcagagtgatgggagaggcacatgaggttgggggcctttgaggctgtggttgggaatttgtattttctcaggatggagtgaagacctggagaggaggggctctggctgctgtgtggggatgaattgtgggaagagggtgcagcactggaccccttccctgccacccatccacgtgcatcatcagtgtaatctctgattggattcctaattggggaggtcttgcccatctctagtcagtaactcactgtttctaagcctcctggaccatggcccaattcttctcccagtgaggtggttgctcagagtgccgacccttccatagggagtgagcagtgcaaagaaggtgccccctcctgaaccttgaagtgtagccattagggttttccctggggggccttctcactaattgtactctggtgctgccagagagaaggttgtcagcttcccactgctaggtggcagtagatggtggcagccctctctttccagggcaaggtctggtggatgaggtgcacatggttaatgcagagcagcttaacatccaccacagagggtgagccctgggataatgtgttgggaggcgtcctggggagggtgaggattgaagcagcccagtctgctgtggcgtgcgtgcttggcaagcatcctgttgtggcagtggccactgatgtttgatcgtgaatgtttatcttgggactgtcttgctgggccgggcccataggtgtagctgagcattcgtggggaatggacgccagcagagttgtaccagggcagagaggtcagggcagagaggtcaagacagatggtccgggctggggagaagttgaagggtccttgtgccagtcctcccctttttgtgtgctacctcatcttgccactgcagtgactttgggcagagggtgggacagggaccttttaaaatttttaaatggcatttcagcctgtgctccagttctccatgtggcaggcactgtgctggctgtcttcccagacacttgttatcttgttcacttgttccacaacaacctgtgaaatagctgtgagctccattggatccatggatgaggaacctgagaccaggaagtcacctgcctgatgccacagctcatgtggcagcactgagacttgaaccagggaattgtgtctgcagaagtggctgggccatttcctttacctctcagccacctttctgccagctccctgatgacaaacatcccggggccctggccacagcattgtagggctgggtcaggggagtggcaactgtcaggcagaggaaagaaccctgtagacagagaaaccaagccctgcaatgagtcctgttagatctccaggagttggggctccagaacctcccaagttatgttctcagagagattaattgctaccgctgtaaacagcagtgtttattacccctgctgtacacatcaggcagttgaggcccattcaggtgttggaactggctagggttacccagcaaattatccttggagttggaattaggtctttctattcagactgtagcttttggctcctgttcggaggtctatgggacagataatttagtggggattctttgtagtccagggcagcagttcttaacattgctgcatggtagaattacctgggaagctttaccaatttcaggcccttccttaggccaggtacttcagaacctcagagctccccagggggctccactccacagccaagggtaagaattcctggtctagggctgtgaggccacctccttgcacacctgaaaatgtttaaattggtattattctactgaaatggctgaggtggggtttggggtatcttgaaacaaatcaaactctgttactaattgagccctagctgggtgccaggccccaggtatgtgtgttgggagggagtgggctcttgaggcccaggagctgaggtttctgatagacttggggatgggattttggctgaaaaagaaagtcttttggggcaggagcttggaacccttgacccaaggagtcatggggaagatggggcaaggaggggtgggaaaataggtaattcatggctgcttctctaagatgtgcctgcctagccccagtaaacctacctccctccatccctgccaggccatggtggcgtgttacccaggcaacgggctcgggtacgtaaggcacgttgacaatccccacggcgatgggcgctgcatcacctgtatctattacctgaatcagaactgggacgttaaggtgcatggcggcctgctgcagatcttccctgagggccggcccgtggtagccaacatcgagccactctttgaccggttgctcattttctggtctgaccggcggaacccccacgaggtgaagccagcctatgccaccaggtacgccatcactgtctggtattttgatgccaaggagcgggcagcagccaaagacaagtatcagctagcatcaggacagaaaggtgtccaagtacctgtatcacagccgcctacgcccacctagtggccagtcccagagccgcatggcagacagcttaaatgacttcaggagagccctgggcctgtgctggctgctccttccctgccaccgctgctgcttctgactttgcctctgtcctgcctggtgtggagggctctgtctgttgctgaggaccaaggaggagaagagacctttgctgccccatcatgggggctggggttgtcacctggacagggggcagccgtggaggccaccgttaccaactgaagctgggggcctgggtcctaccctgtctggtcatgaccccattaggtatggagagctgggaggaggcattgtcacttcccaccaggatgcaggacttggggttgaggtgagtcatggcctcttgctggcaatggggtgggaggagtacccccaagtcctctcactcctccagcctggaatgtgaagtgactccccaacccctttggccatggcaggcaccttttggactgggctgccactgcttgggcagagtaaaaggtgccaggaggagcatgggtgtggaagtcctgtcagccaagaaataaaagtttacctcagagctgca

SEQ ID NO: 295014 - DNA, 1020 bp, Homo sapiens
gcccagatgggacactgctctgagcctcaatttgctgatccacggaatacgaaaaccaggttacatccccagccatggtggcgtgttacccaggcaacgggctcgggtacgtaaggcacgttgacaatccccacggcgatgggcgctgcatcacctgtatctattacctgaatcagaactgggacgttaaggtgcatggcggcctgctgcagatcttccctgagggccggcccgtggtagccaacatcgagccactctttgaccggttgctcattttctggtctgaccggcggaacccccacgaggtgaagccagcctatgccaccaggtacgccatcactgtctggtattttgatgccaaggagcgggcagcagccaaagacaagtatcagctagcatcaggacagaaaggtgtccaagtacctgtatcacagccgcctacgcccacctagtggccagtcccagagccgcatggcagacagcttaaatgacttcaggagagccctgggcctgtgctggctgctccttccctgccaccgctgctgcttctgactttgcctctgtcctgcctggtgtggagggctctgtctgttgctgaggaccaaggaggagaagagacctttgctgccccatcatgggggctggggttgtcacctggacagggggcagccgtggaggccaccgttaccaactgaagctgggggcctgggtcctaccctgtctggtcatgaccccattaggtatggagagctgggaggaggcattgtcacttcccaccaggatgcaggacttggggttgaggtgagtcatggcctcttgctggcaatggggtgggaggagtacccccaagtcctctcactcctccagcctggaatgtgaagtgactccccaacccctttggccatggcaggcaccttttggactgggctgccactgcttgggcagagtaaaaggtgccaggaggagcatgggtgtggaagtcctgtcagccaagaaataaaagtttacctcagagctgca

SEQ ID NO: 295015 - DNA, 1193 bp, Homo sapiens
ggtgggggcggggtatggcgcgctgtgcggcgcagggcggctggcacaaacggcggcgccggggccggaggaaaaagctcgccaccctgaagggtcccttcccaagcccttagggaccgcagaggacttggggaccagcaagcaacccccagggcacgagaagagctcttgctgtctgccctgcctcaccctgccccacgccaggcccggtggcccccagctgcatcaagtggaggcggaggaggaggcggaggagggtggcaccatgggcccgggcggtgccctccatgcccgggggatgaagacactgctgccatggacagcccgtgccagccgcagcccctaagtcaggctctccctcagttaccagggtcttcgtcagagcccttggagcctgagcctggccgggccaggatgggagtggagagttacctgccctgtcccctgctcccctcctaccactgtccaggagtgcctagtgaggcctcggcagggagtgggacccccagagccacagccacctctaccactgccagccctcttcgggacggttttggcgggcaggatggtggtgagctgcggccgctgcagagtgaaggcgctgcagcgctggtcaccaaggggtgccagcgattggcagcccagggcgcacggcctgaggcccccaaacggaaatgggccgaggatggtggggatgccccttcacccagcaaacggccttctgactttgcctctgtcctgcctggtgtggagggctctgtctgttgctgaggaccaaggaggagaagagacctttgctgccccatcatgggggctggggttgtcacctggacagggggcagccgtggaggccaccgttaccaactgaagctgggggcctgggtcctaccctgtctggtcatgaccccattaggtatggagagctgggaggaggcattgtcacttcccaccaggatgcaggacttggggttgaggtgagtcatggcctcttgctggcaatggggtgggaggagtacccccaagtcctctcactcctccagcctggaatgtgaagtgactccccaacccctttggccatggcaggcaccttttggactgggctgccactgcttgggcagagtaaaaggtgccaggaggagcatgggtgtggaagtcctgtcagccaagaaataaaagtttacctcagagctgca

SEQ ID NO: 295016 - DNA, 1045 bp, Homo sapiens
ggtgggggcggggtatggcgcgctgtgcggcgcagggcggctggcacaaacggcggcgccggggccggaggaaaaagctcgccaccctgaagggtcccttcccaagcccttagggaccgcagaggacttggggaccagcaagcaacccccagggcacgagaagagctcttgctgtctgccctgcctcaccctgccccacgccaggcccggtggcccccagctgcatcaagtggaggcggaggaggaggcggaggagggtggcaccatgggcccgggcggtgccctccatgcccgggggatgaagacactgctgccatggacagcccgtgccagccgcagcccctaagtcaggctctccctcagttaccagggtcttcgtcagagcccttggagcctgagcctggccgggccaggatgggagtggagagttacctgccctgtcccctgctcccctcctaccactgtccaggagtgcctagtgaggcctcggcagggagtgggacccccagagccacagccacctctaccactgccagccctcttcgggacggttttggcgggcaggatggtggtgagctgcggccgctgcagagtgaaggcgctgcagcgctggtcaccaaggggtgccagcgattggcagcccagggcgcacggcctgaggcccccaaacggaaatgggccgaggatggtgcagccgtggaggccaccgttaccaactgaagctgggggcctgggtcctaccctgtctggtcatgaccccattaggtatggagagctgggaggaggcattgtcacttcccaccaggatgcaggacttggggttgaggtgagtcatggcctcttgctggcaatggggtgggaggagtacccccaagtcctctcactcctccagcctggaatgtgaagtgactccccaacccctttggccatggcaggcaccttttggactgggctgccactgcttgggcagagtaaaaggtgccaggaggagcatgggtgtggaagtcctgtcagccaagaaataaaagtttacctcagagctgca

SEQ ID NO: 295017 - DNA, 995 bp, Homo sapiens
ggtgggggcggggtatggcgcgctgtgcggcgcagggcggctggcacaaacggcggcgccggggccggaggaaaaagctcgccaccctgaagggtcccttcccaagcccttagggaccgcagaggacttggggaccagcaagcaacccccagggcacgagaagagctcttgctgtctgccctgcctcaccctgccccacgccaggcccggtggcccccagctgcatcaagtggaggcggaggaggaggcggaggagggtggcaccatgggcccgggcggtgccctccatgcccgggggatgaagacactgctgccatggacagcccgtgccagccgcagcccctaagtcaggctctccctcagttaccagggtcttcgtcagagcccttggagcctgagcctggccgggccaggatgggagtggagagttacctgccctgtcccctgctcccctcctaccactgtccaggagtgcctagtgaggcctcggcagggagtgggacccccagagccacagccacctctaccactgccagccctcttcgggacggttttggcgggcaggatggtggtgagctgcggccgctgcagagtgaaggcgctgcagcgctggtcaccaaggggtgccagcgattggcaggcagccgtggaggccaccgttaccaactgaagctgggggcctgggtcctaccctgtctggtcatgaccccattaggtatggagagctgggaggaggcattgtcacttcccaccaggatgcaggacttggggttgaggtgagtcatggcctcttgctggcaatggggtgggaggagtacccccaagtcctctcactcctccagcctggaatgtgaagtgactccccaacccctttggccatggcaggcaccttttggactgggctgccactgcttgggcagagtaaaaggtgccaggaggagcatgggtgtggaagtcctgtcagccaagaaataaaagtttacctcagagctgca

SEQ ID NO: 295018 - DNA, 1178 bp, Homo sapiens
acgttgggtgccggccgttgtgggggttggggtgggggcggggagcgcgcgccgggcggaggccgagtggagggggaggggagggggtccgagcggcccttaggccctgcccctgtcgcctactgcgctcagaaggggcctcagggcctgccccgggttgggggcgttggggtgccctggatgggggcacctttatctctcgtcctgtctccggccaccctgaagggtcccttcccaagcccttagggaccgcagaggacttggggaccagcaagcaacccccagggcacgagaagagctcttgctgtctgccctgcctcaccctgccccacgccaggcccggtggcccccagctgcatcaagtggaggcggaggaggaggcggaggagggtggcaccatgggcccgggcggtgccctccatgcccgggggatgaagacactgctgccatggacagcccgtgccagccgcagcccctaagtcaggctctccctcagttaccagggtcttcgtcagagcccttggagcctgagcctggccgggccaggatgggagtggagagttacctgccctgtcccctgctcccctcctaccactgtccaggagtgcctagtgaggcctcggcagggagtgggacccccagagccacagccacctctaccactgccagccctcttcgggacggttttggcgggcaggatggtggtgagctgcggccgctgcagagtgaaggcgctgcagcgctggtcaccaaggggtgccagcgattggcagcccagggcgcacggcctgaggcccccaaacggaaatgggccgaggatggtgcagccgtggaggccaccgttaccaactgaagctgggggcctgggtcctaccctgtctggtcatgaccccattaggtatggagagctgggaggaggcattgtcacttcccaccaggatgcaggacttggggttgaggtgagtcatggcctcttgctggcaatggggtgggaggagtacccccaagtcctctcactcctccagcctggaatgtgaagtgactccccaacccctttggccatggcaggcaccttttggactgggctgccactgcttgggcagagtaaaaggtgccaggaggagcatgggtgtggaagtcctgtcagccaagaaataaaagtttacctcagagctgca

SEQ ID NO: 295019 - DNA, 1196 bp, Homo sapiens
acgttgggtgccggccgttgtgggggttggggtgggggcggggagcgcgcgccgggcggaggccgagtggagggggaggggagggggtccgagcggcccttaggccctgcccctgtcgcctactgcgctcagaaggggcctcagggcctgccccgggttgggggcgttggggtgccctggatgggggcacctttatctctcgtcctgtctccgggtgcgtgcaccctcctccgtcctttcctctgtcgccgcggaccctctccccgagggcccctcccgtcgccaccctgaagggtcccttcccaagcccttagggaccgcagaggacttggggaccagcaagcaacccccagggcacgagaagagctcttgctgtctgccctgcctcaccctgccccacgccaggcccggtggcccccagctgcatcaagtggaggcggaggaggaggcggaggagggtggcaccatgggcccgggcggtgccctccatgcccgggggatgaagacactgctgccatggacagcccgtgccagccgcagcccctaagtcaggctctccctcagttaccagggtcttcgtcagagcccttggagcctgagcctggccgggccaggatgggagtggagagttacctgccctgtcccctgctcccctcctaccactgtccaggagtgcctagtgaggcctcggcagggagtgggacccccagagccacagccacctctaccactgccagccctcttcgggacggttttggcgggcaggatggtggtgagctgcggccgctgcagagtgaaggcgctgcagcgctggtcaccaaggggtgccagcgattggcaggcagccgtggaggccaccgttaccaactgaagctgggggcctgggtcctaccctgtctggtcatgaccccattaggtatggagagctgggaggaggcattgtcacttcccaccaggatgcaggacttggggttgaggtgagtcatggcctcttgctggcaatggggtgggaggagtacccccaagtcctctcactcctccagcctggaatgtgaagtgactccccaacccctttggccatggcaggcaccttttggactgggctgccactgcttgggcagagtaaaaggtgccaggaggagcatgggtgtggaagtcctgtcagccaagaaataaaagtttacctcagagctgca

SEQ ID NO: 295020 - DNA, 1118 bp, Homo sapiens
gcggaccccacaccctgcccctgctggactcagttggctgacctcgcccaggggctgctcatgatttgaaagttgtcattgataaggcggataatggtgagcagacgctcatcatcatagtcgaagcggctgccgaagagcacggaacagataatgttggaccgtgagcgactcagcacaaacgtggggtcaaagggctcgcctgagggtgaagaatggaatgggtcaggaagacgcgatgtgcagcacaccagacctcatgcagcaacaccattaatttgcacaacatccgactcaaccatggcaacgtgtcttacggtgcaaacacgggcacatggtcacaacatgctgcttaacaacaccccaaaagcatctgtcaatgccacagacagcaccgaacccacagcttcctgcagcacatcgacagcaacaacgcccaaccacagaacaggttggcaacacacacacagcacgcgacatagcacaaggcaatcatcaggcatcacggaacacaacaacacagggcaacagaacacccagcaaatacgatcacagtacatgccaacacacgacacgcagtgacctaatagccagcccggaaacatcccaagacacggtaaccacacaccaacacgtaatgccagcataccgctacataatcctgccacacaacacacgctagtacacagcaacccagcagacagcacagaacacacgatgtggcatcacaacacatacagtcaaggcagcagaacaaaggacacactatgcagcaacgcaacaacgttggcagccagcagatgacacaatgcaaaatcacatgcagtgcctgacaactctacaatctcacccagaaatatctcaacacaacacgtagcatctggccgtccaacagctgaacagaccatagtaaatactgaacaacacatttctttctttccttttttcgagatgaaatctcgctccgtcgcccatgctggagtgcggtggcacgatctcagttcactgcaacgtctgcctcccaggagaatcgcttgaacctgggaggcggaggttgcagtgatccatgatccggccattgcgctccagcctgggtgacgaaagtgaaattccatctc

SEQ ID NO: 295021 - DNA, 1017 bp, Homo sapiens
tttatagcgagcagacgctatatcataggggagttttgaagagagacgaacacccaatgtaggccgaagcactaacacaaacgtggggtcaaagggctcgcctgagggtgaagaatggaatgggtcaggaagacgcgatgtgcagcacaccagacctcatgcagcaacaccattaatttgcacaacatccgactcaaccatggcaacgtgtcttacggtgcaaacacgggcacatggtcacaacatgctgcttaacaacaccccaaaagcatctgtcaatgccacagacagcaccgaacccacagcttcctgcagcacatcgacagcaacaacgcccaaccacagaacaggttggcaacacacacacagcacgcgacatagcacaaggcaatcatcaggcatcacggaacacaacaacacagggcaacagaacacccagcaaatacgatcacagtacatgccaacacacgacacgcagtgacctaatagccagcccggaaacatcccaagacacggtaaccacacaccaacacgtaatgccagcataccgctacataatcctgccacacaacacacgctagtacacagcaacccagcagacagcacagaacacacgatgtggcatcacaacacatacagtcaaggcagcagaacaaaggacacactatgcagcaacgcaacaacgttggcagccagcagatgacacaatgcaaaatcacatgcagtgcctgacaactctacaatctcacccagaaatatctcaacacaacacgtagcatctggccgtccaacagctgaacagaccatagtaaatactgaacaacacatttctttctttccttttttcgagatgaaatctcgctccgtcgcccatgctggagtgcggtggcacgatctcagttcactgcaacgtctgcctcccaggagaatcgcttgaacctgggaggcggaggttgcagtgatccatgatccggccattgcgctccagcctgggtgacgaaagtgaaattccatctc

SEQ ID NO: 295022 - DNA, 822 bp, Homo sapiens
tagcggatcccttttgattattgctaggcagcgggcacatggtcacaacatgctgcttaacaacaccccaaaagcatctgtcaatgccacagacagcaccgaacccacagcttcctgcagcacatcgacagcaacaacgcccaaccacagaacaggttggcaacacacacacagcacgcgacatagcacaaggcaatcatcaggcatcacggaacacaacaacacagggcaacagaacacccagcaaatacgatcacagtacatgccaacacacgacacgcagtgacctaatagccagcccggaaacatcccaagacacggtaaccacacaccaacacgtaatgccagcataccgctacataatcctgccacacaacacacgctagtacacagcaacccagcagacagcacagaacacacgatgtggcatcacaacacatacagtcaaggcagcagaacaaaggacacactatgcagcaacgcaacaacgttggcagccagcagatgacacaatgcaaaatcacatgcagtgcctgacaactctacaatctcacccagaaatatctcaacacaacacgtagcatctggccgtccaacagctgaacagaccatagtaaatactgaacaacacatttctttctttccttttttcgagatgaaatctcgctccgtcgcccatgctggagtgcggtggcacgatctcagttcactgcaacgtctgcctcccaggagaatcgcttgaacctgggaggcggaggttgcagtgatccatgatccggccattgcgctccagcctgggtgacgaaagtgaaattccatctc

SEQ ID NO: 295023 - DNA, 759 bp, Homo sapiens
gcggaccccacaccctgcccctgctggactcagttggctgacctcgcccaggggctgctcatgatttgaaagttgtcattgataaggcggataatggtgagcagacgctcatcatcatagtcgaagcggctgccgaagagcacggaacagataatgttggaccgtgagcgactcagcacaaacgtggggtcaaagggctcgcctgagggtgaagaatggaatgggtcaggaagacgcgatgtgcagcacaccagacctcatgcagcaacaccattaatttgcacaacatccgactcaaccatggcaacgtgtcttacggtgcaaacacgggcacatggtcacaacatgctgcttaacaacaccccaaaagcatctgtcaatgccacagacagcaccgaacccacagcttcctgcagcacatcgacagcaacaacgcccaaccacagaacaggttggcaacacacacacagcacgcgacatagcacaaggcaatcatcaggcatcacggaacacaacaacacagggcaacagaacacccagcaaatacgatcacagtacatgccaacacacgacacgcagtgacctaatagccagcccggaaacatcccaagacacggtaaccacacaccaacacgtaatgccagcataccgctacataatcctgccaagcactagtgtcctgccaagcactagtgtcctgccaagcactagtgtcctgccaagcactagtgtcctgccacagcactagtgtcctgccaa

SEQ ID NO: 295024 - DNA, 391 bp, Homo sapiens
tccacatgcacagtttacagcaagaagtatggagccattcttactttctgttccttttttgtttttgagagacggagttttgctcgtttcccaggctgtcgaagcattggtgccctcatggcccatgtggacgccgtcatccgccactgcgcagggcggctgggcagctatgtcatcaacgggcgcaccaaggccatggtggcgtgttacccaggcaacgggctcgggtacgtaaggcacgttgacaatccccacgtccccaacccctttggccatggcaggcaccttttggactgggctgccactgcttgggcagagtaaaaggtgccaggaggagcatgggtgtggaagtcctgtcagccaagaaataaaagtttacctcagagctgca

SEQ ID NO: 295025 - DNA, 356 bp, Homo sapiens
agaggggaccccagggagagtccagcttgcttggtttgctccttgaagagcagcttggaggtgggacagtcacaggcttctgactggggtgtgtgtgtagtgggggtggggctcttggcaggcagattgtcaccaatagcctttaagtctttggtctcctggccctggtcccacctgtccctcccctaggtgggaggggtggagagcaagtttcctgaggccttcccctgtgagggcaggaagtagatactttccttggggccagaggatgctttcacccccaaggtgtgtatatgtgggggaagggtggggccctaaagagcaggttcctgtttctgtgtgagtcccatgtgctt

SEQ ID NO: 295026 - DNA, 4171 bp, Homo sapiens
gtgggacagtcacaggcttctgactggggtgtgtgtgtagtgggggtggggctcttggcaggcagattgtcaccaatagcctttaagtctttggtctcctggccctggtcccacctgtccctcccctaggtgggaggggtggagagcaagtttcctgaggccttcccctgtgagggcaggaagtagatactttccttggggccagaggatgctttcacccccaaggtgtgtatatgtgggggaagggtggggccctaaagagcaggttcctgtttctgtgtgagtcccatgtgcttggtgggaggcgctgtgtgagaatgtacagggcaggaggaaacatagcagggctggggtgcagaggaggcccagagcagtgcactccagtctgcaggtactgcactgggcactggggagaccaacctggccccaggggcttccctgtggctgccttccagggcagtactaggtaaacaggtgcctgtgctgatgccatgttgctaggagtggaacggacaatcagccggagtactcaaggtgacccttggtctctgaatcctgaataacaaagagggtcagaaggaagagtgtcccaggccagtgctgaggccttgtggtggcgatgagctcagcctgttgaggcatggagcagagtgatgggagaggcacatgaggttgggggcctttgaggctgtggttgggaatttgtattttctcaggatggagtgaagacctggagaggaggggctctggctgctgtgtggggatgaattgtgggaagagggtgcagcactggaccccttccctgccacccatccacgtgcatcatcagtgtaatctctgattggattcctaattggggaggtcttgcccatctctagtcagtaactcactgtttctaagcctcctggaccatggcccaattcttctcccagtgaggtggttgctcagagtgccgacccttccatagggagtgagcagtgcaaagaaggtgccccctcctgaaccttgaagtgtagccattagggttttccctggggggccttctcactaattgtactctggtgctgccagagagaaggttgtcagcttcccactgctaggtggcagtagatggtggcagccctctctttccagggcaaggtctggtggatgaggtgcacatggttaatgcagagcagcttaacatccaccacagagggtgagccctgggataatgtgttgggaggcgtcctggggagggtgaggattgaagcagcccagtctgctgtggcgtgcgtgcttggcaagcatcctgttgtggcagtggccactgatgtttgatcgtgaatgtttatcttgggactgtcttgctgggccgggcccataggtgtagctgagcattcgtggggaatggacgccagcagagttgtaccagggcagagaggtcagggcagagaggtcaagacagatggtccgggctggggagaagttgaagggtccttgtgccagtcctcccctttttgtgtgctacctcatcttgccactgcagtgactttgggcagagggtgggacagggaccttttaaaatttttaaatggcatttcagcctgtgctccagttctccatgtggcaggcactgtgctggctgtcttcccagacacttgttatcttgttcacttgttccacaacaacctgtgaaatagctgtgagctccattggatccatggatgaggaacctgagaccaggaagtcacctgcctgatgccacagctcatgtggcagcactgagacttgaaccagggaattgtgtctgcagaagtggctgggccatttcctttacctctcagccacctttctgccagctccctgatgacaaacatcccggggccctggccacagcattgtagggctgggtcaggggagtggcaactgtcaggcagaggaaagaaccctgtagacagagaaaccaagccctgcaatgagtcctgttagatctccaggagttggggctccagaacctcccaagttatgttctcagagagattaattgctaccgctgtaaacagcagtgtttattacccctgctgtacacatcaggcagttgaggcccattcaggtgttggaactggctagggttacccagcaaattatccttggagttggaattaggtctttctattcagactgtagcttttggctcctgttcggaggtctatgggacagataatttagtggggattctttgtagtccagggcagcagttcttaacattgctgcatggtagaattacctgggaagctttaccaatttcaggcccttccttaggccaggtacttcagaacctcagagctccccagggggctccactccacagccaagggtaagaattcctggtctagggctgtgaggccacctccttgcacacctgaaaatgtttaaattggtattattctactgaaatggctgaggtggggtttggggtatcttgaaacaaatcaaactctgttactaattgagccctagctgggtgccaggccccaggtatgtgtgttgggagggagtgggctcttgaggcccaggagctgaggtttctgatagacttggggatgggattttggctgaaaaagaaagtcttttggggcaggagcttggaacccttgacccaaggagtcatggggaagatggggcaaggaggggtgggaaaataggtaattcatggctgcttctctaagatgtgcctgcctagccccagtaaacctacctccctccatccctgccaggccatggtggcgtgttacccaggcaacgggctcgggtacgtaaggcacgttgacaatccccacggcgatgggcgctgcatcacctgtatctattacctgaatcagaactgggacgttaaggtaggggtgagggtgagggtgagggtggcgctggggctagggctggggcgggggtggcgtgcgtccactccattttccactctcagcccagattctggcattctcctgtttctcttctcaacacacagcgggcagtgcgatctgccggctcttcctgggaaatggcacctcctcctctctagcggactgtgtggtgggaactcccctctttccgggaatggtgctgtctgcccagccccacccggccttgtaatgaacactttcccccttttcctgtctttagtagcttcctgcccatctccatggtgatgcagtctctgggttgtcattcactttgagagcccgaggggtgggagggagtgatgcaggcagacgctgcgcctcctagtgggctcccggggcaccgtgggaggcagcggctcctggccgtaccagctagcctcatcctttggcctgcccccaggtgcatggcggcctgctgcagatcttccctgagggccggcccgtggtagccaacatcgagccactctttgaccggttgctcattttctggtctgaccggcggaacccccacgaggtgaagccagcctatgccaccaggtacgccatcactgtctggtattttgatgccaaggagcgggcagcagccaaagacaagtatcagctagcatcaggacagaaaggtgtccaagtacctgtatcacagccgcctacgcccacctagtggccagtcccagagccgcatggcagacagcttaaatgacttcaggagagccctgggcctgtgctggctgctccttccctgccaccgctgctgcttctgactttgcctctgtcctgcctggtgtggagggctctgtctgttgctgaggaccaaggaggagaagagacctttgctgccccatcatgggggctggggttgtcacctggacagggggcagccgtggaggccaccgttaccaactgaagctgggggcctgggtcctaccctgtctggtcatgaccccattaggtatggagagctgggaggaggcattgtcacttcccaccaggatgcaggacttggggttgaggtgagtcatggcctcttgctggcaatggggtgggaggagtacccccaagtcctctcactcctccagcctggaatgtgaagtgactccccaacccctttggccatggcaggcaccttttggactgggctgccactgcttgggcagagtaaaaggtgccaggaggagcatgggtgtggaagtcctgtcagccaagaaataaaagtttacctcagagctgca

SEQ ID NO: 295027 - DNA, 593 bp, Homo sapiens
gactgagaccacagccttaacaaacaaggaggggcacttatctttttgctttgaaagccagcatcctggagctggtccggccctatgaatgccttggtggcccgggtactgagcacagagagccaccatttccaaaggtttgaatgagttaacacttggcagcaattgcattcccgtgcacttagagtcgagacacatggagaagggttctggggtaggcttcttctttcccttttttctttttcctttttggttgttttatgtttaaaaaccacatgtctgtacggaggagcttggttagctgacattgttttacagtgctgaaaaagaagcgtggcattgaacggcatgcaccagctaaagggctgcaagcagtgagtcatgcagtctcagactgcagcgtccctaggcctgcagaattaacaaaatatatgtgtgtatatatgtagcattggttccaaaaggaatcagaacagcccagaagtgtccaaattaagcacccatgttccaccaaccccaagggggggagaacctaagtcttcccctttggtggggaactggacccctatcttccttccccggattaaagcctt

SEQ ID NO: 295028 - DNA, 1293 bp, Homo sapiens
ggttttttttttttaccccccttttttatttattatttttttgcacattgagcggatccttgggaacgagagaaaaaagaaacccaaactcacgcgtgcagaagatctccccccccttcccctcccctcctccctcttttcccctccccaggagaaaaagacccccaagcagaaaaaagttcaccttggactcgtctttttcttgcaatattttttgggggggcaaaactttttgggggtgattttttttggcttttcttcctccttcatttttcttccaaaattgctgctggtgggtgaaaaaaaaatgccgcagctgaacggcggtggaggggatgacctaggcgccaacgacgaactgatttccttcaaagacgagggcgaacaggaggagaagagctccgaaaactcctcggcagagagggatttagctgatgtcaaatcgtctctagtcaatgaatcagaaacgaatcaaaacagctcctccgattccgaggcggaaagacggcctccgcctcgctccgaaagtttccgagacaaatcccgggaaagtttggaagaagcggccaagaggcaagatggagggctctttaaggggccaccgtatcccggctaccccttcatcatgatccccgacctgacgagcccctacctccccaacggatcgctctcgcccaccgcccgaaccctccattttcagtccggcagcacacattactctgcgtacaaaacgattgaacaccagattgcagttcagtatctccagatgaaatggccactgcttgatgtccaggcagggagcctccagagtagacaagccctcaaggatgcccggtccccatcaccggcacacattgtcagccccctcccttgctgcactcagggacatgactgtcagcacttctaccccccctcagacttcactgtcagcactcaagtcttcagggacatgaaaaggagccactccttacaaaaagttggggagccctggtgtattgagtctaacaaagtgccagtggtgcagcaccctcaccatgtccaccccctcacgcctcttatcacgtacagcaatgaacacttcacgccgggaaacccacctccacacttaccagccgacgtagaccccaaaacagaatccacggctcgacctccagatatattcccgtattaccactattgctggggcggaggaaaatccccatccgtagatggttgtcccagcgcgggtaccgggttcctccgcaaggggtgtaaaccttcccagttgtcgcagtccagtggggcccccatggc

SEQ ID NO: 295029 - DNA, 3812 bp, Homo sapiens
  misc_feature (1612)..(1612): n is a, c, g, or t
ggttttttttttttaccccccttttttatttattatttttttgcacattgagcggatccttgggaacgagagaaaaaagaaacccaaactcacgcgtgcagaagatctccccccccttcccctcccctcctccctcttttcccctccccaggagaaaaagacccccaagcagaaaaaagttcaccttggactcgtctttttcttgcaatattttttgggggggcaaaactttttgggggtgattttttttggcttttcttcctccttcatttttcttccaaaattgctgctggtgggtgaaaaaaaaatgccgcagctgaacggcggtggaggggatgacctaggcgccaacgacgaactgatttccttcaaagacgagggcgaacaggaggagaagagctccgaaaactcctcggcagagagggatttagctgatgtcaaatcgtctctagtcaatgaatcagaaacgaatcaaaacagctcctccgattccgaggcggaaagacggcctccgcctcgctccgaaagtttccgagacaaatcccgggaaagtttggaagaagcggccaagaggcaagatggagggctctttaaggggccaccgtatcccggctaccccttcatcatgatccccgacctgacgagcccctacctccccaacggatcgctctcgcccaccgcccgaacctatctccagatgaaatggccactgcttgatgtccaggcagggagcctccagagtagacaagccctcaaggatgcccggtccccatcaccggcacacattgtctctaacaaagtgccagtggtgcagcaccctcaccatgtccaccccctcacgcctcttatcacgtacagcaatgaacacttcacgccgggaaacccacctccacacttaccagccgacgtagaccccaaaacaggaatcccacggcctccgcaccctccagatatatccccgtattacccactatcgcctggcaccgtaggacaaatcccccatccgctaggatggttagtaccacagcaaggtcaaccagtgtacccaatcacgacaggaggattcagacacccctaccccacagctctgaccgtcaatgcttccatgtccaggttccctccccatatggtcccaccacatcatacgctacacacgacgggcattccgcatccggccatagtcacaccaacagtcaaacaggaatcgtcccagagtgatgtcggctcactccatagttcaaagcatcaggactccaaaaaggaagaagaaaagaagaagccccacataaagaaacctcttaatgcattcatgttgtatatgaaggaaatgagagcaaaggtcgtagctgagtgcacgttgaaagaaagcgcggccatcaaccagatccttgggcggaggtggcatgcactgtccagagaagagcaagcgaaatactacgagctggcccggaaggagcgacagcttcatatgcaactgtaccccggctggtccgcgcgggataactatggaaagaagaagaagaggaaaagggacaagcagccgggagagaccaatgaacacagcgaatgtttcctaaatccttgcctttcacttcctccgattacagacctnagcgctcctaagaaatgccgagcgcgctttggccttgatcaacagaataactggtgcggcccttgcaggagaaaaaaaaagtgcgttcgctacatacaaggtgaaggcagctgcctcagcccaccctcttcagatggaagcttactagattcgcctcccccctccccgaacctgctaggctcccctccccgagacgccaagtcacagactgagcagacccagcctctgtcgctgtccctgaagcccgaccccctggcccacctgtccatgatgcctccgccacccgccctcctgctcgctgaggccacccacaaggcctccgccctctgtcccaacggggccctggacctgcccccagccgctttgcagcctgccgccccctcctcatcaattgcacagccgtcgacttcttccttacattcccacagctccctggccgggacccagccccagccgctgtcgctcgtcaccaagtctttagaatagctttagcgtcgtgaaccccgctgctttgtttatggttttgtttcacttttcttaatttgccccccacccccaccttgaaaggttttgttttgtactctcttaattttgtgccatgtggctacattagttgatgtttatcgagttcattggtcaatatttgacccattcttatttcaatttctccttttaaatatgtagatgagagaagaacctcatgattctaccaaaatttttatcaacagctgtttaaagtctttgtagcgtttaaaaaatatatatatatacataactgttatgtagttcggatagcttagttttaaaagactgattaaaaaacaaaaagaaaaaaaaagcaattttgaagcagccctccagaaggagttggttctgtattatttgtattaaatacgagcttgcgaaccaatcattttacatctggtttttaaaccgtaagggcaccatgaatgcagtgccgttacttttttttttttttttctgtgtgaaacaactcttattgtgatgttacttgttattgtttaaatgtacagaaacaaagggtaaaaatgtgttaatataccttgttccatggtgttgttcttttggggggaggggacgctactcaacacttaatagaatcacaacgctgttgggccagtagtatttattgctttagagattgcttgtcgtacctgtatgtcgtccctttttaaatatgttttcctttttcttgaaactgtataaagtttttttcccccttagcataagcatcttatatataacaactcatttgtacaaggtttttaagtttatatataaaatgtgtatatatatttttgtttcccctttttgacttttttttttctgtatgaaacccagatgtcaccaaatggacattaatagttgcattaaggatcagtagcattaacaaaagttgctttaaaagccattatgtaaaacaagacttgaaaatgagtgagggaattttagcgacactgtctgagcagcagtgggaaccatcttcgtttcccctttgaactcccagtgggatgccctaccctgcgcccttaggacccggactgaccgtgtacaaaactttacgtgccaaaattctcagtgaatttagctttctccctctttttgatgctgtaatttttgttcatcatgttttgctgtgatgttacataggtagatttgtatgtagttttaatgtcacctataacaaaatgtgtttggtagcagattgtccagaaagcattttaaatgaagaggtataaacccttaagggccaaaattctgtatattagattactcttaaacgaaaaaccagctgccgcttttatgtacacatattacatacgagtaggcagcagactttaaaaataaaaaaaacctaggcatgttgatgttgcaaaatgctgtataaagctgaaacctgttcattcagtgccattgtagttgacatgaagcgattgtaaaactgtctccgatttttctctggtttattaaaatgctaactataacattttttgtgaatactttgaatgtttcctaacagttgtgatgttactgttccgttttatgctcttattccaagttcatttttaatggtttggaagccatttttgtaatgaataaatgttcatgctgtacagtatctgtagcatgccgttctggattaataaaagcaacttagtatgtgcagataaaggaaggt

SEQ ID NO: 295030 - DNA, 3808 bp, Homo sapiens
ggttttttttttttaccccccttttttatttattatttttttgcacattgagcggatccttgggaacgagagaaaaaagaaacccaaactcacgcgtgcagaagatctccccccccttcccctcccctcctccctcttttcccctccccaggagaaaaagacccccaagcagaaaaaagttcaccttggactcgtctttttcttgcaatattttttgggggggcaaaactttttgggggtgattttttttggcttttcttcctccttcatttttcttccaaaattgctgctggtgggtgaaaaaaaaatgccgcagctgaacggcggtggaggggatgacctaggcgccaacgacgaactgatttccttcaaagacgagggcgaacaggaggagaagagctccgaaaactcctcggcagagagggatttagctgatgtcaaatcgtctctagtcaatgaatcagaaacgaatcaaaacagctcctccgattccgaggcggaaagacggcctccgcctcgctccgaaagtttccgagacaaatcccgggaaagtttggaagaagcggccaagaggcaagatggagggctctttaaggggccaccgtatcccggctaccccttcatcatgatccccgacctgacgagcccctacctccccaacggatcgctctcgcccaccgcccgaaccctccattttcagtccggcagcacacattactctgcgtacaaaacgattgaacaccagattgcagttcagtatctccagatgaaatggccactgcttgatgtccaggcagggagcctccagagtagacaagccctcaaggatgcccggtccccatcaccggcacacattgtctctaacaaagtgccagtggtgcagcaccctcaccatgtccaccccctcacgcctcttatcacgtacagcaatgaacacttcacgccgggaaacccacctccacacttaccagccgacgtagaccccaaaacaggaatcccacggcctccgcaccctccagatatatccccgtattacccactatcgcctggcaccgtaggacaaatcccccatccgctaggatggttagtaccacagcaaggtcaaccagtgtacccaatcacgacaggaggattcagacacccctaccccacagctctgaccgtcaatgcttccatgtccaggttccctccccatatggtcccaccacatcatacgctacacacgacgggcattccgcatccggccatagtcacaccaacagtcaaacaggaatcgtcccagagtgatgtcggctcactccatagttcaaagcatcaggactccaaaaaggaagaagaaaagaagaagccccacataaagaaacctcttaatgcattcatgttgtatatgaaggaaatgagagcaaaggtcgtagctgagtgcacgttgaaagaaagcgcggccatcaaccagatccttgggcggaggtggcatgcactgtccagagaagagcaagcgaaatactacgagctggcccggaaggagcgacagcttcatatgcaactgtaccccggctggtccgcgcgggataactatggaaagaagaagaagaggaaaagggacaagcagccgggagagaccaatgaacacagcgaatgtttcctaaatccttgcctttcacttcctccgattacaggagaaaaaaaaagtgcgttcgctacatacaaggtgaaggcagctgcctcagcccaccctcttcagatggaagcttactagattcgcctcccccctccccgaacctgctaggctcccctccccgagacgccaagtcacagactgagcagacccagcctctgtcgctgtccctgaagcccgaccccctggcccacctgtccatgatgcctccgccacccgccctcctgctcgctgaggccacccacaaggcctccgccctctgtcccaacggggccctggacctgcccccagccgctttgcagcctgccgccccctcctcatcaattgcacagccgtcgacttcttccttacattcccacagctccctggccgggacccagccccagccgctgtcgctcgtcaccaagtctttagaatagctttagcgtcgtgaaccccgctgctttgtttatggttttgtttcacttttcttaatttgccccccacccccaccttgaaaggttttgttttgtactctcttaattttgtgccatgtggctacattagttgatgtttatcgagttcattggtcaatatttgacccattcttatttcaatttctccttttaaatatgtagatgagagaagaacctcatgattctaccaaaatttttatcaacagctgtttaaagtctttgtagcgtttaaaaaatatatatatatacataactgttatgtagttcggatagcttagttttaaaagactgattaaaaaacaaaaagaaaaaaaaagcaattttgaagcagccctccagaaggagttggttctgtattatttgtattaaatacgagcttgcgaaccaatcattttacatctggtttttaaaccgtaagggcaccatgaatgcagtgccgttacttttttttttttttttctgtgtgaaacaactcttattgtgatgttacttgttattgtttaaatgtacagaaacaaagggtaaaaatgtgttaatataccttgttccatggtgttgttcttttggggggaggggacgctactcaacacttaatagaatcacaacgctgttgggccagtagtatttattgctttagagattgcttgtcgtacctgtatgtcgtccctttttaaatatgttttcctttttcttgaaactgtataaagtttttttcccccttagcataagcatcttatatataacaactcatttgtacaaggtttttaagtttatatataaaatgtgtatatatatttttgtttcccctttttgacttttttttttctgtatgaaacccagatgtcaccaaatggacattaatagttgcattaaggatcagtagcattaacaaaagttgctttaaaagccattatgtaaaacaagacttgaaaatgagtgagggaattttagcgacactgtctgagcagcagtgggaaccatcttcgtttcccctttgaactcccagtgggatgccctaccctgcgcccttaggacccggactgaccgtgtacaaaactttacgtgccaaaattctcagtgaatttagctttctccctctttttgatgctgtaatttttgttcatcatgttttgctgtgatgttacataggtagatttgtatgtagttttaatgtcacctataacaaaatgtgtttggtagcagattgtccagaaagcattttaaatgaagaggtataaacccttaagggccaaaattctgtatattagattactcttaaacgaaaaaccagctgccgcttttatgtacacatattacatacgagtaggcagcagactttaaaaataaaaaaaacctaggcatgttgatgttgcaaaatgctgtataaagctgaaacctgttcattcagtgccattgtagttgacatgaagcgattgtaaaactgtctccgatttttctctggtttattaaaatgctaactataacattttttgtgaatactttgaatgtttcctaacagttgtgatgttactgttccgttttatgctcttattccaagttcatttttaatggtttggaagccatttttgtaatgaataaatgttcatgctgtacagtatctgtagcatgccgttctggattaataaaagcaacttagtatgtgcagataaaggaaggt

SEQ ID NO: 295031 - DNA, 3757 bp, Homo sapiens
ggttttttttttttaccccccttttttatttattatttttttgcacattgagcggatccttgggaacgagagaaaaaagaaacccaaactcacgcgtgcagaagatctccccccccttcccctcccctcctccctcttttcccctccccaggagaaaaagacccccaagcagaaaaaagttcaccttggactcgtctttttcttgcaatattttttgggggggcaaaactttttgggggtgattttttttggcttttcttcctccttcatttttcttccaaaattgctgctggtgggtgaaaaaaaaatgccgcagctgaacggcggtggaggggatgacctaggcgccaacgacgaactgatttccttcaaagacgagggcgaacaggaggagaagagctccgaaaactcctcggcagagagggatttagctgatgtcaaatcgtctctagtcaatgaatcagaaacgaatcaaaacagctcctccgattccgaggcggaaagacggcctccgcctcgctccgaaagtttccgagacaaatcccgggaaagtttggaagaagcggccaagaggcaagatggagggctctttaaggggccaccgtatcccggctaccccttcatcatgatccccgacctgacgagcccctacctccccaacggatcgctctcgcccaccgcccgaaccctccattttcagtccggcagcacacattactctgcgtacaaaacgattgaacaccagattgcagttcagtatctccagatgaaatggccactgcttgatgtccaggcagggagcctccagagtagacaagccctcaaggatgcccggtccccatcaccggcacacattgtctctaacaaagtgccagtggtgcagcaccctcaccatgtccaccccctcacgcctcttatcacgtacagcaatgaacacttcacgccgggaaacccacctccacacttaccagccgacgtagaccccaaaacaggaatcccacggcctccgcaccctccagatatatccccgtattacccactatcgcctggcaccgtaggacaaatcccccatccgctaggatggttagtaccacagcaaggtcaaccagtgtacccaatcacgacaggaggattcagacacccctaccccacagctctgaccgtcaatgcttccatgtccaggttccctccccatatggtcccaccacatcatacgctacacacgacgggcattccgcatccggccatagtcacaccaacagtcaaacaggaatcgtcccagagtgatgtcggctcactccatagttcaaagcatcaggactccaaaaaggaagaagaaaagaagaagccccacataaagaaacctcttaatgcattcatgttgtatatgaaggaaatgagagcaaaggtcgtagctgagtgcacgttgaaagaaagcgcggccatcaaccagatccttgggcggaggtggcatgcactgtccagagaagagcaagcgaaatactacgagctggcccggaaggagcgacagcttcatatgcaactgtaccccggctggtccgcgcgggataactatggaaagaagaagaagaggaaaagggacaagcagccgggagagaccaatggagaaaaaaaaagtgcgttcgctacatacaaggtgaaggcagctgcctcagcccaccctcttcagatggaagcttactagattcgcctcccccctccccgaacctgctaggctcccctccccgagacgccaagtcacagactgagcagacccagcctctgtcgctgtccctgaagcccgaccccctggcccacctgtccatgatgcctccgccacccgccctcctgctcgctgaggccacccacaaggcctccgccctctgtcccaacggggccctggacctgcccccagccgctttgcagcctgccgccccctcctcatcaattgcacagccgtcgacttcttccttacattcccacagctccctggccgggacccagccccagccgctgtcgctcgtcaccaagtctttagaatagctttagcgtcgtgaaccccgctgctttgtttatggttttgtttcacttttcttaatttgccccccacccccaccttgaaaggttttgttttgtactctcttaattttgtgccatgtggctacattagttgatgtttatcgagttcattggtcaatatttgacccattcttatttcaatttctccttttaaatatgtagatgagagaagaacctcatgattctaccaaaatttttatcaacagctgtttaaagtctttgtagcgtttaaaaaatatatatatatacataactgttatgtagttcggatagcttagttttaaaagactgattaaaaaacaaaaagaaaaaaaaagcaattttgaagcagccctccagaaggagttggttctgtattatttgtattaaatacgagcttgcgaaccaatcattttacatctggtttttaaaccgtaagggcaccatgaatgcagtgccgttacttttttttttttttttctgtgtgaaacaactcttattgtgatgttacttgttattgtttaaatgtacagaaacaaagggtaaaaatgtgttaatataccttgttccatggtgttgttcttttggggggaggggacgctactcaacacttaatagaatcacaacgctgttgggccagtagtatttattgctttagagattgcttgtcgtacctgtatgtcgtccctttttaaatatgttttcctttttcttgaaactgtataaagtttttttcccccttagcataagcatcttatatataacaactcatttgtacaaggtttttaagtttatatataaaatgtgtatatatatttttgtttcccctttttgacttttttttttctgtatgaaacccagatgtcaccaaatggacattaatagttgcattaaggatcagtagcattaacaaaagttgctttaaaagccattatgtaaaacaagacttgaaaatgagtgagggaattttagcgacactgtctgagcagcagtgggaaccatcttcgtttcccctttgaactcccagtgggatgccctaccctgcgcccttaggacccggactgaccgtgtacaaaactttacgtgccaaaattctcagtgaatttagctttctccctctttttgatgctgtaatttttgttcatcatgttttgctgtgatgttacataggtagatttgtatgtagttttaatgtcacctataacaaaatgtgtttggtagcagattgtccagaaagcattttaaatgaagaggtataaacccttaagggccaaaattctgtatattagattactcttaaacgaaaaaccagctgccgcttttatgtacacatattacatacgagtaggcagcagactttaaaaataaaaaaaacctaggcatgttgatgttgcaaaatgctgtataaagctgaaacctgttcattcagtgccattgtagttgacatgaagcgattgtaaaactgtctccgatttttctctggtttattaaaatgctaactataacattttttgtgaatactttgaatgtttcctaacagttgtgatgttactgttccgttttatgctcttattccaagttcatttttaatggtttggaagccatttttgtaatgaataaatgttcatgctgtacagtatctgtagcatgccgttctggattaataaaagcaacttagtatgtgcagataaaggaaggt

SEQ ID NO: 295032 - DNA, 3627 bp, Homo sapiens
  misc_feature (1612)..(1612): n is a, c, g, or t
ggttttttttttttaccccccttttttatttattatttttttgcacattgagcggatccttgggaacgagagaaaaaagaaacccaaactcacgcgtgcagaagatctccccccccttcccctcccctcctccctcttttcccctccccaggagaaaaagacccccaagcagaaaaaagttcaccttggactcgtctttttcttgcaatattttttgggggggcaaaactttttgggggtgattttttttggcttttcttcctccttcatttttcttccaaaattgctgctggtgggtgaaaaaaaaatgccgcagctgaacggcggtggaggggatgacctaggcgccaacgacgaactgatttccttcaaagacgagggcgaacaggaggagaagagctccgaaaactcctcggcagagagggatttagctgatgtcaaatcgtctctagtcaatgaatcagaaacgaatcaaaacagctcctccgattccgaggcggaaagacggcctccgcctcgctccgaaagtttccgagacaaatcccgggaaagtttggaagaagcggccaagaggcaagatggagggctctttaaggggccaccgtatcccggctaccccttcatcatgatccccgacctgacgagcccctacctccccaacggatcgctctcgcccaccgcccgaacctatctccagatgaaatggccactgcttgatgtccaggcagggagcctccagagtagacaagccctcaaggatgcccggtccccatcaccggcacacattgtctctaacaaagtgccagtggtgcagcaccctcaccatgtccaccccctcacgcctcttatcacgtacagcaatgaacacttcacgccgggaaacccacctccacacttaccagccgacgtagaccccaaaacaggaatcccacggcctccgcaccctccagatatatccccgtattacccactatcgcctggcaccgtaggacaaatcccccatccgctaggatggttagtaccacagcaaggtcaaccagtgtacccaatcacgacaggaggattcagacacccctaccccacagctctgaccgtcaatgcttccatgtccaggttccctccccatatggtcccaccacatcatacgctacacacgacgggcattccgcatccggccatagtcacaccaacagtcaaacaggaatcgtcccagagtgatgtcggctcactccatagttcaaagcatcaggactccaaaaaggaagaagaaaagaagaagccccacataaagaaacctcttaatgcattcatgttgtatatgaaggaaatgagagcaaaggtcgtagctgagtgcacgttgaaagaaagcgcggccatcaaccagatccttgggcggaggtggcatgcactgtccagagaagagcaagcgaaatactacgagctggcccggaaggagcgacagcttcatatgcaactgtaccccggctggtccgcgcgggataactatggaaagaagaagaagaggaaaagggacaagcagccgggagagaccaatgaacacagcgaatgtttcctaaatccttgcctttcacttcctccgattacagacctnagcgctcctaagaaatgccgagcgcgctttggccttgatcaacagaataactggtgcggcccttgcaggagaaaaaaaaagtgcgttcgctacatacaaggtgaaggcagctgcctcagcccaccctcttcagatggaagcttactagattcgcctcccccctccccgaacctgctaggctcccctccccgagacgccaagtcacagactgagcagacccagcctctgtcgctgtccctgaagcccgaccccctggcccacctgtccatgatgcctccgccacccgccctcctgctcgctgaggccacccacaaggcctccgccctctgtcccaacggggccctggacctgcccccagccgctttgcagcctgccgccccctcctcatcaattgcacagccgtcgacttcttccttacattcccacagctccctggccgggacccagccccagccgctgtcgctcgtcaccaagtctttagaatagctttagcgtcgtgaaccccgctgctttgtttatggttttgtttcacttttcttaatttgccccccacccccaccttgaaaggttttgttttgtactctcttaattttgtgccatgtggctacattagttgatgtttatcgagttcattggtcaatatttgacccattcttatttcaatttctccttttaaatatgtagatgagagaagaacctcatgattctaccaaaatttttatcaacagctgtttaaagtctttgtagcgtttaaaaaatatatatatatacataactgttatgtagttcggatagcttagttttaaaagactgattaaaaaacaaaaagaaaaaaaaagcaattttgaagcagccctccagaaggagttggttctgtattatttgtattaaatacgagcttgcgaaccaatcattttacatctggtttttaaaccgtaagggcaccatgaatgcagtgccgttacttttttttttttttttctgtgtgaaacaactcttattgtgatgttacttgttattgtttaaatgtacagaaacaaagggtaaaaatgtgttaatataccttgttccatggtgttgttcttttggggggaggggacgctactcaacacttaatagaatcacaacgctgttgggccagtagtatttattgctttagagattgcttgtcgtacctgtatgtcgtccctttttaaatatgttttcctttttcttgaaactgtataaagtttttttcccccttagcataagcatcttatatataacaactcatttgtacaaggtttttaagtttatatataaaatgtgtatatatatttttgtttcccctttttgacttttttttttctgtatgaaacccagatgtcaccaaatggacattaatagttgcattaaggatcagtagcattaacaaaagttgctttaaaagccattatgtaaaacaagacttgaaaatgagtgagggaattttagcgacactgtctgagcagcagtgggaaccatcttcgtttcccctttgaactcccagtgggatgccctaccctgcgcccttaggacccggactgaccgtgtacaaaactttacggccaaaattctgtatattagattactcttaaacgaaaaaccagctgccgcttttatgtacacatattacatacgagtaggcagcagactttaaaaataaaaaaaacctaggcatgttgatgttgcaaaatgctgtataaagctgaaacctgttcattcagtgccattgtagttgacatgaagcgattgtaaaactgtctccgatttttctctggtttattaaaatgctaactataacattttttgtgaatactttgaatgtttcctaacagttgtgatgttactgttccgttttatgctcttattccaagttcatttttaatggtttggaagccatttttgtaatgaataaatgttcatgctgtacagtatctgtagcatgccgttctggattaataaaagcaacttagtatgtgcagataaaggaaggt

SEQ ID NO: 295033 - DNA, 3754 bp, Homo sapiens
  misc_feature (1612)..(1612): n is a, c, g, or t
ggttttttttttttaccccccttttttatttattatttttttgcacattgagcggatccttgggaacgagagaaaaaagaaacccaaactcacgcgtgcagaagatctccccccccttcccctcccctcctccctcttttcccctccccaggagaaaaagacccccaagcagaaaaaagttcaccttggactcgtctttttcttgcaatattttttgggggggcaaaactttttgggggtgattttttttggcttttcttcctccttcatttttcttccaaaattgctgctggtgggtgaaaaaaaaatgccgcagctgaacggcggtggaggggatgacctaggcgccaacgacgaactgatttccttcaaagacgagggcgaacaggaggagaagagctccgaaaactcctcggcagagagggatttagctgatgtcaaatcgtctctagtcaatgaatcagaaacgaatcaaaacagctcctccgattccgaggcggaaagacggcctccgcctcgctccgaaagtttccgagacaaatcccgggaaagtttggaagaagcggccaagaggcaagatggagggctctttaaggggccaccgtatcccggctaccccttcatcatgatccccgacctgacgagcccctacctccccaacggatcgctctcgcccaccgcccgaacctatctccagatgaaatggccactgcttgatgtccaggcagggagcctccagagtagacaagccctcaaggatgcccggtccccatcaccggcacacattgtctctaacaaagtgccagtggtgcagcaccctcaccatgtccaccccctcacgcctcttatcacgtacagcaatgaacacttcacgccgggaaacccacctccacacttaccagccgacgtagaccccaaaacaggaatcccacggcctccgcaccctccagatatatccccgtattacccactatcgcctggcaccgtaggacaaatcccccatccgctaggatggttagtaccacagcaaggtcaaccagtgtacccaatcacgacaggaggattcagacacccctaccccacagctctgaccgtcaatgcttccatgtccaggttccctccccatatggtcccaccacatcatacgctacacacgacgggcattccgcatccggccatagtcacaccaacagtcaaacaggaatcgtcccagagtgatgtcggctcactccatagttcaaagcatcaggactccaaaaaggaagaagaaaagaagaagccccacataaagaaacctcttaatgcattcatgttgtatatgaaggaaatgagagcaaaggtcgtagctgagtgcacgttgaaagaaagcgcggccatcaaccagatccttgggcggaggtggcatgcactgtccagagaagagcaagcgaaatactacgagctggcccggaaggagcgacagcttcatatgcaactgtaccccggctggtccgcgcgggataactatggaaagaagaagaagaggaaaagggacaagcagccgggagagaccaatgaacacagcgaatgtttcctaaatccttgcctttcacttcctccgattacagacctnagcgctcctaagaaatgccgagcgcgctttggccttgatcaacagaataactggtgcggcccttgcaggagaaaaaaaaagtgcgttcgctacatacaaggtgaaggcagctgcctcagcccaccctcttcagatggaagcttactagattcgcctcccccctccccgaacctgctaggctcccctccccgagacgccaagtcacagactgagcagacccagcctctgtcgctgtccctgaagcccgaccccctggcccacctgtccatgatgcctccgccacccgccctcctgctcgctgaggccacccacaaggcctccgccctctgtcccaacggggccctggacctgcccccagccgctttgcagcctgccgccccctcctcatcaattgcacagccgtcgacttcttccttacattcccacagctccctggccgggacccagccccagccgctgtcgctcgtcaccaagtctttagaatagctttagcgtcgtgaaccccgctgctttgtttatggttttgtttcacttttcttaatttgccccccacccccaccttgaaaggttttgttttgtactctcttaattttgtgccatgtggctacattagttgatgtttatcgagttcattggtcaatatttgacccattcttatttcaatttctccttttaaatatgtagatgagagaagaacctcatgattctaccaaaatttttatcaacagctgtttaaagtctttgtagcgtttaaaaaatatatatatatacataactgttatgtagttcggatagcttagttttaaaagactgattaaaaaacaaaaagaaaaaaaaagcaattttgaagcagccctccagaaggagttggttctgtattatttgtattaaatacgagcttgcgaaccaatcattttacatctggtttttaaaccgtaagggcaccatgaatgcagtgccgttacttttttttttttttttctgtgtgaaacaactcttattgtgatgttacttgttattgtttaaatgtacagaaacaaagggtaaaaatgtgttaatataccttgttccatggtgttgttcttttggggggaggggacgctactcaacacttaatagaatcacaacgctgttgggccagtagtatttattgctttagagattgcttgtcgtacctgtatgtcgtccctttttaaatatgttttcctttttcttgaaactgtataaagtttttttcccccttagcataagcatcttatatataacaactcatttgtacaaggtttttaagtttatatataaaatgtgtatatatatttttgtttcccctttttgacttttttttttctgtatgaaacccagatgtcaccaaatggacattaatagttgcattaaggatcagtagcattaacaaaagttgctttaaaagccattatgtaaaacaagacttgaaaatgagtgagggaattttagcgacactgtctgagcagcagtgggaaccatcttcgtttcccctttgaactcccagtgggatgccctaccctgcgcccttaggacccggactgaccgtgtacaaaactttacgtgccaaaattctcagtgaatttagctttctccctctttttgatgctgtaatttttgttcatcatgttttgctgtgatgttacataggtagatttgtatgtagttttaatgtcacctataacaaaatgtgtttggtagcagattgtccagaaagcattttaaatgaagaggtataaacccttaagggccaaaattctgtatattagattactcttaaacgaaaaaccagctgccgcttttatgtacacatattacatacgagtaggcagcagactttaaaaatttcagtgccattgtagttgacatgaagcgattgtaaaactgtctccgatttttctctggtttattaaaatgctaactataacattttttgtgaatactttgaatgtttcctaacagttgtgatgttactgttccgttttatgctcttattccaagttcatttttaatggtttggaagccatttttgtaatgaataaatgttcatgctgtacagtatctgtagcatgccgttctggattaataaaagcaacttagtatgtgcagataaaggaaggt

SEQ ID NO: 295034 - DNA, 3700 bp, Homo sapiens
ggttttttttttttaccccccttttttatttattatttttttgcacattgagcggatccttgggaacgagagaaaaaagaaacccaaactcacgcgtgcagaagatctccccccccttcccctcccctcctccctcttttcccctccccaggagaaaaagacccccaagcagaaaaaagttcaccttggactcgtctttttcttgcaatattttttgggggggcaaaactttttgggggtgattttttttggcttttcttcctccttcatttttcttccaaaattgctgctggtgggtgaaaaaaaaatgccgcagctgaacggcggtggaggggatgacctaggcgccaacgacgaactgatttccttcaaagacgagggcgaacaggaggagaagagctccgaaaactcctcggcagagagggatttagctgatgtcaaatcgtctctagtcaatgaatcagaaacgaatcaaaacagctcctccgattccgaggcggaaagacggcctccgcctcgctccgaaagtttccgagacaaatcccgggaaagtttggaagaagcggccaagaggcaagatggagggctctttaaggggccaccgtatcccggctaccccttcatcatgatccccgacctgacgagcccctacctccccaacggatcgctctcgcccaccgcccgaacctatctccagatgaaatggccactgcttgatgtccaggcagggagcctccagagtagacaagcctctaacaaagtgccagtggtgcagcaccctcaccatgtccaccccctcacgcctcttatcacgtacagcaatgaacacttcacgccgggaaacccacctccacacttaccagccgacgtagaccccaaaacaggaatcccacggcctccgcaccctccagatatatccccgtattacccactatcgcctggcaccgtaggacaaatcccccatccgctaggatggttagtaccacagcaaggtcaaccagtgtacccaatcacgacaggaggattcagacacccctaccccacagctctgaccgtcaatgcttccatgtccaggttccctccccatatggtcccaccacatcatacgctacacacgacgggcattccgcatccggccatagtcacaccaacagtcaaacaggaatcgtcccagagtgatgtcggctcactccatagttcaaagcatcaggactccaaaaaggaagaagaaaagaagaagccccacataaagaaacctcttaatgcattcatgttgtatatgaaggaaatgagagcaaaggtcgtagctgagtgcacgttgaaagaaagcgcggccatcaaccagatccttgggcggaggtggcatgcactgtccagagaagagcaagcgaaatactacgagctggcccggaaggagcgacagcttcatatgcaactgtaccccggctggtccgcgcgggataactatggaaagaagaagaagaggaaaagggacaagcagccgggagagaccaatgaacacagcgaatgtttcctaaatccttgcctttcacttcctccgattacaggagaaaaaaaaagtgcgttcgctacatacaaggtgaaggcagctgcctcagcccaccctcttcagatggaagcttactagattcgcctcccccctccccgaacctgctaggctcccctccccgagacgccaagtcacagactgagcagacccagcctctgtcgctgtccctgaagcccgaccccctggcccacctgtccatgatgcctccgccacccgccctcctgctcgctgaggccacccacaaggcctccgccctctgtcccaacggggccctggacctgcccccagccgctttgcagcctgccgccccctcctcatcaattgcacagccgtcgacttcttccttacattcccacagctccctggccgggacccagccccagccgctgtcgctcgtcaccaagtctttagaatagctttagcgtcgtgaaccccgctgctttgtttatggttttgtttcacttttcttaatttgccccccacccccaccttgaaaggttttgttttgtactctcttaattttgtgccatgtggctacattagttgatgtttatcgagttcattggtcaatatttgacccattcttatttcaatttctccttttaaatatgtagatgagagaagaacctcatgattctaccaaaatttttatcaacagctgtttaaagtctttgtagcgtttaaaaaatatatatatatacataactgttatgtagttcggatagcttagttttaaaagactgattaaaaaacaaaaagaaaaaaaaagcaattttgaagcagccctccagaaggagttggttctgtattatttgtattaaatacgagcttgcgaaccaatcattttacatctggtttttaaaccgtaagggcaccatgaatgcagtgccgttacttttttttttttttttctgtgtgaaacaactcttattgtgatgttacttgttattgtttaaatgtacagaaacaaagggtaaaaatgtgttaatataccttgttccatggtgttgttcttttggggggaggggacgctactcaacacttaatagaatcacaacgctgttgggccagtagtatttattgctttagagattgcttgtcgtacctgtatgtcgtccctttttaaatatgttttcctttttcttgaaactgtataaagtttttttcccccttagcataagcatcttatatataacaactcatttgtacaaggtttttaagtttatatataaaatgtgtatatatatttttgtttcccctttttgacttttttttttctgtatgaaacccagatgtcaccaaatggacattaatagttgcattaaggatcagtagcattaacaaaagttgctttaaaagccattatgtaaaacaagacttgaaaatgagtgagggaattttagcgacactgtctgagcagcagtgggaaccatcttcgtttcccctttgaactcccagtgggatgccctaccctgcgcccttaggacccggactgaccgtgtacaaaactttacgtgccaaaattctcagtgaatttagctttctccctctttttgatgctgtaatttttgttcatcatgttttgctgtgatgttacataggtagatttgtatgtagttttaatgtcacctataacaaaatgtgtttggtagcagattgtccagaaagcattttaaatgaagaggtataaacccttaagggccaaaattctgtatattagattactcttaaacgaaaaaccagctgccgcttttatgtacacatattacatacgagtaggcagcagactttaaaaataaaaaaaacctaggcatgttgatgttgcaaaatgctgtataaagctgaaacctgttcattcagtgccattgtagttgacatgaagcgattgtaaaactgtctccgatttttctctggtttattaaaatgctaactataacattttttgtgaatactttgaatgtttcctaacagttgtgatgttactgttccgttttatgctcttattccaagttcatttttaatggtttggaagccatttttgtaatgaataaatgttcatgctgtacagtatctgtagcatgccgttctggattaataaaagcaacttagtatgtgcagataaaggaaggt

SEQ ID NO: 295035 - DNA, 3448 bp, Homo sapiens
ggttttttttttttaccccccttttttatttattatttttttgcacattgagcggatccttgggaacgagagaaaaaagaaacccaaactcacgcgtgcagaagatctccccccccttcccctcccctcctccctcttttcccctccccaggagaaaaagacccccaagcagaaaaaagttcaccttggactcgtctttttcttgcaatattttttgggggggcaaaactttttgggggtgattttttttggcttttcttcctccttcatttttcttccaaaattgctgctggtgggtgaaaaaaaaatgccgcagctgaacggcggtggaggggatgacctaggcgccaacgacgaactgatttccttcaaagacgagggcgaacaggaggagaagagctccgaaaactcctcggcagagagggatttagctgatgtcaaatcgtctctagtcaatgaatcagaaacgaatcaaaacagctcctccgattccgaggcggaaagacggcctccgcctcgctccgaaagtttccgagacaaatcccgggaaagtttggaagaagcggccaagaggcaagatggagggctctttaaggggccaccgtatcccggctaccccttcatcatgatccccgacctgacgagcccctacctccccaacggatcgctctcgcccaccgcccgaaccctccattttcagtccggcagcacacattactctgcgtacaaaacgattgaacaccagattgcagttcagtatctccagatgaaatggccactgcttgatgtccaggcagggagcctccagagtagacaagccctcaaggatgcccggtccccatcaccggcacacattgtctctaacaaagtgccagtggtgcagcaccctcaccatgtccaccccctcacgcctcttatcacgtacagcaatgaacacttcacgccgggaaacccacctccacacttaccagccgacgtagaccccaaaacaggaatcccacggcctccgcaccctccagatatatccccgtattacccactatcgcctggcaccgtaggacaaatcccccatccgctaggatggttagtaccacagcaaggtcaaccagtgtacccaatcacgacaggaggattcagacacccctaccccacagctctgaccgtcaatgcttccatgtccaggttccctccccatatggtcccaccacatcatacgctacacacgacgggcattccgcatccggccatagtcacaccaacagtcaaacaggaatcgtcccagagtgatgtcggctcactccatagttcaaagcatcaggactccaaaaaggaagaagaaaagaagaagccccacataaagaaacctcttaatgcattcatgttgtatatgaaggaaatgagagcaaaggtcgtagctgagtgcacgttgaaagaaagcgcggccatcaaccagatccttgggcggaggtggcatgcactgtccagagaagagcaagcgaaatactacgagctggcccggaaggagcgacagcttcatatgcaactgtaccccggctggtccgcgcgggataactatggaaagaagaagaagaggaaaagggacaagcagccgggagagaccaatgcccctcctcatcaattgcacagccgtcgacttcttccttacattcccacagctccctggccgggacccagccccagccgctgtcgctcgtcaccaagtctttagaatagctttagcgtcgtgaaccccgctgctttgtttatggttttgtttcacttttcttaatttgccccccacccccaccttgaaaggttttgttttgtactctcttaattttgtgccatgtggctacattagttgatgtttatcgagttcattggtcaatatttgacccattcttatttcaatttctccttttaaatatgtagatgagagaagaacctcatgattctaccaaaatttttatcaacagctgtttaaagtctttgtagcgtttaaaaaatatatatatatacataactgttatgtagttcggatagcttagttttaaaagactgattaaaaaacaaaaagaaaaaaaaagcaattttgaagcagccctccagaaggagttggttctgtattatttgtattaaatacgagcttgcgaaccaatcattttacatctggtttttaaaccgtaagggcaccatgaatgcagtgccgttacttttttttttttttttctgtgtgaaacaactcttattgtgatgttacttgttattgtttaaatgtacagaaacaaagggtaaaaatgtgttaatataccttgttccatggtgttgttcttttggggggaggggacgctactcaacacttaatagaatcacaacgctgttgggccagtagtatttattgctttagagattgcttgtcgtacctgtatgtcgtccctttttaaatatgttttcctttttcttgaaactgtataaagtttttttcccccttagcataagcatcttatatataacaactcatttgtacaaggtttttaagtttatatataaaatgtgtatatatatttttgtttcccctttttgacttttttttttctgtatgaaacccagatgtcaccaaatggacattaatagttgcattaaggatcagtagcattaacaaaagttgctttaaaagccattatgtaaaacaagacttgaaaatgagtgagggaattttagcgacactgtctgagcagcagtgggaaccatcttcgtttcccctttgaactcccagtgggatgccctaccctgcgcccttaggacccggactgaccgtgtacaaaactttacgtgccaaaattctcagtgaatttagctttctccctctttttgatgctgtaatttttgttcatcatgttttgctgtgatgttacataggtagatttgtatgtagttttaatgtcacctataacaaaatgtgtttggtagcagattgtccagaaagcattttaaatgaagaggtataaacccttaagggccaaaattctgtatattagattactcttaaacgaaaaaccagctgccgcttttatgtacacatattacatacgagtaggcagcagactttaaaaataaaaaaaacctaggcatgttgatgttgcaaaatgctgtataaagctgaaacctgttcattcagtgccattgtagttgacatgaagcgattgtaaaactgtctccgatttttctctggtttattaaaatgctaactataacattttttgtgaatactttgaatgtttcctaacagttgtgatgttactgttccgttttatgctcttattccaagttcatttttaatggtttggaagccatttttgtaatgaataaatgttcatgctgtacagtatctgtagcatgccgttctggattaataaaagcaacttagtatgtgcagataaaggaaggt

SEQ ID NO: 295036 - DNA, 3230 bp, Homo sapiens
gaactgtaatccctctatcatggagcttctatagaaatgtgggttagggcagaaaggaaggctgggggctgtgtgtgccttggtgacgtgtccccctcgctcccgagccttactctgttcccctttcttcctggcagcagagccccctcccttgctgcactcagggacatgactgtcagcacttctaccccccctcagacttcactgtcagcactcaagtcttcagggacatgaaaaggagccactccttacaaaaagttggggagccctggtgtattgagtctaacaaagtgccagtggtgcagcaccctcaccatgtccaccccctcacgcctcttatcacgtacagcaatgaacacttcacgccgggaaacccacctccacacttaccagccgacgtagaccccaaaacaggaatcccacggcctccgcaccctccagatatatccccgtattacccactatcgcctggcaccgtaggacaaatcccccatccgctaggatggttagtaccacagcaaggtcaaccagtgtacccaatcacgacaggaggattcagacacccctaccccacagctctgaccgtcaatgcttccatgtccaggttccctccccatatggtcccaccacatcatacgctacacacgacgggcattccgcatccggccatagtcacaccaacagtcaaacaggaatcgtcccagagtgatgtcggctcactccatagttcaaagcatcaggactccaaaaaggaagaagaaaagaagaagccccacataaagaaacctcttaatgcattcatgttgtatatgaaggaaatgagagcaaaggtcgtagctgagtgcacgttgaaagaaagcgcggccatcaaccagatccttgggcggaggtggcatgcactgtccagagaagagcaagcgaaatactacgagctggcccggaaggagcgacagcttcatatgcaactgtaccccggctggtccgcgcgggataactatggaaagaagaagaagaggaaaagggacaagcagccgggagagaccaatgaacacagcgaatgtttcctaaatccttgcctttcacttcctccgattacaggagaaaaaaaaagtgcgttcgctacatacaaggtgaaggcagctgcctcagcccaccctcttcagatggaagcttactagattcgcctcccccctccccgaacctgctaggctcccctccccgagacgccaagtcacagactgagcagacccagcctctgtcgctgtccctgaagcccgaccccctggcccacctgtccatgatgcctccgccacccgccctcctgctcgctgaggccacccacaaggcctccgccctctgtcccaacggggccctggacctgcccccagccgctttgcagcctgccgccccctcctcatcaattgcacagccgtcgacttcttccttacattcccacagctccctggccgggacccagccccagccgctgtcgctcgtcaccaagtctttagaatagctttagcgtcgtgaaccccgctgctttgtttatggttttgtttcacttttcttaatttgccccccacccccaccttgaaaggttttgttttgtactctcttaattttgtgccatgtggctacattagttgatgtttatcgagttcattggtcaatatttgacccattcttatttcaatttctccttttaaatatgtagatgagagaagaacctcatgattctaccaaaatttttatcaacagctgtttaaagtctttgtagcgtttaaaaaatatatatatatacataactgttatgtagttcggatagcttagttttaaaagactgattaaaaaacaaaaagaaaaaaaaagcaattttgaagcagccctccagaaggagttggttctgtattatttgtattaaatacgagcttgcgaaccaatcattttacatctggtttttaaaccgtaagggcaccatgaatgcagtgccgttacttttttttttttttttctgtgtgaaacaactcttattgtgatgttacttgttattgtttaaatgtacagaaacaaagggtaaaaatgtgttaatataccttgttccatggtgttgttcttttggggggaggggacgctactcaacacttaatagaatcacaacgctgttgggccagtagtatttattgctttagagattgcttgtcgtacctgtatgtcgtccctttttaaatatgttttcctttttcttgaaactgtataaagtttttttcccccttagcataagcatcttatatataacaactcatttgtacaaggtttttaagtttatatataaaatgtgtatatatatttttgtttcccctttttgacttttttttttctgtatgaaacccagatgtcaccaaatggacattaatagttgcattaaggatcagtagcattaacaaaagttgctttaaaagccattatgtaaaacaagacttgaaaatgagtgagggaattttagcgacactgtctgagcagcagtgggaaccatcttcgtttcccctttgaactcccagtgggatgccctaccctgcgcccttaggacccggactgaccgtgtacaaaactttacgtgccaaaattctcagtgaatttagctttctccctctttttgatgctgtaatttttgttcatcatgttttgctgtgatgttacataggtagatttgtatgtagttttaatgtcacctataacaaaatgtgtttggtagcagattgtccagaaagcattttaaatgaagaggtataaacccttaagggccaaaattctgtatattagattactcttaaacgaaaaaccagctgccgcttttatgtacacatattacatacgagtaggcagcagactttaaaaataaaaaaaacctaggcatgttgatgttgcaaaatgctgtataaagctgaaacctgttcattcagtgccattgtagttgacatgaagcgattgtaaaactgtctccgatttttctctggtttattaaaatgctaactataacattttttgtgaatactttgaatgtttcctaacagttgtgatgttactgttccgttttatgctcttattccaagttcatttttaatggtttggaagccatttttgtaatgaataaatgttcatgctgtacagtatctgtagcatgccgttctggattaataaaagcaacttagtatgtgcagataaaggaaggt

SEQ ID NO: 295037 - DNA, 3771 bp, Homo sapiens
ggttttttttttttaccccccttttttatttattatttttttgcacattgagcggatccttgggaacgagagaaaaaagaaacccaaactcacgcgtgcagaagatctccccccccttcccctcccctcctccctcttttcccctccccaggagaaaaagacccccaagcagaaaaaagttcaccttggactcgtctttttcttgcaatattttttgggggggcaaaactttttgggggtgattttttttggcttttcttcctccttcatttttcttccaaaattgctgctggtgggtgaaaaaaaaatgccgcagctgaacggcggtggaggggatgacctaggcgccaacgacgaactgatttccttcaaagacgagggcgaacaggaggagaagagctccgaaaactcctcggcagagagggatttagctgatgtcaaatcgtctctagtcaatgaatcagaaacgaatcaaaacagctcctccgattccgaggcggaaagacggcctccgcctcgctccgaaagtttccgagacaaatcccgggaaagtttggaagaagcggccaagaggcaagatggagggctctttaaggggccaccgtatcccggctaccccttcatcatgatccccgacctgacgagcccctacctccccaacggatcgctctcgcccaccgcccgaaccctccattttcagtccggcagcacacattactctgcgtacaaaacgattgaacaccagattgcagttcagtatctccagatgaaatggccactgcttgatgtccaggcagggagcctccagagtagacaagccctcaaggatgcccggtccccatcaccggcacacattgtctctaacaaagtgccagtggtgcagcaccctcaccatgtccaccccctcacgcctcttatcacgtacagcaatgaacacttcacgccgggaaacccacctccacacttaccaggaatcccacggcctccgcaccctccagatatatccccgtattacccactatcgcctggcaccatccgctaggatggttagtaccacagcaaggtcaaccagtgtacccaatcacgacaggaggattcagacacccctaccccacagctctgaccgtcaatgcttccatgtccaggttccctccccatatggtcccaccacatcatacgctacacacgacgggcattccgcatccggccatagtcacaccaacagtcaaacaggaatcgtcccagagtgatgtcggctcactccatagttcaaagcatcaggactccaaaaaggaagaagaaaagaagaagccccacataaagaaacctcttaatgcattcatgttgtatatgaaggaaatgagagcaaaggtcgtagctgagtgcacgttgaaagaaagcgcggccatcaaccagatccttgggcggaggtggcatgcactgtccagagaagagcaagcgaaatactacgagctggcccggaaggagcgacagcttcatatgcaactgtaccccggctggtccgcgcgggataactatggaaagaagaagaagaggaaaagggacaagcagccgggagagaccaatgaacacagcgaatgtttcctaaatccttgcctttcacttcctccgattacaggagaaaaaaaaagtgcgttcgctacatacaaggtgaaggcagctgcctcagcccaccctcttcagatggaagcttactagattcgcctcccccctccccgaacctgctaggctcccctccccgagacgccaagtcacagactgagcagacccagcctctgtcgctgtccctgaagcccgaccccctggcccacctgtccatgatgcctccgccacccgccctcctgctcgctgaggccacccacaaggcctccgccctctgtcccaacggggccctggacctgcccccagccgctttgcagcctgccgccccctcctcatcaattgcacagccgtcgacttcttccttacattcccacagctccctggccgggacccagccccagccgctgtcgctcgtcaccaagtctttagaatagctttagcgtcgtgaaccccgctgctttgtttatggttttgtttcacttttcttaatttgccccccacccccaccttgaaaggttttgttttgtactctcttaattttgtgccatgtggctacattagttgatgtttatcgagttcattggtcaatatttgacccattcttatttcaatttctccttttaaatatgtagatgagagaagaacctcatgattctaccaaaatttttatcaacagctgtttaaagtctttgtagcgtttaaaaaatatatatatatacataactgttatgtagttcggatagcttagttttaaaagactgattaaaaaacaaaaagaaaaaaaaagcaattttgaagcagccctccagaaggagttggttctgtattatttgtattaaatacgagcttgcgaaccaatcattttacatctggtttttaaaccgtaagggcaccatgaatgcagtgccgttacttttttttttttttttctgtgtgaaacaactcttattgtgatgttacttgttattgtttaaatgtacagaaacaaagggtaaaaatgtgttaatataccttgttccatggtgttgttcttttggggggaggggacgctactcaacacttaatagaatcacaacgctgttgggccagtagtatttattgctttagagattgcttgtcgtacctgtatgtcgtccctttttaaatatgttttcctttttcttgaaactgtataaagtttttttcccccttagcataagcatcttatatataacaactcatttgtacaaggtttttaagtttatatataaaatgtgtatatatatttttgtttcccctttttgacttttttttttctgtatgaaacccagatgtcaccaaatggacattaatagttgcattaaggatcagtagcattaacaaaagttgctttaaaagccattatgtaaaacaagacttgaaaatgagtgagggaattttagcgacactgtctgagcagcagtgggaaccatcttcgtttcccctttgaactcccagtgggatgccctaccctgcgcccttaggacccggactgaccgtgtacaaaactttacgtgccaaaattctcagtgaatttagctttctccctctttttgatgctgtaatttttgttcatcatgttttgctgtgatgttacataggtagatttgtatgtagttttaatgtcacctataacaaaatgtgtttggtagcagattgtccagaaagcattttaaatgaagaggtataaacccttaagggccaaaattctgtatattagattactcttaaacgaaaaaccagctgccgcttttatgtacacatattacatacgagtaggcagcagactttaaaaataaaaaaaacctaggcatgttgatgttgcaaaatgctgtataaagctgaaacctgttcattcagtgccattgtagttgacatgaagcgattgtaaaactgtctccgatttttctctggtttattaaaatgctaactataacattttttgtgaatactttgaatgtttcctaacagttgtgatgttactgttccgttttatgctcttattccaagttcatttttaatggtttggaagccatttttgtaatgaataaatgttcatgctgtacagtatctgtagcatgccgttctggattaataaaagcaacttagtatgtgcagataaaggaaggt

SEQ ID NO: 295038 - DNA, 2816 bp, Homo sapiens
gactgagaccacagccttaacaaacaaggaggggcacttatctttttgctttgaaagccagcatcctggagctggtccggccctatgaatgccttggtggcccgggtactgagcacagagagccaccatttccaaaggtttgaatgagttaacacttggcagcaattgcattcccgtgcacttagagtcgagacacatggagaagggttctggggtaggcttcttctttcccttttttctttttcctttttggttgttttatgtttaaaaaccacatgtctgtacggaggagcttggttagctgacattgttttacagtgctgaaaaagaagcgtggcattgaacggcatgcaccagctaaagggctgcaagcagtgagtcatgcagtctcagactgcagcgtccctaggcctgcagaattaacaaaatatatgtgtgtatatatgtagcattggttccaaaaggaatcagaacagcccagaagtgtccaaattaagcacccatgttccacctgcaggtctccatccagcctgcattctcagggaaagtgtaggtacttccttcttggtggagggataccgactagctcctgtctcatttcctttctttaatgaccacctttggttaaatgtgttgtttctttgttctgatacaagcagtctttgaatttggaatattacaatggagaaaaaaaaagtgcgttcgctacatacaaggtgaaggcagctgcctcagcccaccctcttcagatggaagcttactagattcgcctcccccctccccgaacctgctaggctcccctccccgagacgccaagtcacagactgagcagacccagcctctgtcgctgtccctgaagcccgaccccctggcccacctgtccatgatgcctccgccacccgccctcctgctcgctgaggccacccacaaggcctccgccctctgtcccaacggggccctggacctgcccccagccgctttgcagcctgccgccccctcctcatcaattgcacagccgtcgacttcttccttacattcccacagctccctggccgggacccagccccagccgctgtcgctcgtcaccaagtctttagaatagctttagcgtcgtgaaccccgctgctttgtttatggttttgtttcacttttcttaatttgccccccacccccaccttgaaaggttttgttttgtactctcttaattttgtgccatgtggctacattagttgatgtttatcgagttcattggtcaatatttgacccattcttatttcaatttctccttttaaatatgtagatgagagaagaacctcatgattctaccaaaatttttatcaacagctgtttaaagtctttgtagcgtttaaaaaatatatatatatacataactgttatgtagttcggatagcttagttttaaaagactgattaaaaaacaaaaagaaaaaaaaagcaattttgaagcagccctccagaaggagttggttctgtattatttgtattaaatacgagcttgcgaaccaatcattttacatctggtttttaaaccgtaagggcaccatgaatgcagtgccgttacttttttttttttttttctgtgtgaaacaactcttattgtgatgttacttgttattgtttaaatgtacagaaacaaagggtaaaaatgtgttaatataccttgttccatggtgttgttcttttggggggaggggacgctactcaacacttaatagaatcacaacgctgttgggccagtagtatttattgctttagagattgcttgtcgtacctgtatgtcgtccctttttaaatatgttttcctttttcttgaaactgtataaagtttttttcccccttagcataagcatcttatatataacaactcatttgtacaaggtttttaagtttatatataaaatgtgtatatatatttttgtttcccctttttgacttttttttttctgtatgaaacccagatgtcaccaaatggacattaatagttgcattaaggatcagtagcattaacaaaagttgctttaaaagccattatgtaaaacaagacttgaaaatgagtgagggaattttagcgacactgtctgagcagcagtgggaaccatcttcgtttcccctttgaactcccagtgggatgccctaccctgcgcccttaggacccggactgaccgtgtacaaaactttacgtgccaaaattctcagtgaatttagctttctccctctttttgatgctgtaatttttgttcatcatgttttgctgtgatgttacataggtagatttgtatgtagttttaatgtcacctataacaaaatgtgtttggtagcagattgtccagaaagcattttaaatgaagaggtataaacccttaagggccaaaattctgtatattagattactcttaaacgaaaaaccagctgccgcttttatgtacacatattacatacgagtaggcagcagactttaaaaataaaaaaaacctaggcatgttgatgttgcaaaatgctgtataaagctgaaacctgttcattcagtgccattgtagttgacatgaagcgattgtaaaactgtctccgatttttctctggtttattaaaatgctaactataacattttttgtgaatactttgaatgtttcctaacagttgtgatgttactgttccgttttatgctcttattccaagttcatttttaatggtttggaagccatttttgtaatgaataaatgttcatgctgtacagtatctgtagcatgccgttctggattaataaaagcaacttagtatgtgcagataaaggaaggt

SEQ ID NO: 295039 - DNA, 2302 bp, Homo sapiens
  misc_feature (4)..(4): n is a, c, g, or t
  misc_feature (6)..(6): n is a, c, g, or t
  misc_feature (9)..(9): n is a, c, g, or t
  misc_feature (13)..(15): n is a, c, g, or t
  misc_feature (17)..(18): n is a, c, g, or t
  misc_feature (29)..(29): n is a, c, g, or t
tgcntntcncttnnncnnattcagacctnagcgctcctaagaaatgccgagcgcgctttggccttgatcaacagaataactggtgcggcccttgcagatgcaaatactccaaagaagtgtcgggcactgttcgggcttgaccgacagactttatggtgcaaaccgtgcaggagaaaaaaaaagtgcgttcgctacatacaaggtgaaggcagctgcctcagcccaccctcttcagatggaagcttactagattcgcctcccccctccccgaacctgctaggctcccctccccgagacgccaagtcacagactgagcagacccagcctctgtcgctgtccctgaagcccgaccccctggcccacctgtccatgatgcctccgccacccgccctcctgctcgctgaggccacccacaaggcctccgccctctgtcccaacggggccctggacctgcccccagccgctttgcagcctgccgccccctcctcatcaattgcacagccgtcgacttcttccttacattcccacagctccctggccgggacccagccccagccgctgtcgctcgtcaccaagtctttagaatagctttagcgtcgtgaaccccgctgctttgtttatggttttgtttcacttttcttaatttgccccccacccccaccttgaaaggttttgttttgtactctcttaattttgtgccatgtggctacattagttgatgtttatcgagttcattggtcaatatttgacccattcttatttcaatttctccttttaaatatgtagatgagagaagaacctcatgattctaccaaaatttttatcaacagctgtttaaagtctttgtagcgtttaaaaaatatatatatatacataactgttatgtagttcggatagcttagttttaaaagactgattaaaaaacaaaaagaaaaaaaaagcaattttgaagcagccctccagaaggagttggttctgtattatttgtattaaatacgagcttgcgaaccaatcattttacatctggtttttaaaccgtaagggcaccatgaatgcagtgccgttacttttttttttttttttctgtgtgaaacaactcttattgtgatgttacttgttattgtttaaatgtacagaaacaaagggtaaaaatgtgttaatataccttgttccatggtgttgttcttttggggggaggggacgctactcaacacttaatagaatcacaacgctgttgggccagtagtatttattgctttagagattgcttgtcgtacctgtatgtcgtccctttttaaatatgttttcctttttcttgaaactgtataaagtttttttcccccttagcataagcatcttatatataacaactcatttgtacaaggtttttaagtttatatataaaatgtgtatatatatttttgtttcccctttttgacttttttttttctgtatgaaacccagatgtcaccaaatggacattaatagttgcattaaggatcagtagcattaacaaaagttgctttaaaagccattatgtaaaacaagacttgaaaatgagtgagggaattttagcgacactgtctgagcagcagtgggaaccatcttcgtttcccctttgaactcccagtgggatgccctaccctgcgcccttaggacccggactgaccgtgtacaaaactttacgtgccaaaattctcagtgaatttagctttctccctctttttgatgctgtaatttttgttcatcatgttttgctgtgatgttacataggtagatttgtatgtagttttaatgtcacctataacaaaatgtgtttggtagcagattgtccagaaagcattttaaatgaagaggtataaacccttaagggccaaaattctgtatattagattactcttaaacgaaaaaccagctgccgcttttatgtacacatattacatacgagtaggcagcagactttaaaaataaaaaaaacctaggcatgttgatgttgcaaaatgctgtataaagctgaaacctgttcattcagtgccattgtagttgacatgaagcgattgtaaaactgtctccgatttttctctggtttattaaaatgctaactataacattttttgtgaatactttgaatgtttcctaacagttgtgatgttactgttccgttttatgctcttattccaagttcatttttaatggtttggaagccatttttgtaatgaataaatgttcatgctgtacagtatctgtagcatgccgttctggattaataaaagcaacttagtatgtgcagataaaggaaggt

SEQ ID NO: 295040 - DNA, 2569 bp, Homo sapiens
tgggagtgaagggccgaggaaacttgatgggaaagtgagggactgtctaagccaaaagagcttttcagttcttctcaatttggacaaagccactttttggcaaatagatgccaccatctgcaggtggccgcctccatgctgctctcgtatataatttgggcatggtggggcatgggtgtttagtaggggttgggggaagcaagtagagagttcagactcttaaataagttgtttgccagagcaggcttagatctgggcactgtgaagtaagcgacccaccctgggggggcgccactgtaattgtcctcggaccactgggcgtgccacctctgtgggacatcccttaggtgacctcagcttgggtgtgagcattaggtaactctctcccttggcatctgtgccctctattcacagataactctctcccctgtttctaggagaaaaaaaaagtgcgttcgctacatacaaggtgaaggcagctgcctcagcccaccctcttcagatggaagcttactagattcgcctcccccctccccgaacctgctaggctcccctccccgagacgccaagtcacagactgagcagacccagcctctgtcgctgtccctgaagcccgaccccctggcccacctgtccatgatgcctccgccacccgccctcctgctcgctgaggccacccacaaggcctccgccctctgtcccaacggggccctggacctgcccccagccgctttgcagcctgccgccccctcctcatcaattgcacagccgtcgacttcttccttacattcccacagctccctggccgggacccagccccagccgctgtcgctcgtcaccaagtctttagaatagctttagcgtcgtgaaccccgctgctttgtttatggttttgtttcacttttcttaatttgccccccacccccaccttgaaaggttttgttttgtactctcttaattttgtgccatgtggctacattagttgatgtttatcgagttcattggtcaatatttgacccattcttatttcaatttctccttttaaatatgtagatgagagaagaacctcatgattctaccaaaatttttatcaacagctgtttaaagtctttgtagcgtttaaaaaatatatatatatacataactgttatgtagttcggatagcttagttttaaaagactgattaaaaaacaaaaagaaaaaaaaagcaattttgaagcagccctccagaaggagttggttctgtattatttgtattaaatacgagcttgcgaaccaatcattttacatctggtttttaaaccgtaagggcaccatgaatgcagtgccgttacttttttttttttttttctgtgtgaaacaactcttattgtgatgttacttgttattgtttaaatgtacagaaacaaagggtaaaaatgtgttaatataccttgttccatggtgttgttcttttggggggaggggacgctactcaacacttaatagaatcacaacgctgttgggccagtagtatttattgctttagagattgcttgtcgtacctgtatgtcgtccctttttaaatatgttttcctttttcttgaaactgtataaagtttttttcccccttagcataagcatcttatatataacaactcatttgtacaaggtttttaagtttatatataaaatgtgtatatatatttttgtttcccctttttgacttttttttttctgtatgaaacccagatgtcaccaaatggacattaatagttgcattaaggatcagtagcattaacaaaagttgctttaaaagccattatgtaaaacaagacttgaaaatgagtgagggaattttagcgacactgtctgagcagcagtgggaaccatcttcgtttcccctttgaactcccagtgggatgccctaccctgcgcccttaggacccggactgaccgtgtacaaaactttacgtgccaaaattctcagtgaatttagctttctccctctttttgatgctgtaatttttgttcatcatgttttgctgtgatgttacataggtagatttgtatgtagttttaatgtcacctataacaaaatgtgtttggtagcagattgtccagaaagcattttaaatgaagaggtataaacccttaagggccaaaattctgtatattagattactcttaaacgaaaaaccagctgccgcttttatgtacacatattacatacgagtaggcagcagactttaaaaataaaaaaaacctaggcatgttgatgttgcaaaatgctgtataaagctgaaacctgttcattcagtgccattgtagttgacatgaagcgattgtaaaactgtctccgatttttctctggtttattaaaatgctaactataacattttttgtgaatactttgaatgtttcctaacagttgtgatgttactgttccgttttatgctcttattccaagttcatttttaatggtttggaagccatttttgtaatgaataaatgttcatgctgtacagtatctgtagcatgccgttctggattaataaaagcaacttagtatgtgcagataaaggaaggt

SEQ ID NO: 295041 - DNA, 2429 bp, Homo sapiens
gagagcttcccttcaccacccgccaatcccttctctgctcccaagaagcgtgtgtccctccagctggggtacaatgcaagggcatttggcttgaagcggggttggaggttggacaaataccgggggtttgtgtggatggagatggcagtatggtcacttcctcctgccttctccttccaggtgcgcccagacactcttctcacatctgtttcttgcagtaattccctgtgtttcatctcttcatctagggaaagaagaagaagaggaaaagggacaagcagccgggagagaccaatggagaaaaaaaaagtgcgttcgctacatacaaggtgaaggcagctgcctcagcccaccctcttcagatggaagcttactagattcgcctcccccctccccgaacctgctaggctcccctccccgagacgccaagtcacagactgagcagacccagcctctgtcgctgtccctgaagcccgaccccctggcccacctgtccatgatgcctccgccacccgccctcctgctcgctgaggccacccacaaggcctccgccctctgtcccaacggggccctggacctgcccccagccgctttgcagcctgccgccccctcctcatcaattgcacagccgtcgacttcttccttacattcccacagctccctggccgggacccagccccagccgctgtcgctcgtcaccaagtctttagaatagctttagcgtcgtgaaccccgctgctttgtttatggttttgtttcacttttcttaatttgccccccacccccaccttgaaaggttttgttttgtactctcttaattttgtgccatgtggctacattagttgatgtttatcgagttcattggtcaatatttgacccattcttatttcaatttctccttttaaatatgtagatgagagaagaacctcatgattctaccaaaatttttatcaacagctgtttaaagtctttgtagcgtttaaaaaatatatatatatacataactgttatgtagttcggatagcttagttttaaaagactgattaaaaaacaaaaagaaaaaaaaagcaattttgaagcagccctccagaaggagttggttctgtattatttgtattaaatacgagcttgcgaaccaatcattttacatctggtttttaaaccgtaagggcaccatgaatgcagtgccgttacttttttttttttttttctgtgtgaaacaactcttattgtgatgttacttgttattgtttaaatgtacagaaacaaagggtaaaaatgtgttaatataccttgttccatggtgttgttcttttggggggaggggacgctactcaacacttaatagaatcacaacgctgttgggccagtagtatttattgctttagagattgcttgtcgtacctgtatgtcgtccctttttaaatatgttttcctttttcttgaaactgtataaagtttttttcccccttagcataagcatcttatatataacaactcatttgtacaaggtttttaagtttatatataaaatgtgtatatatatttttgtttcccctttttgacttttttttttctgtatgaaacccagatgtcaccaaatggacattaatagttgcattaaggatcagtagcattaacaaaagttgctttaaaagccattatgtaaaacaagacttgaaaatgagtgagggaattttagcgacactgtctgagcagcagtgggaaccatcttcgtttcccctttgaactcccagtgggatgccctaccctgcgcccttaggacccggactgaccgtgtacaaaactttacgtgccaaaattctcagtgaatttagctttctccctctttttgatgctgtaatttttgttcatcatgttttgctgtgatgttacataggtagatttgtatgtagttttaatgtcacctataacaaaatgtgtttggtagcagattgtccagaaagcattttaaatgaagaggtataaacccttaagggccaaaattctgtatattagattactcttaaacgaaaaaccagctgccgcttttatgtacacatattacatacgagtaggcagcagactttaaaaataaaaaaaacctaggcatgttgatgttgcaaaatgctgtataaagctgaaacctgttcattcagtgccattgtagttgacatgaagcgattgtaaaactgtctccgatttttctctggtttattaaaatgctaactataacattttttgtgaatactttgaatgtttcctaacagttgtgatgttactgttccgttttatgctcttattccaagttcatttttaatggtttggaagccatttttgtaatgaataaatgttcatgctgtacagtatctgtagcatgccgttctggattaataaaagcaacttagtatgtgcagataaaggaaggt

SEQ ID NO: 295042 - DNA, 658 bp, Homo sapiens
  misc_feature (6)..(6): n is a, c, g, or t
  misc_feature (12)..(12): n is a, c, g, or t
  misc_feature (83)..(83): n is a, c, g, or t
aaaacnggcccncggcggggcgcctcgggccctcaggcacgcgctctgaggcttcggcggtccgccctgccgcctcgcgcccnggtccagctcgttttgttcatcatgttttgctgtgatgttacataggtagatttgtatgtagttttaatgtcacctataacaaaatgtgtttggtagcagattgtccagaaagcattttaaatgaagaggtataaacccttaagggccaaaattctgtatattagattactcttaaacgaaaaaccagctgccgcttttatgtacacatattacatacgagtaggcagcagactttaaaaataaaaaaaacctaggcatgttgatgttgcaaaatgctgtataaagctgaaacctgttcattcagtgccattgtagttgacatgaagcgattgtaaaactgtctccgatttttctctggtttattaaaatgctaactataacattttttgtgaatactttgaatgtttcctaacagttgtgatgttactgttccgttttatgctcttattccaagttcatttttaatggtttggaagccatttttgtaatgaataaatgttcatgctgtacagtatctgtagcatgccgttctggattaataaaagcaacttagtatgtgcagataaaggaaggt

SEQ ID NO: 295043 - DNA, 1494 bp, Homo sapiens
ggttttttttttttaccccccttttttatttattatttttttgcacattgagcggatccttgggaacgagagaaaaaagaaacccaaactcacgcgtgcagaagatctccccccccttcccctcccctcctccctcttttcccctccccaggagaaaaagacccccaagcagaaaaaagttcaccttggactcgtctttttcttgcaatattttttgggggggcaaaactttttgggggtgattttttttggcttttcttcctccttcatttttcttccaaaattgctgctggtgggtgaaaaaaaaatgccgcagctgaacggcggtggaggggatgacctaggcgccaacgacgaactgatttccttcaaagacgagggcgaacaggaggagaagagctccgaaaactcctcggcagagagggatttagctgatgtcaaatcgtctctagtcaatgaatcagaaacgaatcaaaacagctcctccgattccgaggcggaaagacggcctccgcctcgctccgaaagtttccgagacaaatcccgggaaagtttggaagaagcggccaagaggcaagatggagggctctttaaggggccaccgtatcccggctaccccttcatcatgatccccgacctgacgagcccctacctccccaacggatcgctctcgcccaccgcccgaaccctccattttcagtccggcagcacacattactctgcgtacaaaacgattgaacaccagattgcagttcagtatctccagatgaaatggccactgcttgatgtccaggcagggagcctccagagtagacaagccctcaaggatgcccggtccccatcaccggcacacattgtctctaacaaagtgccagtggtgcagcaccctcaccatgtccaccccctcacgcctcttatcacgtacagcaatgaacacttcacgccgggaaacccacctccacacttaccagccgacgtagaccccaaaacaggaatcccacggcctccgcaccctccagatatatccccgtattacccactatcgcctggcaccgtaggacaaatcccccatccgctaggatggttagtaccacagcaaggtcaaccagtgtacccaatcacgacaggaggattcagacacccctaccccacagctctgaccgtcaatgcttccatgtccaggttccctccccatatggtcccaccacatcatacgctacacacgacgggcattccgcatccggccatagtcacaccaacagtcaaacaggaatcgtcccagagtgatgtcggctcactccatagttcaaagcatcaggactccaaaaaggaagaagaaaagaagaagccccacataaagaaacctcttaatgcattcatgttgtatatgaaggaaatgagagcaaaggtcgtagctgagtgcacgttgaaagaaagcgcggccatcaaccagatccttgggcggagggtggcatgcacgcccttctcagggag

SEQ ID NO: 295044 - DNA, 1890 bp, Homo sapiens
ggttttttttttttaccccccttttttatttattatttttttgcacattgagcggatccttgggaacgagagaaaaaagaaacccaaactcacgcgtgcagaagatctccccccccttcccctcccctcctccctcttttcccctccccaggagaaaaagacccccaagcagaaaaaagttcaccttggactcgtctttttcttgcaatattttttgggggggcaaaactttttgggggtgattttttttggcttttcttcctccttcatttttcttccaaaattgctgctggtgggtgaaaaaaaaatgccgcagctgaacggcggtggaggggatgacctaggcgccaacgacgaactgatttccttcaaagacgagggcgaacaggaggagaagagctccgaaaactcctcggcagagagggatttagctgatgtcaaatcgtctctagtcaatgaatcagaaacgaatcaaaacagctcctccgattccgaggcggaaagacggcctccgcctcgctccgaaagtttccgagacaaatcccgggaaagtttggaagaagcggccaagaggcaagatggagggctctttaaggggccaccgtatcccggctaccccttcatcatgatccccgacctgacgagcccctacctccccaacggatcgctctcgcccaccgcccgaaccctccattttcagtccggcagcacacattactctgcgtacaaaacgattgaacaccagattgcagttcagtatctccagatgaaatggccactgcttgatgtccaggcagggagcctccagagtagacaagccctcaaggatgcccggtccccatcaccggcacacattgtctctaacaaagtgccagtggtgcagcaccctcaccatgtccaccccctcacgcctcttatcacgtacagcaatgaacacttcacgccgggaaacccacctccacacttaccagccgacgtagaccccaaaacaggaatcccacggcctccgcaccctccagatatatccccgtattacccactatcgcctggcaccgtaggacaaatcccccatccgctaggatggttagtaccacagcaaggtcaaccagtgtacccaatcacgacaggaggattcagacacccctaccccacagctctgaccgtcaatgcttccatgtccaggttccctccccatatggtcccaccacatcatacgctacacacgacgggcattccgcatccggccatagtcacaccaacagtcaaacaggaatcgtcccagagtgatgtcggctcactccatagttcaaagcatcaggactccaaaaaggaagaagaaaagaagaagccccacataaagaaacctcttaatgcattcatgttgtatatgaaggaaatgagagcaaaggtcgtagctgagtgcacgttgaaagaaagcgcggccatcaaccagatccttgggcggaggtggcatgcactgtccagagaagagcaagcgaaatactacgagctggcccggaaggagcgacagcttcatatgcaactgtaccccggctggtccgcgcgggataactatggaaagaagaagaagaggaaaagggacaagcagccgggagagaccaatgaacacagcgaatgtttcctaaatccttgcctttcacttcctccgattacaggtgctaatgtcattttgagtcattaaaatagttgataaactgttttttaatttttcttgccattatagttttattaacatttaaacacgtatgacatttgaacattctttaaaatgaccatcaacacggtttcgtatgtttcagtagattttttttttcagttgcttctttttttttttttaatttaacctttgttttgtttatttatttttcc

SEQ ID NO: 295045 - DNA, 980 bp, Homo sapiens
ggttttttttttttaccccccttttttatttattatttttttgcacattgagcggatccttgggaacgagagaaaaaagaaacccaaactcacgcgtgcagaagatctccccccccttcccctcccctcctccctcttttcccctccccaggagaaaaagacccccaagcagaaaaaagttcaccttggactcgtctttttcttgcaatattttttgggggggcaaaactttttgggggtgattttttttggcttttcttcctccttcatttttcttccaaaattgctgctggtgggtgaaaaaaaaatgccgcagctgaacggcggtggaggggatgacctaggcgccaacgacgaactgatttccttcaaagacgagggcgaacaggaggagaagagctccgaaaactcctcggcagagagggatttagctgatgtcaaatcgtctctagtcaatgaatcagaaacgaatcaaaacagctcctccgattccgaggcggaaagacggcctccgcctcgctccgaaagtttccgagacaaatcccgggaaagtttggaagaagcggccaagaggcaagatggagggctctttaaggggccaccgtatcccggctaccccttcatcatgatccccgacctgacgagcccctacctccccaacggatcgctctcgcccaccgcccgaacctatctccagatgaaatggccactgcttgatgtccaggcagggagcctccagagtagacaagccctcaaggatgcccggtccccatcaccggcacacattgtcgtaagtaacctcccagagatgatggcttcctttattgagggggtgaaaaagaaaatgcttttttgatgataacaggccttatttgtcatttttttctttctttaaacacattttctttggaaatattgttgggtatagtttatatctataaggtattcattttctgctattggaccttaatgattgtaac

SEQ ID NO: 295046 - DNA, 390 bp, Homo sapiens
tagtccaagcccacttttccgcccaagtacgtcagttgaatttgtcttttgctaaagatgttaaaaatcataatgtcttatgtcagtagcaataatgaattggctttaatgacattatgagaatcattatgtttaatttatcgctaattaatgctgacaggtttcatatgccttgggttgctttcatgtgagtgttacgtgctgtttttttttttctttttaattgtgtgtacacatccctcctcattcattcattttgattctgacgatttacacagctttctgtcttgttccctccccatatggtcccaccacatcatacgctacacacgacgggcattccgcatccggccatagtcacaccaacagtcaaacaggaatcgtcccaga

SEQ ID NO: 295047 - DNA, 124 bp, Homo sapiens
gcttgacggtgtctttctctgttctcctccccacagtctaactctaacaaagtgccagtggtgcagcaccctcaccatgtccaccccctcacgcctcttatcacgtacagcaatgaacacttca

SEQ ID NO: 295048 - DNA, 360 bp, Homo sapiens
tttcttgcaatattttttgggggggcaaaactttttgggggtgattttttttggcttttcttcctccttcatttttcttccaaaattgctgctggtgggtgaaaaaaaaatgccgcagctgaacggcggtggaggggatgacctaggcgccaacgacgaactgatttccttcaaagacgagggcgaacaggaggagaagagctccgaaaactcctcggcagagagggatttagctgatgtcaaatcgtctctagtcaatgaatcagaaacgaatcaaaacagctcctccgattccgaggtaggaaaagcccctcgggctggtggggttttttatctgtttcctgggcttggcaaatgttg

SEQ ID NO: 295049 - DNA, 477 bp, Homo sapiens
agaaattagaaatactgcataggcaatctcagaggtcccttggagaaggccaggcttttacaaacaaacaaaacaaaaattttgaaggctttgtataatttgttcttttttttcagaacacagcgaatgtttcctaaatccttgcctttcacttcctccgattacaggtgctaatgtcattttgagtcattaaaatagttgataaactgttttttaatttttcttgccattatagttttattaacatttaaacacgtatgacatttgaacattctttaaaatgaccatcaacacggtttcgtatgtttcagtagattttttttttcagttgcttctttttttttttttaatttaacctttgttttgtttatttatttttcccataacagttgtttaagcagtgatgacagtgatttagagttgaactaactgtgcaaattgaatatgcagtatttctttaaaagagactggttaaaa

SEQ ID NO: 295050 - DNA, 3283 bp, Homo sapiens
agctgttccccgcgctgcgcggagcagggaccaggcggttgcggcggcgacagccatggccggcgcgctggcaggtctggccgcgggcttgcaggtcccgcgggtcgcgcccagcccagactcggactcggacacagactcggaggacccgagtctccggcgcagcgcgggcggcttgctccgctcgcaggtcatccacagcggtcacttcatggtgtcgtcgccgcacagcgactcgctgccccggcggcgcgaccaggaggggtccgtggggccctccgacttcgggccgcgcagtatcgaccccacactcacacgcctcttcgagtgcttgagcctggcctacagtggcaagctggtgtctcccaagtggaagaatttcaaaggcctcaagctgctctgcagagacaagatccgcctgaacaacgccatctggagggcctggtatatccagtatgtgaagcggaggaagagccccgtgtgtggcttcgtgacccccctgcaggggcctgaggctgatgcgcaccggaagccggaggccgtggtcctggaggggaactactggaagcggcgcatcgaggtggtgatgcgggaataccacaagtggcgcatctactacaagaagcggctccgtaagcccagcagggaagatgacctcctggcccctaagcaggcggaaggcaggtggccgccgccggagcaatggtgcaaacagctcttctccagtgtggtccccgtgctgctgggggacccagaggaggagccgggtgggcggcagctcctggacctcaattgctttttgtccgacatctcagacactctcttcaccatgactcagtccggcccttcgcccctgcagctgccgcctgaggatgcctacgtcggcaatgctgacatgatccagccggacctgacgccactgcagccaagcctggatgacttcatggacatctcagatttctttaccaactcccgcctcccacagccgcccatgccttcaaacttcccagagccccccagcttcagccccgtggttgactccctcttcagcagtgggaccctgggcccagaggtgcccccggcttcctcggccatgacccacctctctggacacagccgtctgcaggctcggaacagctgccctggccccttggactccagcgccttcctgagttctgatttcctccttcctgaagaccccaagccccggctcccaccccctcctgtacccccacctctgctgcattaccctccccctgccaaggtgccaggcctggagccctgccccccacctcccttccctcccatggcaccacccactgctttgctgcaggaagagcctctcttctctcccaggtttcccttccccaccgtccctcctgccccaggagtgtctccgctgcctgctcctgcagccttcccacccaccccacagtctgtccccagcccagcccccacccccttccccatagagcttctacccttggggtattcggagcctgcctttgggccttgcttctccatgcccagaggcaagccccccgccccatcccctaggggacagaaagccagcccccctaccttagcccctgccactgccagtccccccaccactgcggggagcaacaacccctgcctcacacagctgctcacagcagctaagccggagcaagccctggagccaccacttgtatccagcaccctcctccggtccccagggtccccgcaggagacagtccctgaattcccctgcacattccttcccccgaccccggcccctacaccgccccggccacctccaggcccggccacattggccccttccaggcccctgcttgtccccaaagcggagcggctctcacccccagcgcccagcggcagtgaacggcggctgtcaggggacctcagctccatgccaggccctgggactctgagcgtccgtgtctctcccccgcaacccatcctcagccggggccgtccagacagcaacaagaccgagaaccggcgtatcacacacatctccgcggagcagaagcggcgcttcaacatcaagctggggtttgacacccttcatgggctcgtgagcacactcagtgcccagcccagcctcaaggtgagcaaagctaccacgctgcagaagacagctgagtacatccttatgctacagcaggagcgtgcgggcttgcaggaggaggcccagcagctgcgggatgagattgaggagctcaatgccgccattaacctgtgccagcagcagctgcccgccacaggggtacccatcacacaccagcgttttgaccagatgcgagacatgtttgatgactacgtccgaacccgtacgctgcacaactggaagttctgggtgttcagcatcctcatccggcctctgtttgagtccttcaacgggatggtgtccacggcaagtgtgcacaccctccgccagacctcactggcctggctggaccagtactgctctctgcccgctctccggccaactgtcctgaactccctacgccagctgggcacatctaccagtatcctgaccgacccgggccgcatccctgagcaagccacacgggcagtcacagagggcacccttggcaaacctttatagtcctggccagaccctgctgctcactcagctgccctgggggctgctttccctgggcacgggctccagggatcatctctgggcactcccttcctgccccaggccctggctctgcccttccctggggggtggagcagggtccaggtttcacacttgccacctcctggaggtcaagaagagcagagtccccgtccctgctctgccactgtgctccagcaccgtgaccttgggtgactcgtccgctgtctttggaccgctgtgtttcaatctgcaaaatggggatggggaaggttcaatcagcagatgacccccaggccttggcagctgtgacattgggggcctaggctggcaactccgggggctcaacggtggaaagaggaggatgctgtttctctgtcacctccacttgctccccgacaggtggggcacagacctctgttcctgagcagagaagcagaaaaggaggttccctctctctgctccttcactgctgacccagaggggctgcaggatggtttcccctgggagaggccaggagggcctgatcccaggagacaccagggccagagtgaccacagcagggcaggcatcatgtgtgtgtgtgtgtgtggatgtgtgtgtgtgggttttgtaaagaattcttgaccaataaaagcaaaaactgtctgctgg

SEQ ID NO: 295051 - DNA, 3226 bp, Homo sapiens
agctgttccccgcgctgcgcggagcagggaccaggcggttgcggcggcgacagccatggccggcgcgctggcaggtctggccgcgggcttgcaggtcccgcgggtcgcgcccagcccagactcggactcggacacagactcggaggacccgagtctccggcgcagcgcgggcggcttgctccgctcgcaggtcatccacagcggtcacttcatggtgtcgtcgccgcacagcgactcgctgccccggcggcgcgaccaggaggggtccgtggggccctccgacttcgggccgcgcagtatcgaccccacactcacacgcctcttcgagtgcttgagcctggcctacagtggcaagctggtgtctcccaagtggaagaatttcaaaggcctcaagctgctctgcagagacaagatccgcctgaacaacgccatctggagggcctggtatatccagtatgtgaagcggaggaagagccccgtgtgtggcttcgtgacccccctgcaggggcctgaggctgatgcgcaccggaagccggaggccgtggtcctggaggggaactactggaagcggcgcatcgaggtggtgatgcgggaataccacaagtggcgcatctactacaagaagcggctccgtaagcccagcagggaagatgacctcctggcccctaagcaggcggaaggcaggtggccgccgccggagcaatggtgcaaacagctcttctccagtgtggtccccgtgctgctgggggacccagaggaggagccgggtgggcggcagctcctggacctcaattgctttttgtccgacatctcagacactctcttcaccatgactcagtccggcccttcgcccctgcagctgccgcctgaggatgcctacgtcggcaatgctgacatgatccagccggacctgacgccactgcagccaagcctggatgacttcatggacatctcagatttctttaccaactcccgcctcccacagccgcccatgccttcaaacttcccagagccccccagcttcagccccgtggttgactccctcttcagcagtgggaccctgggcccagaggtgcccccggcttcctcggccatgacccacctctctggacacagccgtctgcaggctcggaacagctgccctggccccttggactccagcgccttcctgagttctgatttcctccttcctgaagaccccaagccccggctcccaccccctcctgtacccccacctctgctgcattaccctccccctgccaaggtgccaggcctggagccctgccccccacctcccttccctcccatggcaccacccactgctttgctgcaggaagagcctctcttctctcccaggtttcccttccccaccgtccctcctgccccaggagtgtctccgctgcctgctcctgcagccttcccacccaccccacagtctgtccccagcccagcccccacccccttccccatagagcttctacccttggggtattcggagcctgcctttgggccttgcttctccatgcccagaggcaagccccccgccccatcccctaggggacagaaagccagcccccctaccttagcccctgccactgccagtccccccaccactgcggggagcaacaacccctgcctcacacagctgctcacagcagctaagccggagcaagccctggagccaccacttgtatccagcaccctcctccggtccccagggtccccgcaggagacagtccctgaattcccctgcacattccttcccccgaccccggcccctacaccgccccggccacctccaggcccggccacattggccccttccaggcccctgcttgtccccaaagcggagcggctctcacccccagcgcccagcggcagtgaacggcggctgtcaggggacctcagctccatgccaggccctgggactctgagcgtccgtgtctctcccccgcaacccatcctcagccggggccgtccagacagcaacaagaccgagaaccggcgtatcacacacatctccgcggagcagaagcggcgcttcaacatcaagctggggtttgacacccttcatgggctcgtgagcacactcagtgcccagcccagcctcaaggagcgtgcgggcttgcaggaggaggcccagcagctgcgggatgagattgaggagctcaatgccgccattaacctgtgccagcagcagctgcccgccacaggggtacccatcacacaccagcgttttgaccagatgcgagacatgtttgatgactacgtccgaacccgtacgctgcacaactggaagttctgggtgttcagcatcctcatccggcctctgtttgagtccttcaacgggatggtgtccacggcaagtgtgcacaccctccgccagacctcactggcctggctggaccagtactgctctctgcccgctctccggccaactgtcctgaactccctacgccagctgggcacatctaccagtatcctgaccgacccgggccgcatccctgagcaagccacacgggcagtcacagagggcacccttggcaaacctttatagtcctggccagaccctgctgctcactcagctgccctgggggctgctttccctgggcacgggctccagggatcatctctgggcactcccttcctgccccaggccctggctctgcccttccctggggggtggagcagggtccaggtttcacacttgccacctcctggaggtcaagaagagcagagtccccgtccctgctctgccactgtgctccagcaccgtgaccttgggtgactcgtccgctgtctttggaccgctgtgtttcaatctgcaaaatggggatggggaaggttcaatcagcagatgacccccaggccttggcagctgtgacattgggggcctaggctggcaactccgggggctcaacggtggaaagaggaggatgctgtttctctgtcacctccacttgctccccgacaggtggggcacagacctctgttcctgagcagagaagcagaaaaggaggttccctctctctgctccttcactgctgacccagaggggctgcaggatggtttcccctgggagaggccaggagggcctgatcccaggagacaccagggccagagtgaccacagcagggcaggcatcatgtgtgtgtgtgtgtgtggatgtgtgtgtgtgggttttgtaaagaattcttgaccaataaaagcaaaaactgtctgctgg

SEQ ID NO: 295052 - DNA, 3132 bp, Homo sapiens
agctgttccccgcgctgcgcggagcagggaccaggcggttgcggcggcgacagccatggccggcgcgctggcaggtctggccgcgggcttgcaggtcccgcgggtcgcgcccagcccagactcggactcggacacagactcggaggacccgagtctccggcgcagcgcgggcggcttgctccgctcgcaggtcatccacagcggtcacttcatggtgtcgtcgccgcacagcgactcgctgccccggcggcgcgaccaggaggggtccgtggggccctccgacttcgggccgcgcagtatcgaccccacactcacacgcctcttcgagtgcttgagcctggcctacagtggcaagctggtgtctcccaagtggaagaatttcaaaggcctcaagctgctctgcagagacaagatccgcctgaacaacgccatctggagggcctggtatatccagtatgtgaagcggaggaagagccccgtgtgtggcttcgtgacccccctgcaggggcctgaggctgatgcgcaccggaagccggaggccgtggtcctggaggggaactactggaagcggcgcatcgaggtggtgatgcgggaataccacaagtggcgcatctactacaagaagcggctccgtaagcccagcagggaagatgacctcctggcccctaagcaggcggaaggcaggtggccgccgccggagcaatggtgcaaacagctcttctccagtgtggtccccgtgctgctgggggacccagaggaggagccgggtgggcggcagctcctggacctcaattgctttttgtccgacatctcagacactctcttcaccatgactcagtccggcccttcgcccctgcagctgccgcctgaggatgcctacgtcggcaatgctgacatgatccagccggacctgacgccactgcagccaagcctggatgacttcatggacatctcagatttctttaccaactcccgcctcccacagccgcccatgccttcaaacttcccagagccccccagcttcagccccgtggttgactccctcttcagcagtgggaccctgggcccagaggtgcccccggcttcctcggccatgacccacctctctggacacagccgtctgcaggctcggaacagctgccctggccccttggactccagcgccttcctgagttctgatttcctccttcctgaagaccccaagccccggctcccaccccctcctgtacccccacctctgctgcattaccctccccctgccaaggtgccaggcctggagccctgccccccacctcccttccctcccatggcaccacccactgctttgctgcaggaagagcctctcttctctcccaggtttcccttccccaccgtccctcctgccccaggagtgtctccgctgcctgctcctgcagccttcccacccaccccacagtctgtccccagcccagcccccacccccttccccatagagcttctacccttggggtattcggagcctgcctttgggccttgcttctccatgcccagaggcaagccccccgccccatcccctaggggacagaaagccagcccccctaccttagcccctgccactgccagtccccccaccactgcggggagcaacaacccctgcctcacacagctgctcacagcagctaagccggagcaagccctggagccaccacttgtatccagcaccctcctccggtccccagggtccccggcagtgaacggcggctgtcaggggacctcagctccatgccaggccctgggactctgagcgtccgtgtctctcccccgcaacccatcctcagccggggccgtccagacagcaacaagaccgagaaccggcgtatcacacacatctccgcggagcagaagcggcgcttcaacatcaagctggggtttgacacccttcatgggctcgtgagcacactcagtgcccagcccagcctcaaggtgagcaaagctaccacgctgcagaagacagctgagtacatccttatgctacagcaggagcgtgcgggcttgcaggaggaggcccagcagctgcgggatgagattgaggagctcaatgccgccattaacctgtgccagcagcagctgcccgccacaggggtacccatcacacaccagcgttttgaccagatgcgagacatgtttgatgactacgtccgaacccgtacgctgcacaactggaagttctgggtgttcagcatcctcatccggcctctgtttgagtccttcaacgggatggtgtccacggcaagtgtgcacaccctccgccagacctcactggcctggctggaccagtactgctctctgcccgctctccggccaactgtcctgaactccctacgccagctgggcacatctaccagtatcctgaccgacccgggccgcatccctgagcaagccacacgggcagtcacagagggcacccttggcaaacctttatagtcctggccagaccctgctgctcactcagctgccctgggggctgctttccctgggcacgggctccagggatcatctctgggcactcccttcctgccccaggccctggctctgcccttccctggggggtggagcagggtccaggtttcacacttgccacctcctggaggtcaagaagagcagagtccccgtccctgctctgccactgtgctccagcaccgtgaccttgggtgactcgtccgctgtctttggaccgctgtgtttcaatctgcaaaatggggatggggaaggttcaatcagcagatgacccccaggccttggcagctgtgacattgggggcctaggctggcaactccgggggctcaacggtggaaagaggaggatgctgtttctctgtcacctccacttgctccccgacaggtggggcacagacctctgttcctgagcagagaagcagaaaaggaggttccctctctctgctccttcactgctgacccagaggggctgcaggatggtttcccctgggagaggccaggagggcctgatcccaggagacaccagggccagagtgaccacagcagggcaggcatcatgtgtgtgtgtgtgtgtggatgtgtgtgtgtgggttttgtaaagaattcttgaccaataaaagcaaaaactgtctgctgg

SEQ ID NO: 295053 - DNA, 3278 bp, Homo sapiens
agctgttccccgcgctgcgcggagcagggaccaggcggttgcggcggcgacagccatggccggcgcgctggcaggtctggccgcgggcttgcaggtcccgcgggtcgcgcccagcccagactcggactcggacacagactcggaggacccgagtctccggcgcagcgcgggcggcttgctccgctcgcaggtcatccacagcggtcacttcatggtgtcgtcgccgcacagcgactcgctgccccggcggcgcgaccaggaggggtccgtggggccctccgacttcgggccgcgcagtatcgaccccacactcacacgcctcttcgagtgcttgagcctggcctacagtggcaagctggtgtctcccaagtggaagaatttcaaaggcctcaagctgctctgcagagacaagatccgcctgaacaacgccatctggagggcctggtatatccagtatgtgaagcggaggaagagccccgtgtgtggcttcgtgacccccctgcaggggcctgaggctgatgcgcaccggaagccggaggccgtggtcctggaggggaactactggaagcggcgcatcgagcctacgtcggcaatgctgacatgatccagccggacctgacgccactgcagccaagcctggatgacttcatggacatctcagatttctttaccaactcccgcctcccacagccgcccatgccttcaaacttcccagagccccccagcttcagccccgtggttgactccctcttcagcagtgggaccctgggcccagaggtgcccccggcttcctcggccatgacccacctctctggacacagccgtctgcaggctcggaacagctgccctggccccttggactccagcgccttcctgagttctgatttcctccttcctgaagaccccaagccccggctcccaccccctcctgtacccccacctctgctgcattaccctccccctgccaaggtgccaggcctggagccctgccccccacctcccttccctcccatggcaccacccactgctttgctgcaggaagagcctctcttctctcccaggtttcccttccccaccgtccctcctgccccaggagtgtctccgctgcctgctcctgcagccttcccacccaccccacagtctgtccccagcccagcccccacccccttccccatagagcttctacccttggggtattcggagcctgcctttgggccttgcttctccatgcccagaggcaagccccccgccccatcccctaggggacagaaagccagcccccctaccttagcccctgccactgccagtccccccaccactgcggggagcaacaacccctgcctcacacagctgctcacagcagctaagccggagcaagccctggagccaccacttgtatccagcaccctcctccggtccccagggtccccgcaggagacagtccctgaattcccctgcacattccttcccccgaccccggcccctacaccgccccggccacctccaggcccggccacattggccccttccaggcccctgcttgtccccaaagcggagcggctctcacccccagcgcccagcggcagtgaacggcggctgtcaggggacctcagctccatgccaggccctgggactctgagcgtccgtgtctctcccccgcaacccatcctcagccggggccgtccagacagcaacaagaccgagaaccggcgtatcacacacatctccgcggagcagaagcggcgcttcaacatcaagctggggtttgacacccttcatgggctcgtgagcacactcagtgcccagcccagcctcaaggtgagcaaagctaccacgctgcagaagacagctgagtacatccttatgctacagcaggagcgtgcgggcttgcaggaggaggcccagcagctgcgggatgagattgaggagctcaatgccgccattaacctgtgccagcagcagctgcccgccacaggggtacccatcacacaccagcgttttgaccagatgcgagacatgtttgatgactacgtccgaacccgtacgctgcacaactggaagttctgggtgttcagcatcctcatccggcctctgtttgagtccttcaacgggatggtgtccacggcaagtgtgcacaccctccgccagacctcactggcctggctggaccagtactgctctctgcccgctctccggccaagtacgtgagccatctccctgcctgctagagggacccagcctcgggggtggagggagcattccaccctgcttagatcccacatccagcttgccatcaacacagcctagggttgtggccaccccgcatcccccagatggtcctctggccaccagacgcctgtagacagaggttctaggagggggtgacagtcttgccaactaatacctccccctatccctttggttccacatccaagggtagggccctgaccccaggaagtgtctgtctctctctctctgtctcccacccagctgtcctgaactccctacgccagctgggcacatctaccagtatcctgaccgacccgggccgcatccctgagcaagccacacgggcagtcacagagggcacccttggcaaacctttatagtcctggccagaccctgctgctcactcagctgccctgggggctgctttccctgggcacgggctccagggatcatctctgggcactcccttcctgccccaggccctggctctgcccttccctggggggtggagcagggtccaggtttcacacttgccacctcctggaggtcaagaagagcagagtccccgtccctgctctgccactgtgctccagcaccgtgaccttgggtgactcgtccgctgtctttggaccgctgtgtttcaatctgcaaaatggggatggggaaggttcaatcagcagatgacccccaggccttggcagctgtgacattgggggcctaggctggcaactccgggggctcaacggtggaaagaggaggatgctgtttctctgtcacctccacttgctccccgacaggtggggcacagacctctgttcctgagcagagaagcagaaaaggaggttccctctctctgctccttcactgctgacccagaggggctgcaggatggtttcccctgggagaggccaggagggcctgatcccaggagacaccagggccagagtgaccacagcagggcaggcatcatgtgtgtgtgtgtgtgtggatgtgtgtgtgtgggttttgtaaagaattcttgaccaataaaagcaaaaactgtctgctgg

SEQ ID NO: 295054 - DNA, 2668 bp, Homo sapiens
cacacccagccgcacaagaacccctcctgcattccgtcctcacacgcaggcctgtccatctacttgctactgtcacactcttgccagcagaagaggcccctgtaatggccgatatcaccacccagtctatcctcaccccacagctgtgcagcgggaacctcctgctggcccacgtgcttgccacagcccatgctggcacgacgctccagcaggtcggcgtccctgcgggccacactaccggtgacatggctagcatgaccctccttcctggcagtgacactgttgatgtgaaccccagtttcacatctgtcatttgtaaataggaccattttcccttttcgctctcccttccattcacagggcttttcattctctctgtttctgcctccgtttcagatatttactcacctttttctctctcactatgtctgccgtggtctccatgagactacgccacgtaagattcccccattaaaggtcatgaattgagtggcttttagtatacctgtggttgtgcacattcaattttaattcgcaatccattgtaaaacgtcttatcacccccgaccagagaaagaccctgtagacattagtcactcctcattctgtctcaaaccctctccctgaccctcagccctaggtagcaactacctagtgcgatcaatcccatatgcatagatttccatattgtggacatttcctataaacggaattgcacaataggtgagctgctatgactgacataacacgtagcacaatattttcaagattcatccacattgtaggcttacccacagggggaaaccattttttggggggttttagtaacaccggtgttttctccttcctttcatccttctttccttccttccttccttccttccttccttccttccttccttccttccgtccctcctgccccaggagtgtctccgctgcctgctcctgcagccttcccacccaccccacagtctgtccccagcccagcccccacccccttccccatagagcttctacccttggggtattcggagcctgcctttgggccttgcttctccatgcccagaggcaagccccccgccccatcccctaggggacagaaagccagcccccctaccttagcccctgccactgccagtccccccaccactgcggggagcaacaacccctgcctcacacagctgctcacagcagctaagccggagcaagccctggagccaccacttgtatccagcaccctcctccggtccccagggtccccggcagtgaacggcggctgtcaggggacctcagctccatgccaggccctgggactctgagcgtccgtgtctctcccccgcaacccatcctcagccggggccgtccagacagcaacaagaccgagaaccggcgtatcacacacatctccgcggagcagaagcggcgcttcaacatcaagctggggtttgacacccttcatgggctcgtgagcacactcagtgcccagcccagcctcaaggtgagcaaagctaccacgctgcagaagacagctgagtacatccttatgctacagcaggagcgtgcgggcttgcaggaggaggcccagcagctgcgggatgagattgaggagctcaatgccgccattaacctgtgccagcagcagctgcccgccacaggggtacccatcacacaccagcgttttgaccagatgcgagacatgtttgatgactacgtccgaacccgtacgctgcacaactggaagttctgggtgttcagcatcctcatccggcctctgtttgagtccttcaacgggatggtgtccacggcaagtgtgcacaccctccgccagacctcactggcctggctggaccagtactgctctctgcccgctctccggccaactgtcctgaactccctacgccagctgggcacatctaccagtatcctgaccgacccgggccgcatccctgagcaagccacacgggcagtcacagagggcacccttggcaaacctttatagtcctggccagaccctgctgctcactcagctgccctgggggctgctttccctgggcacgggctccagggatcatctctgggcactcccttcctgccccaggccctggctctgcccttccctggggggtggagcagggtccaggtttcacacttgccacctcctggaggtcaagaagagcagagtccccgtccctgctctgccactgtgctccagcaccgtgaccttgggtgactcgtccgctgtctttggaccgctgtgtttcaatctgcaaaatggggatggggaaggttcaatcagcagatgacccccaggccttggcagctgtgacattgggggcctaggctggcaactccgggggctcaacggtggaaagaggaggatgctgtttctctgtcacctccacttgctccccgacaggtggggcacagacctctgttcctgagcagagaagcagaaaaggaggttccctctctctgctccttcactgctgacccagaggggctgcaggatggtttcccctgggagaggccaggagggcctgatcccaggagacaccagggccagagtgaccacagcagggcaggcatcatgtgtgtgtgtgtgtgtggatgtgtgtgtgtgggttttgtaaagaattcttgaccaataaaagcaaaaactgtctgctgg

SEQ ID NO: 295055 - DNA, 816 bp, Homo sapiens
cgtggacagattgtttttgccgttttcgggcaactgcctaccttcctccgcatgtggacatctaccagtatcctgaccgacccgggccgcatccctgagcaagccacacgggcagtcacagagggcacccttggcaaacctttatagtcctggccagaccctgctgctcactcagctgccctgggggctgctttccctgggcacgggctccagggatcatctctgggcactcccttcctgccccaggccctggctctgcccttccctggggggtggagcagggtccaggtttcacacttgccacctcctggaggtcaagaagagcagagtccccgtccctgctctgccactgtgctccagcaccgtgaccttgggtgactcgtccgctgtctttggaccgctgtgtttcaatctgcaaaatggggatggggaaggttcaatcagcagatgacccccaggccttggcagctgtgacattgggggcctaggctggcaactccgggggctcaacggtggaaagaggaggatgctgtttctctgtcacctccacttgctccccgacaggtggggcacagacctctgttcctgagcagagaagcagaaaaggaggttccctctctctgctccttcactgctgacccagaggggctgcaggatggtttcccctgggagaggccaggagggcctgatcccaggagacaccagggccagagtgaccacagcagggcaggcatcatgtgtgtgtgtgtgtgtggatgtgtgtgtgtgggttttgtaaagaattcttgaccaataaaagcaaaaactgtctgctgg

SEQ ID NO: 295056 - DNA, 669 bp, Homo sapiens
cgctgctaaaagccgggcccgcggcgcagcgcacggagccctctgccgcccgcgcggagaaggcgccgggcgcggtccggcggtcccaagcatccccgcagcgcccccgccgcccgccgcccgcccctggccgcgccgcgcccctctgcaggtcgagcggattccaggtgagggcgtggagcccccgcgtcatcagtggcaagctggtgtctcccaagtggaagaatttcaaaggcctcaagctgctctgcagagacaagatccgcctgaacaacgccatctggagggcctggtatatccagtatgtgaagcggaggaagagccccgtgtgtggcttcgtgacccccctgcaggggcctgaggctgatgcgcaccggaagccggaggccgtggtcctggaggggaactactggaagcggcgcatcgaggtggtgatgcgggaataccacaagtggcgcatctactacaagaagcggctccgtaagcccagcagggaagatgacctcctggcccctaagcaggtgggtgctctgtaagtccagcaggcaagggcatccctttgccccccaagtagatgggaggcagagttgacagtttccgcctcagtgggcaagacagtggctgggcatgagggtggaatgtgggatgttactgccatcctgtggttca

SEQ ID NO: 295057 - DNA, 3325 bp, Homo sapiens
cgctgctaaaagccgggcccgcggcgcagcgcacggagccctctgccgcccgcgcggagaaggcgccgggcgcggtccggcggtcccaagcatccccgcagcgcccccgccgcccgccgcccgcccctggccgcgccgcgcccctctgcaggtcgagcggattccaggtgagggcgtggagcccccgcgtcatcagtggcaagctggtgtctcccaagtggaagaatttcaaaggcctcaagctgctctgcagagacaagatccgcctgaacaacgccatctggagggcctggtatatccagtatgtgaagcggaggaagagccccgtgtgtggcttcgtgacccccctgcaggggcctgaggctgatgcgcaccggaagccggaggccgtggtcctggaggggaactactggaagcggcgcatcgaggtggtgatgcgggaataccacaagtggcgcatctactacaagaagcgggtcagtgggggagggccaggaggccccagagctttcctcctgcggctgccggctaccgcccgcctcggaagatccctggaaaggggatcctgacccccgagcttgcgcccctcgggccctccattcagtcccgggccgacagcgccaccgtgtggccacagcgtctcctagcggcctccttacctaggggtcggctccgtaagcccagcagggaagatgacctcctggcccctaagcaggcggaaggcaggtggccgccgccggagcaatggtgcaaacagctcttctccagtgtggtccccgtgctgctgggggacccagaggaggagccgggtgggcggcagctcctggacctcaattgctttttgtccgacatctcagacactctcttcaccatgactcagtccggcccttcgcccctgcagctgccgcctgaggatgcctacgtcggcaatgctgacatgatccagccggacctgacgccactgcagccaagcctggatgacttcatggacatctcagatttctttaccaactcccgcctcccacagccgcccatgccttcaaacttcccagagccccccagcttcagccccgtggttgactccctcttcagcagtgggaccctgggcccagaggtgcccccggcttcctcggccatgacccacctctctggacacagccgtctgcaggctcggaacagctgccctggccccttggactccagcgccttcctgagttctgatttcctccttcctgaagaccccaagccccggctcccaccccctcctgtacccccacctctgctgcattaccctccccctgccaaggtgccaggcctggagccctgccccccacctcccttccctcccatggcaccacccactgctttgctgcaggaagagcctctcttctctcccaggtttcccttccccaccgtccctcctgccccaggagtgtctccgctgcctgctcctgcagccttcccacccaccccacagtctgtccccagcccagcccccacccccttccccatagagcttctacccttggggtattcggagcctgcctttgggccttgcttctccatgcccagaggcaagccccccgccccatcccctaggggacagaaagccagcccccctaccttagcccctgccactgccagtccccccaccactgcggggagcaacaacccctgcctcacacagctgctcacagcagctaagccggagcaagccctggagccaccacttgtatccagcaccctcctccggtccccagggtccccgcaggagacagtccctgaattcccctgcacattccttcccccgaccccggcccctacaccgccccggccacctccaggcccggccacattggccccttccaggcccctgcttgtccccaaagcggagcggctctcacccccagcgcccagcggcagtgaacggcggctgtcaggggacctcagctccatgccaggccctgggactctgagcgtccgtgtctctcccccgcaacccatcctcagccggggccgtccagacagcaacaagaccgagaaccggcgtatcacacacatctccgcggagcagaagcggcgcttcaacatcaagctggggtttgacacccttcatgggctcgtgagcacactcagtgcccagcccagcctcaaggtgagcaaagctaccacgctgcagaagacagctgagtacatccttatgctacagcaggagcgtgcgggcttgcaggaggaggcccagcagctgcgggatgagattgaggagctcaatgccgccattaacctgtgccagcagcagctgcccgccacaggggtacccatcacacaccagcgttttgaccagatgcgagacatgtttgatgactacgtccgaacccgtacgctgcacaactggaagttctgggtgttcagcatcctcatccggcctctgtttgagtccttcaacgggatggtgtccacggcaagtgtgcacaccctccgccagacctcactggcctggctggaccagtactgctctctgcccgctctccggccaactgtcctgaactccctacgccagctgggcacatctaccagtatcctgaccgacccgggccgcatccctgagcaagccacacgggcagtcacagagggcacccttggcaaacctttatagtcctggccagaccctgctgctcactcagctgccctgggggctgctttccctgggcacgggctccagggatcatctctgggcactcccttcctgccccaggccctggctctgcccttccctggggggtggagcagggtccaggtttcacacttgccacctcctggaggtcaagaagagcagagtccccgtccctgctctgccactgtgctccagcaccgtgaccttgggtgactcgtccgctgtctttggaccgctgtgtttcaatctgcaaaatggggatggggaaggttcaatcagcagatgacccccaggccttggcagctgtgacattgggggcctaggctggcaactccgggggctcaacggtggaaagaggaggatgctgtttctctgtcacctccacttgctccccgacaggtggggcacagacctctgttcctgagcagagaagcagaaaaggaggttccctctctctgctccttcactgctgacccagaggggctgcaggatggtttcccctgggagaggccaggagggcctgatcccaggagacaccagggccagagtgaccacagcagggcaggcatcatgtgtgtgtgtgtgtgtggatgtgtgtgtgtgggttttgtaaagaattcttgaccaataaaagcaaaaactgtctgctgg

SEQ ID NO: 295058 - DNA, 2703 bp, Homo sapiens
ggaggatggggcaagggatccggtgtccaactctgtgtgtccctgcagctccgtaagcccagcagggaagatgacctcctggcccctaagcaggcggaaggcaggtggccgccgccggagcaatggtgcaaacagctcttctccagtgtggtccccgtgctgctgggggacccagaggaggagccgggtgggcggcagctcctggacctcaattgctttttgtccgacatctcagacactctcttcaccatgactcagtccggcccttcgcccctgcagctgccgcctgaggatgcctacgtcggcaatgctgacatgatccagccggacctgacgccactgcagccaagcctggatgacttcatggacatctcagatttctttaccaactcccgcctcccacagccgcccatgccttcaaacttcccagagccccccagcttcagccccgtggttgactccctcttcagcagtgggaccctgggcccagaggtgcccccggcttcctcggccatgacccacctctctggacacagccgtctgcaggctcggaacagctgccctggccccttggactccagcgccttcctgagttctgatttcctccttcctgaagaccccaagccccggctcccaccccctcctgtacccccacctctgctgcattaccctccccctgccaaggtgccaggcctggagccctgccccccacctcccttccctcccatggcaccacccactgctttgctgcaggaagagcctctcttctctcccaggtttcccttccccaccgtccctcctgccccaggagtgtctccgctgcctgctcctgcagccttcccacccaccccacagtctgtccccagcccagcccccacccccttccccatagagcttctacccttggggtattcggagcctgcctttgggccttgcttctccatgcccagaggcaagccccccgccccatcccctaggggacagaaagccagcccccctaccttagcccctgccactgccagtccccccaccactgcggggagcaacaacccctgcctcacacagctgctcacagcagctaagccggagcaagccctggagccaccacttgtatccagcaccctcctccggtccccagggtccccgcaggagacagtccctgaattcccctgcacattccttcccccgaccccggcccctacaccgccccggccacctccaggcccggccacattggccccttccaggcccctgcttgtccccaaagcggagcggctctcacccccagcgcccagcggcagtgaacggcggctgtcaggggacctcagctccatgccaggccctgggactctgagcgtccgtgtctctcccccgcaacccatcctcagccggggccgtccagacagcaacaagaccgagaaccggcgtatcacacacatctccgcggagcagaagcggcgcttcaacatcaagctggggtttgacacccttcatgggctcgtgagcacactcagtgcccagcccagcctcaaggtgagcaaagctaccacgctgcagaagacagctgagtacatccttatgctacagcaggagcgtgcgggcttgcaggaggaggcccagcagctgcgggatgagattgaggagctcaatgccgccattaacctgtgccagcagcagctgcccgccacaggggtacccatcacacaccagcgttttgaccagatgcgagacatgtttgatgactacgtccgaacccgtacgctgcacaactggaagttctgggtgttcagcatcctcatccggcctctgtttgagtccttcaacgggatggtgtccacggcaagtgtgcacaccctccgccagacctcactggcctggctggaccagtactgctctctgcccgctctccggccaactgtcctgaactccctacgccagctgggcacatctaccagtatcctgaccgacccgggccgcatccctgagcaagccacacgggcagtcacagagggcacccttggcaaacctttatagtcctggccagaccctgctgctcactcagctgccctgggggctgctttccctgggcacgggctccagggatcatctctgggcactcccttcctgccccaggccctggctctgcccttccctggggggtggagcagggtccaggtttcacacttgccacctcctggaggtcaagaagagcagagtccccgtccctgctctgccactgtgctccagcaccgtgaccttgggtgactcgtccgctgtctttggaccgctgtgtttcaatctgcaaaatggggatggggaaggttcaatcagcagatgacccccaggccttggcagctgtgacattgggggcctaggctggcaactccgggggctcaacggtggaaagaggaggatgctgtttctctgtcacctccacttgctccccgacaggtggggcacagacctctgttcctgagcagagaagcagaaaaggaggttccctctctctgctccttcactgctgacccagaggggctgcaggatggtttcccctgggagaggccaggagggcctgatcccaggagacaccagggccagagtgaccacagcagggcaggcatcatgtgtgtgtgtgtgtgtggatgtgtgtgtgtgggttttgtaaagaattcttgaccaataaaagcaaaaactgtctgctgg

SEQ ID NO: 295059 - DNA, 2782 bp, Homo sapiens
agctgttccccgcgctgcgcggagcagggaccaggcggttgcggcggcgacagccatggccggcgcgctggcaggtctggccgcgggcttgcaggtcccgcgggtcgcgcccagcccagactcggactcggacacagactcggaggacccgagtctccggcgcagcgcgggcggcttgctccgctcgcaggtcatccacagcggtcacttcatggtgtcgtcgccgcacagcgactcgctgccccggcggcgcgaccaggaggggtccgtggggccctccgacttcgggccgcgcagtatcgaccccacactcacacgcctcttcgagtgcttgagcctggcctacagtggcaagctggtgtctcccaagtggaagaatttcaaaggcctcaagctgctctgcagagacaagatccgcctgaacaacgccatctggagggcctggtatatccagtatttctttaccaactcccgcctcccacagccgcccatgccttcaaacttcccagagccccccagcttcagccccgtggttgactccctcttcagcagtgggaccctgggcccagaggtgcccccggcttcctcggccatgacccacctctctggacacagccgtctgcaggctcggaacagctgccctggccccttggactccagcgccttcctgagttctgatttcctccttcctgaagaccccaagccccggctcccaccccctcctgtacccccacctctgctgcattaccctccccctgccaaggtgccaggcctggagccctgccccccacctcccttccctcccatggcaccacccactgctttgctgcaggaagagcctctcttctctcccaggtttcccttccccaccgtccctcctgccccaggagtgtctccgctgcctgctcctgcagccttcccacccaccccacagtctgtccccagcccagcccccacccccttccccatagagcttctacccttggggtattcggagcctgcctttgggccttgcttctccatgcccagaggcaagccccccgccccatcccctaggggacagaaagccagcccccctaccttagcccctgccactgccagtccccccaccactgcggggagcaacaacccctgcctcacacagctgctcacagcagctaagccggagcaagccctggagccaccacttgtatccagcaccctcctccggtccccagggtccccgcaggagacagtccctgaattcccctgcacattccttcccccgaccccggcccctacaccgccccggccacctccaggcccggccacattggccccttccaggcccctgcttgtccccaaagcggagcggctctcacccccagcgcccagcggcagtgaacggcggctgtcaggggacctcagctccatgccaggccctgggactctgagcgtccgtgtctctcccccgcaacccatcctcagccggggccgtccagacagcaacaagaccgagaaccggcgtatcacacacatctccgcggagcagaagcggcgcttcaacatcaagctggggtttgacacccttcatgggctcgtgagcacactcagtgcccagcccagcctcaaggtgagcaaagctaccacgctgcagaagacagctgagtacatccttatgctacagcaggagcgtgcgggcttgcaggaggaggcccagcagctgcgggatgagattgaggagctcaatgccgccattaacctgtgccagcagcagctgcccgccacaggggtacccatcacacaccagcgttttgaccagatgcgagacatgtttgatgactacgtccgaacccgtacgctgcacaactggaagttctgggtgttcagcatcctcatccggcctctgtttgagtccttcaacgggatggtgtccacggcaagtgtgcacaccctccgccagacctcactggcctggctggaccagtactgctctctgcccgctctccggccaactgtcctgaactccctacgccagctgggcacatctaccagtatcctgaccgacccgggccgcatccctgagcaagccacacgggcagtcacagagggcacccttggcaaacctttatagtcctggccagaccctgctgctcactcagctgccctgggggctgctttccctgggcacgggctccagggatcatctctgggcactcccttcctgccccaggccctggctctgcccttccctggggggtggagcagggtccaggtttcacacttgccacctcctggaggtcaagaagagcagagtccccgtccctgctctgccactgtgctccagcaccgtgaccttgggtgactcgtccgctgtctttggaccgctgtgtttcaatctgcaaaatggggatggggaaggttcaatcagcagatgacccccaggccttggcagctgtgacattgggggcctaggctggcaactccgggggctcaacggtggaaagaggaggatgctgtttctctgtcacctccacttgctccccgacaggtggggcacagacctctgttcctgagcagagaagcagaaaaggaggttccctctctctgctccttcactgctgacccagaggggctgcaggatggtttcccctgggagaggccaggagggcctgatcccaggagacaccagggccagagtgaccacagcagggcaggcatcatgtgtgtgtgtgtgtgtggatgtgtgtgtgtgggttttgtaaagaattcttgaccaataaaagcaaaaactgtctgctgg

SEQ ID NO: 295060 - DNA, 1429 bp, Homo sapiens
gggtctgtctgtccctaccacaggcagtgaacggcggctgtcaggggacctcagctccatgccaggccctgggactctgagcgtccgtgtctctcccccgcaacccatcctcagccggggccgtccagacagcaacaagaccgagaaccggcgtatcacacacatctccgcggagcagaagcggcgcttcaacatcaagctggggtttgacacccttcatgggctcgtgagcacactcagtgcccagcccagcctcaaggtgagcaaagctaccacgctgcagaagacagctgagtacatccttatgctacagcaggagcgtgcgggcttgcaggaggaggcccagcagctgcgggatgagattgaggagctcaatgccgccattaacctgtgccagcagcagctgcccgccacaggggtacccatcacacaccagcgttttgaccagatgcgagacatgtttgatgactacgtccgaacccgtacgctgcacaactggaagttctgggtgttcagcatcctcatccggcctctgtttgagtccttcaacgggatggtgtccacggcaagtgtgcacaccctccgccagacctcactggcctggctggaccagtactgctctctgcccgctctccggccaactgtcctgaactccctacgccagctgggcacatctaccagtatcctgaccgacccgggccgcatccctgagcaagccacacgggcagtcacagagggcacccttggcaaacctttatagtcctggccagaccctgctgctcactcagctgccctgggggctgctttccctgggcacgggctccagggatcatctctgggcactcccttcctgccccaggccctggctctgcccttccctggggggtggagcagggtccaggtttcacacttgccacctcctggaggtcaagaagagcagagtccccgtccctgctctgccactgtgctccagcaccgtgaccttgggtgactcgtccgctgtctttggaccgctgtgtttcaatctgcaaaatggggatggggaaggttcaatcagcagatgacccccaggccttggcagctgtgacattgggggcctaggctggcaactccgggggctcaacggtggaaagaggaggatgctgtttctctgtcacctccacttgctccccgacaggtggggcacagacctctgttcctgagcagagaagcagaaaaggaggttccctctctctgctccttcactgctgacccagaggggctgcaggatggtttcccctgggagaggccaggagggcctgatcccaggagacaccagggccagagtgaccacagcagggcaggcatcatgtgtgtgtgtgtgtgtggatgtgtgtgtgtgggttttgtaaagaattcttgaccaataaaagcaaaaactgtctgctgg

SEQ ID NO: 295061 - DNA, 3408 bp, Homo sapiens
cgctgctaaaagccgggcccgcggcgcagcgcacggagccctctgccgcccgcgcggagaaggcgccgggcgcggtccggcggtcccaagcatccccgcagcgcccccgccgcccgccgcccgcccctggccgcgccgcgcccctctgcaggtcgagcggattccaggtgagggcgtggagcccccgcgtcatcagtggcaagctggtgtctcccaagtggaagaatttcaaaggcctcaagctgctctgcagagacaagatccgcctgaacaacgccatctggagggcctggtatatccagtatgtgaagcggaggaagagccccgtgtgtggcttcgtgacccccctgcaggggcctgaggctgatgcgcaccggaagccggaggccgtggtcctggaggggaactactggaagcggcgcatcgaggtggtgatgcgggaataccacaagtggcgcatctactacaagaagcgggtcagtgggggagggccaggaggccccagagctttcctcctgcggctgccggctaccgcccgcctcggaagatccctggaaaggggatcctgacccccgagcttgcgcccctcgggccctccattcagtcccgggccgacagcgccaccgtgtggccacagcgtctcctagcggcctccttacctaggggtcggctccgtaagcccagcagggaagatgacctcctggcccctaagcaggcggaaggcaggtggccgccgccggagcaatggtgcaaacagctcttctccagtgtggtccccgtgctgctgggggacccagaggaggagccgggtgggcggcagctcctggacctcaattgctttttgtccgacatctcagacactctcttcaccatgactcagtccggcccttcgcccctgcagctgccgcctgaggatgcctacgtcggcaatgctgacatgatccagccggacctgacgccactgcagccaagcctggatgacttcatggacatctcagatttctttaccaactcccgcctcccacagccgcccatgccttcaaacttcccagagccccccagcttcagccccgtggttgactccctcttcagcagtgggaccctgggcccagaggtgcccccggcttcctcggccatgacccacctctctggacacagccgtctgcaggctcggaacagctgccctggccccttggactccagcgccttcctgagttctgatttcctccttcctgaagaccccaagccccggctcccaccccctcctgtacccccacctctgctgcattaccctccccctgccaaggtgccaggcctggagccctgccccccacctcccttccctcccatggcaccacccactgctttgctgcaggaagagcctctcttctctcccaggtttcccttccccaccgtccctcctgccccaggagtgtctccgctgcctgctcctgcagccttcccacccaccccacagtctgtccccagcccagcccccacccccttccccatagagcttctacccttggggtattcggagcctgcctttgggccttgcttctccatgcccagaggcaagccccccgccccatcccctaggggacagaaagccagcccccctaccttagcccctgccactgccagtccccccaccactgcggggagcaacaacccctgcctcacacagctgctcacagcagctaagccggagcaagccctggagccaccacttgtatccagcaccctcctccggtccccagggtccccgcaggagacagtccctgaattcccctgcacattccttcccccgaccccggcccctacaccgccccggccacctccaggcccggccacattggccccttccaggcccctgcttgtccccaaagcggagcggctctcacccccagcgcccagcggcagtgaacggcggctgtcaggggacctcagctccatgccaggccctgggactctgagcgtccgtgtctctcccccgcaacccatcctcagccggggccgtccagacagcaacaagaccgagaaccggcgtatcacacacatctccgcggagcagaagcggcgcttcaacatcaagctggggtttgacacccttcatgggctcgtgagcacactcagtgcccagcccagcctcaaggtgagcaaagctaccacgctgcagaagacagctgagtacatccttatgctacagcaggagcgtgcgggcttgcaggaggaggcccagcagctgcgggatgagattgaggagctcaatgccgccattaacctgtgccagcagcagctgcccgccacaggggtacccatcacacaccagcgttttgaccagatgcgagacatgtttgatgactacgtccgaacccgtacgctgcacaactggaagttctgggtgttcagcatcctcatccggcctctgtttgagtccttcaacgggatggtgtccacggcaagtgtgcacaccctccgccagacctcactggcctggctggaccagtactgctctctgcccgctctccggccaactgtcctgaactccctacgccagctgggcacatctaccagtatcctgaccgacccgggccgcatccctgagcaagccacacgggcagtcacagagggcacccttggcaaacctttatagtcctggccagaccctgctgctcactcagctgccctgggggctgctttccctgggcacgggctccagggatcatctctgggcactcccttcctgccccaggccctggctctgcccttccctggggggtggagcagggtccaggtttcacacttgccacctcctggaggtcaagaagagcagagtccccgtccctgctctgccactgtgctccagcaccgtgaccttgggtgactcgtccgctgtctttggaccgctgtgtttcaatctgcaaaatggggatggggaaggttcaatcagcagatgacccccaggccttggcagctgtgacattgggggcctaggctggcaactccgggggctcaacggtggaaagaggaggatgctgtttctctgtcacctccacttgctccccgacaggtggggcacagacctctgttcctgagcagagaagcagaaaaggaggttccctctctctgctccttcactgctgacccagaggggctgcaggatggtttcccctgggagaggccaggagggcctgatcccaggagacaccagggccagagtgaccacagcagggcaggcatcatgtgtgtgtgtgtgtgtggatgtgtgtgtgtgggttttgtaaagaattcttgaccaataaaagcaaaaactgtctgctggaaaaaaaaaaaatacttgaaaaactgaaagcttaatggagcgttactaaccttaaaagaaaggagtactttgacatttaaaaa

SEQ ID NO: 295062 - DNA, 387 bp, Homo sapiens
aaaaaaaaaaagaagaagtaggggctgcaacatgagtcattggggttcaacgttagacagtgtccaggccctttcttcccctggtttgaactgggcatcagggctccacgtggtgtggggggaccagctggaccacaggcagctccttgacctgggcccagttcagcatcctcatccggcctctgtttgagtccttcaacgggatggtgtccacggcaagtgtgcacaccctccgccagacctcactggcctggctggaccagtactgctctctgcccgctctccggccaagtacgtgagccatctccctgcctgctagagggacccagcctcgggggtggagggagcattccaccctgcttagatcccacatccagcttgccatca

SEQ ID NO: 295063 - DNA, 485 bp, Homo sapiens
gcggccgctgagcgcatcggagggcgggcgcgccgaggcgccgggtgggagcggagcatcttcacttctgcggggacctagtttgcccccacctgatgcaacccagaaaatggactgactgcgagtgccttggggcggagaatgtgtcttgctacgtgtaaagcacctagaaccctgccagattcaggggacacagcatcctgccgttttcctgccgtcccccgcccgccacacagtaggcgctccagtggctcggggcatctaccaggcaggccgcgctgtcctgccctgccggggctggagtggagcaaccctccggggccacccacatctgggtaccttttccccactttttccaccccagccgcgcacagtcaccagaaaactcttttaggtatctgaccttcatttgaacctatgttccctcacttgaacttctttttcctcattcatgagattctaaaggaaatatatgggattgggac

SEQ ID NO: 295064 - DNA, 609 bp, Homo sapiens
gcggcgcgctgggttgctttctcgggggtcgggtgagggccaggcggcggtccctacccggatccgccttcctcaaggcgggtctgcccttcggggagggcgtgtcggtctcagcctctggggcctgcctggtgtggaggacaggagagaagcatttcttctcctactgtattccttcagcatcttcacttctgcggggacctagtttgcccccacctgatgcaacccagaaaatggactgactgcgagtgccttggggcggagaatgtgtcttgctacgtgtaaagcacctagaaccctgccagattcaggggacacagcatcctgccgttttcctgccgtcccccgcccgccacacagtaggcgctccagtggctcggggcatctaccaggcaggccgcgctgtcctgccctgccggggctggagtggagcaaccctccggggccacccacatctgggtaccttttccccactttttccaccccagccgcgcacagtcaccagaaaactcttttaggtatctgaccttcatttgaacctatgttccctcacttgaacttctttttcctcattcatgagattctaaaggaaatatatgggattgggac

SEQ ID NO: 295065 - DNA, 3032 bp, Homo sapiens
atgatgcaaactaaagtacagaacaagaaaaggcaagtggctttcttcattttattgatgctttggggagaggtgggttctgaatcgattcagtattccgtattggaggagacagaaagtggcacgtttgtggccaacttgacaaaggacctgggactgagggtgggggagctggcttcgcggggcgctcgggttgttttcaaagggaacagacaacatttgcagtttgatccacagacccatgatttactgctaaatgaaaaactggaccgggaggagctgtgtggctccactgagccgtgtgtgctacctttccaagtgttactggaaaaccccttgcagttttttcaggcttccttgcgagtcagagatataaatgaccacgccccggaattccctgccagagaaatgctcctgaaaatatcagaaattactatgccaggaaagatatttcctttgaaaatggcacacgatttagacaccggcagcaacggccttcagaggtacacaatcagctccaaccctcacttccacgttctcacccgcaatcgcagcgaaggcaggaagttcccggagctggtgctagacaaaccgttggaccgcgaggagcagccccaactcaggctaacgctgatcgcgctggatggcgggtctccgccccggtcagggacctccgagattcagatccaggttttggacatcaatgacaacgtccccgagtttgctcaggagctctatgaagcacaagtccctgagaacaaccccctcggctctctggttattaccgtctcagccagagatttagatgcaggatcgtttgggaaggtatcttacgccctgtttcaagtcgatgacgtcaaccaacccttcgaaataaacgcaatcacaggagaaattcggctgagaaaggctttggattttgaggaaattcagtcttatgacgtggatgttgaggctacagatggtggaggcctatcaggaaaatgctctttagtcgtcagggtcctggacgtgaatgacaatgcccctgaactcaccatgtcgttcttcatcagcctcatcccagaaaacttaccagagatcacagtggcagttttcagtgtttcagatgcagactctggacataaccaacaggttatttgttcaatagagaacaatctcccctttctactaagaccttccgtggagaatttctacaccctggtaacagaaggcgcgctggacagagagagcagagccgagtacaacatcactatcacggtcactgatttggggacaccaaggctgaaaacccagcagagcataactgtgcaggtctccgacgtcaatgacaacgtccccgccttcacccaaacctcctacaccctgttcgtccgcgagaacaacagccccgccctgcacatcggcagcgtcagcgccacagacagagactcaggcatcaacgcccaggtcacctactcgctgctgccgccccaggacccgcacctgcccctctcttccctggtctccatcaacgcggacaacggccacctgtttgccctcaggtcgctggactacgaggccctgcagtctttcgagttccgcgtgggcgccacagaccgcggctccccggcgttgagcagcgaggcgctggtgcgcttgctggtgctggacgccaacgacaactcgcccttcgtgttgtacccgctgcagaacggctccgcgccctgcaccgagctggtgccccgggcggccgagccgggctacctggtgaccaaggtggtggcggtggacggcgactcgggccagaacgcctggctgtcgtaccagctgctcaaggccacggagctcggtctgttcggcgtgtgggcgcacaatggcgaggtgcgcaccgccaggctgctgagcgagcgagacgcagccaagcacaggctggtggtgcttgtcaaggacaatggcgagcctccgcgctcggccaccgccacgctgcacgtgctcctggtggacggcttctcccagccctacctgcctctccctgaggcggccccggcccaagcccaggccgactctctcaccgtctacctggtggtggcgttggcctcggtgtcgtcgctcttcctcttttcggtgctcctgttcgtggcggtgcggctgtgcaggaggagcagggcggcctcggtgggtcgctactcggtgcccgagggtccctttccagggcatctggtggatgtgagcggcaccgggaccctatcccagagctaccagtacaaggtgtgtctgacgggaggctcagaaacaaatgagttcaagttcctgaagccgattatgcccaacttccctcctcagggcactgagagagaaatggaagaaacccccacctctcggaatagcttcccgttcagttaagtgtgggattattttactaaatcttacttatgtttggagatctcttttaacttaaagttacatggtctgtttcttgtttattttacctctattctttaggttgaaattttatataaagtaagatactggtatcttagtatttcctgttcatgcttagtagtttattacttcacttgagggtacttgacaatatgaacaaaaagtaaatttttatttgcataattttaagcttttgaaattaaattatctattcttcccccccccaaaaaaaagtattgtaaatccttaagtaaaattgtatttctagctattggtaagagttgtttcactattgctatgtaggactgtttaaaatgtgagtatctgatattatttaatcctccaatgtctcattttgcagtaactcctacagtgtgtaacactaaaaataagaactaatgatggctaaacactaaagtagccattcatacttatgcatattttagtatcccataatagtcaatccaaaatttttgtgactatagactttactgaagtgtcaacacattagtttgtgagcctcatgtaagaacatgatggtctttttttaaaaaaaaagtcgtgccaattataagtgcttaataaatatttgctgaatgttactaaca

SEQ ID NO: 295066 - DNA, 3498 bp, Homo sapiens
  misc_feature (1)..(1): n is a, c, g, or t
  misc_feature (38)..(38): n is a, c, g, or t
  misc_feature (40)..(40): n is a, c, g, or t
  misc_feature (129)..(129): n is a, c, g, or t
nggagcaatgtgctggacctcagttcaacgaagatgangntatagagttttcactcattttgttcagctttccaaggaatgcatgtataaaagtcatcatcgatccatgcacagtctttgtacctacanagatggaatatcagaagattttggaaaatggacatttaccatcctgagggatccaccagcacctgaagaagcccacgccacatatgctgcacgtgcccaggggctccccaccatctccaggaatctcccaagacaaagatgatccatcgcagcctctggccttcttccatgccagaccacctaggaattagaggcaaaacaggtgtgcttgagaaaggcaagcaggtacacaggtctcaagggccatgccattcattcccttgtggtgcatcctgtatctacttcccacaggctactacagaaggaaccagaggcactataattcatgggtgtggtctggtttagcaacacctaagttttgctgacagccgtgagtgacaagatacaaacaaacccactgcttcatgcagttaaaaataacaacaaacctctgtaggtctgcaatgcttgtaactaagttctggtattccaagaaccattgccagtgatcaaggaacatatttcaaaggctcactaatccaagattgggcagaaatgtagaatatgacctggcaatttcatctgtgctacaaaccacagaaagcagaatttatagaaaagaaaacggtgtcttaaagaaacaaattaaactcttgagagaaatccttgcacttaaaacctgaaggatggttccatggaagctacacatggcaggaatgaggccccctgtgtaagagaaaagttggcctgtgaatgtctgctggacataaagagtccagtgggagccttgtggatatagaaaattatccaacactgccttgatactggacacaagtccacatgggataccctaattttgtgctctccctgtcacacaacccccaggcagtgaatcctgcaataagatttaggaagaaaactgcctttgaccttaggcaggaggtcaacactgccccaaaaccgacctctaacatacttcttattaaagggccccaagagaggtatccacaatgaccagacagtgcccccaaaacaatagaaattccagtagcactaggatagcagaatgactcagacttagcactgcagggagtatgagtacaaccacaaggacataaaatatctaaaaaagacctcctgaaagtttccagatcactgagattattgcagaaagagatgcataccagacttcaaacataggagagaatagggtcacttacgtaaaccaatatattttggttttgccactgttcacttgagctaccatccacactgctgttacatcaccacacttaatgttgggataaccacaacatttttttttctgatatcgacctgatatactccaataaaatgttccctggagaaaaacacgtgtgactggggatggagcaaagactgtcaggaaacaaaagcaatctgctgaaaggccctcccatgtagacatcagatcatattccattcccagcaccctaaggccaacatggcatttgtgatgtgcagtacacaccatgcaaaacagacgcgcaaatgtggcggacatccccatcttagggtaccaagtcaacacatgtatggcgctttctcattcccacctggagtatccatcaccagccatgggatttcagtttctccctggagacacacaaatcataaatggagccgatctacagggtactctccagaaagaaaataagcatcaccaacctcctcacaactgacttccactgctgctacgaaaacaccatgggcactaaaaagtcctcagccatgaaaaaaaatgagccaaagaacaacaaagatgtggccttgggctctcttcccaaccacaaggagctatctacctctggggaacaagggaacccagagccagcactcaaggacaaacctggccacacagaggcgggttaccggctaactcttctgtgccacctgcacattcacccagtcctgcagacattgtgcgtgctacccagcctcacaaagagaagtccttcacacaaggaatctcctctgcacaggagcacctactgccctgtgactccctttgatccaaagtggaccccatcctaagcctggatggatggcttagtgcaacccacatcaaccaatggaagttgtctctctctctccagctccagttggagccacgtgctggacctcagtttgacgaggacgacggtatagagttttcactcattttgttcagctttccaaggaatgcatgtattgaggtcatcatcgatccatgcacagtctttatccctgcaaagaaggaacatcaggggcttttggaaaatggacatttaccaacctgtgggatccaccagcacccaacagagatcacattccacatgtcaaggggctccctgccctctctagggatctcccaagatgaagactgtccctcgtagccactggccttacttccatggccacaacacctgggaagtgcagaggaaaaacgggtgtgcttaagaacgggaggcaggtacacatgtcaaaagggccattccactcgactcactgtggtatatcccatatgtgcttcccacaggctactccccttttgggatgggtgtatgggtctacccaggaatgaagatagcaggcacgtgttaattttgaaggcaccatcaagctacagagccctaagtgtaagaactctctcaaaaccactcatttgccatcactgactcaaaagccctcctcttggtcatcagagaagacacaagccacagggctatttaaatgaggagagttttggggaaaaactcttccagtacaaaaggcaattttccttcagtcttgaagacttttcaccctgggctgcttgaacacttttcagattgagaaaaacgttcaataacaacttaacctctacctcagcgtcttcctcacaggtgcagctcagaggaccaccagacacactgaatcccacatggcttctaaggcactgtggctgagaacaccatacattttaaggcacttgcctttgaacatggccgcgcagtgcaaaacctatgcatcactgcctgtggataccagccctgtcctacaacaagatgactatttcacaaagaagactcctgggaagaattaggaggaattagaaaataacctaacatcacgagctactaaggtatttaagcacagagaccttcctggaccatgtttccgagtagagatcaccaggatatgggaagtcacactcttataatcgggcacgttgactgcatcgaggtgcctgagtggttcagaggcaaagtatgcacaacctacgataggtagaaaccctgggccgatataagctcaaatgcctaatggagacaagcatctcacagagggtcctgaacacagaccttccaaaccaagtcagtctgaggagtt

SEQ ID NO: 295067 - DNA, 1501 bp, Homo sapiens
  misc_feature (1415)..(1415): n is a, c, g, or t
  misc_feature (1418)..(1418): n is a, c, g, or t
gccgtcgtccgcaaagcctgagtcctgtcctttctctctccccggacagcatgagcttcaccactcgctccaccttctccaccaactaccggtccctgggctctgtccaggcgcccagctacggcgcccggccggtcagcagcgcggccagcgtctatgcaggcgctgggggctctggttcccggatctccgtgtcccgctccaccagcttcaggggcggcatggggtccgggggcctggccaccgggatagccgggggtctggcaggaatgggaggcatccagaacgagaaggagaccatgcaaagcctgaacgaccgcctggcctcttacctggacagagtgaggagcctggagaccgagaaccggaggctggagagcaaaatccgggagcacttggagaagaagggaccccaggtcagagactggagccattacttcaagatcatcgaggacctgagggctcagatcttcgcaaatactgtggacaatgcccgcatcgttctgcagattgacaatgcccgtcttgctgctgatgactttagagtcaagtatgagacagagctggccatgcgccagtctgtggagaacgacatccatgggctccgcaaggtcattgatgacaccaatatcacacgactgcagctggagacagagatcgaggctctcaaggaggagctgctcttcatgaagaagaaccacgaagaggaagtaaaaggcctacaagcccagattgccagctctgggttgaccgtggaggtagatgcccccaaatctcaggacctcgccaagatcatggcagacatccggggccaatatgacgagctggctcggaagaaccgagaggagctagacaagtactggtctcagcagattgaggagagcaccacagtggtcaccacacagtctgctgaggttggagctgctgagacgacgctcacagagctgagacgtacagtccagtccttggagatcgacctggactccatgagaaatctgaaggccacgttggagaacagcctgagggaggtggaggcccgctacgccctacagatggagcagctcaacgggatcctgctgcaccttgagtcagagctggcacagacccgggcagagggacagcgccaggcccaggagtatgaggccctgctgaacatcaaggtcaagctggaggctgagatcgccacctaccgccgcctgctggaagatggcgaggactttaatcttggtgatgccttggacagcagcaactccatgcaaaccatccaaaagaccaccacccgccggatagtggatggcaaagtggtgtctgagaccaatgacaccaaagttctgaggcattaagccagcagaagcagggtaccctttggggagcaggaggccaataaaaagttcagagttcaaaaaacaaaaaanaanaaaacaccggtttttctggggcgacagagaaacgcgccggctcgttgccacccttggcaagggcgggccctggggtataatcg

SEQ ID NO: 295068 - DNA, 2604 bp, Homo sapiens
ggcgcgctccagcacatggcgccctgctgcagcaagggccgacggcggcggagtccgccgctatcccatcagcccggccaggcaggtccagctctcacccgcccaggtcgtcccgcctcccctatcccgtcttgctctgcggcgcaggggcaagatggctgctgagaagcaggtcccaggcggcggcggcggcggcggcaggcggtggacgtggtgccggaggggaagaaaataaagaaaacgaacgcccttcggccggatcgaaggcaaacaaagaatttggggatagcctgagtttggagattcttcagattattaaggaatcccagcagcagcatggtttacggcatggagattttcagaggtacaggggctactgttcccgtagacaaagacgtcttcgaaaaacactcaacttcaagatgggtaacagacacaaattcacagggaagaaagtgactgaagagcttctgaccgataatagatacttgcttctggttctgatggatgctgaaagagcctggagctacgccatgcagctgaaacaggaagccaacactgaaccccgaaaacggtttcacttgttatctcgcctacgcaaagccgtgaagcatgcagaggaattggaacgcttgtgtgagagcaatcgcgtggatgccaagaccaaattagaggctcaggcttacacagcttacctctcaggaatgctacgttttgaacatcaagaatggaaagctgccattgaggcttttaacaaatgcaaaactatctatgagaagctagccagtgctttcacagaggagcaggctgtgctgtataaccaacgtgtggaagagatttcacccaacatccgctattgtgcatataatattggggaccagtcagccatcaatgaactcatgcagatgagattgaggtctgggggcactgagggtctcttggctgaaaaattggaggctttgatcactcagactcgagccaaacaggcagctaccatgagtgaagtggagtggagagggagaacggttccagtgaagattgacaaagtgcgcattttcttattaggactggctgataacgaagcagctattgtccaggctgaaagcgaagaaactaaggagcgcctgtttgaatcaatgctcagcgagtgtcgggacgccatccaggtggttcgggaggagctcaagccagatcagaaacagagagattatatccttgaaggagagccagggaaggtgtctaatcttcaatacttgcatagctacctgacttacatcaagctatcaacggcaatcaagcgtaatgagaacatggccaaaggtctgcagagggctctgctgcagcagcagccagaggatgacagcaagcgctcaccccggccccaggacctgatccgactctatgacatcatcttacagaatctggtggaattgctccagcttcctggtttagaggaagacaaagccttccagaaagagataggcctcaagactctggtgttcaaagcttacaggtgttttttcattgctcagtcctatgtgctggtgaagaagtggagcgaagcccttgtcctgtatgacagagtcctgaaatatgcaaatgaagtaaattctgatgctggcgccttcaagaacagcctaaaggacctgcctgatgtgcaagagctcatcactcaagtgcggtcagagaagtgctccctgcaggccgcagccatccttgatgcaaacgacgctcatcaaacagagacctcctcctcccaagtcaaggacaataagcctctggttgaacggtttgagacattctgcctggacccttcccttgtcaccaagcaagccaaccttgtgcacttcccaccaggcttccagcccattccctgcaagcctttgttctttgacctggccctcaaccatgtggctttcccaccccttgaggacaagttggaacagaagaccaagagtggcctcactggatacatcaagggcatctttggattcaggagctaaccaggctcttcctcgggggcgggggagattctgactcttaatctgtattgtgagaaaatcccagcaagttccatgatattaaatccaggtctgcattggcccggggcaagagtttaacatcttcggccctgcattcctacatcttgtgtctgtacacgttcttaagcagcgtgtcaggagagcaccctgttgtcttctggtaaatgtgtgcagggtcatcctgtctcctgtacctcctgggaaaggggccgctgctgtctggtgccctgtgagctgtgattgattgcctttggtcagtaatgcgttcaggagtccacaccaggcacagatggggccttgaaacgctttgtcatgcttcttcagtaccatggatttgaaatgaactcatccttgctgtgagcatccaggagcccttgagaagtttatctatgactatgaaactggcaacgtcaccccagaattacggtcagccttattccccttcacctcccagtgaacgctaagaagtttcagacaagcagagagctctatttttagaagaaatatgttacactcagaaatgatgaaaccaaatcttatattaaaaggcaaagatgacgga

SEQ ID NO: 295069 - DNA, 2094 bp, Homo sapiens
ggcgcgctccagcacatggcgccctgctgcagcaagggccgacggcggcggagtccgccgctatcccatcagcccggccaggcaggtccagctctcacccgcccaggtcgtcccgcctcccctatcccgtcttgctctgcggcgcaggggcaagatggctgctgagaagcaggtcccaggcggcggcggcggcggcggcagtggcggcggcggtggcagtggcggcggcggtagcggcggtggacgtggtgccggaggggaagaaaataaagaaaacgaacgcccttcggccggatcgaaggcaaacaaagaatttggggatagcctgagtttggagattcttcagattattaaggaatcccagcagcagcatggtttacggcatggagattttcagaggtacaggggctactgttcccgtagacaaagacgtcttcgaaaaacactcaacttcaagatgggtaacagacacaaattcacagggaagaaagtgactgaagagcttctgaccgataatagatacttgcttctggttctgatggatgctgaaagagcctggagctacgccatgcagctgaaacaggaagccaacactgaaccccgaaaacggtttcacttgttatctcgcctacgcaaagccgtgaagcatgcagaggaattggaacgcttgtgtgagagcaatcgcgtggatgccaagaccaaattagaggctcaggcttacacagcttacctctcaggaatgctacgttttgaacatcaagaatggaaagctgccattgaggcttttaacaaatgcaaaactatctatgagaagctagccagtgctttcacagaggagcaggctgtgctgtataaccaacgtgtggaagagatttcacccaacatccgctattgtgcatataatattggggaccagtcagccatcaatgaactcatgcagatgagattgaggtctgggggcactgagggtctcttggctgaaaaattggaggctttgatcactcagactcgagccaaacaggcagctaccatgagtgaagtggagtggagagggagaacggttccagtgaagattgacaaagtgcgcattttcttattaggactggctgataacgaagcagctattgtccaggctgaaagcgaagaaactaaggagcgcctgtttgaatcaatgctcagcgagtgtcgggacgccatccaggtggttcgggaggagctcaagccagatcagagagacctcctcctcccaagtcaaggacaataagcctctggttgaacggtttgagacattctgcctggacccttcccttgtcaccaagcaagccaaccttgtgcacttcccaccaggcttccagcccattccctgcaagcctttgttctttgacctggccctcaaccatgtggctttcccaccccttgaggacaagttggaacagaagaccaagagtggcctcactggatacatcaagggcatctttggattcaggagctaaccaggctcttcctcgggggcgggggagattctgactcttaatctgtattgtgagaaaatcccagcaagttccatgatattaaatccaggtctgcattggcccggggcaagagtttaacatcttcggccctgcattcctacatcttgtgtctgtacacgttcttaagcagcgtgtcaggagagcaccctgttgtcttctggtaaatgtgtgcagggtcatcctgtctcctgtacctcctgggaaaggggccgctgctgtctggtgccctgtgagctgtgattgattgcctttggtcagtaatgcgttcaggagtccacaccaggcacagatggggccttgaaacgctttgtcatgcttcttcagtaccatggatttgaaatgaactcatccttgctgtgagcatccaggagcccttgagaagtttatctatgactatgaaactggcaacgtcaccccagaattacggtcagccttattccccttcacctcccagtgaacgctaagaagtttcagacaagcagagagctctatttttagaagaaatatgttacactcagaaatgatgaaaccaaatcttatattaaaaggcaaagatgacgga

SEQ ID NO: 295070 - DNA, 1691 bp, Homo sapiens
tagttacttctcgtgtctgagaaccctctgcgcgtcttacagaatctggtggaattgctccagcttcctggtttagaggaagacaaagccttccagaaagagataggcctcaagactctggtgttcaaagcttacaggtgttttttcattgctcagtcctatgtgctggtgaagaagtggagcgaagcccttgtcctgtatgacagagtcctgaaatatgcaaatgaagtaaattctgatgctggcgccttcaagaacagcctaaaggacctgcctgatgtgcaagagctcatcactcaagtgcggtcagagaagtgctccctgcaggccgcagccatccttgatgcaaacgacgctcatcaaacagagacctcctcctcccaagtcaaggacaataagcctctggttgaacggtttgagacattctgcctggacccttcccttgtcaccaagcaagccaaccttgtgcacttcccaccaggcttccagcccattccctgcaagcctttgttctttgacctggccctcaaccatgtggctttcccaccccttgaggacaagttggaacagaagaccaagagtggcctcactggatacatcaagggcatctttggattcaggagctaaccaggctcttcctcgggggcgggggagattctgactcttaatctgtattgtgagaaaatcccagcaagttccatgatattaatccgtctgctgaaaaaaaaaaaaaaaaaaaaaaacaaacgggggcgcaaaataacggggggccattccgctaccctctggaaagcgacctagggggctaaacgaggggcgtaacacgatcggatcacgtacttgacactttggttgaccacaacgtactttttattgctcgtcttgtttctctatgcctcattcgtaccacaccgcacataaagctaacaaacacgacaacataacaacagatcagaaaacaagggagggggaagagcagcggggaaggagagcgaggggagaggaggaggggagaagagaggaggggagagagaagggcaaggaagagagggacagggacgggagcaaggggggacgagacagacggcggggcgggaagaggggcagcacgagagcacgagacggcagcaggggcaagaacaagggagagagcgcgagagaggagggaaagaaagaagaagagcggagagacgaggaagagggagagaggagtcgaagcagagacggggggaggacgcggaagaggaggagacggagaggaagaggagagagagtgagaagaagaagggagagagggaggagagaggggcaggaggcagggcggagggaggtggatgagagaaggaaaaggaaggagacgagagacggactaggaagggagagagaggagaaaagagcgcgacacgaagaggagacgccacgcggaacgcggaacagagcgagaagagagagagaggaaaggcaggaccgcggccgagggagcgaggggaaacgagagacggagagacggagagggagaacgagatgcgaacagcgaacggacgaaaggaacgagacagagcaaagagaggagcacagagacgcaggagcggagagaggggaagccgacagagaggcgagaaagggagagtgaaaaccgaggaacacgataggacgagaggacacgagcaagaaagaacaggacgggagca

SEQ ID NO: 295071 - DNA, 490 bp, Homo sapiens
gagcaccctgcacacatttaccagaagacaacagggtgctctcctgacacgctgcttaagaacgtgtacagacacctgttgtcttctggtaaatgtgtgcagggtcatcctgtctcctgtacctcctgggaaaggggccgctgctgtctggtgccctgtgagctgtgattgattgcctttggtcagtaatgcgttcaggagtccacaccaggcacagatggggccttgaaacgctttgtcatgcttcttcagtaccatggatttgaaatgaactcatccttgctgtgagcatccaggagcccttgagaagtttatctatgactatgaaactggcaacgtcaccccagaattacggtcagccttattccccttcacctcccagtgaacgctaagaagtttcagacaagcagagagctctatttttagaagaaatatgttacactcagaaatgatgaaaccaaatcttatattaaaaggcaaagatgacgga

SEQ ID NO: 295072 - DNA, 2639 bp, Homo sapiens
ggcgcgctccagcacatggcgccctgctgcagcaagggccgacggcggcggagtccgccgctatcccatcagcccggccaggcaggtccagctctcacccgcccaggtcgtcccgcctcccctatcccgtcttgctctgcggcgcaggggcaagatggctgctgagaagcaggtcccaggcggcggcggcggcggcggcagtggcggcggcggtggcagtggcggcggcggtagcggcggtggacgtggtgccggaggggaagaaaataaagaaaacgaacgcccttcggccggatcgaaggcaaacaaagaatttggggatagcctgagtttggagattcttcagattattaaggaatcccagcagcagcatggtttacggcatggagattttcagaggtacaggggctactgttcccgtagacaaagacgtcttcgaaaaacactcaacttcaagatgggtaacagacacaaattcacagggaagaaagtgactgaagagcttctgaccgataatagatacttgcttctggttctgatggatgctgaaagagcctggagctacgccatgcagctgaaacaggaagccaacactgaaccccgaaaacggtttcacttgttatctcgcctacgcaaagccgtgaagcatgcagaggaattggaacgcttgtgtgagagcaatcgcgtggatgccaagaccaaattagaggctcaggcttacacagcttacctctcaggaatgctacgttttgaacatcaagaatggaaagctgccattgaggcttttaacaaatgcaaaactatctatgagaagctagccagtgctttcacagaggagcaggctgtgctgtataaccaacgtgtggaagagatttcacccaacatccgctattgtgcatataatattggggaccagtcagccatcaatgaactcatgcagatgagattgaggtctgggggcactgagggtctcttggctgaaaaattggaggctttgatcactcagactcgagccaaacaggcagctaccatgagtgaagtggagtggagagggagaacggttccagtgaagattgacaaagtgcgcattttcttattaggactggctgataacgaagcagctattgtccaggctgaaagcgaagaaactaaggagcgcctgtttgaatcaatgctcagcgagtgtcgggacgccatccaggtggttcgggaggagctcaagccagatcagaaacagagagattatatccttgaaggagagccagggaaggtgtctaatcttcaatacttgcatagctacctgacttacatcaagctatcaacggcaatcaagcgtaatgagaacatggccaaaggtctgcagagggctctgctgcagcagcagccagaggatgacagcaagcgctcaccccggccccaggacctgatccgactctatgacatcatcttacagaatctggtggaattgctccagcttcctggtttagaggaagacaaagccttccagaaagagataggcctcaagactctggtgttcaaagcttacaggtgttttttcattgctcagtcctatgtgctggtgaagaagtggagcgaagcccttgtcctgtatgacagagtcctgaaatatgcaaatgaagtaaattctgatgctggcgccttcaagaacagcctaaaggacctgcctgatgtgcaagagctcatcactcaagtgcggtcagagaagtgctccctgcaggccgcagccatccttgatgcaaacgacgctcatcaaacagagacctcctcctcccaagtcaaggacaataagcctctggttgaacggtttgagacattctgcctggacccttcccttgtcaccaagcaagccaaccttgtgcacttcccaccaggcttccagcccattccctgcaagcctttgttctttgacctggccctcaaccatgtggctttcccaccccttgaggacaagttggaacagaagaccaagagtggcctcactggatacatcaagggcatctttggattcaggagctaaccaggctcttcctcgggggcgggggagattctgactcttaatctgtattgtgagaaaatcccagcaagttccatgatattaaatccaggtctgcattggcccggggcaagagtttaacatcttcggccctgcattcctacatcttgtgtctgtacacgttcttaagcagcgtgtcaggagagcaccctgttgtcttctggtaaatgtgtgcagggtcatcctgtctcctgtacctcctgggaaaggggccgctgctgtctggtgccctgtgagctgtgattgattgcctttggtcagtaatgcgttcaggagtccacaccaggcacagatggggccttgaaacgctttgtcatgcttcttcagtaccatggatttgaaatgaactcatccttgctgtgagcatccaggagcccttgagaagtttatctatgactatgaaactggcaacgtcaccccagaattacggtcagccttattccccttcacctcccagtgaacgctaagaagtttcagacaagcagagagctctatttttagaagaaatatgttacactcagaaatgatgaaaccaaatcttatattaaaaggcaaagatgacgga

SEQ ID NO: 295073 - DNA, 2665 bp, Homo sapiens
ggcgcgctccagcacatggcgccctgctgcagcaagggccgacggcggcggagtccgccgctatcccatcagcccggccaggcaggtccagctctcacccgcccaggtcgtcccgcctcccctatcccgtcttgctctgcggcgcaggggcaagatggctgctgagaagcaggtcccaggcggcggcggcggcggcggcagtggcggcggcggtggcagtggcggcggcggtagcggcggtggacgtggtgccggaggggaagaaaataaagaaaacgaacgcccttcggccggatcgaaggcaaacaaagaatttggggatagcctgagtttggagattcttcagattattaaggaatcccagcagcagcatggtttacggcatggagattttcagaggtacaggggctactgttcccgtagacaaagacgtcttcgaaaaacactcaacttcaagatgggtaacagacacaaattcacagggaagaaagtgactgaagagcttctgaccgataatagatacttgcttctggttctgatggatgctgaaagagcctggagctacgccatgcagctgaaacaggaagccaacactgaaccccgaaaacggtttcacttgttatctcgcctacgcaaagccgtgaagcatgcagaggaattggaacgcttgtgtgagagcaatcgcgtggatgccaagaccaaattagaggctcaggcttacacagcttacctctcaggaatgctacgttttgaacatcaagaatggaaagctgccattgaggcttttaacaaatgcaaaactatctatgagaagctagccagtgctttcacagaggagcaggctgtgctgtataaccaacgtgtggaagagatttcacccaacatccgctattgtgcatataatattggggaccagtcagccatcaatgaactcatgcagatgagattgaggtctgggggcactgagggtctcttggctgaaaaattggaggctttgatcactcagactcgagccaaacaggcagctaccatgagtgaagtggagtggagagggagaacggttccagtgaagattgacaaagtgcgcattttcttattaggactggctgataacgaagcagctattgtccaggctgaaagcgaagaaactaaggagcgcctgtttgaatcaatgctcagcgagtgtcgggacgccatccaggtggttcgggaggagctcaagccagatcagaaacagagagattatatccttgaaggagagccagggaaggtgtctaatcttcaatacttgcatagctacctgacttacatcaagctatcaacggcaatcaagcgtaatgagaacatggccaaaggtctgcagagggctctgctgcagcagcagccagaggatgacagcaagcgctcaccccggccccaggacctgatccgactctatgacatcatcttacagaatctggtggaattgctccagcttcctggtttagaggaagacaaagccttccagaaagagataggcctcaagactctggtgttcaaagcttacaggtgttttttcattgctcagtcctatgtgctggtgaagaagtggagcgaagcccttgtcctgtatgacagagtcctgaaatatgcaaatgaagtaaattctgatgctggcgccttcaagaacagcctaaaggacctgcctgatgtgcaagagctcatcactcaagtgcggtcagagaagtgctccctgcaggccgcagccatccttgatgcaaacgacgctcatcaaacagagacctcctcctcccaagtcaaggacaataagcctctggttgaacggtttgagacattctgcctggacccttcccttgtcaccaagcaagccaaccttgtgcacttcccaccaggcttccagcccattccctgcaagcctttgttctttgacctggccctcaaccatgtggctttcccaccccttgaggacaagttggaacagaagaccaagagtggcctcactggatacatcaagggcatctttggattcaggagctaaccaggctcttcctcgggggcgggggagattctgactcttaatctgtattgtgagaaaatcccagcaagttccatgatattaaatccaggtctgcattggcccggggcaagagtttaacatcttcggccctgcattcctacatcttgtgtctgtacacgttcttaagcagcgtgtcaggagagcaccctgttgtcttctggtaaatgtgtgcagggtcatcctgtctcctgtacctcctgggaaaggggccgctgctgtctggtgccctgtgagctgtgattgattgcctttggtcagtaatgcgttcaggagtccacaccaggcacagatggggccttgaaacgctttgtcatgcttcttcagtaccatggatttgaaatgaactcatccttgctgtgagcatccaggagcccttgagaagtttatctatgactatgaaactggcaacgtcaccccagaattacggtcagccttattccccttcacctcccagtgaacgctaagaagtttcagacaagcagagagctctatttttagaagaaatatgttacactcagaaatgatgaaaccaaatcttatattaaaaggcaaagatgacggaaaaaaaaaacaaaaaaagcaaaaata

SEQ ID NO: 295074 - DNA, 2608 bp, Homo sapiens
  misc_feature (2406)..(2406): n is a, c, g, or t
  misc_feature (2462)..(2462): n is a, c, g, or t
  misc_feature (2468)..(2468): n is a, c, g, or t
  misc_feature (2474)..(2474): n is a, c, g, or t
  misc_feature (2496)..(2496): n is a, c, g, or t
  misc_feature (2499)..(2499): n is a, c, g, or t
  misc_feature (2502)..(2502): n is a, c, g, or t
  misc_feature (2590)..(2590): n is a, c, g, or t
ggcgcgctccagcacatggcgccctgctgcagcaagggccgacggcggcggagtccgccgctatcccatcagcccggccaggcaggtccagctctcacccgcccaggtcgtcccgcctcccctatcccgtcttgctctgcggcgcaggggcaagatggctgctgagaagcaggtcccaggcggcggcggcggcggcggcagtggcggcggcggtggcagtggcggcggcggtagcggcggtggacgtggtgccggaggggaagaaaataaagaaaacgaacgcccttcggccggatcgaaggcaaacaaagaatttggggatagcctgagtttggagattcttcagattattaaggaatcccagcagcagcatggtttacggcatggagattttcagaggtacaggggctactgttcccgtagacaaagacgtcttcgaaaaacactcaacttcaagatgggtaacagacacaaattcacagggaagaaagtgactgaagagcttctgaccgataatagatacttgcttctggttctgatggatgctgaaagagcctggagctacgccatgcagctgaaacaggaagccaacactgaaccccgaaaacggtttcacttgttatctcgcctacgcaaagccgtgaagcatgcagaggaattggaacgcttgtgtgagagcaatcgcgtggatgccaagaccaaattagaggctcaggcttacacagcttacctctcaggaatgctacgttttgaacatcaagaatggaaagctgccattgaggcttttaacaaatgcaaaactatctatgagaagctagccagtgctttcacagaggagcaggctgtgctgtataaccaacgtgtggaagagatttcacccaacatccgctattgtgcatataatattggggaccagtcagccatcaatgaactcatgcagatgagattgaggtctgggggcactgagggtctcttggctgaaaaattggaggctttgatcactcagactcgagccaaacaggcagctaccatgagtgaagtggagtggagagggagaacggttccagtgaagattgacaaagtgcgcattttcttattaggactggctgataacgaagcagctattgtccaggctgaaagcgaagaaactaaggagcgcctgtttgaatcaatgctcagcgagtgtcgggacgccatccaggtggttcgggaggagctcaagccagatcagaaacagagagattatatccttgaaggagagccagggaaggtgtctaatcttcaatacttgcatagctacctgacttacatcaagctatcaacggcaatcaagcgtaatgagaacatggccaaaggtctgcagagggctctgctgcagcagcagccagaggatgacagcaagcgctcaccccggccccaggacctgatccgactctatgacatcatcttacagaatctggtggaattgctccagcttcctggtttagaggaagacaaagccttccagaaagagataggcctcaagactctggtgttcaaagcttacaggtgttttttcattgctcagtcctatgtgctggtgaagaagtggagcgaagcccttgtcctgtatgacagagtcctgaaatatgcaaatgaagtaaattctgatgctggcgccttcaagaacagcctaaaggacctgcctgatgtgcaagagctcatcactcaagtgcggtcagagaagtgctccctgcaggccgcagccatccttgatgcaaacgacgctcatcaaacagagacctcctcctcccaagtcaaggacaataagcctctggttgaacggtttgagacattctgcctggacccttcccttgtcaccaagcaagccaaccttgtgcacttcccaccaggcttccagcccattccctgcaagcctttgttctttgacctggccctcaaccatgtggctttcccaccccttgaggacaagttggaacagaagaccaagagtggcctcactggatacatcaagggcatctttggattcaggagctaaccaggctcttcctcgggggcgggggagattctgactcttaatctgtattgtgagaaaatcccagcaagttccatgatattaaatccaggtctgcattggcccggggcaagagtttaacatcttcggccctgcattcctacatcttgtgtctgtacacgttcttaagcagcgtgtcaggagagcaccctgttgtcttctggtaaatgtgtgcagggtcatcctgtctcctgtacctcctgggaaaggggccgctgctgtctggtgccctgtgagctgtgattgattgcctttggtcagtaatgcgttcaggagtccacaccaggcacagatggggccttgaaacgctttgtcatgcttcttcagctacncagtgggatttttgaaaaatgcaaactcaatcctttgcctgctgagccattccagngagccnccttgnagcaagctttattctaatgaantantgnaaactgcgccaacgctcacccccagcaatttacgcgctcagccctttaattccccctttcaccctccccagctgcaacgcctaagggngctttcagcacaagccag

SEQ ID NO: 295075 - DNA, 2754 bp, Homo sapiens
tttttttataatgaaacattttatttagttttaacataatgaaagaatacactaaatattgaggtggcaaagaagccctgggcaggcagcaagagcgacttggtgaagccaagaggaggtcctgtcaatgacatctgacccgagctggttgctcaaagttgtttattaagcaaactccacgcctccagccttgtggcttcattttccaactcagttaaatggcgatgagggtcctccccagccataatcggagtatcgatcagcttctgaatcctcagatgagcaaaccttgctttcagaattgcaccgtccatgaagatgctttaggcctcgtgccgaattcggcacgaggcggtggacgtggtgccggaggggaagaaaataaagaaaacgaacgcccttcggccggatcgaaggcaaacaaagaatttggggatagcctgagtttggagattcttcagattattaaggaatcccagcagcagcatggtttacggcatggagattttcagaggtacaggggctactgttcccgtagacaaagacgtcttcgaaaaacactcaacttcaagatgggtaacagacacaaattcacagggaagaaagtgactgaagagcttctgaccgataatagatacttgcttctggttctgatggatgctgaaagagcctggagctacgccatgcagctgaaacaggaagccaacactgaaccccgaaaacggtttcacttgttatctcgcctacgcaaagccgtgaagcatgcagaggaattggaacgcttgtgtgagagcaatcgcgtggatgccaagaccaaattagaggctcaggcttacacagcttacctctcaggaatgctacgttttgaacatcaagaatggaaagctgccattgaggcttttaacaaatgcaaaactatctatgagaagctagccagtgctttcacagaggagcaggctgtgctgtataaccaacgtgtggaagagatttcacccaacatccgctattgtgcatataatattggggaccagtcagccatcaatgaactcatgcagatgagattgaggtctgggggcactgagggtctcttggctgaaaaattggaggctttgatcactcagactcgagccaaacaggcagctaccatgagtgaagtggagtggagagggagaacggttccagtgaagattgacaaagtgcgcattttcttattaggactggctgataacgaagcagctattgtccaggctgaaagcgaagaaactaaggagcgcctgtttgaatcaatgctcagcgagtgtcgggacgccatccaggtggttcgggaggagctcaagccagatcagaaacagagagattatatccttgaaggagagccagggaaggtgtctaatcttcaatacttgcatagctacctgacttacatcaagctatcaacggcaatcaagcgtaatgagaacatggccaaaggtctgcagagggctctgctgcagcagcagccagaggatgacagcaagcgctcaccccggccccaggacctgatccgactctatgacatcatcttacagaatctggtggaattgctccagcttcctggtttagaggaagacaaagccttccagaaagagataggcctcaagactctggtgttcaaagcttacaggtgttttttcattgctcagtcctatgtgctggtgaagaagtggagcgaagcccttgtcctgtatgacagagtcctgaaatatgcaaatgaagtaaattctgatgctggcgccttcaagaacagcctaaaggacctgcctgatgtgcaagagctcatcactcaagtgcggtcagagaagtgctccctgcaggccgcagccatccttgatgcaaacgacgctcatcaaacagagacctcctcctcccaagtcaaggacaataagcctctggttgaacggtttgagacattctgcctggacccttcccttgtcaccaagcaagccaaccttgtgcacttcccaccaggcttccagcccattccctgcaagcctttgttctttgacctggccctcaaccatgtggctttcccaccccttgaggacaagttggaacagaagaccaagagtggcctcactggatacatcaagggcatctttggattcaggagctaaccaggctcttcctcgggggcgggggagattctgactcttaatctgtattgtgagaaaatcccagcaagttccatgatattaaatccaggtctgcattggcccggggcaagagtttaacatcttcggccctgcattcctacatcttgtgtctgtacacgttcttaagcagcgtgtcaggagagcaccctgttgtcttctggtaaatgtgtgcagggtcatcctgtctcctgtacctcctgggaaaggggccgctgctgtctggtgccctgtgagctgtgattgattgcctttggtcagtaatgcgttcaggagtccacaccaggcacagatggggccttgaaacgctttgtcatgcttcttcagtaccatggatttgaaatgaactcatccttgctgtgagcatccaggagcccttgagaagtttatctatgactatgaaactggcaacgtcaccccagaattacggtcagccttattccccttcacctcccagtgaacgctaagaagtttcagacaagcagagagctctatttttagaagaaatatgttacactcagaaatgatgaaaccaaatcttatattaaaaggcaaagatgacgga

SEQ ID NO: 295076 - DNA, 2524 bp, Homo sapiens
ggcagcttgtgactcacccagctgggagctctccagagacacccctccctctgccagggccagcttggtcactgcaggggggtggcggggtgactcttgctcgtgccgaattcggcacgaggcggtggacgtggtgccggaggggaagaaaataaagaaaacgaacgcccttcggccggatcgaaggcaaacaaagaatttggggatagcctgagtttggagattcttcagattattaaggaatcccagcagcagcatggtttacggcatggagattttcagaggtacaggggctactgttcccgtagacaaagacgtcttcgaaaaacactcaacttcaagatgggtaacagacacaaattcacagggaagaaagtgactgaagagcttctgaccgataatagatacttgcttctggttctgatggatgctgaaagagcctggagctacgccatgcagctgaaacaggaagccaacactgaaccccgaaaacggtttcacttgttatctcgcctacgcaaagccgtgaagcatgcagaggaattggaacgcttgtgtgagagcaatcgcgtggatgccaagaccaaattagaggctcaggcttacacagcttacctctcaggaatgctacgttttgaacatcaagaatggaaagctgccattgaggcttttaacaaatgcaaaactatctatgagaagctagccagtgctttcacagaggagcaggctgtgctgtataaccaacgtgtggaagagatttcacccaacatccgctattgtgcatataatattggggaccagtcagccatcaatgaactcatgcagatgagattgaggtctgggggcactgagggtctcttggctgaaaaattggaggctttgatcactcagactcgagccaaacaggcagctaccatgagtgaagtggagtggagagggagaacggttccagtgaagattgacaaagtgcgcattttcttattaggactggctgataacgaagcagctattgtccaggctgaaagcgaagaaactaaggagcgcctgtttgaatcaatgctcagcgagtgtcgggacgccatccaggtggttcgggaggagctcaagccagatcagaaacagagagattatatccttgaaggagagccagggaaggtgtctaatcttcaatacttgcatagctacctgacttacatcaagctatcaacggcaatcaagcgtaatgagaacatggccaaaggtctgcagagggctctgctgcagcagcagccagaggatgacagcaagcgctcaccccggccccaggacctgatccgactctatgacatcatcttacagaatctggtggaattgctccagcttcctggtttagaggaagacaaagccttccagaaagagataggcctcaagactctggtgttcaaagcttacaggtgttttttcattgctcagtcctatgtgctggtgaagaagtggagcgaagcccttgtcctgtatgacagagtcctgaaatatgcaaatgaagtaaattctgatgctggcgccttcaagaacagcctaaaggacctgcctgatgtgcaagagctcatcactcaagtgcggtcagagaagtgctccctgcaggccgcagccatccttgatgcaaacgacgctcatcaaacagagacctcctcctcccaagtcaaggacaataagcctctggttgaacggtttgagacattctgcctggacccttcccttgtcaccaagcaagccaaccttgtgcacttcccaccaggcttccagcccattccctgcaagcctttgttctttgacctggccctcaaccatgtggctttcccaccccttgaggacaagttggaacagaagaccaagagtggcctcactggatacatcaagggcatctttggattcaggagctaaccaggctcttcctcgggggcgggggagattctgactcttaatctgtattgtgagaaaatcccagcaagttccatgatattaaatccaggtctgcattggcccggggcaagagtttaacatcttcggccctgcattcctacatcttgtgtctgtacacgttcttaagcagcgtgtcaggagagcaccctgttgtcttctggtaaatgtgtgcagggtcatcctgtctcctgtacctcctgggaaaggggccgctgctgtctggtgccctgtgagctgtgattgattgcctttggtcagtaatgcgttcaggagtccacaccaggcacagatggggccttgaaacgctttgtcatgcttcttcagtaccatggatttgaaatgaactcatccttgctgtgagcatccaggagcccttgagaagtttatctatgactatgaaactggcaacgtcaccccagaattacggtcagccttattccccttcacctcccagtgaacgctaagaagtttcagacaagcagagagctctatttttagaagaaatatgttacactcagaaatgatgaaaccaaatcttatattaaaaggcaaagatgacgga

SEQ ID NO: 295077 - DNA, 2098 bp, Homo sapiens
ggcgcgctccagcacatggcgccctgctgcagcaagggccgacggcggcggagtccgccgctatcccatcagcccggccaggcaggtccagctctcacccgcccaggtcgtcccgcctcccctatcccgtcttgctctgcggcgcaggggcaagatggctgctgagaagcaggtcccaggcggcggcggcggcggcggcagtggcggcggcggtggcagtggcggcggcggtagcggcggtggacgtggtgccggaggggaagaaaataaagaaaacgaacgcccttcggccggatcgaaggcaaacaaagaatttggggatagcctgagtttggagattcttcagattattaaggaatcccagcagcagcatggtttacggcatggagattttcagaggtacaggggctactgttcccgtagacaaagacgtcttcgaaaaacactcaacttcaagatgggtaacagacacaaattcacagggaagaaagtgactgaagagcttctgaccgataatagatacttgcttctggttctgatggatgctgaaagagcctggagctacgccatgcagctgaaacaggaagccaacactgaaccccgaaaacggtttcacttgttatctcgcctacgcaaagccgtgaagcatgcagaggaattggaacgcttgtgtgagagcaatcgcgtggatgccaagaccaaattagaggctcaggcttacacagcttacctctcaggaatgctacgttttgaacatcaagaatggaaagctgccattgaggcttttaacaaatgcaaaactatctatgagaagctagccagtgctttcacagaggagcaggctgtgctgtataaccaacgtgtggaagagatttcacccaacatccgctattgtgcatataatattggggaccagtcagccatcaatgaactcatgcagatgagattgaggtctgggggcactgagggtctcttggctgaaaaattggaggctttgatcactcagactcgagccaaacaggcagctaccatgagtgaagtggagtggagagggagaacggttccagtgaagattgacaaagtgcgcattttcttattaggactggctgataacgaagcagctattgtccaggctgaaagcgaagaaactaaggagcgcctgtttgaatcaatgctcagcgagtgtcgggacgccatccaggtggttcgggaggagctcaagccagatcagaaacagagagattatatccttgaaggagagccagggaaggtgtctaatcttcaatacttgcatagctacctgacttacatcaagctatcaacggcaatcaagcgtaatgagaacatggccaaaggtctgcagagggctctgctgcagcagcagccagaggatgacagcaagcgctcaccccggccccaggacctgatccgactctatgacatcatcttacagaatctggtggaattgctccagcttcctggtttagaggaagacaaagccttccagaaagagataggcctcaagactctggtgttcaaagcttacaggtgttttttcattgctcagtcctatgtgctggtgaagaagtggagcgaagcccttgtcctgtatgacagagtcctgaaatatgcaaatgaagtaaattctgatgctggcgccttcaagaacagcctaaaggacctgcctgatgtgcaagagctcatcactcaagtgcggtcagagaagtgctccctgcaggccgcagccatccttgatgcaaacgacgctcatcaaacagagacctcctcctcccaagtcaaggacaataagcctctggttgaacggtttgagacattctgcctggacccttcccttgtcaccaagcaagccaaccttgtgcacttcccaccaggcttccagcccattccctgcaagcctttgttctttgacctggccctcaaccatgtggctttcccaccccttgaggacaagttggaacagaagaccaagagtggcctcactggatacatcaagggcatctttggattcaggagctaaccaggctcttcctcgggccggacgttttggcataccttgggatcctctagaatcagctag

SEQ ID NO: 295078 - DNA, 2287 bp, Homo sapiens
ggcatatggttctacccggcccacttggcagcacttttatccacgaggtacaggggctactgttcccgtagacaaagacgtcttcgaaaaacactcaacttcaagatgggtaacagacacaaattcacagggaagaaagtgactgaagagcttctgaccgataatagatacttgcttctggttctgatggatgctgaaagagcctggagctacgccatgcagctgaaacaggaagccaacactgaaccccgaaaacggtttcacttgttatctcgcctacgcaaagccgtgaagcatgcagaggaattggaacgcttgtgtgagagcaatcgcgtggatgccaagaccaaattagaggctcaggcttacacagcttacctctcaggaatgctacgttttgaacatcaagaatggaaagctgccattgaggcttttaacaaatgcaaaactatctatgagaagctagccagtgctttcacagaggagcaggctgtgctgtataaccaacgtgtggaagagatttcacccaacatccgctattgtgcatataatattggggaccagtcagccatcaatgaactcatgcagatgagattgaggtctgggggcactgagggtctcttggctgaaaaattggaggctttgatcactcagactcgagccaaacaggcagctaccatgagtgaagtggagtggagagggagaacggttccagtgaagattgacaaagtgcgcattttcttattaggactggctgataacgaagcagctattgtccaggctgaaagcgaagaaactaaggagcgcctgtttgaatcaatgctcagcgagtgtcgggacgccatccaggtggttcgggaggagctcaagccagatcagaaacagagagattatatccttgaaggagagccagggaaggtgtctaatcttcaatacttgcatagctacctgacttacatcaagctatcaacggcaatcaagcgtaatgagaacatggccaaaggtctgcagagggctctgctgcagcagcagccagaggatgacagcaagcgctcaccccggccccaggacctgatccgactctatgacatcatcttacagaatctggtggaattgctccagcttcctggtttagaggaagacaaagccttccagaaagagataggcctcaagactctggtgttcaaagcttacaggtgttttttcattgctcagtcctatgtgctggtgaagaagtggagcgaagcccttgtcctgtatgacagagtcctgaaatatgcaaatgaagtaaattctgatgctggcgccttcaagaacagcctaaaggacctgcctgatgtgcaagagctcatcactcaagtgcggtcagagaagtgctccctgcaggccgcagccatccttgatgcaaacgacgctcatcaaacagagacctcctcctcccaagtcaaggacaataagcctctggttgaacggtttgagacattctgcctggacccttcccttgtcaccaagcaagccaaccttgtgcacttcccaccaggcttccagcccattccctgcaagcctttgttctttgacctggccctcaaccatgtggctttcccaccccttgaggacaagttggaacagaagaccaagagtggcctcactggatacatcaagggcatctttggattcaggagctaaccaggctcttcctcgggggcgggggagattctgactcttaatctgtattgtgagaaaatcccagcaagttccatgatattaaatccaggtctgcattggcccggggcaagagtttaacatcttcggccctgcattcctacatcttgtgtctgtacacgttcttaagcagcgtgtcaggagagcaccctgttgtcttctggtaaatgtgtgcagggtcatcctgtctcctgtacctcctgggaaaggggccgctgctgtctggtgccctgtgagctgtgattgattgcctttggtcagtaatgcgttcaggagtccacaccaggcacagatggggccttgaaacgctttgtcatgcttcttcagtaccatggatttgaaatgaactcatccttgctgtgagcatccaggagcccttgagaagtttatctatgactatgaaactggcaacgtcaccccagaattacggtcagccttattccccttcacctcccagtgaacgctaagaagtttcagacaagcagagagctctatttttagaagaaatatgttacactcagaaatgatgaaaccaaatcttatattaaaaggcaaagatgacgga

SEQ ID NO: 295079 - DNA, 2125 bp, Homo sapiens
ggcgcgctccagcacatggcgccctgctgcagcaagggccgacggcggcggagtccgccgctatcccatcagcccggccaggcaggtccagctctcacccgcccaggtcgtcccgcctcccctatcccgtcttgctctgcggcgcaggggcaagatggctgctgagaagcaggtcccaggcggcggcggcggcggcggcagtggcggcggcggtggcagtggcggcggcggtagcggcggtggacgtggtgccggaggggaagaaaataaagaaaacgaacgcccttcggccggatcgaaggcaaacaaagaatttggggatagcctgagtttggagattcttcagattattaaggaatcccagcagcagcatggtttacggcatggagattttcagaggtacaggggctactgttcccgtagacaaagacgtcttcgaaaaacactcaacttcaagatgggtaacagacacaaattcacagggaagaaagtgactgaagagcttctgaccgataatagatacttgcttctggttctgatggatgctgaaagagcctggagctacgccatgcagctgaaacaggaagccaacactgaaccccgaaaacggtttcacttgttatctcgcctacgcaaagccgtgaagcatgcagaggaattggaacgcttgtgtgagagcaatcgcgtggatgccaagaccaaattagaggctcaggcttacacagcttacctctcaggaatgctacgttttgaacatcaagaatggaaagctgccattgaggcttttaacaaatgcaaaactatctatgagaagctagccagtgctttcacagaggagcaggctgtgctgtataaccaacgtgtggaagagatttcacccaacatccgctattgtgcatataatattggggaccagtcagccatcaatgaactcatgcagatgagattgaggtctgggggcactgagggtctcttggctgaaaaattggaggctttgatcactcagactcgagccaaacaggcagctaccatgagtgaagtggagtggagagggagaacggttccagtgaagattgacaaagtgcgcattttcttattaggactggctgataacgaagcagctattgtccaggctgaaagcgaagaaactaaggagcgcctgtttgaatcaatgctcagcgagtgtcgggacgccatccaggtggttcgggaggagctcaagccagatcagaaacagagagattatatccttgaaggagagccagggaaggtgtctaatcttcaatacttgcatagctacctgacttacatcaagctatcaacggcaatcaagcgtaatgagaacatggccaaaggtctgcagagggctctgctgcagcagcagccagaggatgacagcaagcgctcaccccggccccaggacctgatccgactctatgacatcatcttacagaatctggtggaattgctccagcttcctggtttagaggaagacaaagccttccagaaagagataggcctcaagactctggtgttcaaagcttacaggtgttttttcattgctcagtcctatgtgctggtgaagaagtggagcgaagcccttgtcctgtatgacagagtcctgaaatatgcaaatgaagtaaattctgatgctggcgccttcaagaacagcctaaaggacctgcctgatgtgcaagagctcatcactcaagtgcggtcagagaagtgctccctgcaggccgcagccatccttgatgcaaacgacgctcatcaaacagagacctcctcctcccaagtcaaggacaataagcctttggtcagtaatgcgttcaggagtccacaccaggcacagatggggccttgaaacgctttgtcatgcttcttcagtaccatggatttgaaatgaactcatccttgctgtgagcatccaggagcccttgagaagtttatctatgactatgaaactggcaacgtcaccccagaattacggtcagccttattccccttcacctcccagtgaacgctaagaagtttcagacaagcagagagctctatttttagaagaaatatgttacactcagaaatgatgaaaccaaatcttatattaaaaggcaaagatgacgga

SEQ ID NO: 295080 - DNA, 1891 bp, Homo sapiens
ggcgcgctccagcacatggcgccctgctgcagcaagggccgacggcggcggagtccgccgctatcccatcagcccggccaggcaggtccagctctcacccgcccaggtcgtcccgcctcccctatcccgtcttgctctgcggcgcaggggcaagatggctgctgagaagcaggtcccaggcggcggcggcggcggcggcagtggcggcggcggtggcagtggcggcggcggtagcggcggtggacgtggtgccggaggggaagaaaataaagaaaacgaacgcccttcggccggatcgaaggcaaacaaagaatttggggatagcctgagtttggagattcttcagattattaaggaatcccagcagcagcatggtttacggcatggagattttcagaggtacaggggctactgttcccgtagacaaagacgtcttcgaaaaacactcaacttcaagatgggtaacagacacaaattcacagggaagaaagtgactgaagagcttctgaccgataatagatacttgcttctggttctgatggatgctgaaagagcctggagctacgccatgcagctgaaacaggaagccaacactgaaccccgaaaacggtttcacttgttatctcgcctacgcaaagccgtgaagcatgcagaggaattggaacgcttgtgtgagagcaatcgcgtggatgccaagaccaaattagaggctcaggcttacacagcttacctctcaggaatgctacgttttgaacatcaagaatggaaagctgccattgaggcttttaacaaatgcaaaactatctatgagaagctagccagtgctttcacagaggagcaggctgtgctgtataaccaacgtgtggaagagatttcacccaacatccgctattgtgcatataatattggggaccagtcagccatcaatgaactcatgcagatgagattgaggtctgggggcactgagggtctcttggctgaaaaattggaggctttgatcactcagactcgagccaaacaggcagctaccatgagtgaagtggagtggagagggagaacggttccagtgaagattgacaaagtgcgcattttcttattaggactggctgataacgaagcagctattgtccaggctgaaagcgaagaaactaaggagcgcctgtttgaatcaatgctcagcgagtgtcgggacgccatccaggtggttcgggaggagctcaagccagatcagaaacagagagattatatccttgaaggagagccagggaaggtgtctaatcttcaatacttgcatagctacctgacttacatcaagctatcaacggcaatcaagcgtaatgagaacatggccaaaggtctgcagagggctctgctgcagcagcagccagaggatgacagcaagcgctcaccccggccccaggacctgatccgactctatgacatcatcttacagaatctggtggaattgctccagcttcctggtttagaggaagacaaagccttccagaaagagataggcctcaagactctggtgttcaaagcttacaggtgttttttcattgctcagtcctatgtgctggtgaagaagtggagcgaagcccttgtcctgtatgacagaatggggccttgaaacgctttgtcatgcttcttcagtaccatggatttgaaatgaactcatccttgctgtgagcatccaggagcccttgagaagtttatctatgactatgaaactggcaacgtcaccccagaattacggtcagccttattccccttcacctcccagtgaacgctaagaagtttcagacaagcagagagctctatttttagaagaaatatgttacactcagaaatgatgaaaccaaatcttatattaaaaggcaaagatgacgga

SEQ ID NO: 295081 - DNA, 2085 bp, Homo sapiens
catcttcccccaccagaggggtgcatttgttacaattgatggccctttatagacacaccatcatctcccaaagtccatagtttacatcagggttcacgcttgatgttgtacattctatgggtttggacaaatgtttcatgatgtgtatttaccattatataccatatggagtattttcattgccccagtcaatttcattctttataaaagacttgtcttcagagaacagattgtgctgcagattcattgaagtagcatgtggagggggaagagctctttaagtctgagttgaatctagtgattctcaagaaaacagaccagacccttgaagattttcctgtctttctctcttaggggaccagtcagccatcaatgaactcatgcagatgagattgaggtctgggggcactgagggtctcttggctgaaaaattggaggctttgatcactcagactcgagccaaacaggcagctaccatgagtgaagtggagtggagagggagaacggttccagtgaagattgacaaagtgcgcattttcttattaggactggctgataacgaagcagctattgtccaggctgaaagcgaagaaactaaggagcgcctgtttgaatcaatgctcagcgagtgtcgggacgccatccaggtggttcgggaggagctcaagccagatcagaaacagagagattatatccttgaaggagagccagggaaggtgtctaatcttcaatacttgcatagctacctgacttacatcaagctatcaacggcaatcaagcgtaatgagaacatggccaaaggtctgcagagggctctgctgcagcagcagccagaggatgacagcaagcgctcaccccggccccaggacctgatccgactctatgacatcatcttacagaatctggtggaattgctccagcttcctggtttagaggaagacaaagccttccagaaagagataggcctcaagactctggtgttcaaagcttacaggtgttttttcattgctcagtcctatgtgctggtgaagaagtggagcgaagcccttgtcctgtatgacagagtcctgaaatatgcaaatgaagtaaattctgatgctggcgccttcaagaacagcctaaaggacctgcctgatgtgcaagagctcatcactcaagtgcggtcagagaagtgctccctgcaggccgcagccatccttgatgcaaacgacgctcatcaaacagagacctcctcctcccaagtcaaggacaataagcctctggttgaacggtttgagacattctgcctggacccttcccttgtcaccaagcaagccaaccttgtgcacttcccaccaggcttccagcccattccctgcaagcctttgttctttgacctggccctcaaccatgtggctttcccaccccttgaggacaagttggaacagaagaccaagagtggcctcactggatacatcaagggcatctttggattcaggagctaaccaggctcttcctcgggggcgggggagattctgactcttaatctgtattgtgagaaaatcccagcaagttccatgatattaaatccaggtctgcattggcccggggcaagagtttaacatcttcggccctgcattcctacatcttgtgtctgtacacgttcttaagcagcgtgtcaggagagcaccctgttgtcttctggtaaatgtgtgcagggtcatcctgtctcctgtacctcctgggaaaggggccgctgctgtctggtgccctgtgagctgtgattgattgcctttggtcagtaatgcgttcaggagtccacaccaggcacagatggggccttgaaacgctttgtcatgcttcttcagtaccatggatttgaaatgaactcatccttgctgtgagcatccaggagcccttgagaagtttatctatgactatgaaactggcaacgtcaccccagaattacggtcagccttattccccttcacctcccagtgaacgctaagaagtttcagacaagcagagagctctatttttagaagaaatatgttacactcagaaatgatgaaaccaaatcttatattaaaaggcaaagatgacgga

SEQ ID NO: 295082 - DNA, 1926 bp, Homo sapiens
  misc_feature (56)..(56): n is a, c, g, or t
  misc_feature (97)..(97): n is a, c, g, or t
  misc_feature (103)..(103): n is a, c, g, or t
  misc_feature (107)..(107): n is a, c, g, or t
  misc_feature (175)..(175): n is a, c, g, or t
tctaacacatctcatctccttccaacatctcatccgcgccttcaacactcaccgcncttccaacatctcatcgctccttccaacatcgcatcctccntccaanatcncatcccgccttccaacatctcatgtcccttccaacatctcatctctccttccaacatctcatcccctnccttccaacatctcatccccctcccaacatctcatgcctccttccatggccccttccaacatctcatgcctcctcccaacatctcatggccgaaaaattggaggctttgatcactcagactcgagccaaacaggcagctaccatgagtgaagtggagtggagagggagaacggttccagtgaagattgacaaagtgcgcattttcttattaggactggctgataacgaagcagctattgtccaggctgaaagcgaagaaactaaggagcgcctgtttgaatcaatgctcagcgagtgtcgggacgccatccaggtggttcgggaggagctcaagccagatcagaaacagagagattatatccttgaaggagagccagggaaggtgtctaatcttcaatacttgcatagctacctgacttacatcaagctatcaacggcaatcaagcgtaatgagaacatggccaaaggtctgcagagggctctgctgcagcagcagccagaggatgacagcaagcgctcaccccggccccaggacctgatccgactctatgacatcatcttacagaatctggtggaattgctccagcttcctggtttagaggaagacaaagccttccagaaagagataggcctcaagactctggtgttcaaagcttacaggtgttttttcattgctcagtcctatgtgctggtgaagaagtggagcgaagcccttgtcctgtatgacagagtcctgaaatatgcaaatgaagtaaattctgatgctggcgccttcaagaacagcctaaaggacctgcctgatgtgcaagagctcatcactcaagtgcggtcagagaagtgctccctgcaggccgcagccatccttgatgcaaacgacgctcatcaaacagagacctcctcctcccaagtcaaggacaataagcctctggttgaacggtttgagacattctgcctggacccttcccttgtcaccaagcaagccaaccttgtgcacttcccaccaggcttccagcccattccctgcaagcctttgttctttgacctggccctcaaccatgtggctttcccaccccttgaggacaagttggaacagaagaccaagagtggcctcactggatacatcaagggcatctttggattcaggagctaaccaggctcttcctcgggggcgggggagattctgactcttaatctgtattgtgagaaaatcccagcaagttccatgatattaaatccaggtctgcattggcccggggcaagagtttaacatcttcggccctgcattcctacatcttgtgtctgtacacgttcttaagcagcgtgtcaggagagcaccctgttgtcttctggtaaatgtgtgcagggtcatcctgtctcctgtacctcctgggaaaggggccgctgctgtctggtgccctgtgagctgtgattgattgcctttggtcagtaatgcgttcaggagtccacaccaggcacagatggggccttgaaacgctttgtcatgcttcttcagtaccatggatttgaaatgaactcatccttgctgtgagcatccaggagcccttgagaagtttatctatgactatgaaactggcaacgtcaccccagaattacggtcagccttattccccttcacctcccagtgaacgctaagaagtttcagacaagcagagagctctatttttagaagaaatatgttacactcagaaatgatgaaaccaaatcttatattaaaaggcaaagatgacgga

SEQ ID NO: 295083 - DNA, 1228 bp, Homo sapiens
tagttacttctcgtgtctgagaaccctctgcgcgtcttacagaatctggtggaattgctccagcttcctggtttagaggaagacaaagccttccagaaagagataggcctcaagactctggtgttcaaagcttacaggtgttttttcattgctcagtcctatgtgctggtgaagaagtggagcgaagcccttgtcctgtatgacagagtcctgaaatatgcaaatgaagtaaattctgatgctggcgccttcaagaacagcctaaaggacctgcctgatgtgcaagagctcatcactcaagtgcggtcagagaagtgctccctgcaggccgcagccatccttgatgcaaacgacgctcatcaaacagagacctcctcctcccaagtcaaggacaataagcctctggttgaacggtttgagacattctgcctggacccttcccttgtcaccaagcaagccaaccttgtgcacttcccaccaggcttccagcccattccctgcaagcctttgttctttgacctggccctcaaccatgtggctttcccaccccttgaggacaagttggaacagaagaccaagagtggcctcactggatacatcaagggcatctttggattcaggagctaaccaggctcttcctcgggggcgggggagattctgactcttaatctgtattgtgagaaaatcccagcaagttccatgatattaaatccaggtctgcattggcccggggcaagagtttaacatcttcggccctgcattcctacatcttgtgtctgtacacgttcttaagcagcgtgtcaggagagcaccctgttgtcttctggtaaatgtgtgcagggtcatcctgtctcctgtacctcctgggaaaggggccgctgctgtctggtgccctgtgagctgtgattgattgcctttggtcagtaatgcgttcaggagtccacaccaggcacagatggggccttgaaacgctttgtcatgcttcttcagtaccatggatttgaaatgaactcatccttgctgtgagcatccaggagcccttgagaagtttatctatgactatgaaactggcaacgtcaccccagaattacggtcagccttattccccttcacctcccagtgaacgctaagaagtttcagacaagcagagagctctatttttagaagaaatatgttacactcagaaatgatgaaaccaaatcttatattaaaaggcaaagatgacgga

SEQ ID NO: 295084 - DNA, 431 bp, Homo sapiens
tttccaggcattattacttaagccgtggcatagcttttcccatttgaaacaggctagtgttttgctttgttttgttttgttctaatagtgagaaccgtttagaaagtctaaagtcctgtgaaaataccagtggggtcggttaactcgggttagcttggtgtgcttctctgacctggccctggctcgggagtacacgttttctgaatcttacaggacctgcctgatgtgcaagagctcatcactcaagtgcggtcagagaagtgctccctgcaggccgcagccatccttggtgagccccctgcctggcctttgtatccccagacttcccttcctgccactccccttctctgtcacaccccatactactgttttaaggttgaaagggttgtcttggttcatctgtaagatgttcctggcctttacttgtgcca

SEQ ID NO: 295085 - DNA, 1613 bp, Homo sapiens
gctggtacggtcggagtttaggccccaaccggatcctggacaggcaccccggcttggcgctgtctctccccctcggctcggagaggcccttcggcctgagggagcctcgccgcccgtccccggcacacgcgcagccccggcctctcggcctctgccggagaaacaggtgaagggggtgcagggtggggccgttggggaggcctggggacccgggggctccgcagcggcagggggcctctgggaccttggggatgttgtgatggacgctgcagtggggccgggagagatgaagagacgcggagggtcgccctgagggaagactcttcgggatgacaggagcgggcctcggaagggactcggggcgctggagggaagtttcgttcttcggagaaacagaacgcgctcgagggggcaccgtggggcgagggcgcactcggttgcggcggcaggagtgagggacagtcccccgatttcctgctccctggggccctggggacgttccggccaccggagcgactgtcacgccgacggggatcaccggcgcgagtggggggtcggaaagcgcctcctccccgcccggtcggcggctcccgctgagccacttcctccgcttgccctgttcccgctccttcaggagccagctgtgcccttttggaggcaggaataggtgtgtctgtcgcctgcagccttacgggctggctggtcgtgggtaggctttattgcataagaatcaagtttcctgtagggaaattgacagaccggtactctttctaaattccctcgcatctttttctaggttaaattatgctccccccacgtccccgccttgtaaaaaagagaaaaaaagacaaaataaaatccccatcaacccgtcaagccagctctagagagagaaataaacctcttgacattgtccttttccaaatacctggtaaagtcggccagaagataaataattgagccattgcatttactggattgtggtgttgcttaattgcataggacggaatgaaccaattgagagtgggagttttctgtctcagagccaagatcttgggtaaatgcagaggagagggaaacaaagacaggctggccttgaaaaaaccatgtgtgcaaactttacatgcatttggggggtgtggttgcactgaagttaacaagattcaaaccgtcgcccaagttggtatttccatgtttggtacacatcactctgtgccatatcaggtcgttgttaagtgtggtgacaaaatcagtggttagtcatttttttaattaaaaatgtgtatagtgtgtacctgctggtcttactgtatgtgcaactaaaggtttacatagtctgtgtatgggttgtaaatttttggctggctgtgctgataaagcattgggcttgaataaagcaaagcagaaaatcatctcaatcttttatatgtggatttagactgtgttatgacttggttcagccagttttctatcttattttatattaaatatgtctgtgttctctgagtcagcacatttatttccttattacatgttccagacaggagtgctagcccagtttttgttcagtttgcacagtgggatggggaaacaagtctggaatttaaaaaaaa

SEQ ID NO: 295086 - DNA, 290 bp, Homo sapiens
cctgaggatttgggtgatgcactgcacccctaggaagggaagggctgggatggcagtagacttagctttcccattactcttttctccaggaaaacatggctggcaagggcttctccttctgggtctggctggacaatatcattgaccttgtgaaaaagtacatcctggccctttggaacgaagggtaggttggacagagtgtgcacagatgtaaccaagtccctgctctcagcaagccagtggcaggggatgatgccctgttagcaattccacaggggtcctcctccttg

SEQ ID NO: 295087 - DNA, 281 bp, Homo sapiens
gaataatggtgaagcgcgtgaagtaacaggagggcagtttgagtccctcacctttgacatggagttgacctcggagtgcgctacctcccccatgtgaggagctgagaacggaagctgcagaaagatacgactgaggcgcctacctgcattctgccacccctcacacagccaaaccccagatcatctgaaactactaactttgtggttccagattttttttaatctcctacttctgctatctttgagcaatctgggcacttttaaaaatagagaaatgagtg

SEQ ID NO: 295088 - DNA, 443 bp, Homo sapiens
ctgttacagaaatagtaacgacctccccttcgccccccgccgacagagagccttcacccaggctctgaagcctttgttccgttgtttcctagaataaatgctttccttgatgaatacattagttttaaggtgccacagttcagtccacatctccatggtctgctgctgatttttattctctttctctcctacttatagagcaggtatcttgagaagccaatggagattgcccggattgtggcccggtgcctgtgggaagaatcacgccttctacagactgcagccactgcggcccaggtgagacctgagacaaaacaaatccctggtctgggaggaatggaaaatcaaacaactttataatgagataaattattagatctactaaaaaagaaggaaaagaaattaaatagatcaataatcataaaaatacattgaaaaactct

SEQ ID NO: 295089 - DNA, 260 bp, Homo sapiens
cgattgtgaaataggtaggtttgcaaccttgcatgaagagcacccattgcatttctgtcatctttcagaaagcaccggtatctgtgtccaagggcctatacatcccggaaatttaacattctgggcacaaacacaaaagtgatgaacatggaagaatccaacaacggcagcctctctgcagaattcaaacacttggtatgtgggaggagctccccttcacaaagggcctctggctgccggagagggctagggagagcctc

SEQ ID NO: 295090 - DNA, 3727 bp, Homo sapiens
gtaattcagcggtttccggagctgcggcggcgcagactgggagggggagccgggggttccgacgtcgcagccgagggaacaagccccaaccggatcctggacaggcaccccggcttggcgctgtctctccccctcggctcggagaggcccttcggcctgagggagcctcgccgcccgtccccggcacacgcgcagccccggcctctcggcctctgccggagaaacaggatggcccaatggaatcagctacagcagcttgacacacggtacctggagcagctccatcagctctacagtgacagcttcccaatggagctgcggcagtttctggccccttggattgagagtcaagattgggcatatgcggccagcaaagaatcacatgccactttggtgtttcataatctcctgggagagattgaccagcagtatagccgcttcctgcaagagtcgaatgttctctatcagcacaatctacgaagaatcaagcagtttcttcagagcaggtatcttgagaagccaatggagattgcccggattgtggcccggtgcctgtgggaagaatcacgccttctacagactgcagccactgcggcccagcaagggggccaggccaaccaccccacagcagccgtggtgacggagaagcagcagatgctggagcagcaccttcaggatgtccggaagagagtgcaggatctagaacagaaaatgaaagtggtagagaatctccaggatgactttgatttcaactataaaaccctcaagagtcaaggagacatgcaagatctgaatggaaacaaccagtcagtgaccaggcagaagatgcagcagctggaacagatgctcactgcgctggaccagatgcggagaagcatcgtgagtgagctggcggggcttttgtcagcgatggagtacgtgcagaaaactctcacggacgaggagctggctgactggaagaggcggcaacagattgcctgcattggaggcccgcccaacatctgcctagatcggctagaaaactggataacgtcattagcagaatctcaacttcagacccgtcaacaaattaagaaactggaggagttgcagcaaaaagtttcctacaaaggggaccccattgtacagcaccggccgatgctggaggagagaatcgtggagctgtttagaaacttaatgaaaagtgcctttgtggtggagcggcagccctgcatgcccatgcatcctgaccggcccctcgtcatcaagaccggcgtccagttcactactaaagtcaggttgctggtcaaattccctgagttgaattatcagcttaaaattaaagtgtgcattgacaaagactctggggacgttgcagctctcagaggatcccggaaatttaacattctgggcacaaacacaaaagtgatgaacatggaagaatccaacaacggcagcctctctgcagaattcaaacacttgaccctgagggagcagagatgtgggaatgggggccgagccaattgtgatgcttccctgattgtgactgaggagctgcacctgatcacctttgagaccgaggtgtatcaccaaggcctcaagattgacctagagacccactccttgccagttgtggtgatctccaacatctgtcagatgccaaatgcctgggcgtccatcctgtggtacaacatgctgaccaacaatcccaagaatgtaaacttttttaccaagcccccaattggaacctgggatcaagtggccgaggtcctgagctggcagttctcctccaccaccaagcgaggactgagcatcgagcagctgactacactggcagagaaactcttgggacctggtgtgaattattcagggtgtcagatcacatgggctaaattttgcaaagaaaacatggctggcaagggcttctccttctgggtctggctggacaatatcattgaccttgtgaaaaagtacatcctggccctttggaacgaagggtacatcatgggctttatcagtaaggagcgggagcgggccatcttgagcactaagcctccaggcaccttcctgctaagattcagtgaaagcagcaaagaaggaggcgtcactttcacttgggtggagaaggacatcagcggtaagacccagatccagtccgtggaaccatacacaaagcagcagctgaacaacatgtcatttgctgaaatcatcatgggctataagatcatggatgctaccaatatcctggtgtctccactggtctatctctatcctgacattcccaaggaggaggcattcggaaagtattgtcggccagagagccaggagcatcctgaagctgacccaggtagcgctgccccatacctgaagaccaagtttatctgtgtgacaccaacgacctgcagcaataccattgacctgccgatgtccccccgcactttagattcattgatgcagtttggaaataatggtgaaggtgctgaaccctcagcaggagggcagtttgagtccctcacctttgacatggagttgacctcggagtgcgctacctcccccatgtgaggagctgagaacggaagctgcagaaagatacgactgaggcgcctacctgcattctgccacccctcacacagccaaaccccagatcatctgaaactactaactttgtggttccagattttttttaatctcctacttctgctatctttgagcaatctgggcacttttaaaaatagagaaatgagtgaatgtgggtgatctgcttttatctaaatgcaaataaggatgtgttctctgagacccatgatcaggggatgtggcggggggtggctagagggagaaaaaggaaatgtcttgtgttgttttgttcccctgccctcctttctcagcagctttttgttattgttgttgttgttcttagacaagtgcctcctggtgcctgcggcatccttctgcctgtttctgtaagcaaatgccacaggccacctatagctacatactcctggcattgcactttttaaccttgctgacatccaaatagaagataggactatctaagccctaggtttctttttaaattaagaaataataacaattaaagggcaaaaaacactgtatcagcatagcctttctgtatttaagaaacttaagcagccgggcatggtggctcacgcctgtaatcccagcactttgggaggccgaggcggatcataaggtcaggagatcaagaccatcctggctaacacggtgaaaccccgtctctactaaaagtacaaaaaattagctgggtgtggtggtgggcgcctgtagtcccagctactcgggaggctgaggcaggagaatcgcttgaacctgagaggcggaggttgcagtgagccaaaattgcaccactgcacactgcactccatcctgggcgacagtctgagactctgtctcaaaaaaaaaaaaaaaaaaaagaaacttcagttaacagcctccttggtgctttaagcattcagcttccttcaggctggtaatttatataatccctgaaacgggcttcaggtcaaacccttaagacatctgaagctgcaacctggcctttggtgttgaaataggaaggtttaaggagaatctaagcattttagacttttttttataaatagacttattttcctttgtaatgtattggccttttagtgagtaaggctgggcagagggtgcttacaaccttgactccctttctccctggacttgatctgctgtttca

SEQ ID NO: 295091 - DNA, 3681 bp, Homo sapiens
gtaattcagcggtttccggagctgcggcggcgcagactgggagggggagccgggggttccgacgtcgcagccgagggaacaagccccaaccggatcctggacaggcaccccggcttggcgctgtctctccccctcggctcggagaggcccttcggcctgagggagcctcgccgcccgtccccggcacacgcgcagccccggcctctcggcctctgccggagaaacaggatggcccaatggaatcagctacagcagcttgacacacggtacctggagcagctccatcagctctacagtgacagcttcccaatggagctgcggcagtttctggccccttggattgagagtcaagattgggcatatgcggccagcaaagaatcacatgccactttggtgtttcataatctcctgggagagattgaccagcagtatagccgcttcctgcaagagtcgaatgttctctatcagcacaatctacgaagaatcaagcagtttcttcagagcaggtatcttgagaagccaatggagattgcccggattgtggcccggtgcctgtgggaagaatcacgccttctacagactgcagccactgcggcccagcaagggggccaggccaaccaccccacagcagccgtggtgacggagaagcagcagatgctggagcagcaccttcaggatgtccggaagagagtgcaggatctagaacagaaaatgaaagtggtagagaatctccaggatgactttgatttcaactataaaaccctcaagagtcaaggagacatgcaagatctgaatggaaacaaccagtcagtgaccaggcagaagatgcagcagctggaacagatgctcactgcgctggaccagatgcggagaagcatcgtgagtgagctggcggggcttttgtcagcgatggagtacgtgcagaaaactctcacggacgaggagctggctgactggaagaggcggcaacagattgcctgcattggaggcccgcccaacatctgcctagatcggctagaaaactggataacgtcattagcagaatctcaacttcagacccgtcaacaaattaagaaactggaggagttgcagcaaaaagtttcctacaaaggggaccccattgtacagcaccggccgatgctggaggagagaatcgtggagctgtttagaaacttaatgaaaagtgcctttgtggtggagcggcagccctgcatgcccatgcatcctgaccggcccctcgtcatcaagaccggcgtccagttcactactaaagtcaggttgctggtcaaattccctgagttgaattatcagcttaaaattaaagtgtgcattgacaaagactctggggacgttgcagctctcagaggatcccggaaatttaacattctgggcacaaacacaaaagtgatgaacatggaagaatccaacaacggcagcctctctgcagaattcaaacacttgaccctgagggagcagagatgtgggaatgggggccgagccaattgtgatgcttccctgattgtgactgaggagctgcacctgatcacctttgagaccgaggtgtatcaccaaggcctcaagattgacctagagacccactccttgccagttgtggtgatctccaacatctgtcagatgccaaatgcctgggcgtccatcctgtggtacaacatgctgaccaacaatcccaagaatgtaaacttttttaccaagcccccaattggaacctgggatcaagtggccgaggtcctgagctggcagttctcctccaccaccaagcgaggactgagcatcgagcagctgactacactggcagagaaactcttgggacctggtgtgaattattcagggtgtcagatcacatgggctaaattttgcaaagaaaacatggctggcaagggcttctccttctgggtctggctggacaatatcattgaccttgtgaaaaagtacatcctggccctttggaacgaagggtacatcatgggctttatcagtaaggagcgggagcgggccatcttgagcactaagcctccaggcaccttcctgctaagattcagtgaaagcagcaaagaaggaggcgtcactttcacttgggtggagaaggacatcagcggtaagacccagatccagtccgtggaaccatacacaaagcagcagctgaacaacatgtcatttgctgaaatcatcatgggctataagatcatggatgctaccaatatcctggtgtctccactggtctatctctatcctgacattcccaaggaggaggcattcggaaagtattgtcggccagagagccaggagcatcctgaagctgacccaggtagcgctgccccatacctgaagaccaagtttatctgtgtgacaccaacgacctgcagcaataccattgacctgccgatgtccccccgcactttagattcattgatgcagtttggaaataatggtgaaggtgctgaaccctcagcaggagggcagtttgagtccctcacctttgacatggagttgacctcggagtgcgctacctcccccatgtgaggagctgagaacggaagctgcagaaagatacgactgaggcgcctacctgcattctgccacccctcacacagccaaaccccagatcatctgaaactactaactttgtggttccagattttttttaatctcctacttctgctatctttgagcaatctgggcacttttaaaaatagagaaatgagtgaatgtgggtgatctgcttttatctaaatgcaaataaggatgtgttctctgagacccatgatcaggggatgtggcggggggtggctagagggagaaaaaggaaatgtcttgtgttgttttgttcccctgccctcctttctcagcagctttttgttattgttgttgttgttcttagacaagtgcctcctggtgcctgcggcatccttctgcctgtttctgtaagcaaatgccacaggccacctatagctacatactcctggcattgcactttttaaccttgctgacatccaaatagaagataggactatctaagccctaggtttctttttaaattaagaaataataacaattaaagggcaaaaaacactgtatcagcatagcctttctgtatttaagaaacttaagcagccgggcatggtggctcacgcctgtaatcccagcactttgggaggccgaggcggatcataaggtcaggagatcaagaccatcctggctaacacggtgaaaccccgtctctactaaaagtacaaaaaattagctgggtgtggtggtgggcgcctgtagtcccagctactcgggaggctgaggcaggagaatcgcttgaacctgagaggcggaggttgcagtgagccaaaattgcaccactgcacactgcactccatcctgggcgacagtctgagactctgtctcaaaaaaaaaaaaaaaaaaaagaaaaacccggggggctcaaggggggggggggaaaaaggggaatgaaacggggccctggggccaaaagggggttcccgggacccaagcttttttgtgccacacagggggaaaactcggcgggcgtcccccctaaaaggagaggcggaaaataaattcgagaataacgccgggtaaccggggcttaagactcgcgcacaaaagaagaaagagagacgacaaaacaagaagacaagaaagaacacgggt

SEQ ID NO: 295092 - DNA, 3749 bp, Homo sapiens
gtaattcagcggtttccggagctgcggcggcgcagactgggagggggagccgggggttccgacgtcgcagccgagggaacaagccccaaccggatcctggacaggcaccccggcttggcgctgtctctccccctcggctcggagaggcccttcggcctgagggagcctcgccgcccgtccccggcacacgcgcagccccggcctctcggcctctgccggagaaacagttgggacccctgattttagcaggatggcccaatggaatcagctacagcagcttgacacacggtacctggagcagctccatcagctctacagtgacagcttcccaatggagctgcggcagtttctggccccttggattgagagtcaagattgggcatatgcggccagcaaagaatcacatgccactttggtgtttcataatctcctgggagagattgaccagcagtatagccgcttcctgcaagagtcgaatgttctctatcagcacaatctacgaagaatcaagcagtttcttcagagcaggtatcttgagaagccaatggagattgcccggattgtggcccggtgcctgtgggaagaatcacgccttctacagactgcagccactgcggcccagcaagggggccaggccaaccaccccacagcagccgtggtgacggagaagcagcagatgctggagcagcaccttcaggatgtccggaagagagtgcaggatctagaacagaaaatgaaagtggtagagaatctccaggatgactttgatttcaactataaaaccctcaagagtcaaggagacatgcaagatctgaatggaaacaaccagtcagtgaccaggcagaagatgcagcagctggaacagatgctcactgcgctggaccagatgcggagaagcatcgtgagtgagctggcggggcttttgtcagcgatggagtacgtgcagaaaactctcacggacgaggagctggctgactggaagaggcggcaacagattgcctgcattggaggcccgcccaacatctgcctagatcggctagaaaactggataacgtcattagcagaatctcaacttcagacccgtcaacaaattaagaaactggaggagttgcagcaaaaagtttcctacaaaggggaccccattgtacagcaccggccgatgctggaggagagaatcgtggagctgtttagaaacttaatgaaaagtgcctttgtggtggagcggcagccctgcatgcccatgcatcctgaccggcccctcgtcatcaagaccggcgtccagttcactactaaagtcaggttgctggtcaaattccctgagttgaattatcagcttaaaattaaagtgtgcattgacaaagactctggggacgttgcagctctcagaggatcccggaaatttaacattctgggcacaaacacaaaagtgatgaacatggaagaatccaacaacggcagcctctctgcagaattcaaacacttgaccctgagggagcagagatgtgggaatgggggccgagccaattgtgatgcttccctgattgtgactgaggagctgcacctgatcacctttgagaccgaggtgtatcaccaaggcctcaagattgacctagagacccactccttgccagttgtggtgatctccaacatctgtcagatgccaaatgcctgggcgtccatcctgtggtacaacatgctgaccaacaatcccaagaatgtaaacttttttaccaagcccccaattggaacctgggatcaagtggccgaggtcctgagctggcagttctcctccaccaccaagcgaggactgagcatcgagcagctgactacactggcagagaaactcttgggacctggtgtgaattattcagggtgtcagatcacatgggctaaattttgcaaagaaaacatggctggcaagggcttctccttctgggtctggctggacaatatcattgaccttgtgaaaaagtacatcctggccctttggaacgaagggtacatcatgggctttatcagtaaggagcgggagcgggccatcttgagcactaagcctccaggcaccttcctgctaagattcagtgaaagcagcaaagaaggaggcgtcactttcacttgggtggagaaggacatcagcggtaagacccagatccagtccgtggaaccatacacaaagcagcagctgaacaacatgtcatttgctgaaatcatcatgggctataagatcatggatgctaccaatatcctggtgtctccactggtctatctctatcctgacattcccaaggaggaggcattcggaaagtattgtcggccagagagccaggagcatcctgaagctgacccaggtagcgctgccccatacctgaagaccaagtttatctgtgtgacaccaacgacctgcagcaataccattgacctgccgatgtccccccgcactttagattcattgatgcagtttggaaataatggtgaaggtgctgaaccctcagcaggagggcagtttgagtccctcacctttgacatggagttgacctcggagtgcgctacctcccccatgtgaggagctgagaacggaagctgcagaaagatacgactgaggcgcctacctgcattctgccacccctcacacagccaaaccccagatcatctgaaactactaactttgtggttccagattttttttaatctcctacttctgctatctttgagcaatctgggcacttttaaaaatagagaaatgagtgaatgtgggtgatctgcttttatctaaatgcaaataaggatgtgttctctgagacccatgatcaggggatgtggcggggggtggctagagggagaaaaaggaaatgtcttgtgttgttttgttcccctgccctcctttctcagcagctttttgttattgttgttgttgttcttagacaagtgcctcctggtgcctgcggcatccttctgcctgtttctgtaagcaaatgccacaggccacctatagctacatactcctggcattgcactttttaaccttgctgacatccaaatagaagataggactatctaagccctaggtttctttttaaattaagaaataataacaattaaagggcaaaaaacactgtatcagcatagcctttctgtatttaagaaacttaagcagccgggcatggtggctcacgcctgtaatcccagcactttgggaggccgaggcggatcataaggtcaggagatcaagaccatcctggctaacacggtgaaaccccgtctctactaaaagtacaaaaaattagctgggtgtggtggtgggcgcctgtagtcccagctactcgggaggctgaggcaggagaatcgcttgaacctgagaggcggaggttgcagtgagccaaaattgcaccactgcacactgcactccatcctgggcgacagtctgagactctgtctcaaaaaaaaaaaaaaaaaaaagaaacttcagttaacagcctccttggtgctttaagcattcagcttccttcaggctggtaatttatataatccctgaaacgggcttcaggtcaaacccttaagacatctgaagctgcaacctggcctttggtgttgaaataggaaggtttaaggagaatctaagcattttagacttttttttataaatagacttattttcctttgtaatgtattggccttttagtgagtaaggctgggcagagggtgcttacaaccttgactccctttctccctggacttgatctgctgtttca

SEQ ID NO: 295093 - DNA, 3662 bp, Homo sapiens
  misc_feature (8)..(8): n is a, c, g, or t
  misc_feature (32)..(33): n is a, c, g, or t
  misc_feature (35)..(35): n is a, c, g, or t
aacacctnggctaggtacgaggctgggtgttnnantcggccgacccggcttggcgctgtctctccccctcggctcggagaggcccttcggcctgagggagcctcgccgcccgtccccggcacacgcgcagccccggcctctcggcctctgccggagaaacaggatggcccaatggaatcagctacagcagcttgacacacggtacctggagcagctccatcagctctacagtgacagcttcccaatggagctgcggcagtttctggccccttggattgagagtcaagattgggcatatgcggccagcaaagaatcacatgccactttggtgtttcataatctcctgggagagattgaccagcagtatagccgcttcctgcaagagtcgaatgttctctatcagcacaatctacgaagaatcaagcagtttcttcagagcaggtatcttgagaagccaatggagattgcccggattgtggcccggtgcctgtgggaagaatcacgccttctacagactgcagccactgcggcccagcaagggggccaggccaaccaccccacagcagccgtggtgacggagaagcagcagatgctggagcagcaccttcaggatgtccggaagagagtgcaggatctagaacagaaaatgaaagtggtagagaatctccaggatgactttgatttcaactataaaaccctcaagagtcaaggagacatgcaagatctgaatggaaacaaccagtcagtgaccaggcagaagatgcagcagctggaacagatgctcactgcgctggaccagatgcggagaagcatcgtgagtgagctggcggggcttttgtcagcgatggagtacgtgcagaaaactctcacggacgaggagctggctgactggaagaggcggcaacagattgcctgcattggaggcccgcccaacatctgcctagatcggctagaaaactggataacgtcattagcagaatctcaacttcagacccgtcaacaaattaagaaactggaggagttgcagcaaaaagtttcctacaaaggggaccccattgtacagcaccggccgatgctggaggagagaatcgtggagctgtttagaaacttaatgaaaagtgcctttgtggtggagcggcagccctgcatgcccatgcatcctgaccggcccctcgtcatcaagaccggcgtccagttcactactaaagtcaggttgctggtcaaattccctgagttgaattatcagcttaaaattaaagtgtgcattgacaaagactctggggacgttgcagctctcagaggatcccggaaatttaacattctgggcacaaacacaaaagtgatgaacatggaagaatccaacaacggcagcctctctgcagaattcaaacacttgaccctgagggagcagagatgtgggaatgggggccgagccaattgtgatgcttccctgattgtgactgaggagctgcacctgatcacctttgagaccgaggtgtatcaccaaggcctcaagattgacctagagacccactccttgccagttgtggtgatctccaacatctgtcagatgccaaatgcctgggcgtccatcctgtggtacaacatgctgaccaacaatcccaagaatgtaaacttttttaccaagcccccaattggaacctgggatcaagtggccgaggtcctgagctggcagttctcctccaccaccaagcgaggactgagcatcgagcagctgactacactggcagagaaactcttgggacctggtgtgaattattcagggtgtcagatcacatgggctaaattttgcaaagaaaacatggctggcaagggcttctccttctgggtctggctggacaatatcattgaccttgtgaaaaagtacatcctggccctttggaacgaagggtacatcatgggctttatcagtaaggagcgggagcgggccatcttgagcactaagcctccaggcaccttcctgctaagattcagtgaaagcagcaaagaaggaggcgtcactttcacttgggtggagaaggacatcagcggtaagacccagatccagtccgtggaaccatacacaaagcagcagctgaacaacatgtcatttgctgaaatcatcatgggctataagatcatggatgctaccaatatcctggtgtctccactggtctatctctatcctgacattcccaaggaggaggcattcggaaagtattgtcggccagagagccaggagcatcctgaagctgacccaggtagcgctgccccatacctgaagaccaagtttatctgtgtgacaccaacgacctgcagcaataccattgacctgccgatgtccccccgcactttagattcattgatgcagtttggaaataatggtgaaggtgctgaaccctcagcaggagggcagtttgagtccctcacctttgacatggagttgacctcggagtgcgctacctcccccatgtgaggagctgagaacggaagctgcagaaagatacgactgaggcgcctacctgcattctgccacccctcacacagccaaaccccagatcatctgaaactactaactttgtggttccagattttttttaatctcctacttctgctatctttgagcaatctgggcacttttaaaaatagagaaatgagtgaatgtgggtgatctgcttttatctaaatgcaaataaggatgtgttctctgagacccatgatcaggggatgtggcggggggtggctagagggagaaaaaggaaatgtcttgtgttgttttgttcccctgccctcctttctcagcagctttttgttattgttgttgttgttcttagacaagtgcctcctggtgcctgcggcatccttctgcctgtttctgtaagcaaatgccacaggccacctatagctacatactcctggcattgcactttttaaccttgctgacatccaaatagaagataggactatctaagccctaggtttctttttaaattaagaaataataacaattaaagggcaaaaaacactgtatcagcatagcctttctgtatttaagaaacttaagcagccgggcatggtggctcacgcctgtaatcccagcactttgggaggccgaggcggatcataaggtcaggagatcaagaccatcctggctaacacggtgaaaccccgtctctactaaaagtacaaaaaattagctgggtgtggtggtgggcgcctgtagtcccagctactcgggaggctgaggcaggagaatcgcttgaacctgagaggcggaggttgcagtgagccaaaattgcaccactgcacactgcactccatcctgggcgacagtctgagactctgtctcaaaaaaaaaaaaaaaaaaaagaaacttcagttaacagcctccttggtgctttaagcattcagcttccttcaggctggtaatttatataatccctgaaacgggcttcaggtcaaacccttaagacatctgaagctgcaacctggcctttggtgttgaaataggaaggtttaaggagaatctaagcattttagacttttttttataaatagacttattttcctttgtaatgtattggccttttagtgagtaaggctgggcagagggtgcttacaaccttgactccctttctccctggacttgatctgctgtttca

SEQ ID NO: 295094 - DNA, 2725 bp, Homo sapiens
gtaattcagcggtttccggagctgcggcggcgcagactgggagggggagccgggggttccgacgtcgcagccgagggaacaagccccaaccggatcctggacaggcaccccggcttggcgctgtctctccccctcggctcggagaggcccttcggcctgagggagcctcgccgcccgtccccggcacacgcgcagccccggcctctcggcctctgccggagaaacaggatggcccaatggaatcagctacagcagcttgacacacggtacctggagcagctccatcagctctacagtgacagcttcccaatggagctgcggcagtttctggccccttggattgagagtcaagattgggcatatgcggccagcaaagaatcacatgccactttggtgtttcataatctcctgggagagattgaccagcagtatagccgcttcctgcaagagtcgaatgttctctatcagcacaatctacgaagaatcaagcagtttcttcagagcaggtatcttgagaagccaatggagattgcccggattgtggcccggtgcctgtgggaagaatcacgccttctacagactgcagccactgcggcccagcaagggggccaggccaaccaccccacagcagccgtggtgacggagaagcagcagatgctggagcagcaccttcaggatgtccggaagagagtgcaggatctagaacagaaaatgaaagtggtagagaatctccaggatgactttgatttcaactataaaaccctcaagagtcaaggagacatgcaagatctgaatggaaacaaccagtcagtgaccaggcagaagatgcagcagctggaacagatgctcactgcgctggaccagatgcggagaagcatcgtgagtgagctggcggggcttttgtcagcgatggagtacgtgcagaaaactctcacggacgaggagctggctgactggaagaggcggcaacagattgcctgcattggaggcccgcccaacatctgcctagatcggctagaaaactggataacgtcattagcagaatctcaacttcagacccgtcaacaaattaagaaactggaggagttgcagcaaaaagtttcctacaaaggggaccccattgtacagcaccggccgatgctggaggagagaatcgtggagctgtttagaaacttaatgaaaagtgcctttgtggtggagcggcagccctgcatgcccatgcatcctgaccggcccctcgtcatcaagaccggcgtccagttcactactaaagtcaggttgctggtcaaattccctgagttgaattatcagcttaaaattaaagtgtgcattgacaaagactctggggacgttgcagctctcagaggatcccggaaatttaacattctgggcacaaacacaaaagtgatgaacatggaagaatccaacaacggcagcctctctgcagaattcaaacacttgaccctgagggagcagagatgtgggaatgggggccgagccaattgtgatgcttccctgattgtgactgaggagctgcacctgatcacctttgagaccgaggtgtatcaccaaggcctcaagattgacctagagacccactccttgccagttgtggtgatctccaacatctgtcagatgccaaatgcctgggcgtccatcctgtggtacaacatgctgaccaacaatcccaagaatgtaaacttttttaccaagcccccaattggaacctgggatcaagtggccgaggtcctgagctggcagttctcctccaccaccaagcgaggactgagcatcgagcagctgactacactggcagagaaactcttgggacctggtgtgaattattcagggtgtcagatcacatgggctaaattttgcaaagaaaacatggctggcaagggcttctccttctgggtctggctggacaatatcattgaccttgtgaaaaagtacatcctggccctttggaacgaagggtacatcatgggctttatcagtaaggagcgggagcgggccatcttgagcactaagcctccaggcaccttcctgctaagattcagtgaaagcagcaaagaaggaggcgtcactttcacttgggtggagaaggacatcagcggtaagacccagatccagtccgtggaaccatacacaaagcagcagctgaacaacatgtcatttgctgaaatcatcatgggctataagatcatggatgctaccaatatcctggtgtctccactggtctatctctatcctgacattcccaaggaggaggcattcggaaagtattgtcggccagagagccaggagcatcctgaagctgacccaggtagcgctgccccatacctgaagaccaagtttatctgtgtgacaccaacgacctgcagcaataccattgacctgccgatgtccccccgcactttagattcattgatgcagtttggaaataatggtgaaggtgctgaaccctcagcaggagggcagtttgagtccctcacctttgacatggagttgacctcggagtgcgctacctcccccatgtgaggagctgagaacggaagctgcagaaagatacgactgaggcgcctacctgcattctgccacccctcacacagccaaaccccagatcatctgaaactactaactttgtggttccagattttttttaatctcctacttctgctatctttgagcaatctgggcacttttaaaaatagagaaatgagtg

SEQ ID NO: 295095 - DNA, 3647 bp, Homo sapiens
gtaattcagcggtttccggagctgcggcggcgcagactgggagggggagccgggggttccgacgtcgcagccgagggaacaagccccaaccggatcctggacaggcaccccggcttggcgctgtctctccccctcggctcggagaggcccttcggcctgagggagcctcgccgcccgtccccggcacacgcgcagccccggcctctcggcctctgccggagaaacaggatggcccaatggaatcagctacagcagcttgacacacggtacctggagcagctccatcagctctacagtgacagcttcccaatggagctgcggcagtttctggccccttggattgagagtcaagattgggcatatgcggccagcaaagaatcacatgccactttggtgtttcataatctcctgggagagattgaccagcagtatagccgcttcctgcaagagtcgaatgttctctatcagcacaatctacgaagaatcacgccttctacagactgcagccactgcggcccagcaagggggccaggccaaccaccccacagcagccgtggtgacggagaagcagcagatgctggagcagcaccttcaggatgtccggaagagagtgcaggatctagaacagaaaatgaaagtggtagagaatctccaggatgactttgatttcaactataaaaccctcaagagtcaaggagacatgcaagatctgaatggaaacaaccagtcagtgaccaggcagaagatgcagcagctggaacagatgctcactgcgctggaccagatgcggagaagcatcgtgagtgagctggcggggcttttgtcagcgatggagtacgtgcagaaaactctcacggacgaggagctggctgactggaagaggcggcaacagattgcctgcattggaggcccgcccaacatctgcctagatcggctagaaaactggataacgtcattagcagaatctcaacttcagacccgtcaacaaattaagaaactggaggagttgcagcaaaaagtttcctacaaaggggaccccattgtacagcaccggccgatgctggaggagagaatcgtggagctgtttagaaacttaatgaaaagtgcctttgtggtggagcggcagccctgcatgcccatgcatcctgaccggcccctcgtcatcaagaccggcgtccagttcactactaaagtcaggttgctggtcaaattccctgagttgaattatcagcttaaaattaaagtgtgcattgacaaagactctggggacgttgcagctctcagaggatcccggaaatttaacattctgggcacaaacacaaaagtgatgaacatggaagaatccaacaacggcagcctctctgcagaattcaaacacttgaccctgagggagcagagatgtgggaatgggggccgagccaattgtgatgcttccctgattgtgactgaggagctgcacctgatcacctttgagaccgaggtgtatcaccaaggcctcaagattgacctagagacccactccttgccagttgtggtgatctccaacatctgtcagatgccaaatgcctgggcgtccatcctgtggtacaacatgctgaccaacaatcccaagaatgtaaacttttttaccaagcccccaattggaacctgggatcaagtggccgaggtcctgagctggcagttctcctccaccaccaagcgaggactgagcatcgagcagctgactacactggcagagaaactcttgggacctggtgtgaattattcagggtgtcagatcacatgggctaaattttgcaaagaaaacatggctggcaagggcttctccttctgggtctggctggacaatatcattgaccttgtgaaaaagtacatcctggccctttggaacgaagggtacatcatgggctttatcagtaaggagcgggagcgggccatcttgagcactaagcctccaggcaccttcctgctaagattcagtgaaagcagcaaagaaggaggcgtcactttcacttgggtggagaaggacatcagcggtaagacccagatccagtccgtggaaccatacacaaagcagcagctgaacaacatgtcatttgctgaaatcatcatgggctataagatcatggatgctaccaatatcctggtgtctccactggtctatctctatcctgacattcccaaggaggaggcattcggaaagtattgtcggccagagagccaggagcatcctgaagctgacccaggtagcgctgccccatacctgaagaccaagtttatctgtgtgacaccaacgacctgcagcaataccattgacctgccgatgtccccccgcactttagattcattgatgcagtttggaaataatggtgaaggtgctgaaccctcagcaggagggcagtttgagtccctcacctttgacatggagttgacctcggagtgcgctacctcccccatgtgaggagctgagaacggaagctgcagaaagatacgactgaggcgcctacctgcattctgccacccctcacacagccaaaccccagatcatctgaaactactaactttgtggttccagattttttttaatctcctacttctgctatctttgagcaatctgggcacttttaaaaatagagaaatgagtgaatgtgggtgatctgcttttatctaaatgcaaataaggatgtgttctctgagacccatgatcaggggatgtggcggggggtggctagagggagaaaaaggaaatgtcttgtgttgttttgttcccctgccctcctttctcagcagctttttgttattgttgttgttgttcttagacaagtgcctcctggtgcctgcggcatccttctgcctgtttctgtaagcaaatgccacaggccacctatagctacatactcctggcattgcactttttaaccttgctgacatccaaatagaagataggactatctaagccctaggtttctttttaaattaagaaataataacaattaaagggcaaaaaacactgtatcagcatagcctttctgtatttaagaaacttaagcagccgggcatggtggctcacgcctgtaatcccagcactttgggaggccgaggcggatcataaggtcaggagatcaagaccatcctggctaacacggtgaaaccccgtctctactaaaagtacaaaaaattagctgggtgtggtggtgggcgcctgtagtcccagctactcgggaggctgaggcaggagaatcgcttgaacctgagaggcggaggttgcagtgagccaaaattgcaccactgcacactgcactccatcctgggcgacagtctgagactctgtctcaaaaaaaaaaaaaaaaaaaagaaacttcagttaacagcctccttggtgctttaagcattcagcttccttcaggctggtaatttatataatccctgaaacgggcttcaggtcaaacccttaagacatctgaagctgcaacctggcctttggtgttgaaataggaaggtttaaggagaatctaagcattttagacttttttttataaatagacttattttcctttgtaatgtattggccttttagtgagtaaggctgggcagagggtgcttacaaccttgactccctttctccctggacttgatctgctgtttca

SEQ ID NO: 295096 - DNA, 4027 bp, Homo sapiens
gtaattcagcggtttccggagctgcggcggcgcagactgggagggggagccgggggttccgacgtcgcagccgagggaacaagccccaaccggatcctggacaggcaccccggcttggcgctgtctctccccctcggctcggagaggcccttcggcctgagggagcctcgccgcccgtccccggcacacgcgcagccccggcctctcggcctctgccggagaaacaggatggcccaatggaatcagctacagcagcttgacacacggtacctggagcagctccatcagctctacagtgacagcttcccaatggagctgcggcagtttctggccccttggattgagagtcaagattgggcatatgcggccagcaaagaatcacatgccactttggtgtttcataatctcctgggagagattgaccagcagtatagccgcttcctgcaagagtcgaatgttctctatcagcacaatctacgaagaatcaagcagtttcttcagagcaggtatcttgagaagccaatggagattgcccggattgtggcccggtgcctgtgggaagaatcacgccttctacagactgcagccactgcggcccagcaagggggccaggccaaccaccccacagcagccgtggtgacggagaagcagcagatgctggagcagcaccttcaggatgtccggaagagagtgcaggatctagaacagaaaatgaaagtggtagagaatctccaggatgactttgatttcaactataaaaccctcaagagtcaaggagacatgcaagatctgaatggaaacaaccagtcagtgaccaggcagaagatgcagcagctggaacagatgctcactgcgctggaccagatgcggagagtaagggcataggtcggaccacttcccccatgtgtctcgctcacttgcgggatttcagcgtcttgtggcagaacttgcttggtttctaagaagttcctgctctggagttgactaaagaatgtggttagagacagtctgaggaaatgttttctgactttgttttggtttccaaccagagcatcgtgagtgagctggcggggcttttgtcagcgatggagtacgtgcagaaaactctcacggacgaggagctggctgactggaagaggcggcaacagattgcctgcattggaggcccgcccaacatctgcctagatcggctagaaaactggataacgtcattagcagaatctcaacttcagacccgtcaacaaattaagaaactggaggagttgcagcaaaaagtttcctacaaaggggaccccattgtacagcaccggccgatgctggaggagagaatcgtggagctgtttagaaacttaatgaaaaggtaatttagcatccttgtccctttccctcatctaaaaaatacctaaagactcacgtggtagagtgagaggcgggctgacttctggtcatggccgtgcgcgtgagcccatcttctctttcctcagtgcctttgtggtggagcggcagccctgcatgcccatgcatcctgaccggcccctcgtcatcaagaccggcgtccagttcactactaaagtcaggttgctggtcaaattccctgagttgaattatcagcttaaaattaaagtgtgcattgacaaagactctggggacgttgcagctctcagaggatcccggaaatttaacattctgggcacaaacacaaaagtgatgaacatggaagaatccaacaacggcagcctctctgcagaattcaaacacttgaccctgagggagcagagatgtgggaatgggggccgagccaattgtgatgcttccctgattgtgactgaggagctgcacctgatcacctttgagaccgaggtgtatcaccaaggcctcaagattgacctagagacccactccttgccagttgtggtgatctccaacatctgtcagatgccaaatgcctgggcgtccatcctgtggtacaacatgctgaccaacaatcccaagaatgtaaacttttttaccaagcccccaattggaacctgggatcaagtggccgaggtcctgagctggcagttctcctccaccaccaagcgaggactgagcatcgagcagctgactacactggcagagaaactcttgggacctggtgtgaattattcagggtgtcagatcacatgggctaaattttgcaaagaaaacatggctggcaagggcttctccttctgggtctggctggacaatatcattgaccttgtgaaaaagtacatcctggccctttggaacgaagggtacatcatgggctttatcagtaaggagcgggagcgggccatcttgagcactaagcctccaggcaccttcctgctaagattcagtgaaagcagcaaagaaggaggcgtcactttcacttgggtggagaaggacatcagcggtaagacccagatccagtccgtggaaccatacacaaagcagcagctgaacaacatgtcatttgctgaaatcatcatgggctataagatcatggatgctaccaatatcctggtgtctccactggtctatctctatcctgacattcccaaggaggaggcattcggaaagtattgtcggccagagagccaggagcatcctgaagctgacccaggtagcgctgccccatacctgaagaccaagtttatctgtgtgacaccaacgacctgcagcaataccattgacctgccgatgtccccccgcactttagattcattgatgcagtttggaaataatggtgaaggtgctgaaccctcagcaggagggcagtttgagtccctcacctttgacatggagttgacctcggagtgcgctacctcccccatgtgaggagctgagaacggaagctgcagaaagatacgactgaggcgcctacctgcattctgccacccctcacacagccaaaccccagatcatctgaaactactaactttgtggttccagattttttttaatctcctacttctgctatctttgagcaatctgggcacttttaaaaatagagaaatgagtgaatgtgggtgatctgcttttatctaaatgcaaataaggatgtgttctctgagacccatgatcaggggatgtggcggggggtggctagagggagaaaaaggaaatgtcttgtgttgttttgttcccctgccctcctttctcagcagctttttgttattgttgttgttgttcttagacaagtgcctcctggtgcctgcggcatccttctgcctgtttctgtaagcaaatgccacaggccacctatagctacatactcctggcattgcactttttaaccttgctgacatccaaatagaagataggactatctaagccctaggtttctttttaaattaagaaataataacaattaaagggcaaaaaacactgtatcagcatagcctttctgtatttaagaaacttaagcagccgggcatggtggctcacgcctgtaatcccagcactttgggaggccgaggcggatcataaggtcaggagatcaagaccatcctggctaacacggtgaaaccccgtctctactaaaagtacaaaaaattagctgggtgtggtggtgggcgcctgtagtcccagctactcgggaggctgaggcaggagaatcgcttgaacctgagaggcggaggttgcagtgagccaaaattgcaccactgcacactgcactccatcctgggcgacagtctgagactctgtctcaaaaaaaaaaaaaaaaaaaagaaacttcagttaacagcctccttggtgctttaagcattcagcttccttcaggctggtaatttatataatccctgaaacgggcttcaggtcaaacccttaagacatctgaagctgcaacctggcctttggtgttgaaataggaaggtttaaggagaatctaagcattttagacttttttttataaatagacttattttcctttgtaatgtattggccttttagtgagtaaggctgggcagagggtgcttacaaccttgactccctttctccctggacttgatctgctgtttca

SEQ ID NO: 295097 - DNA, 3673 bp, Homo sapiens
gtaattcagcggtttccggagctgcggcggcgcagactgggagggggagccgggggttccgacgtcgcagccgagggaacaagccccaaccggatcctggacaggcaccccggcttggcgctgtctctccccctcggctcggagaggcccttcggcctgagggagcctcgccgcccgtccccggcacacgcgcagccccggcctctcggcctctgccggagaaacaggatggcccaatggaatcagctacagcagcttgacacacggtacctggagcagctccatcagctctacagtgacagcttcccaatggagctgcggcagtttctggccccttggattgagagtcaagattgggcatatgcggccagcaaagaatcacatgccactttggtgtttcataatctcctgggagagattgaccagcagtatagccgcttcctgcaagagtcgaatgttctctatcagcacaatctacgaagaatcaagcagtttcttcagagcaggtatcttgagaagccaatggagattgcccggattgtggcccggtgcctgtgggaagaatcacgccttctacagactgcagccactgcggcccagcaagggggccaggccaaccaccccacagcagccgtggtgacggagaagcagcagatgctggagcagcaccttcaggatgtccggaagagagtgcaggatctagaacagaaaatgaaagtggtagagaatctccaggatgactttgatttcaactataaaaccctcaagagtcaaggagacatgcaagatctgaatggaaacaaccagtcagtgaccaggcagaagatgcagcagctggaacagatgctcactgcgctggaccagatgcggagaagcatcgtgagtgagctggcggggcttttgtcagcgatggagtacgtgcagaaaactctcacggacgaggagctggctgactggaagaggcggcaacagattgcctgcattggaggcccgcccaacatctgcctagatcggctagaaaactggataacgtcattagcagaatctcaacttcagacccgtcaacaaattaagaaactggaggagttgcagcaaaaagtttcctacaaaggggaccccattgtacagcaccggccgatgctggaggagagaatcgtggagctgtttagaaacttaatgaaaagtgcctttgtggtggagcggcagccctgcatgcccatgcatcctgaccggcccctcgtcatcaagaccggcgtccagttcactactaaagtcaggttgctggtcaaattccctgagttgaattatcagcttaaaattaaagtgtgcattgacaaagactctggggacgttgcagctctcagaggatcccggaaatttaacattctgggcacaaacacaaaagtgatgaacatggaagaatccaacaacggcagcctctctgcagaattcaaacacttgaccctgagggagcagagatgtgggaatgggggccgagccaattgtgatgcttccctgattgtgactgaggagctgcacctgatcacctttgagaccgaggtgtatcaccaaggcctcaagattgacctagagacccactccttgccagttgtggtgatctccaacatctgtcagatgccaaatgcctgggcgtccatcctgtggtacaacatgctgaccaacaatcccaagaatgtaaacttttttaccaagcccccaattggaacctgggatcaagtggccgaggtcctgagctggcagttctcctccaccaccaagcgaggactgagcatcgagcagctgactacactggcagagaaactcttgggacctggtgtgaattattcagggtgtcagatcacatgggctaaattttgcaaagaaaacatggctggcaagggcttctccttctgggtctggctggacaatatcattgaccttgtgaaggagcgggagcgggccatcttgagcactaagcctccaggcaccttcctgctaagattcagtgaaagcagcaaagaaggaggcgtcactttcacttgggtggagaaggacatcagcggtaagacccagatccagtccgtggaaccatacacaaagcagcagctgaacaacatgtcatttgctgaaatcatcatgggctataagatcatggatgctaccaatatcctggtgtctccactggtctatctctatcctgacattcccaaggaggaggcattcggaaagtattgtcggccagagagccaggagcatcctgaagctgacccaggtagcgctgccccatacctgaagaccaagtttatctgtgtgacaccaacgacctgcagcaataccattgacctgccgatgtccccccgcactttagattcattgatgcagtttggaaataatggtgaaggtgctgaaccctcagcaggagggcagtttgagtccctcacctttgacatggagttgacctcggagtgcgctacctcccccatgtgaggagctgagaacggaagctgcagaaagatacgactgaggcgcctacctgcattctgccacccctcacacagccaaaccccagatcatctgaaactactaactttgtggttccagattttttttaatctcctacttctgctatctttgagcaatctgggcacttttaaaaatagagaaatgagtgaatgtgggtgatctgcttttatctaaatgcaaataaggatgtgttctctgagacccatgatcaggggatgtggcggggggtggctagagggagaaaaaggaaatgtcttgtgttgttttgttcccctgccctcctttctcagcagctttttgttattgttgttgttgttcttagacaagtgcctcctggtgcctgcggcatccttctgcctgtttctgtaagcaaatgccacaggccacctatagctacatactcctggcattgcactttttaaccttgctgacatccaaatagaagataggactatctaagccctaggtttctttttaaattaagaaataataacaattaaagggcaaaaaacactgtatcagcatagcctttctgtatttaagaaacttaagcagccgggcatggtggctcacgcctgtaatcccagcactttgggaggccgaggcggatcataaggtcaggagatcaagaccatcctggctaacacggtgaaaccccgtctctactaaaagtacaaaaaattagctgggtgtggtggtgggcgcctgtagtcccagctactcgggaggctgaggcaggagaatcgcttgaacctgagaggcggaggttgcagtgagccaaaattgcaccactgcacactgcactccatcctgggcgacagtctgagactctgtctcaaaaaaaaaaaaaaaaaaaagaaacttcagttaacagcctccttggtgctttaagcattcagcttccttcaggctggtaatttatataatccctgaaacgggcttcaggtcaaacccttaagacatctgaagctgcaacctggcctttggtgttgaaataggaaggtttaaggagaatctaagcattttagacttttttttataaatagacttattttcctttgtaatgtattggccttttagtgagtaaggctgggcagagggtgcttacaaccttgactccctttctccctggacttgatctgctgtttca

SEQ ID NO: 295098 - DNA, 5656 bp, Homo sapiens
gtaattcagcggtttccggagctgcggcggcgcagactgggagggggagccgggggttccgacgtcgcagccgagggaacaagccccaaccggatcctggacaggcaccccggcttggcgctgtctctccccctcggctcggagaggcccttcggcctgagggagcctcgccgcccgtccccggcacacgcgcagccccggcctctcggcctctgccggagaaacaggatggcccaatggaatcagctacagcagcttgacacacggtacctggagcagctccatcagctctacagtgacagcttcccaatggagctgcggcagtttctggccccttggattgagagtcaagattgggcatatgcggccagcaaagaatcacatgccactttggtgtttcataatctcctgggagagattgaccagcagtatagccgcttcctgcaagagtcgaatgttctctatcagcacaatctacgaagaatcaagcagtttcttcagagcaggtatcttgagaagccaatggagattgcccggattgtggcccggtgcctgtgggaagaatcacgccttctacagactgcagccactgcggcccagcaagggggccaggccaaccaccccacagcagccgtggtgacggagaagcagcagatgctggagcagcaccttcaggatgtccggaagagagtgcaggatctagaacagaaaatgaaagtggtagagaatctccaggatgactttgatttcaactataaaaccctcaagagtcaaggagacatgcaagatctgaatggaaacaaccagtcagtgaccaggcagaagatgcagcagctggaacagatgctcactgcgctggaccagatgcggagaagcatcgtgagtgagctggcggggcttttgtcagcgatggagtacgtgcagaaaactctcacggacgaggagctggctgactggaagaggcggcaacagattgcctgcattggaggcccgcccaacatctgcctagatcggctagaaaactggataacgtcattagcagaatctcaacttcagacccgtcaacaaattaagaaactggaggagttgcagcaaaaagtttcctacaaaggggaccccattgtacagcaccggccgatgctggaggagagaatcgtggagctgtttagaaacttaatgaaaagtgcctttgtggtggagcggcagccctgcatgcccatgcatcctgaccggcccctcgtcatcaagaccggcgtccagttcactactaaagtcaggttgctggtcaaattccctgagttgaattatcagcttaaaattaaagtgtgcattgacaaagactctggggacgttgcagctctcagaggatcccggaaatttaacattctgggcacaaacacaaaagtgatgaacatggaagaatccaacaacggcagcctctctgcagaattcaaacacttgaccctgagggagcagagatgtgggaatgggggccgagccaattgtgatgcttccctgattgtgactgaggagctgcacctgatcacctttgagaccgaggtgtatcaccaaggcctcaagattgacctagagacccactccttgccagttgtggtgatctccaacatctgtcagatgccaaatgcctgggcgtccatcctgtggtacaacatgctgaccaacaatcccaagaatgtaaacttttttaccaagcccccaattggaacctgggatcaagtggccgaggtcctgagctggcagttctcctccaccaccaagcgaggactgagcatcgagcagctgactacactggcagagaaactcttgggacctggtgtgaattattcagggtgtcagatcacatgggctaaattttgcaaagaaaacatggctggcaagggcttctccttctgggtctggctggacaatatcattgaccttgtgaaaaagtacatcctggccctttggaacgaagggtacatcatgggctttatcagtaaggagcgggagcgggccatcttgagcactaagcctccaggcaccttcctgctaagattcagtgaaagcagcaaagaaggaggcgtcactttcacttgggtggagaaggacatcagcggtaagacccagatccagtccgtggaaccatacacaaagcagcagctgaacaacatgtcatttgctgaaatcatcatgggctataagatcatggatgctaccaatatcctggtgtctccactggtctatctctatcctgacattcccaaggaggaggcattcggaaagtattgtcggccagagagccaggagcatcctgaagctgacccaggtagttgttgattttccatgttcctggcatttaatttttgggaaaagttggaaattttgggatccttggaggatagataggcaaatgcctgaataacctgggggataattatttctccttatgggaaagaattgtagtgagtgcttttgttggggtgaccgatgggatttgagaggagaatcagaatcacttagagtagtgtagttcctgctccacagagagtgcatgagtctaaagaggggatacagcctgggcaatatggtgaaacctcgtctctacaaaaaatccaaaaaaattacccggtgtggtggcacgcatttgtagtcgtagctacttgggaggctgaggtgggaggatcacctgagccaaggagttcaaggctgtagtgagcggtgatcatgccaccgcactccagcctggctgatagagtgagatactgtgtcaaaaaataaaaataaagaggggatcaatacacatacgtcccccaaaacatgcctgaaacacgagaagggaaagtgagggcagttaacaggatgccctgctggcacagtgcttcttagtagatgctagaaggtttgaggcccagatttcagcccagcatatggctttttgcctgtaactgaaccatgtcagtgtgccagatggtctgaagaaagggtttctggaggaaattattattagctgcatgggagtatggtttacactagagtagaagagctgggagcatcacgtttgaaggggaagacagtgactgggtggaggggcaagggattagtatttagagtgtgcaactattgaaaataaggtatattttaatgtgtaagaggacatgtacttatatgttatatataaattaaagtgctgggattataggtgtgagccacagtgcccagccttgtttttgtttttgttttgttttgacagtctaatcacttgaaccctggaggcagaggttgtagagagccaagatggcgctactgcactccaacctgggcgaaagagagcaagactccgtctcaaaaaaaaaaaagacaaaaattagccaggcatggtggtgccacctgtagtcccagctgcttgggagcctaaggcaggagaatcgttttgacctgggagtaggaggttgcggtaaccgagattgtgccactgcacttgagcctgggcaacagagtgagactctgtctcaaaacaataagaacaacagcaacaaaagagagagaccatgccttgctccaggtctcttagctattgaagatgtacctggacccaggtctccggtcttctagttgaagcaattgtactgccttacaaagtcacattctctttggtgctttttgattgacgtatttatccaactagaaagttactcatgccctcatccaaaaatgtggtagaggccagattagtgctggtaggaataagagatataacctttggctttggaaccacaagcattagcagtctccatgttctttaaagacttggtgatattggtatttaggctggacaccatgcaaagactacacaggctcggttcctgcatgcagagaagttatctaagagatatgaccaggccggaatagaatgctcagaccacgtggaggctgttaaacttttacataatctagggaaagaagggacacaaggtggcattagtctagggtcaggtgggaaaaggttatgctgaaaagtctctgcagctcaggacagctttgtgcaaagaactgaagttcacagctgctagtgcctgggagatcaaatagtataaatgagggcagacaaccctgaggggcagatggagctttccagacaatcttggcatgaggatgagtgagtttcaaatcagtcctgccgaggcagatggcttcctccagctctgcttactgaatgcgaagtcacagtcagtaagaaaactggttttcttcttcccaggcgctgccccatacctgaagaccaagtttatctgtgtgacaccaacgacctgcagcaataccattgacctgccgatgtccccccgcactttagattcattgatgcagtttggaaataatggtgaaggtgctgaaccctcagcaggagggcagtttgagtccctcacctttgacatggagttgacctcggagtgcgctacctcccccatgtgaggagctgagaacggaagctgcagaaagatacgactgaggcgcctacctgcattctgccacccctcacacagccaaaccccagatcatctgaaactactaactttgtggttccagattttttttaatctcctacttctgctatctttgagcaatctgggcacttttaaaaatagagaaatgagtgaatgtgggtgatctgcttttatctaaatgcaaataaggatgtgttctctgagacccatgatcaggggatgtggcggggggtggctagagggagaaaaaggaaatgtcttgtgttgttttgttcccctgccctcctttctcagcagctttttgttattgttgttgttgttcttagacaagtgcctcctggtgcctgcggcatccttctgcctgtttctgtaagcaaatgccacaggccacctatagctacatactcctggcattgcactttttaaccttgctgacatccaaatagaagataggactatctaagccctaggtttctttttaaattaagaaataataacaattaaagggcaaaaaacactgtatcagcatagcctttctgtatttaagaaacttaagcagccgggcatggtggctcacgcctgtaatcccagcactttgggaggccgaggcggatcataaggtcaggagatcaagaccatcctggctaacacggtgaaaccccgtctctactaaaagtacaaaaaattagctgggtgtggtggtgggcgcctgtagtcccagctactcgggaggctgaggcaggagaatcgcttgaacctgagaggcggaggttgcagtgagccaaaattgcaccactgcacactgcactccatcctgggcgacagtctgagactctgtctcaaaaaaaaaaaaaaaaaaaagaaacttcagttaacagcctccttggtgctttaagcattcagcttccttcaggctggtaatttatataatccctgaaacgggcttcaggtcaaacccttaagacatctgaagctgcaacctggcctttggtgttgaaataggaaggtttaaggagaatctaagcattttagacttttttttataaatagacttattttcctttgtaatgtattggccttttagtgagtaaggctgggcagagggtgcttacaaccttgactccctttctccctggacttgatctgctgtttca

SEQ ID NO: 295099 - DNA, 3161 bp, Homo sapiens
ttccctcaggtcaaggagttttttcttccttcgcagacatgcaagatctgaatggaaacaaccagtcagtgaccaggcagaagatgcagcagctggaacagatgctcactgcgctggaccagatgcggagagtaagggcataggtcggaccacttcccccatgtgtctcgctcacttgcgggatttcagcgtcttgtggcagaacttgcttggtttctaagaagttcctgctctggagttgactaaagaatgtggttagagacagtctgaggaaatgttttctgactttgttttggtttccaaccagagcatcgtgagtgagctggcggggcttttgtcagcgatggagtacgtgcagaaaactctcacggacgaggagctggctgactggaagaggcggcaacagattgcctgcattggaggcccgcccaacatctgcctagatcggctagaaaactggataacgtcattagcagaatctcaacttcagacccgtcaacaaattaagaaactggaggagttgcagcaaaaagtttcctacaaaggggaccccattgtacagcaccggccgatgctggaggagagaatcgtggagctgtttagaaacttaatgaaaagtgcctttgtggtggagcggcagccctgcatgcccatgcatcctgaccggcccctcgtcatcaagaccggcgtccagttcactactaaagtcaggttgctggtcaaattccctgagttgaattatcagcttaaaattaaagtgtgcattgacaaagactctggggacgttgcagctctcagaggatcccggaaatttaacattctgggcacaaacacaaaagtgatgaacatggaagaatccaacaacggcagcctctctgcagaattcaaacacttgaccctgagggagcagagatgtgggaatgggggccgagccaattgtgatgcttccctgattgtgactgaggagctgcacctgatcacctttgagaccgaggtgtatcaccaaggcctcaagattgacctagagacccactccttgccagttgtggtgatctccaacatctgtcagatgccaaatgcctgggcgtccatcctgtggtacaacatgctgaccaacaatcccaagaatgtaaacttttttaccaagcccccaattggaacctgggatcaagtggccgaggtcctgagctggcagttctcctccaccaccaagcgaggactgagcatcgagcagctgactacactggcagagaaactcttgggacctggtgtgaattattcagggtgtcagatcacatgggctaaattttgcaaagaaaacatggctggcaagggcttctccttctgggtctggctggacaatatcattgaccttgtgaaaaagtacatcctggccctttggaacgaagggtacatcatgggctttatcagtaaggagcgggagcgggccatcttgagcactaagcctccaggcaccttcctgctaagattcagtgaaagcagcaaagaaggaggcgtcactttcacttgggtggagaaggacatcagcggtaagacccagatccagtccgtggaaccatacacaaagcagcagctgaacaacatgtcatttgctgaaatcatcatgggctataagatcatggatgctaccaatatcctggtgtctccactggtctatctctatcctgacattcccaaggaggaggcattcggaaagtattgtcggccagagagccaggagcatcctgaagctgacccaggtagcgctgccccatacctgaagaccaagtttatctgtgtgacaccaacgacctgcagcaataccattgacctgccgatgtccccccgcactttagattcattgatgcagtttggaaataatggtgaaggtgctgaaccctcagcaggagggcagtttgagtccctcacctttgacatggagttgacctcggagtgcgctacctcccccatgtgaggagctgagaacggaagctgcagaaagatacgactgaggcgcctacctgcattctgccacccctcacacagccaaaccccagatcatctgaaactactaactttgtggttccagattttttttaatctcctacttctgctatctttgagcaatctgggcacttttaaaaatagagaaatgagtgaatgtgggtgatctgcttttatctaaatgcaaataaggatgtgttctctgagacccatgatcaggggatgtggcggggggtggctagagggagaaaaaggaaatgtcttgtgttgttttgttcccctgccctcctttctcagcagctttttgttattgttgttgttgttcttagacaagtgcctcctggtgcctgcggcatccttctgcctgtttctgtaagcaaatgccacaggccacctatagctacatactcctggcattgcactttttaaccttgctgacatccaaatagaagataggactatctaagccctaggtttctttttaaattaagaaataataacaattaaagggcaaaaaacactgtatcagcatagcctttctgtatttaagaaacttaagcagccgggcatggtggctcacgcctgtaatcccagcactttgggaggccgaggcggatcataaggtcaggagatcaagaccatcctggctaacacggtgaaaccccgtctctactaaaagtacaaaaaattagctgggtgtggtggtgggcgcctgtagtcccagctactcgggaggctgaggcaggagaatcgcttgaacctgagaggcggaggttgcagtgagccaaaattgcaccactgcacactgcactccatcctgggcgacagtctgagactctgtctcaaaaaaaaaaaaaaaaaaaagaaacttcagttaacagcctccttggtgctttaagcattcagcttccttcaggctggtaatttatataatccctgaaacgggcttcaggtcaaacccttaagacatctgaagctgcaacctggcctttggtgttgaaataggaaggtttaaggagaatctaagcattttagacttttttttataaatagacttattttcctttgtaatgtattggccttttagtgagtaaggctgggcagagggtgcttacaaccttgactccctttctccctggacttgatctgctgtttca

SEQ ID NO: 295100 - DNA, 3677 bp, Homo sapiens
gtaattcagcggtttccggagctgcggcggcgcagactgggagggggagccgggggttccgacgtcgcagccgagggaacaagccccaaccggatcctggacaggcaccccggcttggcgctgtctctccccctcggctcggagaggcccttcggcctgagggagcctcgccgcccgtccccggcacacgcgcagccccggcctctcggcctctgccggagaaacaggatggcccaatggaatcagctacagcagcttgacacacggtacctggagcagctccatcagctctacagtgacagcttcccaatggagctgcggcagtttctggccccttggattgagagtcaagattgggcatatgcggccagcaaagaatcacatgccactttggtgtttcataatctcctgggagagattgaccagcagtatagccgcttcctgcaagagtcgaatgttctctatcagcacaatctacgaagaatcaagcagtttcttcagagcaggtatcttgagaagccaatggagattgcccggattgtggcccggtgcctgtgggaagaatcacgccttctacagactgcagccactgcggcccagcaagggggccaggccaaccaccccacagcagccgtggtgacggagaagcagcagatgctggagcagcaccttcaggatgtccggaagagagtgcaggatctagaacagaaaatgaaagtggtagagaatctccaggatgactttgatttcaactataaaaccctcaagagtcaaggagacatgcaagatctgaatggaaacaaccagtcagtgaccaggcagaagatgcagcagctggaacagatgctcactgcgctggaccagatgcggagaagcatcgtgagtgagctggcggggcttttgtcagcgatggagtacgtgcagaaaactctcacggacgaggagctggctgactggaagaggcggcaacagattgcctgcattggaggcccgcccaacatctgcctagatcggctagaaaactggataacgtcattagcagaatctcaacttcagacccgtcaacaaattaagaaactggaggagttgcagcaaaaagtttcctacaaaggggaccccattgtacagcaccggccgatgctggaggagagaatcgtggagctgtttagaaacttaatgaaaagtgcctttgtggtggagcggcagccctgcatgcccatgcatcctgaccggcccctcgtcatcaagaccggcgtccagttcactactaaagtcaggttgctggtcaaattccctgagttgaattatcagcttaaaattaaagtgtgcattgacaaagactctggggacgttgcagctctcagaggatcccggaaatttaacattctgggcacaaacacaaaagtgatgaacatggaagaatccaacaacggcagcctctctgcagaattcaaacacttgaccctgagggagcagagatgtgggaatgggggccgagccaattgtgatgcttccctgattgtgactgaggagctgcacctgatcacctttgagaccgaggtgtatcaccaaggcctcaagattgacctagagacccactccttgccagttgtggtgatctccaacatctgtcagatgccaaatgcctgggcgtccatcctgtggtacaacatgctgaccaacaatcccaagaatgtaaacttttttaccaagcccccaattggaacctgggatcaagtggccgaggtcctgagctggcagttctcctccaccaccaagcgaggactgagcatcgagcagctgactacactggcagagaaactcttgggacctggtgtgaattattcagggtgtcagatcacatgggctaaattttgcaaagaaaacatggctggcaagggcttctccttctgggtctggctggacaatatcattgaccttgtgaaaaagtacatcctggccctttggaacgaagggtacatcatgggctttatcagtaaggagcgggagcgggccatcttgagcactaagcctccaggcaccttcctgctaagattcagtgaaagcagcaaagaaggaggcgtcactttcacttgggtggagaaggacatcagcggtaagacccagatccagtccgtggaaccatacacaaagcagcagctgaacaacatgtcatttgctgaaatcatcatgggctataagatcatggatgctaccaatatcctggtgtctccactggtctatctctatcctgacattcccaaggaggaggcattcggaaagtattgtcggccagagagccaggagcatcctgaagctgacccaggtagcgctgccccatacctgaagaccaagtttatctgtgtgacaccattcattgatgcagtttggaaataatggtgaaggtgctgaaccctcagcaggagggcagtttgagtccctcacctttgacatggagttgacctcggagtgcgctacctcccccatgtgaggagctgagaacggaagctgcagaaagatacgactgaggcgcctacctgcattctgccacccctcacacagccaaaccccagatcatctgaaactactaactttgtggttccagattttttttaatctcctacttctgctatctttgagcaatctgggcacttttaaaaatagagaaatgagtgaatgtgggtgatctgcttttatctaaatgcaaataaggatgtgttctctgagacccatgatcaggggatgtggcggggggtggctagagggagaaaaaggaaatgtcttgtgttgttttgttcccctgccctcctttctcagcagctttttgttattgttgttgttgttcttagacaagtgcctcctggtgcctgcggcatccttctgcctgtttctgtaagcaaatgccacaggccacctatagctacatactcctggcattgcactttttaaccttgctgacatccaaatagaagataggactatctaagccctaggtttctttttaaattaagaaataataacaattaaagggcaaaaaacactgtatcagcatagcctttctgtatttaagaaacttaagcagccgggcatggtggctcacgcctgtaatcccagcactttgggaggccgaggcggatcataaggtcaggagatcaagaccatcctggctaacacggtgaaaccccgtctctactaaaagtacaaaaaattagctgggtgtggtggtgggcgcctgtagtcccagctactcgggaggctgaggcaggagaatcgcttgaacctgagaggcggaggttgcagtgagccaaaattgcaccactgcacactgcactccatcctgggcgacagtctgagactctgtctcaaaaaaaaaaaaaaaaaaaagaaacttcagttaacagcctccttggtgctttaagcattcagcttccttcaggctggtaatttatataatccctgaaacgggcttcaggtcaaacccttaagacatctgaagctgcaacctggcctttggtgttgaaataggaaggtttaaggagaatctaagcattttagacttttttttataaatagacttattttcctttgtaatgtattggccttttagtgagtaaggctgggcagagggtgcttacaaccttgactccctttctccctggacttgatctgctgtttca

SEQ ID NO: 295101 - DNA, 5606 bp, Homo sapiens
gtaattcagcggtttccggagctgcggcggcgcagactgggagggggagccgggggttccgacgtcgcagccgagggaacaagccccaaccggatcctggacaggcaccccggcttggcgctgtctctccccctcggctcggagaggcccttcggcctgagggagcctcgccgcccgtccccggcacacgcgcagccccggcctctcggcctctgccggagaaacaggatggcccaatggaatcagctacagcagcttgacacacggtacctggagcagctccatcagctctacagtgacagcttcccaatggagctgcggcagtttctggccccttggattgagagtcaagattgggcatatgcggccagcaaagaatcacatgccactttggtgtttcataatctcctgggagagattgaccagcagtatagccgcttcctgcaagagtcgaatgttctctatcagcacaatctacgaagaatcaagcagtttcttcagagcaggtatcttgagaagccaatggagattgcccggattgtggcccggtgcctgtgggaagaatcacgccttctacagactgcagccactgcggcccagcaagggggccaggccaaccaccccacagcagccgtggtgacggagaagcagcagatgctggagcagcaccttcaggatgtccggaagagagtgcaggatctagaacagaaaatgaaagtggtagagaatctccaggatgactttgatttcaactataaaaccctcaagagtcaaggagacatgcaagatctgaatggaaacaaccagtcagtgaccaggcagaagatgcagcagctggaacagatgctcactgcgctggaccagatgcggagaagcatcgtgagtgagctggcggggcttttgtcagcgatggagtacgtgcagaaaactctcacggacgaggagctggctgactggaagaggcggcaacagattgcctgcattggaggcccgcccaacatctgcctagatcggctagaaaactggataacgtcattagcagaatctcaacttcagacccgtcaacaaattaagaaactggaggagttgcagcaaaaagtttcctacaaaggggaccccattgtacagcaccggccgatgctggaggagagaatcgtggagctgtttagaaacttaatgaaaagtgcctttgtggtggagcggcagccctgcatgcccatgcatcctgaccggcccctcgtcatcaagaccggcgtccagttcactactaaagtcaggttgctggtcaaattccctgagttgaattatcagcttaaaattaaagtgtgcattgacaaagactctggggacgttgcagctctcagaggatcccggaaatttaacattctgggcacaaacacaaaagtgatgaacatggaagaatccaacaacggcagcctctctgcagaattcaaacacttgaccctgagggagcagagatgtgggaatgggggccgagccaattgtgatgcttccctgattgtgactgaggagctgcacctgatcacctttgagaccgaggtgtatcaccaaggcctcaagattgacctagagacccactccttgccagttgtggtgatctccaacatctgtcagatgccaaatgcctgggcgtccatcctgtggtacaacatgctgaccaacaatcccaagaatgtaaacttttttaccaagcccccaattggaacctgggatcaagtggccgaggtcctgagctggcagttctcctccaccaccaagcgaggactgagcatcgagcagctgactacactggcagagaaactcttgggacctggtgtgaattattcagggtgtcagatcacatgggctaaattttgcaaagaaaacatggctggcaagggcttctccttctgggtctggctggacaatatcattgaccttgtgaaaaagtacatcctggccctttggaacgaagggtacatcatgggctttatcagtaaggagcgggagcgggccatcttgagcactaagcctccaggcaccttcctgctaagattcagtgaaagcagcaaagaaggaggcgtcactttcacttgggtggagaaggacatcagcggtaagacccagatccagtccgtggaaccatacacaaagcagcagctgaacaacatgtcatttgctgaaatcatcatgggctataagatcatggatgctaccaatatcctggtgtctccactggtctatctctatcctgacattcccaaggaggaggcattcggaaagtattgtcggccagagagccaggagcatcctgaagctgacccaggtagttgttgattttccatgttcctggcatttaatttttgggaaaagttggaaattttgggatccttggaggatagataggcaaatgcctgaataacctgggggataattatttctccttatgggaaagaattgtagtgagtgcttttgttggggtgaccgatgggatttgagaggagaatcagaatcacttagagtagtgtagttcctgctccacagagagtgcatgagtctaaagaggggatacagcctgggcaatatggtgaaacctcgtctctacaaaaaatccaaaaaaattacccggtgtggtggcacgcatttgtagtcgtagctacttgggaggctgaggtgggaggatcacctgagccaaggagttcaaggctgtagtgagcggtgatcatgccaccgcactccagcctggctgatagagtgagatactgtgtcaaaaaataaaaataaagaggggatcaatacacatacgtcccccaaaacatgcctgaaacacgagaagggaaagtgagggcagttaacaggatgccctgctggcacagtgcttcttagtagatgctagaaggtttgaggcccagatttcagcccagcatatggctttttgcctgtaactgaaccatgtcagtgtgccagatggtctgaagaaagggtttctggaggaaattattattagctgcatgggagtatggtttacactagagtagaagagctgggagcatcacgtttgaaggggaagacagtgactgggtggaggggcaagggattagtatttagagtgtgcaactattgaaaataaggtatattttaatgtgtaagaggacatgtacttatatgttatatataaattaaagtgctgggattataggtgtgagccacagtgcccagccttgtttttgtttttgttttgttttgacagtctaatcacttgaaccctggaggcagaggttgtagagagccaagatggcgctactgcactccaacctgggcgaaagagagcaagactccgtctcaaaaaaaaaaaagacaaaaattagccaggcatggtggtgccacctgtagtcccagctgcttgggagcctaaggcaggagaatcgttttgacctgggagtaggaggttgcggtaaccgagattgtgccactgcacttgagcctgggcaacagagtgagactctgtctcaaaacaataagaacaacagcaacaaaagagagagaccatgccttgctccaggtctcttagctattgaagatgtacctggacccaggtctccggtcttctagttgaagcaattgtactgccttacaaagtcacattctctttggtgctttttgattgacgtatttatccaactagaaagttactcatgccctcatccaaaaatgtggtagaggccagattagtgctggtaggaataagagatataacctttggctttggaaccacaagcattagcagtctccatgttctttaaagacttggtgatattggtatttaggctggacaccatgcaaagactacacaggctcggttcctgcatgcagagaagttatctaagagatatgaccaggccggaatagaatgctcagaccacgtggaggctgttaaacttttacataatctagggaaagaagggacacaaggtggcattagtctagggtcaggtgggaaaaggttatgctgaaaagtctctgcagctcaggacagctttgtgcaaagaactgaagttcacagctgctagtgcctgggagatcaaatagtataaatgagggcagacaaccctgaggggcagatggagctttccagacaatcttggcatgaggatgagtgagtttcaaatcagtcctgccgaggcagatggcttcctccagctctgcttactgaatgcgaagtcacagtcagtaagaaaactggttttcttcttcccaggcgctgccccatacctgaagaccaagtttatctgtgtgacaccattcattgatgcagtttggaaataatggtgaaggtgctgaaccctcagcaggagggcagtttgagtccctcacctttgacatggagttgacctcggagtgcgctacctcccccatgtgaggagctgagaacggaagctgcagaaagatacgactgaggcgcctacctgcattctgccacccctcacacagccaaaccccagatcatctgaaactactaactttgtggttccagattttttttaatctcctacttctgctatctttgagcaatctgggcacttttaaaaatagagaaatgagtgaatgtgggtgatctgcttttatctaaatgcaaataaggatgtgttctctgagacccatgatcaggggatgtggcggggggtggctagagggagaaaaaggaaatgtcttgtgttgttttgttcccctgccctcctttctcagcagctttttgttattgttgttgttgttcttagacaagtgcctcctggtgcctgcggcatccttctgcctgtttctgtaagcaaatgccacaggccacctatagctacatactcctggcattgcactttttaaccttgctgacatccaaatagaagataggactatctaagccctaggtttctttttaaattaagaaataataacaattaaagggcaaaaaacactgtatcagcatagcctttctgtatttaagaaacttaagcagccgggcatggtggctcacgcctgtaatcccagcactttgggaggccgaggcggatcataaggtcaggagatcaagaccatcctggctaacacggtgaaaccccgtctctactaaaagtacaaaaaattagctgggtgtggtggtgggcgcctgtagtcccagctactcgggaggctgaggcaggagaatcgcttgaacctgagaggcggaggttgcagtgagccaaaattgcaccactgcacactgcactccatcctgggcgacagtctgagactctgtctcaaaaaaaaaaaaaaaaaaaagaaacttcagttaacagcctccttggtgctttaagcattcagcttccttcaggctggtaatttatataatccctgaaacgggcttcaggtcaaacccttaagacatctgaagctgcaacctggcctttggtgttgaaataggaaggtttaaggagaatctaagcattttagacttttttttataaatagacttattttcctttgtaatgtattggccttttagtgagtaaggctgggcagagggtgcttacaaccttgactccctttctccctggacttgatctgctgtttca

SEQ ID NO: 295102 - DNA, 1978 bp, Homo sapiens
ccaaaggatccccgctcgtgcagatatcagcgaggactgagcatcgagcagctgactacactggcagagaaactcttgggacctggtgtgaattattcagggtgtcagatcacatgggctaaattttgcaaagaaaacatggctggcaagggcttctccttctgggtctggctggacaatatcattgaccttgtgaaaaagtacatcctggccctttggaacgaagggtacatcatgggctttatcagtaaggagcgggagcgggccatcttgagcactaagcctccaggcaccttcctgctaagattcagtgaaagcagcaaagaaggaggcgtcactttcacttgggtggagaaggacatcagcggtaagacccagatccagtccgtggaaccatacacaaagcagcagctgaacaacatgtcatttgctgaaatcatcatgggctataagatcatggatgctaccaatatcctggtgtctccactggtctatctctatcctgacattcccaaggaggaggcattcggaaagtattgtcggccagagagccaggagcatcctgaagctgacccaggtagcgctgccccatacctgaagaccaagtttatctgtgtgacaccaacgacctgcagcaataccattgacctgccgatgtccccccgcactttagattcattgatgcagtttggaaataatggtgaaggtgctgaaccctcagcaggagggcagtttgagtccctcacctttgacatggagttgacctcggagtgcgctacctcccccatgtgaggagctgagaacggaagctgcagaaagatacgactgaggcgcctacctgcattctgccacccctcacacagccaaaccccagatcatctgaaactactaactttgtggttccagattttttttaatctcctacttctgctatctttgagcaatctgggcacttttaaaaatagagaaatgagtgaatgtgggtgatctgcttttatctaaatgcaaataaggatgtgttctctgagacccatgatcaggggatgtggcggggggtggctagagggagaaaaaggaaatgtcttgtgttgttttgttcccctgccctcctttctcagcagctttttgttattgttgttgttgttcttagacaagtgcctcctggtgcctgcggcatccttctgcctgtttctgtaagcaaatgccacaggccacctatagctacatactcctggcattgcactttttaaccttgctgacatccaaatagaagataggactatctaagccctaggtttctttttaaattaagaaataataacaattaaagggcaaaaaacactgtatcagcatagcctttctgtatttaagaaacttaagcagccgggcatggtggctcacgcctgtaatcccagcactttgggaggccgaggcggatcataaggtcaggagatcaagaccatcctggctaacacggtgaaaccccgtctctactaaaagtacaaaaaattagctgggtgtggtggtgggcgcctgtagtcccagctactcgggaggctgaggcaggagaatcgcttgaacctgagaggcggaggttgcagtgagccaaaattgcaccactgcacactgcactccatcctgggcgacagtctgagactctgtctcaaaaaaaaaaaaaaaaaaaagaaacttcagttaacagcctccttggtgctttaagcattcagcttccttcaggctggtaatttatataatccctgaaacgggcttcaggtcaaacccttaagacatctgaagctgcaacctggcctttggtgttgaaataggaaggtttaaggagaatctaagcattttagacttttttttataaatagacttattttcctttgtaatgtattggccttttagtgagtaaggctgggcagagggtgcttacaaccttgactccctttctccctggacttgatctgctgtttca

SEQ ID NO: 295103 - DNA, 1984 bp, Homo sapiens
  misc_feature (8)..(8): n is a, c, g, or t
  misc_feature (32)..(33): n is a, c, g, or t
  misc_feature (35)..(35): n is a, c, g, or t
aacacctnggctaggtacgaggctgggtgttnnantcggccgagggagcatcgagcagctgactacactggcagagaaactctgggacctggtgtgaattattcagggtgtcagatcacatgggctaaattttgcaaagaaaacatggctggcaagggcttctccttctgggtctggctggacaatatcattgaccttgtgaaaaagtacatcctggccctttggaacgaagggtacatcatgggctttatcagtaaggagcgggagcgggccatcttgagcactaagcctccaggcaccttcctgctaagattcagtgaaagcagcaaagaaggaggcgtcactttcacttgggtggagaaggacatcagcggtaagacccagatccagtccgtggaaccatacacaaagcagcagctgaacaacatgtcatttgctgaaatcatcatgggctataagatcatggatgctaccaatatcctggtgtctccactggtctatctctatcctgacattcccaaggaggaggcattcggaaagtattgtcggccagagagccaggagcatcctgaagctgacccaggtagcgctgccccatacctgaagaccaagtttatctgtgtgacaccaacgacctgcagcaataccattgacctgccgatgtccccccgcactttagattcattgatgcagtttggaaataatggtgaaggtgctgaaccctcagcaggagggcagtttgagtccctcacctttgacatggagttgacctcggagtgcgctacctcccccatgtgaggagctgagaacggaagctgcagaaagatacgactgaggcgcctacctgcattctgccacccctcacacagccaaaccccagatcatctgaaactactaactttgtggttccagattttttttaatctcctacttctgctatctttgagcaatctgggcacttttaaaaatagagaaatgagtgaatgtgggtgatctgcttttatctaaatgcaaataaggatgtgttctctgagacccatgatcaggggatgtggcggggggtggctagagggagaaaaaggaaatgtcttgtgttgttttgttcccctgccctcctttctcagcagctttttgttattgttgttgttgttcttagacaagtgcctcctggtgcctgcggcatccttctgcctgtttctgtaagcaaatgccacaggccacctatagctacatactcctggcattgcactttttaaccttgctgacatccaaatagaagataggactatctaagccctaggtttctttttaaattaagaaataataacaattaaagggcaaaaaacactgtatcagcatagcctttctgtatttaagaaacttaagcagccgggcatggtggctcacgcctgtaatcccagcactttgggaggccgaggcggatcataaggtcaggagatcaagaccatcctggctaacacggtgaaaccccgtctctactaaaagtacaaaaaattagctgggtgtggtggtgggcgcctgtagtcccagctactcgggaggctgaggcaggagaatcgcttgaacctgagaggcggaggttgcagtgagccaaaattgcaccactgcacactgcactccatcctgggcgacagtctgagactctgtctcaaaaaaaaaaaaaaaaaaaagaaacttcagttaacagcctccttggtgctttaagcattcagcttccttcaggctggtaatttatataatccctgaaacgggcttcaggtcaaacccttaagacatctgaagctgcaacctggcctttggtgttgaaataggaaggtttaaggagaatctaagcattttagacttttttttataaatagacttattttcctttgtaatgtattggccttttagtgagtaaggctgggcagagggtgcttacaaccttgactccctttctccctggacttgatctgctgtttca

SEQ ID NO: 295104 - DNA, 2675 bp, Homo sapiens
gtaattcagcggtttccggagctgcggcggcgcagactgggagggggagccgggggttccgacgtcgcagccgagggaacaagccccaaccggatcctggacaggcaccccggcttggcgctgtctctccccctcggctcggagaggcccttcggcctgagggagcctcgccgcccgtccccggcacacgcgcagccccggcctctcggcctctgccggagaaacaggatggcccaatggaatcagctacagcagcttgacacacggtacctggagcagctccatcagctctacagtgacagcttcccaatggagctgcggcagtttctggccccttggattgagagtcaagattgggcatatgcggccagcaaagaatcacatgccactttggtgtttcataatctcctgggagagattgaccagcagtatagccgcttcctgcaagagtcgaatgttctctatcagcacaatctacgaagaatcaagcagtttcttcagagcaggtatcttgagaagccaatggagattgcccggattgtggcccggtgcctgtgggaagaatcacgccttctacagactgcagccactgcggcccagcaagggggccaggccaaccaccccacagcagccgtggtgacggagaagcagcagatgctggagcagcaccttcaggatgtccggaagagagtgcaggatctagaacagaaaatgaaagtggtagagaatctccaggatgactttgatttcaactataaaaccctcaagagtcaaggagacatgcaagatctgaatggaaacaaccagtcagtgaccaggcagaagatgcagcagctggaacagatgctcactgcgctggaccagatgcggagaagcatcgtgagtgagctggcggggcttttgtcagcgatggagtacgtgcagaaaactctcacggacgaggagctggctgactggaagaggcggcaacagattgcctgcattggaggcccgcccaacatctgcctagatcggctagaaaactggataacgtcattagcagaatctcaacttcagacccgtcaacaaattaagaaactggaggagttgcagcaaaaagtttcctacaaaggggaccccattgtacagcaccggccgatgctggaggagagaatcgtggagctgtttagaaacttaatgaaaagtgcctttgtggtggagcggcagccctgcatgcccatgcatcctgaccggcccctcgtcatcaagaccggcgtccagttcactactaaagtcaggttgctggtcaaattccctgagttgaattatcagcttaaaattaaagtgtgcattgacaaagactctggggacgttgcagctctcagaggatcccggaaatttaacattctgggcacaaacacaaaagtgatgaacatggaagaatccaacaacggcagcctctctgcagaattcaaacacttgaccctgagggagcagagatgtgggaatgggggccgagccaattgtgatgcttccctgattgtgactgaggagctgcacctgatcacctttgagaccgaggtgtatcaccaaggcctcaagattgacctagagacccactccttgccagttgtggtgatctccaacatctgtcagatgccaaatgcctgggcgtccatcctgtggtacaacatgctgaccaacaatcccaagaatgtaaacttttttaccaagcccccaattggaacctgggatcaagtggccgaggtcctgagctggcagttctcctccaccaccaagcgaggactgagcatcgagcagctgactacactggcagagaaactcttgggacctggtgtgaattattcagggtgtcagatcacatgggctaaattttgcaaagaaaacatggctggcaagggcttctccttctgggtctggctggacaatatcattgaccttgtgaaaaagtacatcctggccctttggaacgaagggtacatcatgggctttatcagtaaggagcgggagcgggccatcttgagcactaagcctccaggcaccttcctgctaagattcagtgaaagcagcaaagaaggaggcgtcactttcacttgggtggagaaggacatcagcggtaagacccagatccagtccgtggaaccatacacaaagcagcagctgaacaacatgtcatttgctgaaatcatcatgggctataagatcatggatgctaccaatatcctggtgtctccactggtctatctctatcctgacattcccaaggaggaggcattcggaaagtattgtcggccagagagccaggagcatcctgaagctgacccaggtagcgctgccccatacctgaagaccaagtttatctgtgtgacaccattcattgatgcagtttggaaataatggtgaaggtgctgaaccctcagcaggagggcagtttgagtccctcacctttgacatggagttgacctcggagtgcgctacctcccccatgtgaggagctgagaacggaagctgcagaaagatacgactgaggcgcctacctgcattctgccacccctcacacagccaaaccccagatcatctgaaactactaactttgtggttccagattttttttaatctcctacttctgctatctttgagcaatctgggcacttttaaaaatagagaaatgagtg

SEQ ID NO: 295105 - DNA, 2433 bp, Homo sapiens
acgacccagacaggtggtgctttcctatagtccctcttggaaaactgaggtgagaggatttcttgagcccaggagttcaagcccagcctgggcaacatagcaagacctccctgccccaatctgtacaaacagattttttaaaatagctggcatggtggtgccacctgtagtcccagctgcttgggagcctaaggcaggagaatcgttttgacctgggagtaggaggttgcggtaaccgagattgtgccactgcacttgagcctgggcaacagagtgagactctgtctcaaaacaataagaacaacagcaacaaaagagagagaccatgccttgctccaggtctcttagctattgaagatgtacctggacccaggtctccggtcttctagttgaagcaattgtactgccttacaaagtcacattctctttggtgctttttgattgacgtatttatccaactagaaagttactcatgccctcatccaaaaatgtggtagaggccagattagtgctggtaggaataagagatataacctttggctttggaaccacaagcattagcagtctccatgttctttaaagacttggtgatattggtatttaggctggacaccatgcaaagactacacaggctcggttcctgcatgcagagaagttatctaagagatatgaccaggccggaatagaatgctcagaccacgtggaggctgttaaacttttacataatctagggaaagaagggacacaaggtggcattagtctagggtcaggtgggaaaaggttatgctgaaaagtctctgcagctcaggacagctttgtgcaaagaactgaagttcacagctgctagtgcctgggagatcaaatagtataaatgagggcagacaaccctgaggggcagatggagctttccagacaatcttggcatgaggatgagtgagtttcaaatcagtcctgccgaggcagatggcttcctccagctctgcttactgaatgcgaagtcacagtcagtaagaaaactggttttcttcttcccaggcgctgccccatacctgaagaccaagtttatctgtgtgacaccaacgacctgcagcaataccattgacctgccgatgtccccccgcactttagattcattgatgcagtttggaaataatggtgaaggtgctgaaccctcagcaggagggcagtttgagtccctcacctttgacatggagttgacctcggagtgcgctacctcccccatgtgaggagctgagaacggaagctgcagaaagatacgactgaggcgcctacctgcattctgccacccctcacacagccaaaccccagatcatctgaaactactaactttgtggttccagattttttttaatctcctacttctgctatctttgagcaatctgggcacttttaaaaatagagaaatgagtgaatgtgggtgatctgcttttatctaaatgcaaataaggatgtgttctctgagacccatgatcaggggatgtggcggggggtggctagagggagaaaaaggaaatgtcttgtgttgttttgttcccctgccctcctttctcagcagctttttgttattgttgttgttgttcttagacaagtgcctcctggtgcctgcggcatccttctgcctgtttctgtaagcaaatgccacaggccacctatagctacatactcctggcattgcactttttaaccttgctgacatccaaatagaagataggactatctaagccctaggtttctttttaaattaagaaataataacaattaaagggcaaaaaacactgtatcagcatagcctttctgtatttaagaaacttaagcagccgggcatggtggctcacgcctgtaatcccagcactttgggaggccgaggcggatcataaggtcaggagatcaagaccatcctggctaacacggtgaaaccccgtctctactaaaagtacaaaaaattagctgggtgtggtggtgggcgcctgtagtcccagctactcgggaggctgaggcaggagaatcgcttgaacctgagaggcggaggttgcagtgagccaaaattgcaccactgcacactgcactccatcctgggcgacagtctgagactctgtctcaaaaaaaaaaaaaaaaaaaagaaacttcagttaacagcctccttggtgctttaagcattcagcttccttcaggctggtaatttatataatccctgaaacgggcttcaggtcaaacccttaagacatctgaagctgcaacctggcctttggtgttgaaataggaaggtttaaggagaatctaagcattttagacttttttttataaatagacttattttcctttgtaatgtattggccttttagtgagtaaggctgggcagagggtgcttacaaccttgactccctttctccctggacttgatctgctgtttca

SEQ ID NO: 295106 - DNA, 1540 bp, Homo sapiens
tggaagcccctgggctatgtttagtactcaaagtgaccttgtgtgtttaaaaagcttgagcttttatttttctgttggagaccagagtttgatggcttgtgtgtgtgtgttttgttcttttttttttttccattgtgtcttgtcaaccccccgtttcccctcctgctgccccccatttcctacagaacgacctgcagcaataccattgacctgccgatgtccccccgcactttagattcattgatgcagtttggaaataatggtgaaggtgctgaaccctcagcaggagggcagtttgagtccctcacctttgacatggagttgacctcggagtgcgctacctcccccatgtgaggagctgagaacggaagctgcagaaagatacgactgaggcgcctacctgcattctgccacccctcacacagccaaaccccagatcatctgaaactactaactttgtggttccagattttttttaatctcctacttctgctatctttgagcaatctgggcacttttaaaaatagagaaatgagtgaatgtgggtgatctgcttttatctaaatgcaaataaggatgtgttctctgagacccatgatcaggggatgtggcggggggtggctagagggagaaaaaggaaatgtcttgtgttgttttgttcccctgccctcctttctcagcagctttttgttattgttgttgttgttcttagacaagtgcctcctggtgcctgcggcatccttctgcctgtttctgtaagcaaatgccacaggccacctatagctacatactcctggcattgcactttttaaccttgctgacatccaaatagaagataggactatctaagccctaggtttctttttaaattaagaaataataacaattaaagggcaaaaaacactgtatcagcatagcctttctgtatttaagaaacttaagcagccgggcatggtggctcacgcctgtaatcccagcactttgggaggccgaggcggatcataaggtcaggagatcaagaccatcctggctaacacggtgaaaccccgtctctactaaaagtacaaaaaattagctgggtgtggtggtgggcgcctgtagtcccagctactcgggaggctgaggcaggagaatcgcttgaacctgagaggcggaggttgcagtgagccaaaattgcaccactgcacactgcactccatcctgggcgacagtctgagactctgtctcaaaaaaaaaaaaaaaaaaaagaaacttcagttaacagcctccttggtgctttaagcattcagcttccttcaggctggtaatttatataatccctgaaacgggcttcaggtcaaacccttaagacatctgaagctgcaacctggcctttggtgttgaaataggaaggtttaaggagaatctaagcattttagacttttttttataaatagacttattttcctttgtaatgtattggccttttagtgagtaaggctgggcagagggtgcttacaaccttgactccctttctccctggacttgatctgctgtttca

SEQ ID NO: 295107 - DNA, 1384 bp, Homo sapiens
atacggctgtacatctgtgtacacgttgaaacgacctgcagcaataccattgacctgccgatgtccccccgcactttagattcattgatgcagtttggaaataatggtgaaggtgctgaaccctcagcaggagggcagtttgagtccctcacctttgacatggagttgacctcggagtgcgctacctcccccatgtgaggagctgagaacggaagctgcagaaagatacgactgaggcgcctacctgcattctgccacccctcacacagccaaaccccagatcatctgaaactactaactttgtggttccagattttttttaatctcctacttctgctatctttgagcaatctgggcacttttaaaaatagagaaatgagtgaatgtgggtgatctgcttttatctaaatgcaaataaggatgtgttctctgagacccatgatcaggggatgtggcggggggtggctagagggagaaaaaggaaatgtcttgtgttgttttgttcccctgccctcctttctcagcagctttttgttattgttgttgttgttcttagacaagtgcctcctggtgcctgcggcatccttctgcctgtttctgtaagcaaatgccacaggccacctatagctacatactcctggcattgcactttttaaccttgctgacatccaaatagaagataggactatctaagccctaggtttctttttaaattaagaaataataacaattaaagggcaaaaaacactgtatcagcatagcctttctgtatttaagaaacttaagcagccgggcatggtggctcacgcctgtaatcccagcactttgggaggccgaggcggatcataaggtcaggagatcaagaccatcctggctaacacggtgaaaccccgtctctactaaaagtacaaaaaattagctgggtgtggtggtgggcgcctgtagtcccagctactcgggaggctgaggcaggagaatcgcttgaacctgagaggcggaggttgcagtgagccaaaattgcaccactgcacactgcactccatcctgggcgacagtctgagactctgtctcaaaaaaaaaaaaaaaaaaaagaaacttcagttaacagcctccttggtgctttaagcattcagcttccttcaggctggtaatttatataatccctgaaacgggcttcaggtcaaacccttaagacatctgaagctgcaacctggcctttggtgttgaaataggaaggtttaaggagaatctaagcattttagacttttttttataaatagacttattttcctttgtaatgtattggccttttagtgagtaaggctgggcagagggtgcttacaaccttgactccctttctccctggacttgatctgctgtttca

SEQ ID NO: 295108 - DNA, 1388 bp, Homo sapiens
gagctcggtacccgatctgactacgcggctaccaacgacctgcagcaataccattgacctgccgatgtccccccgcactttagattcattgatgcagtttggaaataatggtgaaggtgctgaaccctcagcaggagggcagtttgagtccctcacctttgacatggagttgacctcggagtgcgctacctcccccatgtgaggagctgagaacggaagctgcagaaagatacgactgaggcgcctacctgcattctgccacccctcacacagccaaaccccagatcatctgaaactactaactttgtggttccagattttttttaatctcctacttctgctatctttgagcaatctgggcacttttaaaaatagagaaatgagtgaatgtgggtgatctgcttttatctaaatgcaaataaggatgtgttctctgagacccatgatcaggggatgtggcggggggtggctagagggagaaaaaggaaatgtcttgtgttgttttgttcccctgccctcctttctcagcagctttttgttattgttgttgttgttcttagacaagtgcctcctggtgcctgcggcatccttctgcctgtttctgtaagcaaatgccacaggccacctatagctacatactcctggcattgcactttttaaccttgctgacatccaaatagaagataggactatctaagccctaggtttctttttaaattaagaaataataacaattaaagggcaaaaaacactgtatcagcatagcctttctgtatttaagaaacttaagcagccgggcatggtggctcacgcctgtaatcccagcactttgggaggccgaggcggatcataaggtcaggagatcaagaccatcctggctaacacggtgaaaccccgtctctactaaaagtacaaaaaattagctgggtgtggtggtgggcgcctgtagtcccagctactcgggaggctgaggcaggagaatcgcttgaacctgagaggcggaggttgcagtgagccaaaattgcaccactgcacactgcactccatcctgggcgacagtctgagactctgtctcaaaaaaaaaaaaaaaaaaaagaaacttcagttaacagcctccttggtgctttaagcattcagcttccttcaggctggtaatttatataatccctgaaacgggcttcaggtcaaacccttaagacatctgaagctgcaacctggcctttggtgttgaaataggaaggtttaaggagaatctaagcattttagacttttttttataaatagacttattttcctttgtaatgtattggccttttagtgagtaaggctgggcagagggtgcttacaaccttgactccctttctccctggacttgatctgctgtttca

SEQ ID NO: 295109 - DNA, 1203 bp, Homo sapiens
gcggccgcctactattactaaattcgcggccgcgtcgacgaaagatacgactgaggcgcctacctgcattctgccacccctcacacagccaaaccccagatcatctgaaactactaactttgtggttccagattttttttaatctcctacttctgctatctttgagcaatctgggcacttttaaaaatagagaaatgagtgaatgtgggtgatctgcttttatctaaatgcaaataaggatgtgttctctgagacccatgatcaggggatgtggcggggggtggctagagggagaaaaaggaaatgtcttgtgttgttttgttcccctgccctcctttctcagcagctttttgttattgttgttgttgttcttagacaagtgcctcctggtgcctgcggcatccttctgcctgtttctgtaagcaaatgccacaggccacctatagctacatactcctggcattgcactttttaaccttgctgacatccaaatagaagataggactatctaagccctaggtttctttttaaattaagaaataataacaattaaagggcaaaaaacactgtatcagcatagcctttctgtatttaagaaacttaagcagccgggcatggtggctcacgcctgtaatcccagcactttgggaggccgaggcggatcataaggtcaggagatcaagaccatcctggctaacacggtgaaaccccgtctctactaaaagtacaaaaaattagctgggtgtggtggtgggcgcctgtagtcccagctactcgggaggctgaggcaggagaatcgcttgaacctgagaggcggaggttgcagtgagccaaaattgcaccactgcacactgcactccatcctgggcgacagtctgagactctgtctcaaaaaaaaaaaaaaaaaaaagaaacttcagttaacagcctccttggtgctttaagcattcagcttccttcaggctggtaatttatataatccctgaaacgggcttcaggtcaaacccttaagacatctgaagctgcaacctggcctttggtgttgaaataggaaggtttaaggagaatctaagcattttagacttttttttataaatagacttattttcctttgtaatgtattggccttttagtgagtaaggctgggcagagggtgcttacaaccttgactccctttctccctggacttgatctgctgtttca

SEQ ID NO: 295110 - DNA, 1433 bp, Homo sapiens
gagacagagtcttgctctgttgccaggctggagtgcagtggcgtgatctcagctcactgcaacttctgcctcccaggttcaagctattcccctgcctcagcctcccaagtagctgggactacaggcgcgcgccaccacacccagctaattttttgtgtttttagtagagatggggtttcactgtgttagccaggatggtctcgatctcttgacctcgtgatccgcccgcctcggcctcccaaagtgctgggattacaggcgtgagcaaccaaagatacgactgaggcgcctacctgcattctgccacccctcacacagccaaaccccagatcatctgaaactactaactttgtggttccagattttttttaatctcctacttctgctatctttgagcaatctgggcacttttaaaaatagagaaatgagtgaatgtgggtgatctgcttttatctaaatgcaaataaggatgtgttctctgagacccatgatcaggggatgtggcggggggtggctagagggagaaaaaggaaatgtcttgtgttgttttgttcccctgccctcctttctcagcagctttttgttattgttgttgttgttcttagacaagtgcctcctggtgcctgcggcatccttctgcctgtttctgtaagcaaatgccacaggccacctatagctacatactcctggcattgcactttttaaccttgctgacatccaaatagaagataggactatctaagccctaggtttctttttaaattaagaaataataacaattaaagggcaaaaaacactgtatcagcatagcctttctgtatttaagaaacttaagcagccgggcatggtggctcacgcctgtaatcccagcactttgggaggccgaggcggatcataaggtcaggagatcaagaccatcctggctaacacggtgaaaccccgtctctactaaaagtacaaaaaattagctgggtgtggtggtgggcgcctgtagtcccagctactcgggaggctgaggcaggagaatcgcttgaacctgagaggcggaggttgcagtgagccaaaattgcaccactgcacactgcactccatcctgggcgacagtctgagactctgtctcaaaaaaaaaaaaaaaaaaaagaaacttcagttaacagcctccttggtgctttaagcattcagcttccttcaggctggtaatttatataatccctgaaacgggcttcaggtcaaacccttaagacatctgaagctgcaacctggcctttggtgttgaaataggaaggtttaaggagaatctaagcattttagacttttttttataaatagacttattttcctttgtaatgtattggccttttagtgagtaaggctgggcagagggtgcttacaaccttgactccctttctccctggacttgatctgctgtttca

SEQ ID NO: 295111 - DNA, 1459 bp, Homo sapiens
gtaattcagcggtttccggagctgcggcggcgcagactgggagggggagccgggggttccgacgtcgcagccgagggaacaagccccaaccggatcctggacaggcaccccggcttggcgctgtctctccccctcggctcggagaggcccttcggcctgagggagcctcgccgcccgtccccggcacacgcgcagccccggcctctcggcctctgccggagaaacaggatggcccaatggaatcagctacagcagcttgacacacggtacctggagcagctccatcagctctacagtgacagcttcccaatggagctgcggcagtttctggccccttggattgagagtcaagattgggcatatgcggccagcaaagaatcacatgccactttggtgtttcataatctcctgggagagattgaccagcagtatagccgcttcctgcaagagtcgaatgttctctatcagcacaatctacgaagaatcaagcagtttcttcagagcaggtatcttgagaagccaatggagattgcccggattgtggcccggtgcctgtgggaagaatcacgccttctacagactgcagccactgcggcccagcaagggggccaggccaaccaccccacagcagccgtggtgacggagaagcagcagatgctggagcagcaccttcaggatgtccggaagagagtgcaggatctagaacagaaaatgaaagtggtagagaatctccaggatgactttgatttcaactataaaaccctcaagagtcaaggagacatgcaagatctgaatggaaacaaccagtcagtgaccaggcagaagatgcagcagctggaacagatgctcactgcgctggaccagatgcggagaagcatcgtgagtgagctggcggggcttttgtcagcgatggagtacgtgcagaaaactctcacggacgaggagctggctgactggaagaggcggcaacagattgcctgcattggaggcccgcccaacatctgcctagatcggctagaaaactggataacgtcattagcagaatctcaacttcagacccgtcaacaaattaagaaactggaggagttgcagcaaaaagtttcctacaaaggggaccccattgtacagcaccggccgatgctggaggagagaatcgtggagctgtttagaaacttaatgaaaagtgcctttgtggtggagcggcagccctgcatgcccatgcatcctgaccggcccctcgtcatcaagaccggcgtccagttcactactaaagtcaggttgctggtcaaattccctgagttgaattatcagcttaaaattaaagtgtgcattgacaaagactctggggacgttgcagctctcagagggtaagttcagcctagaggcttccttttgttccgtttaacctaacttcatcctccggctacttggtcacctacataagtgattgttccccgct

SEQ ID NO: 295112 - DNA, 746 bp, Homo sapiens
gtaattcagcggtttccggagctgcggcggcgcagactgggagggggagccgggggttccgacgtcgcagccgagggaacaagccccaaccggatcctggacaggcaccccggcttggcgctgtctctccccctcggctcggagaggcccttcggcctgagggagcctcgccgcccgtccccggcacacgcgcagccccggcctctcggcctctgccggagaaacaggatggcccaatggaatcagctacagcagcttgacacacggtacctggagcagctccatcagctctacagtgacagcttcccaatggagctgcggcagtttctggccccttggattgagagtcaagattgggcatatgcggccagcaaagaatcacatgccactttggtgtttcataatctcctgggagagattgaccagcagtatagccgcttcctgcaagagtcgaatgttctctatcagcacaatctacgaagaatcaagcagtttcttcagagcaggtatcttgagaagccaatggagattgcccggattgtggcccggtgcctgtgggaagaatcacgccttctacagactgcagccactgcggcccaggtgagacctgagacaaaacaaatccctggtctgggaggaatggaaaatcaaacaactttataatgagataaattattagatctactaaaaaagaaggaaaagaaattaaatagatcaataatcataaaaatacattgaaaaactct

SEQ ID NO: 295113 - DNA, 314 bp, Homo sapiens
ggatgaatgtgtgtgtgttctgttttaagaaataacctcttgaccccaagctgaaaatgtactacttgactctttttctttccttcaggacctggtgtgaattattcagggtgtcagatcacatgggctaaattttgcaaagtaagcaatcttgttaaattctcgtgggaatgggaatgctcacctgcacggctgtcgttgagggctctggcttgaaggccctgaactcttggtccagcggccagtaggacctgcctgaaggtagacgggcctgaggatttgggtgatgcactgcacccctaggaagggaaggg

SEQ ID NO: 295114 - DNA, 659 bp, Homo sapiens
gcctcttcttaattagaagccagcctgaatatttccacagtgccaggccactgaacagggtgttcagggtctcaacactagggtggcttaagtcttttccccttcgaggaaagaaaaaatgggcagttttctctgagatgacctagctgtaggttccatgatctttccttcccatgtcctgtgacaggtaagacccagatccagtccgtggaaccatacacaaagcagcagctgaacaacatgtcatttgctgaaatcatcatgggctataagatcatggatgctaccaatatcctggtgtctccactggtctatctctatcctgacattcccaaggaggaggcattcggaaagtattgtcggccagagagccaggagcatcctgaagctgacccaggtagttgttgattttccatgttcctggcatttaatttttgggaaaagttggaaattttgggatccttggaggatagataggcaaatgcctgaataacctgggggataattatttctccttatgggaaagaattgtagtgagtgcttttgttggggtgaccgatgggatttgagaggagaatcagaatcacttagagtagtgtagttcctgctccacagagagtgcatgagtctaaagaggggatacagcctgggcaatatgg

SEQ ID NO: 295115 - DNA, 754 bp, Homo sapiens
gggggtctccctgtgttgtccaggctgatcatgaactcctgggctcaagtgatcctcccaactcagcctctcaaagtgctggcattacaggcgtgagccactgcacctggccaacagggagccttctcttggggatactgcctgcaggtcctgcatgtatcttttttgaggttttggcttcatttgaattctcctcagaaactttatattttctgttcccaaggaaatctttctttacttctgtttttttgtttgcttattttaaacaggatctagaacagaaaatgaaagtggtagagaatctccaggatgactttgatttcaactataaaaccctcaagagtcaaggaggcaagtgaatattagagatgttaaaatctctagaaagtgagtttgtgttgttgagttgaaagactcatttgtcttaactctgtttagatcttaaggcgggcggggcgcaagggaggtacgggtcctcaaaggagcctggtcattaaggacaggagtattccctcaggtccaggagtattccctcaggtccaggagtattccctcaggtcaaggagtattccctcaggtcaaggagtattccctcaggtccaggagtattccctcaggtccaggagtattccctcaggtccaggagtattccctcaggtccaggagtattccctcaggtccaggagtattccctcaggtcaaggagtattccctcaggtccaggagtattccctcaggtccaggagtattccct

SEQ ID NO: 295116 - DNA, 1642 bp, Homo sapiens
gttacccagcacttgggtgcgaaggttagcggtaagacccagatccagtccgtggaaccatacacaaagcagcagctgaacaacatgtcatttgctgaaatcatcatgggctataagatcatggatgctaccaatatcctggtgtctccactggtctatctctatcctgacattcccaaggaggaggcattcggaaagtattgtcggccagagagccaggagcatcctgaagctgacccaggtagcgctgccccatacctgaagaccaagtttatctgtgtgacaccaacgacctgcagcaataccattgacctgccgatgtccccccgcactttagattcattgatgcagtttggaaataatggtgaaggtgctgaaccctcagcaggagggcagtttgagtccctcacctttgacatggagttgacctcggagtgcgctacctcccccatgtgaggagctgagaacggaagctgcagaaagatacgactgaggcgcctacctgcattctgccacccctcacacagccaaaccccagatcatctgaaactactaactttgtggttccagattttttttaatctcctacttctgctatctttgagcaatctgggcacttttaaaaatagagaaatgagtgaatgtgggtgatctgcttttatctaaatgcaaataaggatgtgttctctgagacccatgatcaggggatgtggcggggggtggctagagggagaaaaaggaaatgtcttgtgttgttttgttcccctgccctcctttctcagcagctttttgttattgttgttgttgttcttagacaagtgcctcctggtgcctgcggcatccttctgcctgtttctgtaagcaaatgccacaggccacctatagctacatactcctggcattgcactttttaaccttgctgacatccaaatagaagataggactatctaagccctaggtttctttttaaattaagaaataataacaattaaagggcaaaaaacactgtatcagcatagcctttctgtatttaagaaacttaagcagccgggcatggtggctcacgcctgtaatcccagcactttgggaggccgaggcggatcataaggtcaggagatcaagaccatcctggctaacacggtgaaaccccgtctctactaaaagtacaaaaaattagctgggtgtggtggtgggcgcctgtagtcccagctactcgggaggctgaggcaggagaatcgcttgaacctgagaggcggaggttgcagtgagccaaaattgcaccactgcacactgcactccatcctgggcgacagtctgagactctgtctcaaaaaaaaaaaaaaaaaaaagaaacttcagttaacagcctccttggtgctttaagcattcagcttccttcaggctggtaatttatataatccctgaaacgggcttcaggtcaaacccttaagacatctgaagctgcaacctggcctttggtgttgaaataggaaggtttaaggagaatctaagcattttagacttttttttataaatagacttattttcctttgtaatgtattggccttttagtgagtaaggctgggcagagggtgcttacaaccttgactccctttctccctggacttgatctgctgtttca

SEQ ID NO: 295117 - DNA, 1645 bp, Homo sapiens
gtaattcagcggtttccggagctgcggcggcgcagactgggagggggagccgggggttccgacgtcgcagccgagggaacaagccccaaccggatcctggacaggcaccccggcttggcgctgtctctccccctcggctcggagaggcccttcggcctgagggagcctcgccgcccgtccccggcacacgcgcagccccggcctctcggcctctgccggagaaacaggatggcccaatggaatcagctacagcagcttgacacacggtacctggagcagctccatcagctctacagtgacagcttcccaatggagctgcggcagtttctggccccttggattgagagtcaagattgggcatatgcggccagcaaagaatcacatgccactttggtgtttcataatctcctgggagagattgaccagcagtatagccgcttcctgcaagagtcgaatgttctctatcagcacaatctacgaagaatcaagcagtttcttcagagcaggtatcttgagaagccaatggagattgcccggattgtggcccggtgcctgtgggaagaatcacgccttctacagactgcagccactgcggcccagcaagggggccaggccaaccaccccacagcagccgtggtgacggagaagcagcagatgctggagcagcaccttcaggatgtccggaagagagtgcaggatctagaacagaaaatgaaagtggtagagaatctccaggatgactttgatttcaactataaaaccctcaagagtcaaggagacatgcaagatctgaatggaaacaaccagtcagtgaccaggcagaagatgcagcagctggaacagatgctcactgcgctggaccagatgcggagaagcatcgtgagtgagctggcggggcttttgtcagcgatggagtacgtgcagaaaactctcacggacgaggagctggctgactggaagaggcggcaacagattgcctgcattggaggcccgcccaacatctgcctagatcggctagaaaactggataacgtcattagcagaatctcaacttcagacccgtcaacaaattaagaaactggaggagttgcagcaaaaagtttcctacaaaggggaccccattgtacagcaccggccgatgctggaggagagaatcgtggagctgtttagaaacttaatgaaaagtgcctttgtggtggagcggcagccctgcatgcccatgcatcctgaccggcccctcgtcatcaagaccggcgtccagttcactactaaagtcaggttgctggtcaaattccctgagttgaattatcagcttaaaattaaagtgtgcattgacaaagactctggggacgttgcagctctcagaggatcccggaaatttaacattctgggcacaaacacaaaagtgatgaacatggaagaatccaacaacggcagcctctctgcagaattcaaacacttgaccctgagggagcagagatgtgggaatgggggccgagccaattgtgatgcttccctgattgtgactgaggagctgcacctgatcacctttgagaccgaggtgtatcaccaaggcctcaagattgacctagagagattcacgtcgtttaacacttctggtgattaataacatctctctgattgta

SEQ ID NO: 295118 - DNA, 968 bp, Homo sapiens
gtaattcagcggtttccggagctgcggcggcgcagactgggagggggagccgggggttccgacgtcgcagccgagggaacaagccccaaccggatcctggacaggcaccccggcttggcgctgtctctccccctcggctcggagaggcccttcggcctgagggagcctcgccgcccgtccccggcacacgcgcagccccggcctctcggcctctgccggagaaacaggatggcccaatggaatcagctacagcagcttgacacacggtacctggagcagctccatcagctctacagtgacagcttcccaatggagctgcggcagtttctggccccttggattgagagtcaagattgggcatatgcggccagcaaagaatcacatgccactttggtgtttcataatctcctgggagagattgaccagcagtatagccgcttcctgcaagagtcgaatgttctctatcagcacaatctacgaagaatcaagcagtttcttcaggtatgatgagaaactgaggacaaggagaaacaggacccgcagagtcgggtgttagtgttctttcctggaagcatctcttttctcatttggctaagtaacgagaatctatcttgtattttcaatcacaggagaagtaattagccctttctcaaagctctgtatacttacccgtgagcatcattacctgagaatcacttctcttgtcacagttgaagtaataaagtgattgttatgttaatcatacatgttagcatgttaacgcggtccactgataggaagatgactctcactgttacatgttaaatgtttgaccataatgggatacttcttgactaagtcagtagcttccctgcaagaccaggatagtatactgtgtaaagactcagacaaggccaggcatggtggctcacgcctgtaatcccaacaccttaggaggttgaggtgggaggattgcttgagcctgggag

SEQ ID NO: 295119 - DNA, 732 bp, Homo sapiens
cccccccccccgcgagtccgtccgctgcacagccaatcagcggtcggcgcgcgcggcatcacgggagttgtagtcctgtaagcgcgcggagcccgtcgggcgcctatggaactcgacccgcaggccaaaggggctccgttgcaaggaagaagtgcggggtcccgccgcctcctagaccgagatcgcggtgagctggccgcggcgcacaatgggcacggcctgggcggcggcgtccgtactatcgccctgtgcctgcggatcccggtaacattgcgcggcaggccccaggccggcctccctcagcttcgcggactgtctgggccgggggtctcaaccttgacttcagggccgggccgctggggcagacccttagtgatgttcaggtcctctgggcccctgccagtcaagggacgctcgtcgcgcgccaattgttaagtctttcattgtttctgtaaacctgctgacgccctcccagcgcatagggagactgcgcacgtgagtccgcccccgcgcgcactgcggagaggtagaggcacgaatgtagtacaaggagccagctggtccaccagaagtctgtgttctgcctgtccctgcagcacggagggctgggctttatacctgtgccaaggacaccaacggcagcatcagcaagtccgtgttgtctcccaaataagtggtgttctccaacaagcttttagcagtaataaagctgacatttttattctcaaaaat

SEQ ID NO: 295120 - DNA, 514 bp, Homo sapiens
ccacagagagatgggcaggtccccctggctggggtcaggaagggcttgcaggagggtttactgctcactgtctctctctctttctatctctctccatctctctcatcacacacatacacactcagtcttgctgagggagaattctgagaaggtggagttctctgtagggaagggatacatatttcctactagtcatgtttccctgaaaatgggacttctgttaataatactcctggcctctctctacctggggaagaggaaacgtgagttacctgagagaagctgggaagaaagaaccaagcatacatgatttagtcccctctcctctttaggagccagctggtccaccagaagtctgtgttctgcctgtccctgcagcacggagggctgggctttatacctgtgccaaggacaccaacggcagcatcagcaagtccgtgttgtctcccaaataagtggtgttctccaacaagcttttagcagtaataaagctgacatttttattctcaaaaat

SEQ ID NO: 295121 - DNA, 446 bp, Homo sapiens
cccccccccccgcgagtccgtccgctgcacagccaatcagcggtcggcgcgcgcggcatcacgggagttgtagtcctgtaagcgcgcggagcccgtcgggcgcctatggaactcgacccgcaggccaaaggggctccgttgcaaggaagaagtgcggggtcccgccgcctcctagaccgagatcgcggtgagctggccgcggcgcacaatgggcacggcctgggcggcggcgtccgtactatcgccctgtgcctgcggatcccggagccagctggtccaccagaagtctgtgttctgcctgtccctgcagcacggagggctgggctttatacctgtgccaaggacaccaacggcagcatcagcaagtccgtgttgtctcccaaataagtggtgttctccaacaagcttttagcagtaataaagctgacatttttattctcaaaaat

SEQ ID NO: 295122 - DNA, 4832 bp, Homo sapiens
  misc_feature (3262)..(3263): n is a, c, g, or t
  misc_feature (3309)..(3309): n is a, c, g, or t
ccagaggcctcagcggccctgcaggtccgggcgaccaaggattattgcaacaattacgacctgaccagcctcaacgtgaaggcaggggacatcatcacagtcctcgagcagcatccggatggccggtggaagggctgcatccatgacaaccggacgggcaatgaccgggtgggctacttcccgtcctccctgggcgaggccattgtcaagcgagcaggttcccgagcaggcactgaaccaagcctgccccagggaagcagctcatcgggaccctctgcacccccagaggagatctgggtgctgaggaagccttttgcaggtggggaccgaagcggcagcattagcggcatggctggcggccggggcagcgggggtcacgccctacacgcgggctctgaaggcgtcaagctcctggcaacggtgctttcccagaagtccgtctctgagtccggcccgggggacagccccgccaagcctccggaaggctctgcaggtgtggcccggtcccagcctccagtggcccacgccgggcaggtctatggggagcagccgcccaagaagctggagccagcatcggagggcaagagctctgaggccgtgagccagtggctcaccgcgttccagctgcagctctacgcccccaacttcatcagcgccggctacgacctgcccaccatcagccgcatgactcccgaggacctcacggccattggtgtcaccaagccgggccaccggaagaagatcgcggcagagatcagcggcctaagcatccctgactggctgcctgagcacaaacccgctaacctggccgtgtggctgtccatgatcggcctggcccagtactacaaggtgttggtggacaatggctacgagaacattgatttcatcaccgacatcacctgggaggacctgcaggagatcggcatcaccaagctggggcaccagaagaagctgatgctcgctgtgaggaagctggcagagctgcagaaggctgaatacgccaagtatgaggggggccccctgcgccggaaggcgccccagtctcttgaagtgatggccatcgagtcgccgcccccgcctgagcccacaccggccgactgccagtcccctaaaatgaccaccttccaggacagcgagctcagtgacgagctgcaggctgccatgactggcccggctgaggtggggcccaccactgagaagccctccagccacctgccacccaccccgagggccaccacgcggcaggactccagcctgggtggtcgggcacggcacatgagcagctcgcaggagctgctgggagatgggccccctgggcccagcagccccatgtctcgaagccaggagtacctcctggatgagggccccgcccccggcaccccgcccagggaggcccggcccggccgccacggccacagcatcaagagggccagcgtgccccccgtgcctggcaagccacggcaggtcctcccaccaggcactagccacttcacgcccccccagacgcccaccaaaacccgaccaggctctccccaggcccttgggggacctcatggtccagccccagctacggccaaggtgaagcccaccccgcagctgctgccgccgacagagcgccccatgtcaccccgctccctgcctcagtcaccgacgcaccgcggctttgcctacgtgctgccccagcccgtggagggcgaggtggggccggctgccccggggcctgcgcccccacccgtgccgacggctgtgcccacactgtgcctgccccctgaggccgacgcggagccggggcggcccaagaagcgggcccacagcctgaatcgctatgcggcgtccgacagcgagccggagcgggacgagctgctggtgcctgcggctgccggcccctatgccacggtccagcggcgcgtgggccgcagccactcagtgagggcgcccgcaggtgccgacaagaacgtcaaccgcagccagtcctttgccgtgcggccccgaaagaaggggcccccgccgcccccacccaagcgctccagctcggccctggctagtgccaacctggcggatgagccggtgcctgacgccgagcctgaggatggcctgctgggggtccgggcacagtgccggcgggccagtgacctggccggcagcgtggacacgggtagtgccggcagtgtgaagagcatcgcggccatgctggagctgtcctccattgggggtgggggccgggctgcccgcaggcctcctgagggccaccccactccccgccctgccagcccagagccgggccgggtggccaccgtgctggcctcagtgaaacacaaagaggccatcgggcctggcggggaggtggtgaaccggcgccgcacgctcagcgggccagtcaccggacttctggccactgcccgccgggggcctggggagtcggcagacccaggcccctttgtggaggatggcactggccggcagcggcctcggggtccctccaagggcgaggcgggtgtcgaaggcccgcccttggccaaggtggaagccagcgccacactcaagaggcgcatccgggccaagcagaaccagcaggagaacgtcaagttcatcctgaccgagtctgacacggtcaagcgcaggcccaaggccaaggagcgggaggccgggcctgagccaccaccgccactgtccgtgtaccataatggcactggcaccgtgcgccgccgaccggcctcggagcaggctgggcctccggagctgcctccaccgcccccgcctgccgaacccccgcccaccgacctggcgcacctacccccattgcccccgcccgagggcgaagcccggaagccggccaagccgcctgtctctcccaagcccgtcctgacgcagcctgtgcccaagctccagggctcgcccacacccacctccaagaaggtgccgctgccaggccctggcagcccagaggtgaagcgcgcccacggcacgccaccgcccgtgtctcccaagccgccgccgccgcccacagcgcccaagcccgtcaaggcggtcgcggggctgccttcgggcagcgccggcccttcacccgcaccctcgcccgcgcgacagccgcccgccgccctcgccaagccgcccggtacgccgccctcgctgggcgccagccccgccaagcccccgtcccccggcgcgcccgcgctgcacgtgcccgccaagcccccgcgagccgccgccgccgccgccgccgccgccgccgcgccccccgccccgcccgaaggcgcctcgnnaggggacagcgcccggcagaaactggaggagacaagcgcgtgcctngccgcggcgctgcaggcggtggaggagaagatccggcaggaggacgcgcagggcccgcgcgactcggcggcggaaaagagcactggcagcatcctggacgacatcggcagcatgttcgacgacctggccgaccagctggatgccatgctggagtgaacgccgcctggccgggccctcccgcgccgcccgggccctccccgcacactgacctatacctcaggatgggcgcgtctgggcgcggcgcgagcggccgggcagggccctgcagaagcacaactccggcccctggacccgggccggggcgcccaccggggaccgcctggccgggggctccaagggctctaggcagaccctgcgcccgcgggtcctccccacctgctgctccccgtgcaatacctgctgggcctcctgcccgcgcgggaggggagggcgccccgggaccagggatggggcagcgcacaggcccgggcccagcacagaactgcccatcgggacgcccggccagccgctcgggcgcagcacaagggacaggggaccaaggtcagggcccccctgccccaccgcacccccagaatataagctatcaagagtattaatttattgggaatgagctgaggcggatttccccagagaaacaaaaaggtataactttaacaaatatatatttaaagaaagaaatattattgattctatagaaaaccatttaccaactgaaaggacacgaagtctagctccggacaaaagctgttagaggcccaggctgtctgcctgcggtccttcctccggccagagtggaggccccaggctgctagcacaggtggaaggctggggcccgggggcgggtgctctgccgggggctcctccgtgcttctctcctaagttctctgcgccccaagaactcgaggttgtgccttgctctcggcggccgtgtcctcctcctggcgtggctgcgtcccagggcgcgggtgggtttggtgaatgtgggtgtgtcagcgtggcagccacgtggaagcagggcatgtagcaggccaggccacgggcttgcagctcctctgagggtgtgcctggccccctctccaggggctgtgcaggcagcccatccaccccagtggagttcccacggacgcttctgctcatggtccaaggctgtgttgtgtggtcattctcgccctcccttttcctctctcctcctgccccctccaagaagtactgactggtctcctctatcgtgtttgctgatccacagtgttgggcacaactttgacgtttcttaaaaaaaaaatttaaaaaatgccgaaaaccagcgattgtggtgtggggcgggtggaggcggctggcggaggtggcgtcccggcgtgcagggccccttcctgctgtctcaccccgtgtttccctgcgagtggacgtgcccagctgtccccccaggcctctcctcagagggcggcacaggctgggctccagcaggtgggcaggggaggtctgggcaaggcgctgccgtcggctgtcaataaacagcaggaaac

SEQ ID NO: 295123 - DNA, 4007 bp, Homo sapiens
  misc_feature (3262)..(3263): n is a, c, g, or t
  misc_feature (3309)..(3309): n is a, c, g, or t
ccagaggcctcagcggccctgcaggtccgggcgaccaaggattattgcaacaattacgacctgaccagcctcaacgtgaaggcaggggacatcatcacagtcctcgagcagcatccggatggccggtggaagggctgcatccatgacaaccggacgggcaatgaccgggtgggctacttcccgtcctccctgggcgaggccattgtcaagcgagcaggttcccgagcaggcactgaaccaagcctgccccagggaagcagctcatcgggaccctctgcacccccagaggagatctgggtgctgaggaagccttttgcaggtggggaccgaagcggcagcattagcggcatggctggcggccggggcagcgggggtcacgccctacacgcgggctctgaaggcgtcaagctcctggcaacggtgctttcccagaagtccgtctctgagtccggcccgggggacagccccgccaagcctccggaaggctctgcaggtgtggcccggtcccagcctccagtggcccacgccgggcaggtctatggggagcagccgcccaagaagctggagccagcatcggagggcaagagctctgaggccgtgagccagtggctcaccgcgttccagctgcagctctacgcccccaacttcatcagcgccggctacgacctgcccaccatcagccgcatgactcccgaggacctcacggccattggtgtcaccaagccgggccaccggaagaagatcgcggcagagatcagcggcctaagcatccctgactggctgcctgagcacaaacccgctaacctggccgtgtggctgtccatgatcggcctggcccagtactacaaggtgttggtggacaatggctacgagaacattgatttcatcaccgacatcacctgggaggacctgcaggagatcggcatcaccaagctggggcaccagaagaagctgatgctcgctgtgaggaagctggcagagctgcagaaggctgaatacgccaagtatgaggggggccccctgcgccggaaggcgccccagtctcttgaagtgatggccatcgagtcgccgcccccgcctgagcccacaccggccgactgccagtcccctaaaatgaccaccttccaggacagcgagctcagtgacgagctgcaggctgccatgactggcccggctgaggtggggcccaccactgagaagccctccagccacctgccacccaccccgagggccaccacgcggcaggactccagcctgggtggtcgggcacggcacatgagcagctcgcaggagctgctgggagatgggccccctgggcccagcagccccatgtctcgaagccaggagtacctcctggatgagggccccgcccccggcaccccgcccagggaggcccggcccggccgccacggccacagcatcaagagggccagcgtgccccccgtgcctggcaagccacggcaggtcctcccaccaggcactagccacttcacgcccccccagacgcccaccaaaacccgaccaggctctccccaggcccttgggggacctcatggtccagccccagctacggccaaggtgaagcccaccccgcagctgctgccgccgacagagcgccccatgtcaccccgctccctgcctcagtcaccgacgcaccgcggctttgcctacgtgctgccccagcccgtggagggcgaggtggggccggctgccccggggcctgcgcccccacccgtgccgacggctgtgcccacactgtgcctgccccctgaggccgacgcggagccggggcggcccaagaagcgggcccacagcctgaatcgctatgcggcgtccgacagcgagccggagcgggacgagctgctggtgcctgcggctgccggcccctatgccacggtccagcggcgcgtgggccgcagccactcagtgagggcgcccgcaggtgccgacaagaacgtcaaccgcagccagtcctttgccgtgcggccccgaaagaaggggcccccgccgcccccacccaagcgctccagctcggccctggctagtgccaacctggcggatgagccggtgcctgacgccgagcctgaggatggcctgctgggggtccgggcacagtgccggcgggccagtgacctggccggcagcgtggacacgggtagtgccggcagtgtgaagagcatcgcggccatgctggagctgtcctccattgggggtgggggccgggctgcccgcaggcctcctgagggccaccccactccccgccctgccagcccagagccgggccgggtggccaccgtgctggcctcagtgaaacacaaagaggccatcgggcctggcggggaggtggtgaaccggcgccgcacgctcagcgggccagtcaccggacttctggccactgcccgccgggggcctggggagtcggcagacccaggcccctttgtggaggatggcactggccggcagcggcctcggggtccctccaagggcgaggcgggtgtcgaaggcccgcccttggccaaggtggaagccagcgccacactcaagaggcgcatccgggccaagcagaaccagcaggagaacgtcaagttcatcctgaccgagtctgacacggtcaagcgcaggcccaaggccaaggagcgggaggccgggcctgagccaccaccgccactgtccgtgtaccataatggcactggcaccgtgcgccgccgaccggcctcggagcaggctgggcctccggagctgcctccaccgcccccgcctgccgaacccccgcccaccgacctggcgcacctacccccattgcccccgcccgagggcgaagcccggaagccggccaagccgcctgtctctcccaagcccgtcctgacgcagcctgtgcccaagctccagggctcgcccacacccacctccaagaaggtgccgctgccaggccctggcagcccagaggtgaagcgcgcccacggcacgccaccgcccgtgtctcccaagccgccgccgccgcccacagcgcccaagcccgtcaaggcggtcgcggggctgccttcgggcagcgccggcccttcacccgcaccctcgcccgcgcgacagccgcccgccgccctcgccaagccgcccggtacgccgccctcgctgggcgccagccccgccaagcccccgtcccccggcgcgcccgcgctgcacgtgcccgccaagcccccgcgagccgccgccgccgccgccgccgccgccgccgcgccccccgccccgcccgaaggcgcctcgnnaggggacagcgcccggcagaaactggaggagacaagcgcgtgcctngccgcggcgctgcaggcggtggaggagaagatccggcaggaggacgcgcagggcccgcgcgactcggcggcggaaaagagcactggcagcatcctggacgacatcggcagcatgttcgacgacctggccgaccagctggatgccatgctggagtgaacgccgcctggccgggccctcccgcgccgcccgggccctccccgcacactgacctatacctcaggatgggcgcgtctgggcgcggcgcgagcggccgggcagggccctgcagaagcacaactccggcccctggacccgggccggggcgcccaccggggaccgcctggccgggggctccaagggctctaggcagaccctgcgcccgcgggtcctccccacctgctgctccccgtgcaatacctgctgggcctcctgcccgcgcgggaggggagggcgccccgggaccagggatggggcagcgcacaggcccgggcccagcacagaactgcccatcgggacgcccggccagccgctcgggcgcagcacaagggacaggggaccaaggtcagggcccccctgccccaccgcacccccagaatataagctatcaagagtattaatttattgggaatgagctgaggcggatttccccagagaaacaaaaaggtataactttaacaaatatatatttaaagaaagaaaaaacaaaagggcgcccgctc

SEQ ID NO: 295124 - DNA, 5043 bp, Homo sapiens
cttggctgttcctgaggcctggcctggctccccgctgaccccttcccagacctgggatggcggaggccggcctgaggggctggctgctgtgggccctgctcctgcgcttggcccagagtgagccttacacaaccatccaccagcctggctactgcgccttctatgacgaatgtgggaagaacccagagctgtctggaagcctcatgacactctccaacgtgtcctgcctgtccaacacgccggcccgcaagatcacaggtgatcacctgatcctattacagaagatctgcccccgcctctacaccggccccaacacccaagcctgctgctccgccaagcagctggtatcactggaagcgagtctgtcgatcaccaaggccctcctcacccgctgcccagcctgctctgacaattttgtgaacctgcactgccacaacacgtgcagccccaatcagagcctcttcatcaatgtgacccgcgtggcccagctaggggctggacaactcccagctgtggtggcctatgaggccttctaccagcatagctttgccgagcagagctatgactcctgcagccgtgtgcgcgtccctgcagctgccacgctggctgtgggcaccatgtgtggcgtgtatggctctgccctttgcaatgcccagcgctggctcaacttccagggagacacaggcaatggtctggccccactggacatcaccttccacctcttggagcctggccaggccgtggggagtgggattcagcctctgaatgagggggttgcacgttgcaatgagtcccaaggtgacgacgtggcgacctgctcctgccaagactgtgctgcatcctgtcctgccatagcccgcccccaggccctcgactccaccttctacctgggccagatgccgggcagtctggtcctcatcatcatcctctgctctgtcttcgctgtggtcaccatcctgcttgtgggattccgtgtggcccccgccagggacaaaagcaagatggtggaccccaagaagggcaccagcctctctgacaagctcagcttctccacccacaccctccttggccagttcttccagggctggggcacgtgggtggcttcgtggcctctgaccatcttggtgctatctgtcatcccggtggtggccttggcagcgggcctggtctttacagaactcactacggaccccgtggagctgtggtcggcccccaacagccaagcccggagtgagaaagctttccatgaccagcatttcggccccttcttccgaaccaaccaggtgatcctgacggctcctaaccggtccagctacaggtatgactctctgctgctggggcccaagaacttcagcggaatcctggacctggacttgctgctggagctgctagagctgcaggagaggctgcggcacctccaggtatggtcgcccgaagcacagcgcaacatctccctgcaggacatctgctacgcccccctcaatccggacaataccagtctctacgactgctgcatcaacagcctcctgcagtatttccagaacaaccgcacgctcctgctgctcacagccaaccagacactgatggggcagacctcccaagtcgactggaaggaccattttctgtactgtgccaatgccccgctcaccttcaaggatggcacagccctggccctgagctgcatggctgactacggggcccctgtcttccccttccttgccattggggggtacaaaggaaaggactattctgaggcagaggccctgatcatgacgttctccctcaacaattaccctgccggggacccccgtctggcccaggccaagctgtgggaggaggccttcttagaggaaatgcgagccttccagcgtcggatggctggcatgttccaggtcacgttcatggctgagcgctctctggaagacgagatcaatcgcaccacagctgaagacctgcccatctttgccaccagctacattgtcatattcctgtacatctctctggccctgggcagctattccagctggagccgagtgatggtggactccaaggccacgctgggcctcggcggggtggccgtggtcctgggagcagtcatggctgccatgggcttcttctcctacttgggtatccgctcctccctggtcatcctgcaagtggttcctttcctggtgctgtccgtgggggctgataacatcttcatctttgttctcgagtaccagaggctgccccggaggcctggggagccacgagaggtccacattgggcgagccctaggcagggtggctcccagcatgctgttgtgcagcctctctgaggccatctgcttcttcctaggggccctgacccccatgccagctgtgcggacctttgccctgacctctggccttgcagtgatccttgacttcctcctgcagatgtcagcctttgtggccctgctctccctggacagcaagaggcaggaggcctcccggttggacgtctgctgctgtgtcaagccccaggagctgcccccgcctggccagggagaggggctcctgcttggcttcttccaaaaggcttatgcccccttcctgctgcactggatcactcgaggtgttgtgctgctgctgtttctcgccctgttcggagtgagcctctactccatgtgccacatcagcgtgggactggaccaggagctggccctgcccaaggactcgtacctgcttgactatttcctctttctgaaccgctacttcgaggtgggggccccggtgtactttgttaccaccttgggctacaacttctccagcgaggctgggatgaatgccatctgctccagtgcaggctgcaacaacttctccttcacccagaagatccagtatgccacagagttccctgagcagtcttacctggccatccctgcctcctcctgggtggatgacttcattgactggctgaccccgtcctcctgctgccgcctttatatatctggccccaataaggacaagttctgcccctcgaccgtcaactctctgaactgcctaaagaactgcatgagcatcacgatgggctctgtgaggccctcggtggagcagttccataagtatcttccctggttcctgaacgaccggcccaacatcaaatgtcccaaaggcggcctggcagcatacagcacctctgtgaacttgacttcagatggccaggttttagacacagttgccattctgtcacccaggctggagtacagtggcacaatctcggctcactgcaacctctacctcctggattcagcctccaggttcatggcctatcacaagcccctgaaaaactcacaggattacacagaagctctgcgggcagctcgagagctggcagccaacatcactgctgacctgcggaaagtgcctggaacagacccggcttttgaggtcttcccctacacgatcaccaatgtgttttatgagcagtacctgaccatcctccctgaggggctcttcatgctcagcctctgccttgtgcccaccttcgctgtctcctgcctcctgctgggcctggacctgcgctccggcctcctcaacctgctctccattgtcatgatcctcgtggacactgtcggcttcatggccctgtggggcatcagttacaatgctgtgtccctcatcaacctggtctcggcggtgggcatgtctgtggagtttgtgtcccacattacccgctcctttgccatcagcaccaagcccacctggctggagagggccaaagaggccaccatctctatgggaagtgcggtgtttgcaggtgtggccatgaccaacctgcctggcatccttgtcctgggcctcgccaaggcccagctcattcagatcttcttcttccgcctcaacctcctgatcactctgctgggcctgctgcatggcttggtcttcctgcccgtcatcctcagctacgtggggcctgacgttaacccggctctggcactggagcagaagcgggctgaggaggcggtggcagcagtcatggtggcctcttgcccaaatcacccctcccgagtctccacagctgacaacatctatgtcaaccacagctttgaaggttctatcaaaggtgctggtgccatcagcaacttcttgcccaacaatgggcggcagttctgatacagccagaggccctgtctaggctctatggccctgaaccaaagggttatggggatcttccttgtgactgccccttgacacacgccctcctcaaatcctaggggaggccattcccatgagactgcctgtcactggaggatggcctgctcttgaggtatccaggcagcaccactgatggctcctctgctcccatagtgggtccccagtttccaagtcacctaggccttgggcagtgcctcctcctgggcctgggtctggaagttggcaggaacagacacactccatgtttgtcccacactcactcactttcctaggagcccacttctcatccaacttttcccttctcagttcctctctcgaaagtcttaattctgtgtcagtaagtctttaacacgtagcagtgtccctgagaacacagacaatgaccactaccctgggtgtgatatcacaggaggccagagagaggcaaaggctcaggccaagagccaacgctgtgggaggccggtcggcagccactccctccagggcgcacctgcaggtctgccatccacggccttttctggcaagagaagggcccaggaaggatgctctcataaggcccaggaaggatgctctcataagcaccttggtcatggattagcccctcctggaaaatggtgttgggtttggtctccagctccaatacttattaaggctgttgctgccagtcaaggccacccaggagtctgaaggctgggagctcttggggctgggctggtcctcccatcttcacctcgggcctggatcccaggcctcaaaccagcccaacccgagcttttggacagctctccagaagcatgaactgcagtggagatgaagatcctggctctgtgctgtgcacataggtgtttaataaacatttgttggc

SEQ ID NO: 295125 - DNA, 2552 bp, Homo sapiens
cttggctgttcctgaggcctggcctggctccccgctgaccccttcccagacctgggatggcggaggccggcctgaggggctggctgctgtgggccctgctcctgcgcttggcccagagtgagccttacacaaccatccaccagcctggctactgcgccttctatgacgaatgtgggaagaacccagagctgtctggaagcctcatgacactctccaacgtgtcctgcctgtccaacacgccggcccgcaagatcacaggtgatcacctgatcctattacagaagatctgcccccgcctctacaccggccccaacacccaagcctgctgctccgccaagcagctggtatcactggaagcgagtctgtcgatcaccaaggccctcctcacccgctgcccagcctgctctgacaattttgtgaacctgcactgccacaacacgtgcagccccaatcagagcctcttcatcaatgtgacccgcgtggcccagctaggggctggacaactcccagctgtggtggcctatgaggccttctaccagcatagctttgccgagcagagctatgactcctgcagccgtgtgcgcgtccctgcagctgccacgctggctgtgggcaccatgtgtggcgtgtatggctctgccctttgcaatgcccagcgctggctcaacttccagggagacacaggcaatggtctggccccactggacatcaccttccacctcttggagcctggccaggccgtggggagtgggattcagcctctgaatgagggggttgcacgttgcaatgagtcccaaggtgacgacgtggcgacctgctcctgccaagactgtgctgcatcctgtcctgccatagcccgcccccaggccctcgactccaccttctacctgggccagatgccgggcagtctggtcctcatcatcatcctctgctctgtcttcgctgtggtcaccatcctgcttgtgggattccgtgtggcccccgccagggacaaaagcaagatggtggaccccaagaagggcaccagcctctctgacaagctcagcttctccacccacaccctccttggccagttcttccagggctggggcacgtgggtggcttcgtggcctctgaccatcttggtgctatctgtcatcccggtggtggccttggcagcgggcctggtctttacagaactcactacggaccccgtggagctgtggtcggcccccaacagccaagcccggagtgagaaagctttccatgaccagcatttcggccccttcttccgaaccaaccaggtgatcctgacggctcctaaccggtccagctacaggtatgactctctgctgctggggcccaagaacttcagcggaatcctggacctggacttgctgctggagctgctagagctgcaggagaggctgcggcacctccaggtatggtcgcccgaagcacagcgcaacatctccctgcaggacatctgctacgcccccctcaatccggacaataccagtctctacgactgctgcatcaacagcctcctgcagtatttccagaacaaccgcacgctcctgctgctcacagccaaccagacactgatggggcagacctcccaagtcgactggaaggaccattttctgtactgtgccaatgccccgctcaccttcaaggatggcacagccctggccctgagctgcatggctgactacggggcccctgtcttccccttccttgccattggggggtacaaaggaaaggactattctgaggcagaggccctgatcatgacgttctccctcaacaattaccctgccggggacccccgtctggcccaggccaagctgtgggaggaggccttcttagaggaaatgcgagccttccagcgtcggatggctggcatgttccaggtcacgttcatggctgagcgctctctggaagacgagatcaatcgcaccacagctgaagacctgcccatctttgccaccagctacattgtcatattcctgtacatctctctggccctgggcagctattccagctggagccgagtgatggtggactccaaggccacgctgggcctcggcggggtggccgtggtcctgggagcagtcatggctgccatgggcttcttctcctacttgggtatccgctcctccctggtcatcctgcaagtggttcctttcctggtgctgtccgtgggggctgataacatcttcatctttgttctcgagtaccaggggccctgacccccatgccagctgtgcggacctttgccctgacctctggccttgcagtgatccttgacttcctcctgcagatgtcagcctttgtggccctgctctccctggacagcaagaggcaggaggtaggggcagctgggccagtactgagggacctgcccctgggttcccaccatggcagggagatggggtggctttaccaccacagagatggcccagagaatggggtgggggacaggggcattgtgccaggagagtaatatttaggccatgtattctccaatttcctacagaaaaataaatttgttttgacaattttttaaatat

SEQ ID NO: 295126 - DNA, 400 bp, Homo sapiens
tttatagtccattatagggtattatctttattttgacttcggatgctcacaacaactctcgggtggtccaattatctccattttacagacaggaaaactgaggttcagaggggtgtggtaagctgctcaaggtcacacagcaaccagcactcgcttgctgagattgccccgctcaccttcaaggatggcacagccctggccctgagctgcatggctgactacggggcccctgtcttccccttccttgccattggggggtacaaaggtaagctaagtgggccctgagaggaagccaaggaagatgcagtattggggcaggaaccatagacgggagggtgggagtggtgctggggattctcgcggcctgggggtagcctggcttctggaagctgtaggccaa

SEQ ID NO: 295127 - DNA, 255 bp, Homo sapiens
  misc_feature (27)..(27): n is a, c, g, or t
agagctttaccctggggttttcggggnccctccagagcaaccgatttatgtcctgccctcggtggagcagttccataagtatcttccctggttcctgaacgaccggcccaacatcaaatgtcccaaaggcggcctggcagcatacagcacctctgtgaacttgacttcagatggccaggttttaggtaagcatggccttgcctggaggggaggacataaatcggttgctctggagggcccccgaaaaccccaggg

SEQ ID NO: 295128 - DNA, 4481 bp, Homo sapiens
cttggctgttcctgaggcctggcctggctccccgctgaccccttcccagacctgggatggcggaggccggcctgaggggctggctgctgtgggccctgctcctgcgcttggcccagagtgagccttacacaaccatccaccagcctggctactgcgccttctatgacgaatgtgggaagaacccagagctgtctggaagcctcatgacactctccaacgtgtcctgcctgtccaacacgccggcccgcaagatcacaggtgatcacctgatcctattacagaagatctgcccccgcctctacaccggccccaacacccaagcctgctgctccgccaagcagctggtatcactggaagcgagtctgtcgatcaccaaggccctcctcacccgctgcccagcctgctctgacaattttgtgaacctgcactgccacaacacgtgcagccccaatcagagcctcttcatcaatgtgacccgcgtggcccagctaggggctggacaactcccagctgtggtggcctatgaggccttctaccagcatagctttgccgagcagagctatgactcctgcagccgtgtgcgcgtccctgcagctgccacgctggctgtgggcaccatgtgtggcgtgtatggctctgccctttgcaatgcccagcgctggctcaacttccagggagacacaggcaatggtctggccccactggacatcaccttccacctcttggagcctggccaggccgtggggagtgggattcagcctctgaatgagggggttgcacgttgcaatgagtcccaaggtgacgacgtggcgacctgctcctgccaagactgtgctgcatcctgtcctgccatagcccgcccccaggccctcgactccaccttctacctgggccagatgccgggcagtctggtcctcatcatcatcctctgctctgtcttcgctgtggtcaccatcctgcttgtgggattccgtgtggcccccgccagggacaaaagcaagatggtggaccccaagaagggcaccagcctctctgacaagctcagcttctccacccacaccctccttggccagttcttccagggctggggcacgtgggtggcttcgtggcctctgaccatcttggtgctatctgtcatcccggtggtggccttggcagcgggcctggtctttacagaactcactacggaccccgtggagctgtggtcggcccccaacagccaagcccggagtgagaaagctttccatgaccagcatttcggccccttcttccgaaccaaccaggtgatcctgacggctcctaaccggtccagctacaggtatgactctctgctgctggggcccaagaacttcagcggaatcctggacctggacttgctgctggagctgctagagctgcaggagaggctgcggcacctccaggtatggtcgcccgaagcacagcgcaacatctccctgcaggacatctgctacgcccccctcaatccggacaataccagtctctacgactgctgcatcaacagcctcctgcagtatttccagaacaaccgcacgctcctgctgctcacagccaaccagacactgatggggcagacctcccaagtcgactggaaggaccattttctgtactgtgccaatgccccgctcaccttcaaggatggcacagccctggccctgagctgcatggctgactacggggcccctgtcttccccttccttgccattggggggtacaaaggaaaggactattctgaggcagaggccctgatcatgacgttctccctcaacaattaccctgccggggacccccgtctggcccaggccaagctgtgggaggaggccttcttagaggaaatgcgagccttccagcgtcggatggctggcatgttccaggtcacgttcatggctgagcgctctctggaagacgagatcaatcgcaccacagctgaagacctgcccatctttgccaccagctacattgtcatattcctgtacatctctctggccctgggcagctattccagctggagccgagtgatggtggactccaaggccacgctgggcctcggcggggtggccgtggtcctgggagcagtcatggctgccatgggcttcttctcctacttgggtatccgctcctccctggtcatcctgcaagtggttcctttcctggtgctgtccgtgggggctgataacatcttcatctttgttctcgagtaccagaggctgccccggaggcctggggagccacgagaggtccacattgggcgagccctaggcagggtggctcccagcatgctgttgtgcagcctctctgaggccatctgcttcttcctaggggccctgacccccatgccagctgtgcggacctttgccctgacctctggccttgcagtgatccttgacttcctcctgcagatgtcagcctttgtggccctgctctccctggacagcaagaggcaggaggcctcccggttggacgtctgctgctgtgtcaagccccaggagctgcccccgcctggccagggagaggggctcctgcttggcttcttccaaaaggcttatgcccccttcctgctgcactggatcactcgaggtgttgtgctgctgctgtttctcgccctgttcggagtgagcctctactccatgtgccacatcagcgtgggactggaccaggagctggccctgcccaaggactcgtacctgcttgactatttcctctttctgaaccgctacttcgaggtgggggccccggtgtactttgttaccaccttgggctacaacttctccagcgaggctgggatgaatgccatctgctccagtgcaggctgcaacaacttctccttcacccagaagatccagtatgccacagagttccctgagcagtcttacctggccatccctgcctcctcctgggtggatgacttcattgactggctgaccccgtcctcctgctgccgcctttatatatctggccccaataaggacaagttctgcccctcgaccgtcaactctctgaactgcctaaagaactgcatgagcatcacgatgggctctgtgaggccctcggtggagcagttccataagtatcttccctggttcctgaacgaccggcccaacatcaaatgtcccaaaggcggcctggcagcatacagcacctctgtgaacttgacttcagatggccaggttttagacacagttgccattctgtcacccaggctggagtacagtggcacaatctcggctcactgcaacctctacctcctggattcagcctccaggttcatggcctatcacaagcccctgaaaaactcacaggattacacagaagctctgcgggcagctcgagagctggcagccaacatcactgctgacctgcggaaagtgcctggaacagacccggcttttgaggtcttcccctacacgatcaccaatgtgttttatgagcagtacctgaccatcctccctgaggggctcttcatgctcagcctctgccttgtgcccaccttcgctgtctcctgcctcctgctgggcctggacctgcgctccggcctcctcaacctgctctccattgtcatgatcctcgtggacactgtcggcttcatggccctgtggggcatcagttacaatgctgtgtccctcatcaacctggtctcggcggtgggcatgtctgtggagtttgtgtcccacattacccgctcctttgccatcagcaccaagcccacctggctggagagggccaaagaggccaccatctctatgggaagtgcggtgtttgcaggtgtggccatgaccaacctgcctggcatccttgtcctgggcctcgccaaggcccagctcattcagatcttcttcttccgcctcaacctcctgatcactctgctgggcctgctgcatggcttggtcttcctgcccgtcatcctcagctacgtggggcctgacgttaacccggctctggcactggagcagaagcgggctgaggaggcggtggcagcagtcatggtggcctcttgcccaaatcacccctcccgagtctccacagctgacaacatctatgtcaaccacagctttgaaggttctatcaaaggtgctggtgccatcagcaacttcttgcccaacaatgggcggcagttctgatacagccagaggccctgtctaggctctatggccctgaaccaaagggttatggggatcttccttgtgactgccccttgacacacgccctcctcaaatcctaggggaggccattcccatgagactgcctgtcactggaggatggcctgctcttgaggtatccaggcagcaccactgatgctcttggggctgggctggtcctcccatcttcacctcgggcctggatcccaggcctcaaaccagcccaacccgagcttttggacagctctccagaagcatgaactgcagtggagatgaagatcctggctctgtgctgtgcacataggtgtttaataaacatttgttggc

SEQ ID NO: 295129 - DNA, 1146 bp, Homo sapiens
aaaaccctgtctctacacctccattcccagggcaagctcactctctggcaacaagctccctggggtgatttttcttctagaagagtccacggggacaggtaaggagtaggaggcagggagtccagttctgggacggggattccgtgatgcaaagtgaagagagagggacggggcccattccgagggtttctccctggtttctcagacagctcctgggccaagactcagggaaacattgagacagagcgcttggcacagaagtagcggggtcagggcgaagtcccagggcctcaggcgtggctctcaggatctcaggccccaaaggcggtgtatggattggggaggcccagcgctgggcattccccatctttgcagggtttctcttctccctctcccaacctgtgtcgggtccttcttcctgggtactcaccgggctgccccagttctcactcccattgagtgtcgggtttctagagaagccaatcaatgtagccgcggtcccggttctaaagttcccacgcacccaccgggactccgattcttcccagtcgccgaggatggtgtcatggcgccccgaaccctgcttctgctgctctcgggggccctggtcctgacccagacctgggcaggcttccactccttgaggtatttccacaccaccatgtcccggcccggccgcgcggatccccgcttcctctccgtgggcgacgtggacgacacgcagtgcgtgcggctcgacagcgacgccacgagtcccaggatggagccgcgggcgccgtggatggagcaggaggggccggaatattgggaagaggagacagggaccgccaaggccaaagcacagttttaccgagtgaacctgcggaccctgagcggctactacaaccagagtgaggcctgtgagtgacaccggccgggggcgcagatcactacccctccacatcccccacggaccgcccgggtctccccgagtctctgggtccgagatccacgccgaggcagcgggacctggagacccttgacccgggagaggcccaggagccgttacccggtttcattttcagccaaaatccccgcaggggctgccagccacacagagtcatggacaggtctctacagacacaacttagtgccagcttggatgaa

SEQ ID NO: 295130 - DNA, 810 bp, Homo sapiens
attaggagatgtcctggactcacacagaaactcagggctatggaatgaagggcaagctcactctctggcaacaagctccctggggtgatttttcttctagaagagtccacggggacaggctgccccagttctcactcccattgagtgtcgggtttctagagaagccaatcaatgtagccgcggtcccggttctaaagttcccacgcacccaccgggactccgattcttcccagtcgccgaggatggtgtcatggcgccccgaaccctgcttctgctgctctcgggggccctggtcctgacccagacctgggcaggcttccactccttgaggtatttccacaccaccatgtcccggcccggccgcgcggatccccgcttcctctccgtgggcgacgtggacgacacgcagtgcgtgcggctcgacagcgacgccacgagtcccaggatggagccggaggggccggaatattgggaagaggagacagggaccgccaaggccaaagcacagttttaccgagtgaacctgcggaccctgagcggctactacaaccagagtgaggcctgtgagtgacaccggccgggggcgcagatcactacccctccacatcccccacggaccgcccgggtctccccgagtctctgggtccgagatccacgccgaggcagcgggacctggagacccttgacccgggagaggcccaggagccgttacccggtttcattttcagccaaaatccccgcaggggctgccagccacacagagtcatggacaggtctctacagacacaacttagtgccagcttggatgaa

SEQ ID NO: 295131 - DNA, 868 bp, Homo sapiens
attaggagatgtcctggactcacacagaaactcagggctatggaatgaagggcaagctcactctctggcaacaagctccctggggtgatttttcttctagaagagtccacggggacagggtttctcttctccctctcccaacctgtgtcgggtccttcttcctgggtactcaccgggctgccccagttctcactcccattgagtgtcgggtttctagagaagccaatcaatgtagccgcggtcccggttctaaagttcccacgcacccaccgggactccgattcttcccagtcgccgaggatggtgtcatggcgccccgaaccctgcttctgctgctctcgggggccctggtcctgacccagacctgggcaggcttccactccttgaggtatttccacaccaccatgtcccggcccggccgcgcggatccccgcttcctctccgtgggcgacgtggacgacacgcagtgcgtgcggctcgacagcgacgccacgagtcccaggatggagccggaggggccggaatattgggaagaggagacagggaccgccaaggccaaagcacagttttaccgagtgaacctgcggaccctgagcggctactacaaccagagtgaggcctgtgagtgacaccggccgggggcgcagatcactacccctccacatcccccacggaccgcccgggtctccccgagtctctgggtccgagatccacgccgaggcagcgggacctggagacccttgacccgggagaggcccaggagccgttacccggtttcattttcagccaaaatccccgcaggggctgccagccacacagagtcatggacaggtctctacagacacaacttagtgccagcttggatgaa

SEQ ID NO: 295132 - DNA, 924 bp, Homo sapiens
gtaccaggccccagaggcagcggaaagggagactgtggggaactaggagcaacagcaggcatggaccaaagcagtgaaggatgtatgaaaaagattagcagtgtgaatcttgacaaacttataaatgacttctcacagatagaaaagaaaatggtagaaaccaatggaaagaacaatatactggatattcagttggaaaaaagtaattgcctattaaaagtaatgcaagcaaaggaggtctccattaaagaagaatgtgctactcttcataatataataaaagggctacaacagaccattgaatatcaacagaatttgaaaggtgaaaatgaacaactaaaaataagtgctgatcttataaaagagaagttaaagtctcatgaacaggaatataagaataatattgccaaacttgtaagtgaaatgaaaatcaaagaggagggatataagaaagaaataagcaaactttatcaggacatgcagagaaaagttgaattaaatgaagaaaagcacaaagaactaatagagaaaaaggagatggaaatttcagagttaaatgcaaagctaagaagtcaagaaaaagaaaaacaaaatgaaataatcaagctacaactagaatttgatgccaaactagcaagagttcagactaaatcaaaatcatatcaggattctactgttttgccacaaagtatctacagaaggaaacttcagcattttcaagaagaaaaaacaaggagattgcaattcttcgtaataccattcgcgatttagagcaacgcctttctgttggcaaagattctcaccttaagcgtagacggttttgagcttagcagtaaattcattagttggtatttatttaaaagcaatcgaaagtttcacttctgttttcaatatatgcatacagcctacataacaaacgaagtc

SEQ ID NO: 295133 - DNA, 423 bp, Homo sapiens
aatagatatggataattatttattcaatggagctgactcacaattcagaacacccaatgtgatttattctttggttggggaaacaattattgatccggtgttgattcatgttctggaaaccacatgaaaatacctaagcagccgcagatgctgagcggagctgggccaagttggtaagaactgctggtggtaggagctccagcatagcgcacagggcgggcccagagaaaggcgggcccattgttgggggattcggcttccggaggaggggacagcattcaggggtgtaccaggccccagaggcagcggaaagggagactgtggggaactaggagcaacagcaggtacactccaaattctattgacggttcgaaattcccgctttctccatagagattcctttcttcatatttcattacagtg

SEQ ID NO: 295134 - DNA, 431 bp, Homo sapiens
gaaatttttaacaaatgaattttatttatttcattttattcagttgaattaaatgaagaaaagcacaaagaactaatagagaaaaaggagatggaaatttcagagttaaatgcaaagctaagaagtcaagaaaaagaaaaacaaaatgaaataatcaagctacaactagaagtaagtgtttaagagtctgctaaacttgaggacacatcccttagtctaaactgtactttgattgtttttcatcacagtgagatacattttaggattagaagcaattctgtgagagggcttcacacatgctcattctccaccaaatgattgcagtaatcacataccatacaactgtcatctgcattgcctttcagcacttgacctgaaagtggacccttgagttgttcgaaagttcctggtttttagggaggatattgctt

SEQ ID NO: 295135 - DNA, 452 bp, Homo sapiens
aacaatatactggatattcagttggaaaaaagtaattgcctattaaaagtaatgcaagcaaaggaggtctccattaaagaaggttagttatttgctgcctgaggaatgctaattctaatgaaagtgtttttcagttcaacagtgattaatattacaccatatatttgtaaagtgttttaagtccacatagaattttccagattatcatctcatttatatccttactatagccctgaaagacatgtaagatgggtattattactctacctcaccaatgaagaaacatagaatgagacaagttaaataatctttctgagactgctcaactttctgaggccaataagaaatggccaattgaagtctcaatacaggcctataaaaaccatagggaaaaaaattaagttgaatttctaccttataattacatcaaaataaatgtcaaatgtgtcaaa

SEQ ID NO: 295136 - DNA, 534 bp, Homo sapiens
tcagctcggtaccatatttgataatttctaaggagtgtttttcccccccgcctccaacactttcaggggcagacagcatccgtgttctaagcaaacgtgcccgctacagggtctggggggatattaccctctagtcaacttagtctcactgaagatatgacccagtcagtgggtcagggagagtattccatgtaacaggtatcacaagtgcagggagaaaaggctgctgcagcttgcctgtgatgtcagagcaatgggctttagggtccagagcaggaggtgagcagggcttctggtggtgcttgccaggccacacaccctgctgatggctccacaaggcaagggatgagcgggcttccagatttcttctgggcctcagctggaacagctgatggcttggaacagctgctccaaaggagagctccgcttgactcattgcatgcgatcctattcatttgccctaactctccccatgttaggaatcaaccgtcttcccagtaaggaaacaggctcaagttttactcaaggtcacag

SEQ ID NO: 295137 - DNA, 848 bp, Homo sapiens
ctcccggcctcgcctcgcagacgcgacgggccggggaggaagcgctcggagcagtgcaggtttcgttatcctgtgttaggtcactccggagaggggaaagcggcccacagcgtcgcgcgacccggaaacgacacaacgaggcccaatcttttagactcgagtttaggccccggggtggagtctccggaccgggtccccccacccccgctacaggggcagtgcgcaggcgcgagggacgcacaaccccagcccctgtcccagtgagcccgtcgccatggaatccctgcagactccccagcaccgcgaaaatcaagataaaagggagaaggagtatggggtaaaacacatgcctatgggcaataatgcagggaatcttgagcccgaaaagagaaaggcagtaagagttgccttgagttcagcaacagctgcacagaatatcccgtccagtgtccactgtggctgctccaagcaatggagactcaggctaccatcggagtcgctgcaaagtcggggacaagtgatgaagcggccgaataacattttaaagctcaggaatctggatctgttgatctacccttggccagaacttagaagacggcaggttgcttctgacctaatgagcctcctccttctccccgctttttccggccttacttgggcccccttccttttcctctttacgtatctgcctccttttctcaatctcctcactgttggttttgtatcctattttctggtatagtttctgtgatttctttcttttatttattattattattgttgttgagaccgagttttgcccttgttgcccaggctggagtgcaatggcgcgaacctggctcactcca

SEQ ID NO: 295138 - DNA, 799 bp, Homo sapiens
agacgctcaggacttggaccgtccagttgttcggaggccagcctatagccaatggtatcccgagggctcgctctctccgggcgtttgtgctcccctctctcttctaacccagtttctacctttcagtgctttggaatcttagccctctgtctctattcgcttttctgtatttgccttgcctcagggacgcacaaccccagcccctgtcccagtgagcccgtcgccatggaatccctgcagactccccagcaccgcgaaaatcaagataaaagggagaaggagtatggggtaaaacacatgcctatgggcaataatgcagggaatcttgagcccgaaaagagaaaggcagtaagagttgccttgagttcagcaacagctgcacagaatatcccgtccagtgtccactgtggctgctccaagcaatggagactcaggctaccatcggagtcgctgcaaagtcggggacaagtgatgaagcggccgaataacattttaaagctcaggaatctggatctgttgatctacccttggccagaacttagaagacggcaggttgcttctgacctaatgagcctcctccttctccccgctttttccggccttacttgggcccccttccttttcctctttacgtatctgcctccttttctcaatctcctcactgttggttttgtatcctattttctggtatagtttctgtgatttctttcttttatttattattattattgttgttgagaccgagttttgcccttgttgcccaggctggagtgcaatggcgcgaacctggctcactcca

SEQ ID NO: 295139 - DNA, 519 bp, Homo sapiens
tcaggcctgcctagatgttgtaggggatcatgagactatcctgtgtatcccacaaagaagacaggcaagattccttggctgatgcacctccacagaggtctccttctcagccaagcctcagggaattgtggcattcatgctgtacccgtgatctgttcccactggaggaggagatgtctagactgtgatggggtctctgagaactgctcttctgactttattcctgaaagaggctgtgtgcaagaattgagtcccagggggactggaatgttgtctggtgaatgtgtgggaccgcatccacccctcaccagcttgtatcctcacctttatctgatgttatggctgctcaaagtatctgtcccaaaatgaaattccaagacaatgaaggagtgacgtgaaggtcctgctcagctaggaactgaatatgaagtaaattcaaggggccctgaggactggactgctagtgtttctccatgggatgtacactggagaataaagcagtgaaatatttctgttcct

SEQ ID NO: 295140 - DNA, 820 bp, Homo sapiens
gaaataaaaggttagtacatgacatttaattgattcggtttactcctacttgctggtgtgtttggagcctcagtgacttcctatttttcaaaaaatcaagaaaggctaaatttaagtggagaaaactaactagtctagtgtcattgcagaggagggctggatgaagttgagtgcttttgagattctcttccacagctagagaactgttccctgtgttctcacacatcagtctggaggttaaatgtctccggctagtcgtttcctgtgagttgagagttttcctttggtcatgccctgtgtactccttcactccgaaatgctgttccacactgttagataacaacagagcaaagctcacttgatgattcaagtgtgagaaatatgactgggggcttatccgaggggttcaggagaacaggagagcaccgtgcagttctgctcccggaggggaaggagaggcagcgtccgcatttcagctggtccttgaagaaggaggaggagctgcttagggtaaggaaaaggcatttcagttggaaaacacaggccagggaggcgttagaggatgtgagacattcatccagaagacgtggagttggttctcttctccgttggggagtccctcactcgtactcaaatttatttgtttgtttgtttatttatttatttaatttattttgagacagggtcttgctctgtagcccaggctaggctggagtgcagtggtgtgatcacagctcactacagccttgaactcctgggctcaagtgctcttcctgccttagcctccctagtagctcctgggagtacaggtgtgctccac

SEQ ID NO: 295141 - DNA, 368 bp, Homo sapiens
ggcttttccactgaggttcaggacttttccggaagttaccgtgctgtcaaatccctccgccccctgcaggaaacggaatccttccgcagctgcacgacgcctgtgtgtctggcctttccttcttcttctcttccccggcagcacagtgtggctgtttgtctccttgcccgccaaagttctgcccagtccaacgactccacgcagctcgcccttggacgcagcagctctcctgaattaccagccagtatcgtctagctacctgcaggacatctcactttgataactcaaagtactttaattgttcactgtttcttcagtgttcctggtttccattaatgacttcatctattcagttgcctgagcaaaaa

SEQ ID NO: 295142 - DNA, 2482 bp, Homo sapiens
aatacagtttccaaatatgagactgtttttactataaaaatacaactggccaggtgcagtggctcacgcctaaaatcccagctctttggatggccaaggcaggcggatcacttgaagtcaggagtttgagaccagcctggccaacagggtgaaatcttctctactaaaaatacaaaaattagccaggtgtggtgatggattcctgtaatcccagctactcaggaggctgaggcaggagaatcacttgaacctgggaggcagaagtttcagtgagctgagatcgtgccactgcaatccagcctgggtgacagagcaagactttgtctcaaaaaaaacaaacaaacaaacaaacaaaaaacaaactacaacttccttacaagacataatgacttcttttctccataaatgtctctagtattagttacatgattgtataatcttctaccttattttaacttgtcatagctatatatctgtgaagaaaatagaagagctaatgaatatgatttcaagaaagctttggacttgttggaatatattgatgaggaagaagatataaatataaatgatctaaaactggaaatcctttgcaaagctcttcagagagataactggtccagttctgatggcaaagatgatccaattgaagtatctaaagacagtatatttgtgaagatcttacagaaacttttaaaagatggcattcagctcagtgagtacttaccggaggtgaaagacctgctacaagcggatcagcttggaagcttaaagtccaatccttacttcgagtttgttttgaaagcaaattatgaatattatgttcagggacaaatataactttttctaaaaatggccattgtttatgaaatctgtataagtgtgtccttatacaaattttaggccataaacaagtgtaagtttgtacaatttcataacatgtatagctgagtttttatactttatatgtaggaagctaatataaaatagttatgtaactgtgattttggttttcagttatgtgacttgttttttccacctgaaatgtgtcagttgttgttcctgtactcggtgccctttctttttactctcacgtggtcccaggttctggagttcttgtcctggttctagctgctcacatgtacaaatcacttctaggcctcagtttctgcgactatgaaaattactagattgcactagcttgtctctaaaattgctgtgactccagatactttgcactgaagagaatctagggtgtttgatatctgtttcagttagggctaatgggaaatgtctagtaagataaatgtcaacttttgctgacttattatgagatgaaaaaccaaaggagagtgggcctaactcatgtgagcttgataactgatgaactcattgggagcattttaaacttttctacataaataataaatgagcactaatgaaagtattttagtgaatgaaacgtttatgtggttttctaacctatctagaaattactgttgatgtttagttctaatctttcagtgtggggattcagccagcctcatgtattttcagaatgactcatgaatctttaccacagtctgcctagctagtcaaaagcatgaatgatactagaaaccattataggttttcctaatatggcaattgatgtgactgaaaggtactgtactctcagagctttgtcctgaccagtgtcatcactcactcaatgtttatctgggttttaaataaaggccagaggttggacagggagttgctggcatgtccgcggcttggcccagtagaatgcccactaaccatcttgctccagcagctgaaaaggtcagaagttaaacatggtgaagagtccggttcctggattcacagagcccagcatcaggccgtctcccccgcaggctgcaaggccagcccttgagtatgtttggaagagcaggttaatggagctgtttgtaaatcaaagggaagaaattagcagcctgttctttttctctttgcagcttgtatgttaggacagcattagggtctgggttaggaacatgttggaaggtactaagagaagttaggaagagcagcttgtcagatggccagtaagaaaccgctgagtacttgtatcgtaagatgaggctttgcttttacgtggaggtcagctgtcagtgttcacgtctcacctgtaggaccctgtcgggtgataatgtgctgcgagacacacaggctcccatctccctcccgtgctgctgcaaacctggtgatccctggtgtatgggacagtaccgcaggaaagcccatctgatcatgccccagaacccactgatcgcgtggacgtagaacgactgctcttaccgtgtgaagtagagtcatcctgttcaagggaagaaaaagctccctcttttaatcctgtttctctctaagttagtagctattacacccaaatggttgagtttttaaaaattattttaacagtaaaaatgaaattaagacctag

SEQ ID NO: 295143 - DNA, 5236 bp, Homo sapiens
tgcgtttgacgtcatcatcgcgcgccatctcttcccttaggtgtttaagttccgcgcgcaggccaggctgcaacctgacggccagatccctcgctgtcctagtcgctgctccttggagtcatgttcccagccgccccttctccgcggaccccgggtaccgggtcccgaaggggcccgctggccggactcgggcccggctccacgccccggacggctagcaggaagggtctgcccctggggtctgcagtcagctccccagtgctcttctcgccggtcggccggcgtagctcgctaagctcgcggggaacaccaacacgaatgttcccacaccactccataactgagtctgtgaactatgatgtgaaaacgtttggatcttctcttcctgttaaagtcatggaagccctaacattggctgaagtcgatgaccagctgaccattaacatagatgaaggtggatgggcttgtctggtgtgcaaagagaagctcattatttggaagattgctctgtcacctattactaagttatccgtttgcaaagaacttcagctgccacctagtgatttccactggagtgccgacttagtggctctttcttactcttctccctcaggtgaagcacattctactcaggctgttgctgtcatggttgccaccagagaaggatctatccgctattggccaagccttgctggtgaagatacctacacagaggcttttgtagattcgggaggtgataagacttacagtttcctaacagcagtgcagggaggaagttttattttgtcttcatcaggaagccaactaattcggttgatacctgagagctcaggaaagattcatcagcatatcctgcctcaggggcaaggcatgctttcaggaattggtcgaaaagtttcttctctttttggaattttatctcctagtagtgatctcacactttcaagtgttctctgggatagagagagatcaagcttttatagcctgacgagttcaaacatcagtaaatgggaattagatgattcttcagaaaagcatgcatacagttgggatataaatagagccctgaaggaaaacattaccgatgctatttggggatctgaaagtaactatgaagctattaaagaaggagtcaacattcgatatttggacttgaagcaaaactgtgatgggctggtgattttggcagcagcatggcactcagcagacaatccatgtctcatctattactctctgataacaatagaagataatggttgccaaatgtcagatgcagttactgtagaagtcactcaatataatccaccttttcagtctgaagacctgattttgtgtcagttgacggtcccaaacttttcaaaccagactgcctatctgtataacgaaagtgctgtctatgtgtgctccacaggaactgggaaattttctcttccccaggagaaaattgtctttaatgcacaaggagatagtgttttaggtgctggtgcctgtggtggtgttcctatcattttttctagaaacagtggactggtgtctattacttcaagggaaaatgtgtctatattggcagaagacttggaagggtctttagcatcttcagttgctggaccaaacagtgagagtatgatttttgagaccactacaaagaatgaaactatagcccaggaagataaaatcaagttgctgaaagctgcctttctgcaatactgcagaaaagatttaggtcatgctcaaatggtggttgatgagctcttttcctctcactctgatttggattctgattctgaactagacagggcagttacccaaatcagtgtagacctgatggatgactacccagcatctgacccacggtgggctgagtctgtccctgaggaagcacctgggttcagcaatacgtcactgattatccttcaccagctagaagacaagatgaaagctcactcttttcttatggactttattcatcaagttggcttatttggacgtctaggcagttttccagttagagggacaccgatggccactcgactgttgctctgtgagcatgccgaaaagctgtcagccgccattgttctcaagaaccaccactcccggctttctgaccttgtcaacacagccatattgattgctttgaacaagagggagtatgaaatcccatccaacctgactcctgcagatgtctttttcagggaggtatcccaagtagataccatctgtgagtgcttactggagcatgaggagcaagtcttgagggatgcacctatggattccattgaatgggctgaagtggtgatcaatgtgaacaatattctcaaggatatgctgcaggctgctagtcattatcgccaaaatagaaactctttgtatagaagagaagaatcactagaaaaagaacctgaatatgttccatggacggcaacaagtggtcctggtggcatccgaacggtaataatacgccagcatgagattgtcctgaaggtggcttatccacaggcagacagcaacctccgaaacatcgtgaccgagcagctggtagccctgatcgattgcttcctggatggttatgtttctcagcttaagtctgtggataaatccagtaatcgggaaagatatgacaatctggagatggaatacctacagaaaagatcagatctcttatctcctcttctttcactaggccagtacctgtgggctgcttctctagcagagaaatactgtgactttgatatattggtacaaatgtgtgagcagactgacaaccagagccgactccagcgctacatgacccagtttgctgatcagaatttttcagactttctcttccgttggtatctggagaaaggaaagcgaggcaaattattatctcagcccatttctcagcatggacagttggcaaattttttgcaagctcatgaacatctcagctggttacatgaaattaatagccaagaattagaaaaggctcatgcaacacttctgggtttggcaaatatggaaactcgttactttgcaaagaagaaaacccttcttggcttgagtaaattggctgcattagcttcagacttttcagaggatatgctacaagaaaaaattgaagaaatggctgagcaggagcgctttctactgcatcaggagaccctacctgaacagctgctggcggagaaacagctaaatctcagtgcgatgccagtattgactgcaccacaactcattggtctatatatctgtgaagaaaatagaagagctaatgaatatgatttcaagaaagctttggacttgttggaatatattgatgaggaagaagatataaatataaatgatctaaaactggaaatcctttgcaaagctcttcagagagataactggtccagttctgatggcaaagatgatccaattgaagtatctaaagacagtatatttgtgaagatcttacagaaacttttaaaagatggcattcagctcagtgagtacttaccggaggtgaaagacctgctacaagcggatcagcttggaagcttaaagtccaatccttacttcgagtttgttttgaaagcaaattatgaatattatgttcagggacaaatataactttttctaaaaatggccattgtttatgaaatctgtataagtgtgtccttatacaaattttaggccataaacaagtgtaagtttgtacaatttcataacatgtatagctgagtttttatactttatatgtaggaagctaatataaaatagttatgtaactgtgattttggttttcagttatgtgacttgttttttccacctgaaatgtgtcagttgttgttcctgtactcggtgccctttctttttactctcacgtggtcccaggttctggagttcttgtcctggttctagctgctcacatgtacaaatcacttctaggcctcagtttctgcgactatgaaaattactagattgcactagcttgtctctaaaattgctgtgactccagatactttgcactgaagagaatctagggtgtttgatatctgtttcagttagggctaatgggaaatgtctagtaagataaatgtcaacttttgctgacttattatgagatgaaaaaccaaaggagagtgggcctaactcatgtgagcttgataactgatgaactcattgggagcattttaaacttttctacataaataataaatgagcactaatgaaagtattttagtgaatgaaacgtttatgtggttttctaacctatctagaaattactgttgatgtttagttctaatctttcagtgtggggattcagccagcctcatgtattttcagaatgactcatgaatctttaccacagtctgcctagctagtcaaaagcatgaatgatactagaaaccattataggttttcctaatatggcaattgatgtgactgaaaggtactgtactctcagagctttgtcctgaccagtgtcatcactcactcaatgtttatctgggttttaaataaaggccagaggttggacagggagttgctggcatgtccgcggcttggcccagtagaatgcccactaaccatcttgctccagcagctgaaaaggtcagaagttaaacatggtgaagagtccggttcctggattcacagagcccagcatcaggccgtctcccccgcaggctgcaaggccagcccttgagtatgtttggaagagcaggttaatggagctgtttgtaaatcaaagggaagaaattagcagcctgttctttttctctttgcagcttgtatgttaggacagcattagggtctgggttaggaacatgttggaaggtactaagagaagttaggaagagcagcttgtcagatggccagtaagaaaccgctgagtacttgtatcgtaagatgaggctttgcttttacgtggaggtcagctgtcagtgttcacgtctcacctgtaggaccctgtcgggtgataatgtgctgcgagacacacaggctcccatctccctcccgtgctgctgcaaacctggtgatccctggtgtatgggacagtaccgcaggaaagcccatctgatcatgccccagaacccactgatcgcgtggacgtagaacgactgctcttaccgtgtgaagtagagtcatcctgttcaagggaagaaaaagctccctcttttaatcctgtttctctctaagttagtagctattacacccaaatggttgagtttttaaaaattattttaacagtaaaaatgaaattaagacctag

SEQ ID NO: 295144 - DNA, 2131 bp, Homo sapiens
tctgtttgttacagcttagatacactactctcttctaccagtcattacttccttggccatgttccgttggaactcagggctcctgcttacctcaattcttcacttctgctgaactctgtgttactgctgcctagaaaagggtgtatgtggttaggagtaataggtgagggtgaattcctgggggacatactgagttagctgcgggatcctgatatttggctgagagtctaagaaattgtttcctaggtaacttggtataattactctttggtcatgctaattttaaatgtcagatgaacaaatcaagagtaaattgggaaagttccataggaagcctaagcactcatcttaaccttacttagtcttctcttaactggacttttctagcccaggaagaggttaggatagttgttcttcagagtttggtctacctttaagttttcatgattcaatactcttaagatactttgttttaaaattactgaaagcctgattaaaaggagatgtgagaagaaagaatatttgtagaatggtgtttccagcagtgagtcagaatctaaaatatgcagagaagggaaatcagatgcatcttcaaaatactggatttgatgtgaaagattttctgtttgggtttgttctacagttatccgtttgcaaagaacttcagctgccacctagtgatttccactggagtgccgacttagtggctctttcttactcttctccctcaggtgaagcacattctactcaggtaggtgacttaaaagcttatttaaataaactttttacaacaaggacatcctaaagttagaggaatcatcctctttgattttgagatataactataaacctatagaaatcaagatattgtggtattggcaaagagagctacacacataggtcagtgtaacagaatagagaatacagttatagatccacataaaggcacccatttggtctttgatgaaggtgcaaaagcaattcagaaaggatggtttttgacgatgatttttctctgtatcaatgcatagtgtaggaacatttgtaattttaaaattacaaatgaccaatttgtattgtattgtattgaattttcccttaaacctcataccttgttacaaagattaatttgaaatgggtcatagatctaaatgtaaaacagtaaaacttttagaagaaaacagaagaaaatcatcatgacctgagattagacagagttcttggaaatcaccaaaagcatgatccataaaagaaaagtttgataaaattaataataaaattaaaataaaataaaaatttaaagcgttgctttgccaaagacaagaaaatgaagagacaagttacagagtaagaagaatttgcaaatcatgtatccagcaaaggacttgtatccagaatattttttaaaattctaaacttgataagaaaacaatgcagtttaaaaacaggggctaggacttgaacagacacttagtgaggatataaggatggcacataagcacatgaagagatgttcagcatcattagccattagaaaaatgcaaaccaaaacactggtgagttcttatttctgatttttcttgatcaaatagtaaattgtcctgtttctttgtatcattgccatcagactgctggtttttgggttcctcttttattgtgattgctgattgttgtgatcttgttttgaggctgttgctgtcatggttgccaccagagaaggatctatccgctattggccaagccttgctggtgaagatacctacacagaggcttttgtagattcgggaggtgataagacttacagtttcctaacagcagtgcaggttcacaaagaaacaaaatctggctgagcatggtggctcatgcgtgcagtctcaccactttgaatggtcttgaactcctggtctcaagcagtcttcccgcttcggcctcccaaagtgctgagattatagacatgagccactgctccggccaggtctggtggactcttaagcacctaaagctagatgagcttaaatctcatctaagccaatatttataaaatgtatttgaccacaacatatggtaaaagctgatgttttatattctgtctttcaaaaatgttgagatctgcaaaatgacccgctgtttg

SEQ ID NO: 295145 - DNA, 786 bp, Homo sapiens
aatacagtttccaaatatgagactgtttttactataaaaatacaactggccaggtgcagtggctcacgcctaaaatcccagctctttggatggccaaggcaggcggatcacttgaagtcaggagtttgagaccagcctggccaacagggtgaaatcttctctactaaaaatacaaaaattagccaggtgtggtgatggattcctgtaatcccagctactcaggaggctgaggcaggagaatcacttgaacctgggaggcagaagtttcagtgagctgagatcgtgccactgcaatccagcctgggtgacagagcaagactttgtctcaaaaaaaacaaacaaacaaacaaacaaaaaacaaactacaacttccttacaagacataatgacttcttttctccataaatgtctctagtattagttacatgattgtataatcttctaccttattttaacttgtcatagctatatatctgtgaagaaaatagaagagctaatgaatatgatttcaagaaagctttggacttgttggaatatattgatgaggaagaagatataaatataaatgatctaaaactggaaatcctttgcaaagctcttcagagagataagtaagtgctcgtggcattgcttctttggaaagtatagaaactgcttttcctctgctctcaccacatgacagtcaataacagaagacttctgtgaccagacgtgttgggatttcccacctcctacactgggcaaccagtgagttctgttggtgggcaccagctgaatgtcctttaa

SEQ ID NO: 295146 - DNA, 6173 bp, Homo sapiens
tgcgtttgacgtcatcatcgcgcgccatctcttcccttaggtgtttaagttccgcgcgcaggccaggctgcaacctgacggccagatccctcgctgtcctagtcgctgctccttggagtcatgttcccagccgccccttctccgcggaccccgggtaccgggtcccgaaggggcccgctggccggactcgggcccggctccacgccccggacggctagcaggaagggtctgcccctggggtctgcagtcagctccccagtgctcttctcgccggtcggccggcgtagctcgctaagctcgcggggaacaccaacacgaatgttcccacaccactccataactgagtctgtgaactatgatgtgaaaacgtttggatcttctcttcctgttaaagtcatggaagccctaacattggctgaagtcgatgaccagctgaccattaacatagatgaaggtggatgggcttgtctggtgtgcaaagagaagctcattatttggaagattgctctgtcacctattactaagttatccgtttgcaaagaacttcagctgccacctagtgatttccactggagtgccgacttagtggctctttcttactcttctccctcaggtgaagcacattctactcaggtaggtgacttaaaagcttatttaaataaactttttacaacaaggacatcctaaagttagaggaatcatcctctttgattttgagatataactataaacctatagaaatcaagatattgtggtattggcaaagagagctacacacataggtcagtgtaacagaatagagaatacagttatagatccacataaaggcacccatttggtctttgatgaaggtgcaaaagcaattcagaaaggatggtttttgacgatgatttttctctgtatcaatgcatagtgtaggaacatttgtaattttaaaattacaaatgaccaatttgtattgtattgtattgaattttcccttaaacctcataccttgttacaaagattaatttgaaatgggtcatagatctaaatgtaaaacagtaaaacttttagaagaaaacagaagaaaatcatcatgacctgagattagacagagttcttggaaatcaccaaaagcatgatccataaaagaaaagtttgataaaattaataataaaattaaaataaaataaaaatttaaagcgttgctttgccaaagacaagaaaatgaagagacaagttacagagtaagaagaatttgcaaatcatgtatccagcaaaggacttgtatccagaatattttttaaaattctaaacttgataagaaaacaatgcagtttaaaaacaggggctaggacttgaacagacacttagtgaggatataaggatggcacataagcacatgaagagatgttcagcatcattagccattagaaaaatgcaaaccaaaacactggtgagttcttatttctgatttttcttgatcaaatagtaaattgtcctgtttctttgtatcattgccatcagactgctggtttttgggttcctcttttattgtgattgctgattgttgtgatcttgttttgaggctgttgctgtcatggttgccaccagagaaggatctatccgctattggccaagccttgctggtgaagatacctacacagaggcttttgtagattcgggaggtgataagacttacagtttcctaacagcagtgcagggaggaagttttattttgtcttcatcaggaagccaactaattcggttgatacctgagagctcaggaaagattcatcagcatatcctgcctcaggggcaaggcatgctttcaggaattggtcgaaaagtttcttctctttttggaattttatctcctagtagtgatctcacactttcaagtgttctctgggatagagagagatcaagcttttatagcctgacgagttcaaacatcagtaaatgggaattagatgattcttcagaaaagcatgcatacagttgggatataaatagagccctgaaggaaaacattaccgatgctatttggggatctgaaagtaactatgaagctattaaagaaggagtcaacattcgatatttggacttgaagcaaaactgtgatgggctggtgattttggcagcagcatggcactcagcagacaatccatgtctcatctattactctctgataacaatagaagataatggttgccaaatgtcagatgcagttactgtagaagtcactcaatataatccaccttttcagtctgaagacctgattttgtgtcagttgacggtcccaaacttttcaaaccagactgcctatctgtataacgaaagtgctgtctatgtgtgctccacaggaactgggaaattttctcttccccaggagaaaattgtctttaatgcacaaggagatagtgttttaggtgctggtgcctgtggtggtgttcctatcattttttctagaaacagtggactggtgtctattacttcaagggaaaatgtgtctatattggcagaagacttggaagggtctttagcatcttcagttgctggaccaaacagtgagagtatgatttttgagaccactacaaagaatgaaactatagcccaggaagataaaatcaagttgctgaaagctgcctttctgcaatactgcagaaaagatttaggtcatgctcaaatggtggttgatgagctcttttcctctcactctgatttggattctgattctgaactagacagggcagttacccaaatcagtgtagacctgatggatgactacccagcatctgacccacggtgggctgagtctgtccctgaggaagcacctgggttcagcaatacgtcactgattatccttcaccagctagaagacaagatgaaagctcactcttttcttatggactttattcatcaagttggcttatttggacgtctaggcagttttccagttagagggacaccgatggccactcgactgttgctctgtgagcatgccgaaaagctgtcagccgccattgttctcaagaaccaccactcccggctttctgaccttgtcaacacagccatattgattgctttgaacaagagggagtatgaaatcccatccaacctgactcctgcagatgtctttttcagggaggtatcccaagtagataccatctgtgagtgcttactggagcatgaggagcaagtcttgagggatgcacctatggattccattgaatgggctgaagtggtgatcaatgtgaacaatattctcaaggatatgctgcaggctgctagtcattatcgccaaaatagaaactctttgtatagaagagaagaatcactagaaaaagaacctgaatatgttccatggacggcaacaagtggtcctggtggcatccgaacggtaataatacgccagcatgagattgtcctgaaggtggcttatccacaggcagacagcaacctccgaaacatcgtgaccgagcagctggtagccctgatcgattgcttcctggatggttatgtttctcagcttaagtctgtggataaatccagtaatcgggaaagatatgacaatctggagatggaatacctacagaaaagatcagatctcttatctcctcttctttcactaggccagtacctgtgggctgcttctctagcagagaaatactgtgactttgatatattggtacaaatgtgtgagcagactgacaaccagagccgactccagcgctacatgacccagtttgctgatcagaatttttcagactttctcttccgttggtatctggagaaaggaaagcgaggcaaattattatctcagcccatttctcagcatggacagttggcaaattttttgcaagctcatgaacatctcagctggttacatgaaattaatagccaagaattagaaaaggctcatgcaacacttctgggtttggcaaatatggaaactcgttactttgcaaagaagaaaacccttcttggcttgagtaaattggctgcattagcttcagacttttcagaggatatgctacaagaaaaaattgaagaaatggctgagcaggagcgctttctactgcatcaggagaccctacctgaacagctgctggcggagaaacagctaaatctcagtgcgatgccagtattgactgcaccacaactcattggtctatatatctgtgaagaaaatagaagagctaatgaatatgatttcaagaaagctttggacttgttggaatatattgatgaggaagaagatataaatataaatgatctaaaactggaaatcctttgcaaagctcttcagagagataactggtccagttctgatggcaaagatgatccaattgaagtatctaaagacagtatatttgtgaagatcttacagaaacttttaaaagatggcattcagctcagtgagtacttaccggaggtgaaagacctgctacaagcggatcagcttggaagcttaaagtccaatccttacttcgagtttgttttgaaagcaaattatgaatattatgttcagggacaaatataactttttctaaaaatggccattgtttatgaaatctgtataagtgtgtccttatacaaattttaggccataaacaagtgtaagtttgtacaatttcataacatgtatagctgagtttttatactttatatgtaggaagctaatataaaatagttatgtaactgtgattttggttttcagttatgtgacttgttttttccacctgaaatgtgtcagttgttgttcctgtactcggtgccctttctttttactctcacgtggtcccaggttctggagttcttgtcctggttctagctgctcacatgtacaaatcacttctaggcctcagtttctgcgactatgaaaattactagattgcactagcttgtctctaaaattgctgtgactccagatactttgcactgaagagaatctagggtgtttgatatctgtttcagttagggctaatgggaaatgtctagtaagataaatgtcaacttttgctgacttattatgagatgaaaaaccaaaggagagtgggcctaactcatgtgagcttgataactgatgaactcattgggagcattttaaacttttctacataaataataaatgagcactaatgaaagtattttagtgaatgaaacgtttatgtggttttctaacctatctagaaattactgttgatgtttagttctaatctttcagtgtggggattcagccagcctcatgtattttcagaatgactcatgaatctttaccacagtctgcctagctagtcaaaagcatgaatgatactagaaaccattataggttttcctaatatggcaattgatgtgactgaaaggtactgtactctcagagctttgtcctgaccagtgtcatcactcactcaatgtttatctgggttttaaataaaggccagaggttggacagggagttgctggcatgtccgcggcttggcccagtagaatgcccactaaccatcttgctccagcagctgaaaaggtcagaagttaaacatggtgaagagtccggttcctggattcacagagcccagcatcaggccgtctcccccgcaggctgcaaggccagcccttgagtatgtttggaagagcaggttaatggagctgtttgtaaatcaaagggaagaaattagcagcctgttctttttctctttgcagcttgtatgttaggacagcattagggtctgggttaggaacatgttggaaggtactaagagaagttaggaagagcagcttgtcagatggccagtaagaaaccgctgagtacttgtatcgtaagatgaggctttgcttttacgtggaggtcagctgtcagtgttcacgtctcacctgtaggaccctgtcgggtgataatgtgctgcgagacacacaggctcccatctccctcccgtgctgctgcaaacctggtgatccctggtgtatgggacagtaccgcaggaaagcccatctgatcatgccccagaacccactgatcgcgtggacgtagaacgactgctcttaccgtgtgaagtagagtcatcctgttcaagggaagaaaaagctccctcttttaatcctgtttctctctaagttagtagctattacacccaaatggttgagtttttaaaaattattttaacagtaaaaatgaaattaagacctag

SEQ ID NO: 295147 - DNA, 6291 bp, Homo sapiens
tctgtttgttacagcttagatacactactctcttctaccagtcattacttccttggccatgttccgttggaactcagggctcctgcttacctcaattcttcacttctgctgaactctgtgttactgctgcctagaaaagggtgtatgtggttaggagtaataggtgagggtgaattcctgggggacatactgagttagctgcgggatcctgatatttggctgagagtctaagaaattgtttcctaggtaacttggtataattactctttggtcatgctaattttaaatgtcagatgaacaaatcaagagtaaattgggaaagttccataggaagcctaagcactcatcttaaccttacttagtcttctcttaactggacttttctagcccaggaagaggttaggatagttgttcttcagagtttggtctacctttaagttttcatgattcaatactcttaagatactttgttttaaaattactgaaagcctgattaaaaggagatgtgagaagaaagaatatttgtagaatggtgtttccagcagtgagtcagaatctaaaatatgcagagaagggaaatcagatgcatcttcaaaatactggatttgatgtgaaagattttctgtttgggtttgttctacagttatccgtttgcaaagaacttcagctgccacctagtgatttccactggagtgccgacttagtggctctttcttactcttctccctcaggtgaagcacattctactcaggtaggtgacttaaaagcttatttaaataaactttttacaacaaggacatcctaaagttagaggaatcatcctctttgattttgagatataactataaacctatagaaatcaagatattgtggtattggcaaagagagctacacacataggtcagtgtaacagaatagagaatacagttatagatccacataaaggcacccatttggtctttgatgaaggtgcaaaagcaattcagaaaggatggtttttgacgatgatttttctctgtatcaatgcatagtgtaggaacatttgtaattttaaaattacaaatgaccaatttgtattgtattgtattgaattttcccttaaacctcataccttgttacaaagattaatttgaaatgggtcatagatctaaatgtaaaacagtaaaacttttagaagaaaacagaagaaaatcatcatgacctgagattagacagagttcttggaaatcaccaaaagcatgatccataaaagaaaagtttgataaaattaataataaaattaaaataaaataaaaatttaaagcgttgctttgccaaagacaagaaaatgaagagacaagttacagagtaagaagaatttgcaaatcatgtatccagcaaaggacttgtatccagaatattttttaaaattctaaacttgataagaaaacaatgcagtttaaaaacaggggctaggacttgaacagacacttagtgaggatataaggatggcacataagcacatgaagagatgttcagcatcattagccattagaaaaatgcaaaccaaaacactggtgagttcttatttctgatttttcttgatcaaatagtaaattgtcctgtttctttgtatcattgccatcagactgctggtttttgggttcctcttttattgtgattgctgattgttgtgatcttgttttgaggctgttgctgtcatggttgccaccagagaaggatctatccgctattggccaagccttgctggtgaagatacctacacagaggcttttgtagattcgggaggtgataagacttacagtttcctaacagcagtgcagggaggaagttttattttgtcttcatcaggaagccaactaattcggttgatacctgagagctcaggaaagattcatcagcatatcctgcctcaggggcaaggcatgctttcaggaattggtcgaaaagtttcttctctttttggaattttatctcctagtagtgatctcacactttcaagtgttctctgggatagagagagatcaagcttttatagcctgacgagttcaaacatcagtaaatgggaattagatgattcttcagaaaagcatgcatacagttgggatataaatagagccctgaaggaaaacattaccgatgctatttggggatctgaaagtaactatgaagctattaaagaaggagtcaacattcgatatttggacttgaagcaaaactgtgatgggctggtgattttggcagcagcatggcactcagcagacaatccatgtctcatctattactctctgataacaatagaagataatggttgccaaatgtcagatgcagttactgtagaagtcactcaatataatccaccttttcagtctgaagacctgattttgtgtcagttgacggtcccaaacttttcaaaccagactgcctatctgtataacgaaagtgctgtctatgtgtgctccacaggaactgggaaattttctcttccccaggagaaaattgtctttaatgcacaaggagatagtgttttaggtgctggtgcctgtggtggtgttcctatcattttttctagaaacagtggactggtgtctattacttcaagggaaaatgtgtctatattggcagaagacttggaagggtctttagcatcttcagttgctggaccaaacagtgagagtatgatttttgagaccactacaaagaatgaaactatagcccaggaagataaaatcaagttgctgaaagctgcctttctgcaatactgcagaaaagatttaggtcatgctcaaatggtggttgatgagctcttttcctctcactctgatttggattctgattctgaactagacagggcagttacccaaatcagtgtagacctgatggatgactacccagcatctgacccacggtgggctgagtctgtccctgaggaagcacctgggttcagcaatacgtcactgattatccttcaccagctagaagacaagatgaaagctcactcttttcttatggactttattcatcaagttggcttatttggacgtctaggcagttttccagttagagggacaccgatggccactcgactgttgctctgtgagcatgccgaaaagctgtcagccgccattgttctcaagaaccaccactcccggctttctgaccttgtcaacacagccatattgattgctttgaacaagagggagtatgaaatcccatccaacctgactcctgcagatgtctttttcagggaggtatcccaagtagataccatctgtgagtgcttactggagcatgaggagcaagtcttgagggatgcacctatggattccattgaatgggctgaagtggtgatcaatgtgaacaatattctcaaggatatgctgcaggctgctagtcattatcgccaaaatagaaactctttgtatagaagagaagaatcactagaaaaagaacctgaatatgttccatggacggcaacaagtggtcctggtggcatccgaacggtaataatacgccagcatgagattgtcctgaaggtggcttatccacaggcagacagcaacctccgaaacatcgtgaccgagcagctggtagccctgatcgattgcttcctggatggttatgtttctcagcttaagtctgtggataaatccagtaatcgggaaagatatgacaatctggagatggaatacctacagaaaagatcagatctcttatctcctcttctttcactaggccagtacctgtgggctgcttctctagcagagaaatactgtgactttgatatattggtacaaatgtgtgagcagactgacaaccagagccgactccagcgctacatgacccagtttgctgatcagaatttttcagactttctcttccgttggtatctggagaaaggaaagcgaggcaaattattatctcagcccatttctcagcatggacagttggcaaattttttgcaagctcatgaacatctcagctggttacatgaaattaatagccaagaattagaaaaggctcatgcaacacttctgggtttggcaaatatggaaactcgttactttgcaaagaagaaaacccttcttggcttgagtaaattggctgcattagcttcagacttttcagaggatatgctacaagaaaaaattgaagaaatggctgagcaggagcgctttctactgcatcaggagaccctacctgaacagctgctggcggagaaacagctaaatctcagtgcgatgccagtattgactgcaccacaactcattggtctatatatctgtgaagaaaatagaagagctaatgaatatgatttcaagaaagctttggacttgttggaatatattgatgaggaagaagatataaatataaatgatctaaaactggaaatcctttgcaaagctcttcagagagataactggtccagttctgatggcaaagatgatccaattgaagtatctaaagacagtatatttgtgaagatcttacagaaacttttaaaagatggcattcagctcagtgagtacttaccggaggtgaaagacctgctacaagcggatcagcttggaagcttaaagtccaatccttacttcgagtttgttttgaaagcaaattatgaatattatgttcagggacaaatataactttttctaaaaatggccattgtttatgaaatctgtataagtgtgtccttatacaaattttaggccataaacaagtgtaagtttgtacaatttcataacatgtatagctgagtttttatactttatatgtaggaagctaatataaaatagttatgtaactgtgattttggttttcagttatgtgacttgttttttccacctgaaatgtgtcagttgttgttcctgtactcggtgccctttctttttactctcacgtggtcccaggttctggagttcttgtcctggttctagctgctcacatgtacaaatcacttctaggcctcagtttctgcgactatgaaaattactagattgcactagcttgtctctaaaattgctgtgactccagatactttgcactgaagagaatctagggtgtttgatatctgtttcagttagggctaatgggaaatgtctagtaagataaatgtcaacttttgctgacttattatgagatgaaaaaccaaaggagagtgggcctaactcatgtgagcttgataactgatgaactcattgggagcattttaaacttttctacataaataataaatgagcactaatgaaagtattttagtgaatgaaacgtttatgtggttttctaacctatctagaaattactgttgatgtttagttctaatctttcagtgtggggattcagccagcctcatgtattttcagaatgactcatgaatctttaccacagtctgcctagctagtcaaaagcatgaatgatactagaaaccattataggttttcctaatatggcaattgatgtgactgaaaggtactgtactctcagagctttgtcctgaccagtgtcatcactcactcaatgtttatctgggttttaaataaaggccagaggttggacagggagttgctggcatgtccgcggcttggcccagtagaatgcccactaaccatcttgctccagcagctgaaaaggtcagaagttaaacatggtgaagagtccggttcctggattcacagagcccagcatcaggccgtctcccccgcaggctgcaaggccagcccttgagtatgtttggaagagcaggttaatggagctgtttgtaaatcaaagggaagaaattagcagcctgttctttttctctttgcagcttgtatgttaggacagcattagggtctgggttaggaacatgttggaaggtactaagagaagttaggaagagcagcttgtcagatggccagtaagaaaccgctgagtacttgtatcgtaagatgaggctttgcttttacgtggaggtcagctgtcagtgttcacgtctcacctgtaggaccctgtcgggtgataatgtgctgcgagacacacaggctcccatctccctcccgtgctgctgcaaacctggtgatccctggtgtatgggacagtaccgcaggaaagcccatctgatcatgccccagaacccactgatcgcgtggacgtagaacgactgctcttaccgtgtgaagtagagtcatcctgttcaagggaagaaaaagctccctcttttaatcctgtttctctctaagttagtagctattacacccaaatggttgagtttttaaaaattattttaacagtaaaaatgaaattaagacctag

SEQ ID NO: 295148 - DNA, 2939 bp, Homo sapiens
aacacattaactttttttccaggatatgctgcaggctgctagtcattatcgccaaaatagaaactctttgtatagaagagaagaatcactagaaaaagaacctgaatatgttccatggacggcaacaagtggtcctggtggcatccgaacggtaataatacgccagcatgagattgtcctgaaggtggcttatccacaggcagacagcaacctccgaaacatcgtgaccgagcagctggtagccctgatcgattgcttcctggatggttatgtttctcagcttaagtctgtggataaatccagtaatcgggaaagatatgacaatctggagatggaatacctacagaaaagatcagatctcttatctcctcttctttcactaggccagtacctgtgggctgcttctctagcagagaaatactgtgactttgatatattggtacaaatgtgtgagcagactgacaaccagagccgactccagcgctacatgacccagtttgctgatcagaatttttcagactttctcttccgttggtatctggagaaaggaaagcgaggcaaattattatctcagcccatttctcagcatggacagttggcaaattttttgcaagctcatgaacatctcagctggttacatgaaattaatagccaagaattagaaaaggctcatgcaacacttctgggtttggcaaatatggaaactcgttactttgcaaagaagaaaacccttcttggcttgagtaaattggctgcattagcttcagacttttcagaggatatgctacaagaaaaaattgaagaaatggctgagcaggagcgctttctactgcatcaggagaccctacctgaacagctgctggcggagaaacagctaaatctcagtgcgatgccagtattgactgcaccacaactcattggtctatatatctgtgaagaaaatagaagagctaatgaatatgatttcaagaaagctttggacttgttggaatatattgatgaggaagaagatataaatataaatgatctaaaactggaaatcctttgcaaagctcttcagagagataactggtccagttctgatggcaaagatgatccaattgaagtatctaaagacagtatatttgtgaagatcttacagaaacttttaaaagatggcattcagctcagtgagtacttaccggaggtgaaagacctgctacaagcggatcagcttggaagcttaaagtccaatccttacttcgagtttgttttgaaagcaaattatgaatattatgttcagggacaaatataactttttctaaaaatggccattgtttatgaaatctgtataagtgtgtccttatacaaattttaggccataaacaagtgtaagtttgtacaatttcataacatgtatagctgagtttttatactttatatgtaggaagctaatataaaatagttatgtaactgtgattttggttttcagttatgtgacttgttttttccacctgaaatgtgtcagttgttgttcctgtactcggtgccctttctttttactctcacgtggtcccaggttctggagttcttgtcctggttctagctgctcacatgtacaaatcacttctaggcctcagtttctgcgactatgaaaattactagattgcactagcttgtctctaaaattgctgtgactccagatactttgcactgaagagaatctagggtgtttgatatctgtttcagttagggctaatgggaaatgtctagtaagataaatgtcaacttttgctgacttattatgagatgaaaaaccaaaggagagtgggcctaactcatgtgagcttgataactgatgaactcattgggagcattttaaacttttctacataaataataaatgagcactaatgaaagtattttagtgaatgaaacgtttatgtggttttctaacctatctagaaattactgttgatgtttagttctaatctttcagtgtggggattcagccagcctcatgtattttcagaatgactcatgaatctttaccacagtctgcctagctagtcaaaagcatgaatgatactagaaaccattataggttttcctaatatggcaattgatgtgactgaaaggtactgtactctcagagctttgtcctgaccagtgtcatcactcactcaatgtttatctgggttttaaataaaggccagaggttggacagggagttgctggcatgtccgcggcttggcccagtagaatgcccactaaccatcttgctccagcagctgaaaaggtcagaagttaaacatggtgaagagtccggttcctggattcacagagcccagcatcaggccgtctcccccgcaggctgcaaggccagcccttgagtatgtttggaagagcaggttaatggagctgtttgtaaatcaaagggaagaaattagcagcctgttctttttctctttgcagcttgtatgttaggacagcattagggtctgggttaggaacatgttggaaggtactaagagaagttaggaagagcagcttgtcagatggccagtaagaaaccgctgagtacttgtatcgtaagatgaggctttgcttttacgtggaggtcagctgtcagtgttcacgtctcacctgtaggaccctgtcgggtgataatgtgctgcgagacacacaggctcccatctccctcccgtgctgctgcaaacctggtgatccctggtgtatgggacagtaccgcaggaaagcccatctgatcatgccccagaacccactgatcgcgtggacgtagaacgactgctcttaccgtgtgaagtagagtcatcctgttcaagggaagaaaaagctccctcttttaatcctgtttctctctaagttagtagctattacacccaaatggttgagtttttaaaaattattttaacagtaaaaatgaaattaagacctag

SEQ ID NO: 295149 - DNA, 5117 bp, Homo sapiens
tgcgtttgacgtcatcatcgcgcgccatctcttcccttaggtgtttaagttccgcgcgcaggccaggctgcaacctgacggccagatccctcgctgtcctagtcgctgctccttggagtcatgttcccagccgccccttctccgcggaccccgggtaccgggtcccgaaggggcccgctggccggactcgggcccggctccacgccccggacggctagcaggaagggtctgcccctggggtctgcagtcagctccccagtgctcttctcgccggtcggccggcgtagctcgctaagctcgcggggaacaccaacacgaatgttcccacaccactccataactgagtctgtgaactatgatgtgaaaacgtttggatcttctcttcctgttaaagtcatggaagccctaacattggctgaagtcgatgaccagctgaccattaacatagatgaaggtggatgggcttgtctggtgtgcaaagagaagctcattatttggaagattgctctgtcacctattactaagttatccgtttgcaaagaacttcagctgccacctagtgatttccactggagtgccgacttagtggctctttcttactcttctccctcaggtgaagcacattctactcaggctgttgctgtcatggttgccaccagagaaggatctatccgctattggccaagccttgctggtgaagatacctacacagaggcttttgtagattcgggaggtgataagacttacagtttcctaacagcagtgcagggaggaagttttattttgtcttcatcaggaagccaactaattcggttgatacctgagagctcaggaaagattcatcagcatatcctgcctcaggggcaaggcatgctttcaggaattggtcgaaaagtttcttctctttttggaattttatctcctagtagtgatctcacactttcaagtgttctctgggatagagagagatcaagcttttatagcctgacgagttcaaacatcagtaaatgggaattagatgattcttcagaaaagcatgcatacagttgggatataaatagagccctgaaggaaaacattaccgatgctatttggggatctgaaagtaactatgaagctattaaagaaggagtcaacattcgatatttggacttgaagcaaaactgtgatgggctggtgattttggcagcagcatggcactcagcagacaatccatgtctcatctattactctctgataacaatagaagataatggttgccaaatgtcagatgcagttactgtagaagtcactcaatataatccaccttttcagtctgaagacctgattttgtgtcagttgacggtcccaaacttttcaaaccagactgcctatctgtataacgaaagtgctgtctatgtgtgctccacaggaactgggaaattttctcttccccaggagaaaattgtctttaatgcacaaggagatagtgttttaggtgctggtgcctgtggtggtgttcctatcattttttctagaaacagtggactggtgtctattacttcaagggaaaatgtgtctatattggcagaagacttggaagggtctttagcatcttcagttgctggaccaaacagtgagagtatgatttttgagaccactacaaagaatgaaactatagcccaggaagataaaatcaagttgctgaaagctgcctttctgcaatactgcagaaaagatttaggtcatgctcaaatggtggttgatgagctcttttcctctcactctgatttggattctgattctgaactagacagggcagttacccaaatcagtgtagacctgatggatgactacccagcatctgacccacggtgggctgagtctgtccctgaggaagcacctgggttcagcaatacgtcactgattatccttcaccagctagaagacaagatgaaagctcactcttttcttatggactttattcatcaagttggcttatttggacgtctaggcagttttccagttagagggacaccgatggccactcgactgttgctctgtgagcatgccgaaaagctgtcagccgccattgttctcaagaaccaccactcccggctttctgaccttgtcaacacagccatattgattgctttgaacaagagggagtatgaaatcccatccaacctgactcctgcagatgtctttttcagggaggtatcccaagtagataccatctgtgagtgcttactggagcatgaggagcaagtcttgagggatgcacctatggattccattgaatgggctgaagtggtgatcaatgtgaacaatattctcaaggatatgctgcaggctgctagtcattatcgccaaaatagaaactctttgtatagaagagaagaatcactagaaaaagaacctgaatatgttccatggacggcaacaagtggtcctggtggcatccgaacggtaataatacgccagcatgagattgtcctgaaggtggcttatccacaggcagacagcaacctccgaaacatcgtgaccgagcagctggtagccctgatcgattgcttcctggatggttatgtttctcagcttaagtctgtggataaatccagtaatcgggaaagatatgacaatctggagatggaatacctacagaaaagatcagatctcttatctcctcttctttcactaggccagtacctgtgggctgcttctctagcagagaaatactgtgactttgatatattggtacaaatgtgtgagcagactgacaaccagagccgactccagcgctacatgacccagtttgctgatcagaatttttcagactttctcttccgttggtatctggagaaaggaaagcgaggcaaattattatctcagcccatttctcagcatggacagttggcaaattttttgcaagctcatgaacatctcagctggttacatgaaattaatagccaagaattagaaaaggctcatgcaacacttctgggtttggcaaatatggaaactcgttactttgcaaagaagaaaacccttcttggcttgagtaaattggctgcattagcttcagacttttcagaggatatgctacaagaaaaaattgaagctatatatctgtgaagaaaatagaagagctaatgaatatgatttcaagaaagctttggacttgttggaatatattgatgaggaagaagatataaatataaatgatctaaaactggaaatcctttgcaaagctcttcagagagataactggtccagttctgatggcaaagatgatccaattgaagtatctaaagacagtatatttgtgaagatcttacagaaacttttaaaagatggcattcagctcagtgagtacttaccggaggtgaaagacctgctacaagcggatcagcttggaagcttaaagtccaatccttacttcgagtttgttttgaaagcaaattatgaatattatgttcagggacaaatataactttttctaaaaatggccattgtttatgaaatctgtataagtgtgtccttatacaaattttaggccataaacaagtgtaagtttgtacaatttcataacatgtatagctgagtttttatactttatatgtaggaagctaatataaaatagttatgtaactgtgattttggttttcagttatgtgacttgttttttccacctgaaatgtgtcagttgttgttcctgtactcggtgccctttctttttactctcacgtggtcccaggttctggagttcttgtcctggttctagctgctcacatgtacaaatcacttctaggcctcagtttctgcgactatgaaaattactagattgcactagcttgtctctaaaattgctgtgactccagatactttgcactgaagagaatctagggtgtttgatatctgtttcagttagggctaatgggaaatgtctagtaagataaatgtcaacttttgctgacttattatgagatgaaaaaccaaaggagagtgggcctaactcatgtgagcttgataactgatgaactcattgggagcattttaaacttttctacataaataataaatgagcactaatgaaagtattttagtgaatgaaacgtttatgtggttttctaacctatctagaaattactgttgatgtttagttctaatctttcagtgtggggattcagccagcctcatgtattttcagaatgactcatgaatctttaccacagtctgcctagctagtcaaaagcatgaatgatactagaaaccattataggttttcctaatatggcaattgatgtgactgaaaggtactgtactctcagagctttgtcctgaccagtgtcatcactcactcaatgtttatctgggttttaaataaaggccagaggttggacagggagttgctggcatgtccgcggcttggcccagtagaatgcccactaaccatcttgctccagcagctgaaaaggtcagaagttaaacatggtgaagagtccggttcctggattcacagagcccagcatcaggccgtctcccccgcaggctgcaaggccagcccttgagtatgtttggaagagcaggttaatggagctgtttgtaaatcaaagggaagaaattagcagcctgttctttttctctttgcagcttgtatgttaggacagcattagggtctgggttaggaacatgttggaaggtactaagagaagttaggaagagcagcttgtcagatggccagtaagaaaccgctgagtacttgtatcgtaagatgaggctttgcttttacgtggaggtcagctgtcagtgttcacgtctcacctgtaggaccctgtcgggtgataatgtgctgcgagacacacaggctcccatctccctcccgtgctgctgcaaacctggtgatccctggtgtatgggacagtaccgcaggaaagcccatctgatcatgccccagaacccactgatcgcgtggacgtagaacgactgctcttaccgtgtgaagtagagtcatcctgttcaagggaagaaaaagctccctcttttaatcctgtttctctctaagttagtagctattacacccaaatggttgagtttttaaaaattattttaacagtaaaaatgaaattaagacctag

SEQ ID NO: 295150 - DNA, 2385 bp, Homo sapiens
tctagagggtccccgaggccgatgtctcaggatggaggtcgtgaaatgggtatccgggagctcatgaacatctcagctggttacatgaaattaatagccaagaattagaaaaggctcatgcaacacttctgggtttggcaaatatggaaactcgttactttgcaaagaagaaaacccttcttggcttgagtaaattggctgcattagcttcagacttttcagaggatatgctacaagaaaaaattgaagaaatggctgagcaggagcgctttctactgcatcaggagaccctacctgaacagctgctggcggagaaacagctaaatctcagtgcgatgccagtattgactgcaccacaactcattggtctatatatctgtgaagaaaatagaagagctaatgaatatgatttcaagaaagctttggacttgttggaatatattgatgaggaagaagatataaatataaatgatctaaaactggaaatcctttgcaaagctcttcagagagataactggtccagttctgatggcaaagatgatccaattgaagtatctaaagacagtatatttgtgaagatcttacagaaacttttaaaagatggcattcagctcagtgagtacttaccggaggtgaaagacctgctacaagcggatcagcttggaagcttaaagtccaatccttacttcgagtttgttttgaaagcaaattatgaatattatgttcagggacaaatataactttttctaaaaatggccattgtttatgaaatctgtataagtgtgtccttatacaaattttaggccataaacaagtgtaagtttgtacaatttcataacatgtatagctgagtttttatactttatatgtaggaagctaatataaaatagttatgtaactgtgattttggttttcagttatgtgacttgttttttccacctgaaatgtgtcagttgttgttcctgtactcggtgccctttctttttactctcacgtggtcccaggttctggagttcttgtcctggttctagctgctcacatgtacaaatcacttctaggcctcagtttctgcgactatgaaaattactagattgcactagcttgtctctaaaattgctgtgactccagatactttgcactgaagagaatctagggtgtttgatatctgtttcagttagggctaatgggaaatgtctagtaagataaatgtcaacttttgctgacttattatgagatgaaaaaccaaaggagagtgggcctaactcatgtgagcttgataactgatgaactcattgggagcattttaaacttttctacataaataataaatgagcactaatgaaagtattttagtgaatgaaacgtttatgtggttttctaacctatctagaaattactgttgatgtttagttctaatctttcagtgtggggattcagccagcctcatgtattttcagaatgactcatgaatctttaccacagtctgcctagctagtcaaaagcatgaatgatactagaaaccattataggttttcctaatatggcaattgatgtgactgaaaggtactgtactctcagagctttgtcctgaccagtgtcatcactcactcaatgtttatctgggttttaaataaaggccagaggttggacagggagttgctggcatgtccgcggcttggcccagtagaatgcccactaaccatcttgctccagcagctgaaaaggtcagaagttaaacatggtgaagagtccggttcctggattcacagagcccagcatcaggccgtctcccccgcaggctgcaaggccagcccttgagtatgtttggaagagcaggttaatggagctgtttgtaaatcaaagggaagaaattagcagcctgttctttttctctttgcagcttgtatgttaggacagcattagggtctgggttaggaacatgttggaaggtactaagagaagttaggaagagcagcttgtcagatggccagtaagaaaccgctgagtacttgtatcgtaagatgaggctttgcttttacgtggaggtcagctgtcagtgttcacgtctcacctgtaggaccctgtcgggtgataatgtgctgcgagacacacaggctcccatctccctcccgtgctgctgcaaacctggtgatccctggtgtatgggacagtaccgcaggaaagcccatctgatcatgccccagaacccactgatcgcgtggacgtagaacgactgctcttaccgtgtgaagtagagtcatcctgttcaagggaagaaaaagctccctcttttaatcctgtttctctctaagttagtagctattacacccaaatggttgagtttttaaaaattattttaacagtaaaaatgaaattaagacctag

SEQ ID NO: 295151 - DNA, 2336 bp, Homo sapiens
gcggaagtacatcgaacatgctcagctgaacacatgcccgggagtagacaagaatcagagaggggctcatgcaacacttctgggtttggcaaatatggaaactcgttactttgcaaagaagaaaacccttcttggcttgagtaaattggctgcattagcttcagacttttcagaggatatgctacaagaaaaaattgaagaaatggctgagcaggagcgctttctactgcatcaggagaccctacctgaacagctgctggcggagaaacagctaaatctcagtgcgatgccagtattgactgcaccacaactcattggtctatatatctgtgaagaaaatagaagagctaatgaatatgatttcaagaaagctttggacttgttggaatatattgatgaggaagaagatataaatataaatgatctaaaactggaaatcctttgcaaagctcttcagagagataactggtccagttctgatggcaaagatgatccaattgaagtatctaaagacagtatatttgtgaagatcttacagaaacttttaaaagatggcattcagctcagtgagtacttaccggaggtgaaagacctgctacaagcggatcagcttggaagcttaaagtccaatccttacttcgagtttgttttgaaagcaaattatgaatattatgttcagggacaaatataactttttctaaaaatggccattgtttatgaaatctgtataagtgtgtccttatacaaattttaggccataaacaagtgtaagtttgtacaatttcataacatgtatagctgagtttttatactttatatgtaggaagctaatataaaatagttatgtaactgtgattttggttttcagttatgtgacttgttttttccacctgaaatgtgtcagttgttgttcctgtactcggtgccctttctttttactctcacgtggtcccaggttctggagttcttgtcctggttctagctgctcacatgtacaaatcacttctaggcctcagtttctgcgactatgaaaattactagattgcactagcttgtctctaaaattgctgtgactccagatactttgcactgaagagaatctagggtgtttgatatctgtttcagttagggctaatgggaaatgtctagtaagataaatgtcaacttttgctgacttattatgagatgaaaaaccaaaggagagtgggcctaactcatgtgagcttgataactgatgaactcattgggagcattttaaacttttctacataaataataaatgagcactaatgaaagtattttagtgaatgaaacgtttatgtggttttctaacctatctagaaattactgttgatgtttagttctaatctttcagtgtggggattcagccagcctcatgtattttcagaatgactcatgaatctttaccacagtctgcctagctagtcaaaagcatgaatgatactagaaaccattataggttttcctaatatggcaattgatgtgactgaaaggtactgtactctcagagctttgtcctgaccagtgtcatcactcactcaatgtttatctgggttttaaataaaggccagaggttggacagggagttgctggcatgtccgcggcttggcccagtagaatgcccactaaccatcttgctccagcagctgaaaaggtcagaagttaaacatggtgaagagtccggttcctggattcacagagcccagcatcaggccgtctcccccgcaggctgcaaggccagcccttgagtatgtttggaagagcaggttaatggagctgtttgtaaatcaaagggaagaaattagcagcctgttctttttctctttgcagcttgtatgttaggacagcattagggtctgggttaggaacatgttggaaggtactaagagaagttaggaagagcagcttgtcagatggccagtaagaaaccgctgagtacttgtatcgtaagatgaggctttgcttttacgtggaggtcagctgtcagtgttcacgtctcacctgtaggaccctgtcgggtgataatgtgctgcgagacacacaggctcccatctccctcccgtgctgctgcaaacctggtgatccctggtgtatgggacagtaccgcaggaaagcccatctgatcatgccccagaacccactgatcgcgtggacgtagaacgactgctcttaccgtgtgaagtagagtcatcctgttcaagggaagaaaaagctccctcttttaatcctgtttctctctaagttagtagctattacacccaaatggttgagtttttaaaaattattttaacagtaaaaatgaaattaagacctag

SEQ ID NO: 295152 - DNA, 4227 bp, Homo sapiens
  misc_feature (4179)..(4180): n is a, c, g, or t
  misc_feature (4182)..(4182): n is a, c, g, or t
  misc_feature (4194)..(4194): n is a, c, g, or t
tgcgtttgacgtcatcatcgcgcgccatctcttcccttaggtgtttaagttccgcgcgcaggccaggctgcaacctgacggccagatccctcgctgtcctagtcgctgctccttggagtcatgttcccagccgccccttctccgcggaccccgggtaccgggtcccgaaggggcccgctggccggactcgggcccggctccacgccccggacggctagcaggaagggtctgcccctggggtctgcagtcagctccccagtgctcttctcgccggtcggccggcgtagctcgctaagctcgcggggaacaccaacacgaatgttcccacaccactccataactgagtctgtgaactatgatgtgaaaacgtttggatcttctcttcctgttaaagtcatggaagccctaacattggctgaagtcgatgaccagctgaccattaacatagatgaaggtggatgggcttgtctggtgtgcaaagagaagctcattatttggaagattgctctgtcacctattactaagttatccgtttgcaaagaacttcagctgccacctagtgatttccactggagtgccgacttagtggctctttcttactcttctccctcaggtgaagcacattctactcaggctgttgctgtcatggttgccaccagagaaggatctatccgctattggccaagccttgctggtgaagatacctacacagaggcttttgtagattcgggaggtgataagacttacagtttcctaacagcagtgcagggaggaagttttattttgtcttcatcaggaagccaactaattcggttgatacctgagagctcaggaaagattcatcagcatatcctgcctcaggggcaaggcatgctttcaggaattggtcgaaaagtttcttctctttttggaattttatctcctagtagtgatctcacactttcaagtgttctctgggatagagagagatcaagcttttatagcctgacgagttcaaacatcagtaaatgggaattagatgattcttcagaaaagcatgcatacagttgggatataaatagagccctgaaggaaaacattaccgatgctatttggggatctgaaagtaactatgaagctattaaagaaggagtcaacattcgatatttggacttgaagcaaaactgtgatgggctggtgattttggcagcagcatggcactcagcagacaatccatgtctcatctattactctctgataacaatagaagataatggttgccaaatgtcagatgcagttactgtagaagtcactcaatataatccaccttttcagtctgaagacctgattttgtgtcagttgacggtcccaaacttttcaaaccagactgcctatctgtataacgaaagtgctgtctatgtgtgctccacaggaactgggaaattttctcttccccaggagaaaattgtctttaatgcacaaggagatagtgttttaggtgctggtgcctgtggtggtgttcctatcattttttctagaaacagtggactggtgtctattacttcaagggaaaatgtgtctatattggcagaagacttggaagggtctttagcatcttcagttgctggaccaaacagtgagagtatgatttttgagaccactacaaagaatgaaactatagcccaggaagataaaatcaagttgctgaaagctgcctttctgcaatactgcagaaaagatttaggtcatgctcaaatggtggttgatgagctcttttcctctcactctgatttggattctgattctgaactagacagggcagttacccaaatcagtgtagacctgatggatgactacccagcatctgacccacggtgggctgagtctgtccctgaggaagcacctgggttcagcaatacgtcactgattatccttcaccagctagaagacaagatgaaagctcactcttttcttatggactttattcatcaagttggcttatttggacgtctaggcagttttccagttagagggacaccgatggccactcgactgttgctctgtgagcatgccgaaaagctgtcagccgccattgttctcaagaaccaccactcccggctttctgaccttgtcaacacagccatattgattgctttgaacaagagggagtatgaaatcccatccaacctgactcctgcagatgtctttttcagggaggtatcccaagtagataccatctgtgagtgcttactggagcatgaggagcaagtcttgagggatgcacctatggattccattgaatgggctgaagtggtgatcaatgtgaacaatattctcaaggatatgctgcaggctgctagtcattatcgccaaaatagaaactctttgtatagaagagaagaatcactagaaaaagaacctgaatatgttccatggacggcaacaagtggtcctggtggcatccgaacggtaataatacgccagcatgagattgtcctgaaggtggcttatccacaggcagacagcaacctccgaaacatcgtgaccgagcagctggtagccctgatcgattgcttcctggatggttatgtttctcagcttaagtctgtggataaatccagtaatcgggaaagatatgacaatctggagatggaatacctacagaaaagatcagatctcttatctcctcttctttcactaggccagtacctgtgggctgcttctctagcagagaaatactgtgactttgatatattggtacaaatgtgtgagcagactgacaaccagagccgactccagcgctacatgacccagtttgctgatcagaatttttcagactttctcttccgttggtatctggagaaaggaaagcgaggcaaattattatctcagcccatttctcagcatggacagttggcaaattttttgcaagctcatgaacatctcagctggttacatgaaattaatagccaagaattagaaaaggctcatgcaacacttctgggtttggcaaatatggaaactcgttactttgcaaagaagaaaacccttcttggcttgagtaaattggctgcattagcttcagacttttcagaggatatgctacaagaaaaaattgaagaaatggctgagcaggagcgctttctactgcatcaggagaccctacctgaacagctgctggcggagaaacagctaaatctcagtgcgatgccagtattgactgcaccacaactcattggtctatatatctgtgaagaaaatagaagagctaatgaatatgatttcaagaaagctttggacttgttggaatatattgatgaggaagaagatataaatataaatgatctaaaactggaaatcctttgcaaagctcttcagagagataactggtccagttctgatggcaaagatgatccaattgaagtatctaaagacagtatatttgtgaagatcttacagaaacttttaaaagatggcattcagctcagtgagtacttaccggaggtgaaagacctgctacaagcggatcagcttggaagcttaaagtccaatccttacttcgagtttgttttgaaagcaaattatgaatattatgttcagggacaaatataactttttctaaaaatggccattgtttatgaaatctgtataagtgtgtccttatacaaattttaggccataaacaagtgtaagtttgtacaatttcataacatgtatagctgagtttttatactttatatgtaggaagctaatataaaatagttatgtaactgtgattttggttttcagttatgtgacttgttttttccacctgaaatgtgtcagttgttgttcctgtactcggtgccctttctttttactctcacgtggtcccaggttctggagttcttgtcctggttctagctgctcacatgtacaaatcacttctaggcctcagtttctgcgactatgaaaattactagattgcactagcttgtctctaaaattgctgtgactccagatactttgcactgaagagaatctagggtgtttgatatctgtttcagttagggctaatgggaaatgtctagtaagataaatgtcaacttttgctgacttattatgagatgaaaaaccaaaggagagtgggcctaactcatgtgagcttgataactgatgaactcattgggagcattttaaacttttctacataaataatannangatcggccgatnattattatattataaatcaacaaaaacaatctc

SEQ ID NO: 295153 - DNA, 4238 bp, Homo sapiens
tgcgtttgacgtcatcatcgcgcgccatctcttcccttaggtgtttaagttccgcgcgcaggccaggctgcaacctgacggccagatccctcgctgtcctagtcgctgctccttggagtcatgttcccagccgccccttctccgcggaccccgggtaccgggtcccgaaggggcccgctggccggactcgggcccggctccacgccccggacggctagcaggaagggtctgcccctggggtctgcagtcagctccccagtgctcttctcgccggtcggccggcgtagctcgctaagctcgcggggaacaccaacacgaatgttcccacaccactccataactgagtctgtgaactatgatgtgaaaacgtttggatcttctcttcctgttaaagtcatggaagccctaacattggctgaagtcgatgaccagctgaccattaacatagatgaaggtggatgggcttgtctggtgtgcaaagagaagctcattatttggaagattgctctgtcacctattactaagttatccgtttgcaaagaacttcagctgccacctagtgatttccactggagtgccgacttagtggctctttcttactcttctccctcaggtgaagcacattctactcaggctgttgctgtcatggttgccaccagagaaggatctatccgctattggccaagccttgctggtgaagatacctacacagaggcttttgtagattcgggaggtgataagacttacagtttcctaacagcagtgcagggaggaagttttattttgtcttcatcaggaagccaactaattcggttgatacctgagagctcaggaaagattcatcagcatatcctgcctcaggggcaaggcatgctttcaggaattggtcgaaaagtttcttctctttttggaattttatctcctagtagtgatctcacactttcaagtgttctctgggatagagagagatcaagcttttatagcctgacgagttcaaacatcagtaaatgggaattagatgattcttcagaaaagcatgcatacagttgggatataaatagagccctgaaggaaaacattaccgatgctatttggggatctgaaagtaactatgaagctattaaagaaggagtcaacattcgatatttggacttgaagcaaaactgtgatgggctggtgattttggcagcagcatggcactcagcagacaatccatgtctcatctattactctctgataacaatagaagataatggttgccaaatgtcagatgcagttactgtagaagtcactcaatataatccaccttttcagtctgaagacctgattttgtgtcagttgacggtcccaaacttttcaaaccagactgcctatctgtataacgaaagtgctgtctatgtgtgctccacaggaactgggaaattttctcttccccaggagaaaattgtctttaatgcacaaggagatagtgttttaggtgctggtgcctgtggtggtgttcctatcattttttctagaaacagtggactggtgtctattacttcaagggaaaatgtgtctatattggcagaagacttggaagggtctttagcatcttcagttgctggaccaaacagtgagagtatgatttttgagaccactacaaagaatgaaactatagcccaggaagataaaatcaagttgctgaaagctgcctttctgcaatactgcagaaaagatttaggtcatgctcaaatggtggttgatgagctcttttcctctcactctgatttggattctgattctgaactagacagggcagttacccaaatcagtgtagacctgatggatgactacccagcatctgacccacggtgggctgagtctgtccctgaggaagcacctgggttcagcaatacgtcactgattatccttcaccagctagaagacaagatgaaagctcactcttttcttatggactttattcatcaagttggcttatttggacgtctaggcagttttccagttagagggacaccgatggccactcgactgttgctctgtgagcatgccgaaaagctgtcagccgccattgttctcaagaaccaccactcccggctttctgaccttgtcaacacagccatattgattgctttgaacaagagggagtatgaaatcccatccaacctgactcctgcagatgtctttttcagggaggtatcccaagtagataccatctgtgagtgcttactggagcatgaggagcaagtcttgagggatgcacctatggattccattgaatgggctgaagtggtgatcaatgtgaacaatattctcaaggatatgctgcaggctgctagtcattatcgccaaaatagaaactctttgtatagaagagaagaatcactagaaaaagaacctgaatatgttccatggacggcaacaagtggtcctggtggcatccgaacggtaataatacgccagcatgagattgtcctgaaggtggcttatccacaggcagacagcaacctccgaaacatcgtgaccgagcagctggtagccctgatcgattgcttcctggatggttatgtttctcagcttaagtctgtggataaatccagtaatcgggaaagatatgacaatctggagatggaatacctacagaaaagatcagatctcttatctcctcttctttcactaggccagtacctgtgggctgcttctctagcagagaaatactgtgactttgatatattggtacaaatgtgtgagcagactgacaaccagagccgactccagcgctacatgacccagtttgctgatcagaatttttcagactttctcttccgttggtatctggagaaaggaaagcgaggcaaattattatctcagcccatttctcagcatggacagttggcaaattttttgcaagctcatgaacatctcagctggttacatgaaattaatagccaagaattagaaaaggctcatgcaacacttctgggtttggcaaatatggaaactcgttactttgcaaagaagaaaacccttcttggcttgagtaaattggctgcattagcttcagacttttcagaggatatgctacaagaaaaaattgaagaaatggctgagcaggagcgctttctactgcatcaggagaccctacctgaacagctgctggcggagaaacagctaaatctcagtgcgatgccagtattgactgcaccacaactcattggtctatatatctgtgaagaaaatagaagagctaatgaatatgatttcaagaaagctttggacttgttggaatatattgatgaggaagaagatataaatataaatgatctaaaactggaaatcctttgcaaagctcttcagagagataactggtccagttctgatggcaaagatgatccaattgaagtatctaaagacagtatatttgtgaagatcttacagaaacttttaaaagatggcattcagctcagtgagtacttaccggaggtgaaagacctgctacaagcggatcagcttggaagcttaaagtccaatccttacttcgagtttgttttgaaagcaaattatgaatattatgttcagggacaaatataactttttctaaaaatggccattgtttatgaaatctgtataagtgtgtccttatacaaattttaggccataaacaagtgtaagtttgtacaatttcataacatgtatagctgagtttttatactttatatgtaggaagctaatataaaatagttatgtaactgtgattttggttttcagttatgtgacttgttttttccacctgaaatgtgtcagttgttgttcctgtactcggtgccctttctttttactctcacgtggtcccaggttctggagttcttgtcctggttctagctgctcacatgtacaaatcacttctaggcctcagtttctgcgactatgaaaattactagattgcactagcttgtctctaaaattgctgtgactccagatactttgcactgaagagaatctagggtgtttgatatctgtttcagttagggctaatgggaaatgtctagtaagataaatgtcaacttttgctgacttattatgagatgaaaaaccaaaggagagtgggcctaactcatgtgagcttgataactgatgaactcattgggagcattttaaacttttctacataaataatataacgcacgcgcgccggcgcgcgctccgcgcgcgtctctcccaccacgcgccgctcactc

SEQ ID NO: 295154 - DNA, 2280 bp, Homo sapiens
gcacgaggttcgaagctgcagtgagtcatactttggggtccatactgaatatgttacttactaatagaattttcttcagaaagatacctcactacttggtttctgaaatcaaataggtaagagttatattgagtcagtagctaccttgagtataacatctttttttaaatgtattttccttggcgtctcttgcatgttccctagagtgtaatgtcttatatctaatgtagaaactgtcagggtattcagcatgtaaagtgcctttatttaaatgatttgaaacagtatcacaaaactcagattctccatcccccacagccatcaaaataaaaccatgatagcaaacaaatcatttaattcagctatatcagtgatttcatttttccctcataatgattttgttttctagctggtccagttctgatggcaaagatgatccaattgaagtatctaaagacagtatatttgtgaagatcttacagaaacttttaaaagatggcattcagctcagtgagtacttaccggaggtgaaagacctgctacaagcggatcagcttggaagcttaaagtccaatccttacttcgagtttgttttgaaagcaaattatgaatattatgttcagggacaaatataactttttctaaaaatggccattgtttatgaaatctgtataagtgtgtccttatacaaattttaggccataaacaagtgtaagtttgtacaatttcataacatgtatagctgagtttttatactttatatgtaggaagctaatataaaatagttatgtaactgtgattttggttttcagttatgtgacttgttttttccacctgaaatgtgtcagttgttgttcctgtactcggtgccctttctttttactctcacgtggtcccaggttctggagttcttgtcctggttctagctgctcacatgtacaaatcacttctaggcctcagtttctgcgactatgaaaattactagattgcactagcttgtctctaaaattgctgtgactccagatactttgcactgaagagaatctagggtgtttgatatctgtttcagttagggctaatgggaaatgtctagtaagataaatgtcaacttttgctgacttattatgagatgaaaaaccaaaggagagtgggcctaactcatgtgagcttgataactgatgaactcattgggagcattttaaacttttctacataaataataaatgagcactaatgaaagtattttagtgaatgaaacgtttatgtggttttctaacctatctagaaattactgttgatgtttagttctaatctttcagtgtggggattcagccagcctcatgtattttcagaatgactcatgaatctttaccacagtctgcctagctagtcaaaagcatgaatgatactagaaaccattataggttttcctaatatggcaattgatgtgactgaaaggtactgtactctcagagctttgtcctgaccagtgtcatcactcactcaatgtttatctgggttttaaataaaggccagaggttggacagggagttgctggcatgtccgcggcttggcccagtagaatgcccactaaccatcttgctccagcagctgaaaaggtcagaagttaaacatggtgaagagtccggttcctggattcacagagcccagcatcaggccgtctcccccgcaggctgcaaggccagcccttgagtatgtttggaagagcaggttaatggagctgtttgtaaatcaaagggaagaaattagcagcctgttctttttctctttgcagcttgtatgttaggacagcattagggtctgggttaggaacatgttggaaggtactaagagaagttaggaagagcagcttgtcagatggccagtaagaaaccgctgagtacttgtatcgtaagatgaggctttgcttttacgtggaggtcagctgtcagtgttcacgtctcacctgtaggaccctgtcgggtgataatgtgctgcgagacacacaggctcccatctccctcccgtgctgctgcaaacctggtgatccctggtgtatgggacagtaccgcaggaaagcccatctgatcatgccccagaacccactgatcgcgtggacgtagaacgactgctcttaccgtgtgaagtagagtcatcctgttcaagggaagaaaaagctccctcttttaatcctgtttctctctaagttagtagctattacacccaaatggttgagtttttaaaaattattttaacagtaaaaatgaaattaagacctag

SEQ ID NO: 295155 - DNA, 3915 bp, Homo sapiens
tgcgtttgacgtcatcatcgcgcgccatctcttcccttaggtgtttaagttccgcgcgcaggccaggctgcaacctgacggccagatccctcgctgtcctagtcgctgctccttggagtcatgttcccagccgccccttctccgcggaccccgggtaccgggtcccgaaggggcccgctggccggactcgggcccggctccacgccccggacggctagcaggaagggtctgcccctggggtctgcagtcagctccccagtgctcttctcgccggtcggccggcgtagctcgctaagctcgcggggaacaccaacacgaatgttcccacaccactccataactgagtctgtgaactatgatgtgaaaacgtttggatcttctcttcctgttaaagtcatggaagccctaacattggctgaagtcgatgaccagctgaccattaacatagatgaaggtggatgggcttgtctggtgtgcaaagagaagctcattatttggaagattgctctgtcacctattactaagttatccgtttgcaaagaacttcagctgccacctagtgatttccactggagtgccgacttagtggctctttcttactcttctccctcaggtgaagcacattctactcaggctgttgctgtcatggttgccaccagagaaggatctatccgctattggccaagccttgctggtgaagatacctacacagaggcttttgtagattcgggaggtgataagacttacagtttcctaacagcagtgcagggaggaagttttattttgtcttcatcaggaagccaactaattcggttgatacctgagagctcaggaaagattcatcagcatatcctgcctcaggggcaaggcatgctttcaggaattggtcgaaaagtttcttctctttttggaattttatctcctagtagtgatctcacactttcaagtgttctctgggatagagagagatcaagcttttatagcctgacgagttcaaacatcagtaaatgggaattagatgattcttcagaaaagcatgcatacagttgggatataaatagagccctgaaggaaaacattaccgatgctatttggggatctgaaagtaactatgaagctattaaagaaggagtcaacattcgatatttggacttgaagcaaaactgtgatgggctggtgattttggcagcagcatggcactcagcagacaatccatgtctcatctattactctctgataacaatagaagataatggttgccaaatgtcagatgcagttactgtagaagtcactcaatataatccaccttttcagtctgaagacctgattttgtgtcagttgacggtcccaaacttttcaaaccagactgcctatctgtataacgaaagtgctgtctatgtgtgctccacaggaactgggaaattttctcttccccaggagaaaattgtctttaatgcacaaggagatagtgttttaggtgctggtgcctgtggtggtgttcctatcattttttctagaaacagtggactggtgtctattacttcaagggaaaatgtgtctatattggcagaagacttggaagggtctttagcatcttcagttgctggaccaaacagtgagagtatgatttttgagaccactacaaagaatgaaactatagcccaggaagataaaatcaagttgctgaaagctgcctttctgcaatactgcagaaaagatttaggtcatgctcaaatggtggttgatgagctcttttcctctcactctgatttggattctgattctgaactagacagggcagttacccaaatcagtgtagacctgatggatgactacccagcatctgacccacggtgggctgagtctgtccctgaggaagcacctgggttcagcaatacgtcactgattatccttcaccagctagaagacaagatgaaagctcactcttttcttatggactttattcatcaagttggcttatttggacgtctaggcagttttccagttagagggacaccgatggccactcgactgttgctctgtgagcatgccgaaaagctgtcagccgccattgttctcaagaaccaccactcccggctttctgaccttgtcaacacagccatattgattgctttgaacaagagggagtatgaaatcccatccaacctgactcctgcagatgtctttttcagggaggtatcccaagtagataccatctgtgagtgcttactggagcatgaggagcaagtcttgagggatgcacctatggattccattgaatgggctgaagtggtgatcaatgtgaacaatattctcaaggatatgctgcaggctgctagtcattatcgccaaaatagaaactctttgtatagaagagaagaatcactagaaaaagaacctgaatatgttccatggacggcaacaagtggtcctggtggcatccgaacggtaataatacgccagcatgagattgtcctgaaggtggcttatccacaggcagacagcaacctccgaaacatcgtgaccgagcagctggtagccctgatcgattgcttcctggatggttatgtttctcagcttaagtctgtggataaatccagtaatcgggaaagatatgacaatctggagatggaatacctacagaaaagatcagatctcttatctcctcttctttcactaggccagtacctgtgggctgcttctctagcagagaaatactgtgactttgatatattggtacaaatgtgtgagcagactgacaaccagagccgactccagcgctacatgacccagtttgctgatcagaatttttcagactttctcttccgttggtatctggagaaaggaaagcgaggcaaattattatctcagcccatttctcagcatggacagttggcaaattttttgcaagctcatgaacatctcagctggttacatgaaattaatagccaagaattagaaaaggctcatgcaacacttctgggtttggcaaatatggaaactcgttactttgcaaagaagaaaacccttcttggcttgagtaaattggctgcattagcttcagacttttcagaggatatgctacaagaaaaaattgaagaaatggctgagcaggagcgctttctactgcatcaggagaccctacctgaacagctgctggcggagaaacagctaaatctcagtgcgatgccagtattgactgcaccacaactcattggtctatatatctgtgaagaaaatagaagagctaatgaatatgatttcaagaaagctttggacttgttggaatatattgatgaggaagaagatataaatataaatgatctaaaactggaaatcctttgcaaagctcttcagagagataactggtccagttctgatggcaaagatgatccaattgaagtatctaaagacagtatatttgtgaagatcttacagaaacttttaaaagatggcattcagctcagtgagtacttaccggaggtgaaagacctgctacaagcggatcagcttggaagcttaaagtccaatccttacttcgagtttgttttgaaagcaaattatgaatattatgttcagggacaaatataactttttctaaaaatggccattgtttatgaaatctgtataagtgtgtccttatacaaattttaggccataaacaagtgtaagtttgtacaatttcataacatgtatagctgagtttttatactttatatgtaggaagctaatataaaatagttatgtactgggaaaaaaaaaaaaaaaaaacaaatttggggggcggggcgaaaaagtttaaacatgttgggggggccaggagagaaaggctagggtcccagaaccggcgagggggttccaaaaagcgggcggttgaacaaggtggtggtaggcgttcccgcgccgggagaaaag

SEQ ID NO: 295156 - DNA, 3724 bp, Homo sapiens
tgcgtttgacgtcatcatcgcgcgccatctcttcccttaggtgtttaagttccgcgcgcaggccaggctgcaacctgacggccagatccctcgctgtcctagtcgctgctccttggagtcatgttcccagccgccccttctccgcggaccccgggtaccgggtcccgaaggggcccgctggccggactcgggcccggctccacgccccggacggctagcaggaagggtctgcccctggggtctgcagtcagctccccagtgctcttctcgccggtcggccggcgtagctcgctaagctcgcggggaacaccaacacgaatgttcccacaccactccataactgagtctgtgaactatgatgtgaaaacgtttggatcttctcttcctgttaaagtcatggaagccctaacattggctgaagtcgatgaccagctgaccattaacatagatgaaggtggatgggcttgtctggtgtgcaaagagaagctcattatttggaagattgctctgtcacctattactaagttatccgtttgcaaagaacttcagctgccacctagtgatttccactggagtgccgacttagtggctctttcttactcttctccctcaggtgaagcacattctactcaggctgttgctgtcatggttgccaccagagaaggatctatccgctattggccaagccttgctggtgaagatacctacacagaggcttttgtagattcgggaggtgataagacttacagtttcctaacagcagtgcagggaggaagttttattttgtcttcatcaggaagccaactaattcggttgatacctgagagctcaggaaagattcatcagcatatcctgcctcaggggcaaggcatgctttcaggaattggtcgaaaagtttcttctctttttggaattttatctcctagtagtgatctcacactttcaagtgttctctgggatagagagagatcaagcttttatagcctgacgagttcaaacatcagtaaatgggaattagatgattcttcagaaaagcatgcatacagttgggatataaatagagccctgaaggaaaacattaccgatgctatttggggatctgaaagtaactatgaagctattaaagaaggagtcaacattcgatatttggacttgaagcaaaactgtgatgggctggtgattttggcagcagcatggcactcagcagacaatccatgtctcatctattactctctgataacaatagaagataatggttgccaaatgtcagatgcagttactgtagaagtcactcaatataatccaccttttcagtctgaagacctgattttgtgtcagttgacggtcccaaacttttcaaaccagactgcctatctgtataacgaaagtgctgtctatgtgtgctccacaggaactgggaaattttctcttccccaggagaaaattgtctttaatgcacaaggagatagtgttttaggtgctggtgcctgtggtggtgttcctatcattttttctagaaacagtggactggtgtctattacttcaagggaaaatgtgtctatattggcagaagacttggaagggtctttagcatcttcagttgctggaccaaacagtgagagtatgatttttgagaccactacaaagaatgaaactatagcccaggaagataaaatcaagttgctgaaagctgcctttctgcaatactgcagaaaagatttaggtcatgctcaaatggtggttgatgagctcttttcctctcactctgatttggattctgattctgaactagacagggcagttacccaaatcagtgtagacctgatggatgactacccagcatctgacccacggtgggctgagtctgtccctgaggaagcacctgggttcagcaatacgtcactgattatccttcaccagctagaagacaagatgaaagctcactcttttcttatggactttattcatcaagttggcttatttggacgtctaggcagttttccagttagagggacaccgatggccactcgactgttgctctgtgagcatgccgaaaagctgtcagccgccattgttctcaagaaccaccactcccggctttctgaccttgtcaacacagccatattgattgctttgaacaagagggagtatgaaatcccatccaacctgactcctgcagatgtctttttcagggaggtatcccaagtagataccatctgtgagtgcttactggagcatgaggagcaagtcttgagggatgcacctatggattccattgaatgggctgaagtggtgatcaatgtgaacaatattctcaaggatatgctgcaggctgctagtcattatcgccaaaatagaaactctttgtatagaagagaagaatcactagaaaaagaacctgaatatgttccatggacggcaacaagtggtcctggtggcatccgaacggtaataatacgccagcatgagattgtcctgaaggtggcttatccacaggcagacagcaacctccgaaacatcgtgaccgagcagctggtagccctgatcgattgcttcctggatggttatgtttctcagcttaagtctgtggataaatccagtaatcgggaaagatatgacaatctggagatggaatacctacagaaaagatcagatctcttatctcctcttctttcactaggccagtacctgtgggctgcttctctagcagagaaatactgtgactttgatatattggtacaaatgtgtgagcagactgacaaccagagccgactccagcgctacatgacccagtttgctgatcagaatttttcagactttctcttccgttggtatctggagaaaggaaagcgaggcaaattattatctcagcccatttctcagcatggacagttggcaaattttttgcaagctcatgaacatctcagctggttacatgaaattaatagccaagaattagaaaaggctcatgcaacacttctgggtttggcaaatatggaaactcgttactttgcaaagaagaaaacccttcttggcttgagtaaattggctgcattagcttcagacttttcagaggatatgctacaagaaaaaattgaagaaatggctgagcaggagcgctttctactgcatcaggagaccctacctgaacagctgctggcggagaaacagctaaatctcagtgcgatgccagtattgactgcaccacaactcattggtctatatatctgtgaagaaaatagaagagctaatgaatatgatttcaagaaagctttggacttgttggaatatattgatgaggaagaagatataaatataaatgatctaaaactggaaatcctttgcaaagctcttcagagagataactggtccagttctgatggcaaagatgatccaattgaagtatctaaagacagtatatttgtgaagatcttacagaaacttttaaaagatggcattcaagtccagtgagtacttacggaggtgaagactgtacagggatagtggagcttaagtcatctattcgagtgttgaagcaatttgatttgtcggcaattactttttaaatgggctgtttgaatcggtagggtgttcaattggggaaacgggggtgctctaagtaggggggttatgaggggaaaatgaggggggggtgagggccagggggggggaggaaagggggggggaggaaaaacagaaattgggtgtggtggtggtctaaggt

SEQ ID NO: 295157 - DNA, 3540 bp, Homo sapiens
tgcgtttgacgtcatcatcgcgcgccatctcttcccttaggtgtttaagttccgcgcgcaggccaggctgcaacctgacggccagatccctcgctgtcctagtcgctgctccttggagtcatgttcccagccgccccttctccgcggaccccgggtaccgggtcccgaaggggcccgctggccggactcgggcccggctccacgccccggacggctagcaggaagggtctgcccctggggtctgcagtcagctccccagtgctcttctcgccggtcggccggcgtagctcgctaagctcgcggggaacaccaacacgaatgttcccacaccactccataactgagtctgtgaactatgatgtgaaaacgtttggatcttctcttcctgttaaagtcatggaagccctaacattggctgaagtcgatgaccagctgaccattaacatagatgaaggtggatgggcttgtctggtgtgcaaagagaagctcattatttggaagattgctctgtcacctattactaagttatccgtttgcaaagaacttcagctgccacctagtgatttccactggagtgccgacttagtggctctttcttactcttctccctcaggtgaagcacattctactcaggctgttgctgtcatggttgccaccagagaaggatctatccgctattggccaagccttgctggtgaagatacctacacagaggcttttgtagattcgggaggtgataagacttacagtttcctaacagcagtgcagggaggaagttttattttgtcttcatcaggaagccaactaattcggttgatacctgagagctcaggaaagattcatcagcatatcctgcctcaggggcaaggcatgctttcaggaattggtcgaaaagtttcttctctttttggaattttatctcctagtagtgatctcacactttcaagtgttctctgggatagagagagatcaagcttttatagcctgacgagttcaaacatcagtaaatgggaattagatgattcttcagaaaagcatgcatacagttgggatataaatagagccctgaaggaaaacattaccgatgctatttggggatctgaaagtaactatgaagctattaaagaaggagtcaacattcgatatttggacttgaagcaaaactgtgatgggctggtgattttggcagcagcatggcactcagcagacaatccatgtctcatctattactctctgataacaatagaagataatggttgccaaatgtcagatgcagttactgtagaagtcactcaatataatccaccttttcagtctgaagacctgattttgtgtcagttgacggtcccaaacttttcaaaccagactgcctatctgtataacgaaagtgctgtctatgtgtgctccacaggaactgggaaattttctcttccccaggagaaaattgtctttaatgcacaaggagatagtgttttaggtgctggtgcctgtggtggtgttcctatcattttttctagaaacagtggactggtgtctattacttcaagggaaaatgtgtctatattggcagaagacttggaagggtctttagcatcttcagttgctggaccaaacagtgagagtatgatttttgagaccactacaaagaatgaaactatagcccaggaagataaaatcaagttgctgaaagctgcctttctgcaatactgcagaaaagatttaggtcatgctcaaatggtggttgatgagctcttttcctctcactctgatttggattctgattctgaactagacagggcagttacccaaatcagtgtagacctgatggatgactacccagcatctgacccacggtgggctgagtctgtccctgaggaagcacctgggttcagcaatacgtcactgattatccttcaccagctagaagacaagatgaaagctcactcttttcttatggactttattcatcaagttggcttatttggacgtctaggcagttttccagttagagggacaccgatggccactcgactgttgctctgtgagcatgccgaaaagctgtcagccgccattgttctcaagaaccaccactcccggctttctgaccttgtcaacacagccatattgattgctttgaacaagagggagtatgaaatcccatccaacctgactcctgcagatgtctttttcagggaggtatcccaagtagataccatctgtgagtgcttactggagcatgaggagcaagtcttgagggatgcacctatggattccattgaatgggctgaagtggtgatcaatgtgaacaatattctcaaggatatgctgcaggctgctagtcattatcgccaaaatagaaactctttgtatagaagagaagaatcactagaaaaagaacctgaatatgttccatggacggcaacaagtggtcctggtggcatccgaacggtaataatacgccagcatgagattgtcctgaaggtggcttatccacaggcagacagcaacctccgaaacatcgtgaccgagcagctggtagccctgatcgattgcttcctggatggttatgtttctcagcttaagtctgtggataaatccagtaatcgggaaagatatgacaatctggagatggaatacctacagaaaagatcagatctcttatctcctcttctttcactaggccagtacctgtgggctgcttctctagcagagaaatactgtgactttgatatattggtacaaatgtgtgagcagactgacaaccagagccgactccagcgctacatgacccagtttgctgatcagaatttttcagactttctcttccgttggtatctggagaaaggaaagcgaggcaaattattatctcagcccatttctcagcatggacagttggcaaattttttgcaagctcatgaacatctcagctggttacatgaaattaatagccaagaattagaaaaggctcatgcaacacttctgggtttggcaaatatggaaactcgttactttgcaaagaagaaaacccttcttggcttgagtaaattggctgcattagcttcagacttttcagaggatatgctacaagaaaaaattgaagaaatggctgagcaggagcgctttctactgcatcaggagaccctacctgaacagctgctggcggagaaacagctaaatctcagtgcgatgccagtattgactgcaccacaactcattggtctatatatctgtgaagaaaatagaagagctaatgaatatgatttcaagaaagctttggacttgttggaatatattgatgaggaagaagatataaatataaatgatctaaaactggaaatcctttgcaaagctcttcagagagataagtaagtgctcgtggcattgcttctttggaaagtatagaaactgcttttcctctgctctcaccacatgacagtcaataacagaagacttctgtgaccagacgtgttgggatttcccacctcctacactgggcaaccagtgagttctgttggtgggcaccagctgaatgtcctttaa

SEQ ID NO: 295158 - DNA, 2791 bp, Homo sapiens
tgcgtttgacgtcatcatcgcgcgccatctcttcccttaggtgtttaagttccgcgcgcaggccaggctgcaacctgacggccagatccctcgctgtcctagtcgctgctccttggagtcatgttcccagccgccccttctccgcggaccccgggtaccgggtcccgaaggggcccgctggccggactcgggcccggctccacgccccggacggctagcaggaagggtctgcccctggggtctgcagtcagctccccagtgctcttctcgccggtcggccggcgtagctcgctaagctcgcggggaacaccaacacgaatgttcccacaccactccataactgagtctgtgaactatgatgtgaaaacgtttggatcttctcttcctgttaaagtcatggaagccctaacattggctgaagtcgatgaccagctgaccattaacatagatgaaggtggatgggcttgtctggtgtgcaaagagaagctcattatttggaagattgctctgtcacctattactaagttatccgtttgcaaagaacttcagctgccacctagtgatttccactggagtgccgacttagtggctctttcttactcttctccctcaggtgaagcacattctactcaggctgttgctgtcatggttgccaccagagaaggatctatccgctattggccaagccttgctggtgaagatacctacacagaggcttttgtagattcgggaggtgataagacttacagtttcctaacagcagtgcagggaggaagttttattttgtcttcatcaggaagccaactaattcggttgatacctgagagctcaggaaagattcatcagcatatcctgcctcaggggcaaggcatgctttcaggaattggtcgaaaagtttcttctctttttggaattttatctcctagtagtgatctcacactttcaagtgttctctgggatagagagagatcaagcttttatagcctgacgagttcaaacatcagtaaatgggaattagatgattcttcagaaaagcatgcatacagttgggatataaatagagccctgaaggaaaacattaccgatgctatttggggatctgaaagtaactatgaagctattaaagaaggagtcaacattcgatatttggacttgaagcaaaactgtgatgggctggtgattttggcagcagcatggcactcagcagacaatccatgtctcatctattactctctgataacaatagaagataatggttgccaaatgtcagatgcagttactgtagaagtcactcaatataatccaccttttcagtctgaagacctgattttgtgtcagttgacggtcccaaacttttcaaaccagactgcctatctgtataacgaaagtgctgtctatgtgtgctccacaggaactgggaaattttctcttccccaggagaaaattgtctttaatgcacaaggagatagtgttttaggtgctggtgcctgtggtggtgttcctatcattttttctagaaacagtggactggtgtctattacttcaagggaaaatgtgtctatattggcagaagacttggaagggtctttagcatcttcagttgctggaccaaacagtgagagtatgatttttgagaccactacaaagaatgaaactatagcccaggaagataaaatcaagttgctgaaagctgcctttctgcaatactgcagaaaagatttaggtcatgctcaaatggtggttgatgagctcttttcctctcactctgatttggattctgattctgaactagacagggcagttacccaaatcagtgtagacctgatggatgactacccagcatctgacccacggtgggctgagtctgtccctgaggaagcacctgggttcagcaatacgtcactgattatccttcaccagctagaagacaagatgaaagctcactcttttcttatggactttattcatcaagttggcttatttggacgtctaggcagttttccagttagagggacaccgatggccactcgactgttgctctgtgagcatgccgaaaagctgtcagccgccattgttctcaagaaccaccactcccggctttctgaccttgtcaacacagccatattgattgctttgaacaagagggagtatgaaatcccatccaacctgactcctgcagatgtctttttcagggaggtatcccaagtagataccatctgtgagtgcttactggagcatgaggagcaagtcttgagggatgcacctatggattccattgaatgggctgaagtggtgatcaatgtgaacaatattctcaaggatatgctgcaggctgctagtcattatcgccaaaatagaaactctttgtatagaagagaagaatcactagaaaaagaacctgaatatgttccatggacggcaacaagtggtcctggtggcatccgaacggtaataatacgccagcatgagattgtcctgaaggtggcttatccacaggcagacagcaacctccgaaacatcgtgaccgagcagctggtagccctgatcgattgcttcctggatggttatgtttctcagcttaagtctgtggataaatccagtaatcgggaaagatatgacaatctggagatggaatacctacagaaaagatcagatctcttatctcctcttcgtaagttcatgatacttggcaagagttttaaatttgctgaatggatgaaagggttgaatagttaattcagtatattcagtgtggtagtgttaatccaactgtaataaagaacttaaagca

SEQ ID NO: 295159 - DNA, 2076 bp, Homo sapiens
  misc_feature (2031)..(2031): n is a, c, g, or t
  misc_feature (2051)..(2051): n is a, c, g, or t
  misc_feature (2058)..(2058): n is a, c, g, or t
  misc_feature (2062)..(2062): n is a, c, g, or t
  misc_feature (2073)..(2073): n is a, c, g, or t
  misc_feature (2076)..(2076): n is a, c, g, or t
tgcgtttgacgtcatcatcgcgcgccatctcttcccttaggtgtttaagttccgcgcgcaggccaggctgcaacctgacggccagatccctcgctgtcctagtcgctgctccttggagtcatgttcccagccgccccttctccgcggaccccgggtaccgggtcccgaaggggcccgctggccggactcgggcccggctccacgccccggacggctagcaggaagggtctgcccctggggtctgcagtcagctccccagtgctcttctcgccggtcggccggcgtagctcgctaagctcgcggggaacaccaacacgaatgttcccacaccactccataactgagtctgtgaactatgatgtgaaaacgtttggatcttctcttcctgttaaagtcatggaagccctaacattggctgaagtcgatgaccagctgaccattaacatagatgaaggtggatgggcttgtctggtgtgcaaagagaagctcattatttggaagattgctctgtcacctattactaagttatccgtttgcaaagaacttcagctgccacctagtgatttccactggagtgccgacttagtggctctttcttactcttctccctcaggtgaagcacattctactcaggctgttgctgtcatggttgccaccagagaaggatctatccgctattggccaagccttgctggtgaagatacctacacagaggcttttgtagattcgggaggtgataagacttacagtttcctaacagcagtgcagggaggaagttttattttgtcttcatcaggaagccaactaattcggttgatacctgagagctcaggaaagattcatcagcatatcctgcctcaggggcaaggcatgctttcaggaattggtcgaaaagtttcttctctttttggaattttatctcctagtagtgatctcacactttcaagtgttctctgggatagagagagatcaagcttttatagcctgacgagttcaaacatcagtaaatgggaattagatgattcttcagaaaagcatgcatacagttgggatataaatagagccctgaaggaaaacattaccgatgctatttggggatctgaaagtaactatgaagctattaaagaaggagtcaacattcgatatttggacttgaagcaaaactgtgatgggctggtgattttggcagcagcatggcactcagcagacaatccatgtctcatctattactctctgataacaatagaagataatggttgccaaatgtcagatgcagttactgtagaagtcactcaatataatccaccttttcagtctgaagacctgattttgtgtcagttgacggtcccaaacttttcaaaccagactgcctatctgtataacgaaagtgctgtctatgtgtgctccacaggaactgggaaattttctcttccccaggagaaaattgtctttaatgcacaaggagatagtgttttaggtgctggtgcctgtggtggtgttcctatcattttttctagaaacagtggactggtgtctattacttcaagggaaaatgtgtctatattggcagaagacttggaagggtctttagcatcttcagttgctggaccaaacagtgagagtatgatttttgagaccactacaaagaatgaaactatagcccaggaagataaaatcaagttgctgaaagctgcctttctgcaatactgcagaaaagatttaggtcatgctcaaatggtggttgatgagctcttttcctctcactctgatttggattctgattctgaactagacagggcagttacccaaatcagtgtagacctgatggatgactacccagcatctgacccacggtgggctgagtctgtccctgaggaagcacctgggttcagcaatacgtcactgattatccttcaccagctagaagacaagatgaaagctcactcttttcttatggactttattcatcaagttggggttatttgggacgttctaggccggtttctccaggtttagaaggggacaccgatnggccactccaactgtttggntcttttnaacntgcccaaaaanctn

SEQ ID NO: 295160 - DNA, 1987 bp, Homo sapiens
tgcgtttgacgtcatcatcgcgcgccatctcttcccttaggtgtttaagttccgcgcgcaggccaggctgcaacctgacggccagatccctcgctgtcctagtcgctgctccttggagtcatgttcccagccgccccttctccgcggaccccgggtaccgggtcccgaaggggcccgctggccggactcgggcccggctccacgccccggacggctagcaggaagggtctgcccctggggtctgcagtcagctccccagtgctcttctcgccggtcggccggcgtagctcgctaagctcgcggggaacaccaacacgaatgttcccacaccactccataactgagtctgtgaactatgatgtgaaaacgtttggatcttctcttcctgttaaagtcatggaagccctaacattggctgaagtcgatgaccagctgaccattaacatagatgaaggtggatgggcttgtctggtgtgcaaagagaagctcattatttggaagattgctctgtcacctattactaagttatccgtttgcaaagaacttcagctgccacctagtgatttccactggagtgccgacttagtggctctttcttactcttctccctcaggtgaagcacattctactcaggctgttgctgtcatggttgccaccagagaaggatctatccgctattggccaagccttgctggtgaagatacctacacagaggcttttgtagattcgggaggtgataagacttacagtttcctaacagcagtgcagggaggaagttttattttgtcttcatcaggaagccaactaattcggttgatacctgagagctcaggaaagattcatcagcatatcctgcctcaggggcaaggcatgctttcaggaattggtcgaaaagtttcttctctttttggaattttatctcctagtagtgatctcacactttcaagtgttctctgggatagagagagatcaagcttttatagcctgacgagttcaaacatcagtaaatgggaattagatgattcttcagaaaagcatgcatacagttgggatataaatagagccctgaaggaaaacattaccgatgctatttggggatctgaaagtaactatgaagctattaaagaaggagtcaacattcgatatttggacttgaagcaaaactgtgatgggctggtgattttggcagcagcatggcactcagcagacaatccatgtctcatctattactctctgataacaatagaagataatggttgccaaatgtcagatgcagttactgtagaagtcactcaatataatccaccttttcagtctgaagacctgattttgtgtcagttgacggtcccaaacttttcaaaccagactgcctatctgtataacgaaagtgctgtctatgtgtgctccacaggaactgggaaattttctcttccccaggagaaaattgtctttaatgcacaaggagatagtgttttaggtgctggtgcctgtggtggtgttcctatcattttttctagaaacagtggactggtgtctattacttcaagggaaaatgtgtctatattggcagaagacttggaagggtctttagcatcttcagttgctggaccaaacagtgagagtatgatttttgagaccactacaaagaatgaaactatagcccaggaagataaaatcaagttgctgaaagctgcctttctgcaatactgcagaaaagatttaggtcatgctcaaatggtggttgatgagctcttttcctctcactctgatttggattctgattctgaactagacagggcagttacccaaatcagtgtagacctgatggatgactacccagcagacaatccatgtctcatctattactctctgataacaatagaagataatggttgccaaatgtcagatgcagttactgtagaagtcactcaatataatccaccttttcagagataaagtctgggcaacagagtgagattccgtctca

SEQ ID NO: 295161 - DNA, 1725 bp, Homo sapiens
tgcgtttgacgtcatcatcgcgcgccatctcttcccttaggtgtttaagttccgcgcgcaggccaggctgcaacctgacggccagatccctcgctgtcctagtcgctgctccttggagtcatgttcccagccgccccttctccgcggaccccgggtaccgggtcccgaaggggcccgctggccggactcgggcccggctccacgccccggacggctagcaggaagggtctgcccctggggtctgcagtcagctccccagtgctcttctcgccggtcggccggcgtagctcgctaagctcgcggggaacaccaacacgaatgttcccacaccactccataactgagtctgtgaactatgatgtgaaaacgtttggatcttctcttcctgttaaagtcatggaagccctaacattggctgaagtcgatgaccagctgaccattaacatagatgaaggtggatgggcttgtctggtgtgcaaagagaagctcattatttggaagattgctctgtcacctattactaagttatccgtttgcaaagaacttcagctgccacctagtgatttccactggagtgccgacttagtggctctttcttactcttctccctcaggtgaagcacattctactcaggctgttgctgtcatggttgccaccagagaaggatctatccgctattggccaagccttgctggtgaagatacctacacagaggcttttgtagattcgggaggtgataagacttacagtttcctaacagcagtgcagggaggaagttttattttgtcttcatcaggaagccaactaattcggttgatacctgagagctcaggaaagattcatcagcatatcctgcctcaggggcaaggcatgctttcaggaattggtcgaaaagtttcttctctttttggaattttatctcctagtagtgatctcacactttcaagtgttctctgggatagagagagatcaagcttttatagcctgacgagttcaaacatcagtaaatgggaattagatgattcttcagaaaagcatgcatacagttgggatataaatagagccctgaaggaaaacattaccgatgctatttggggatctgaaagtaactatgaagctattaaagaaggagtcaacattcgatatttggacttgaagcaaaactgtgatgggctggtgattttggcagcagcatggcactcagcagacaatccatgtctcatctattactctctgataacaatagaagataatggttgccaaatgtcagatgcagttactgtagaagtcactcaatataatccaccttttcagtctgaagacctgattttgtgtcagttgacggtcccaaacttttcaaaccagactgcctatctgtataacgaaagtgctgtctatgtgtgctccacaggaactgggaaattttctcttccccaggagaaaattgtctttaatgcacaaggagatagtgttttaggtgctggtgcctgtggtggtgttcctatcattttttctagaaacagtggactggtgtctattacttcaagggaaaatgtgtctatattggcagaagacttggaagggtctttagcatcttcagttgctggaccaaacagtgaggtagatcgcttgagaccaggagttggagaccagcctgggcaacatgtcaaaaccccatctctacccaaaaaataaagaacttggttggtgtgtgtaactggccga

SEQ ID NO: 295162 - DNA, 1065 bp, Homo sapiens
tgcgtttgacgtcatcatcgcgcgccatctcttcccttaggtgtttaagttccgcgcgcaggccaggctgcaacctgacggccagatccctcgctgtcctagtcgctgctccttggagtcatgttcccagccgccccttctccgcggaccccgggtaccgggtcccgaaggggcccgctggccggactcgggcccggctccacgccccggacggctagcaggaagggtctgcccctggggtctgcagtcagctccccagtgctcttctcgccggtcggccggcgtagctcgctaagctcgcggggaacaccaacacgaatgttcccacaccactccataactgagtctgtgaactatgatgtgaaaacgtttggatcttctcttcctgttaaagtcatggaagccctaacattggctgaagtcgatgaccagctgaccattaacatagatgaaggtggatgggcttgtctggtgtgcaaagagaagctcattatttggaagattgctctgtcacctattactaagttatccgtttgcaaagaacttcagctgccacctagtgatttccactggagtgccgacttagtggctctttcttactcttctccctcaggtgaagcacattctactcaggctgttgctgtcatggttgccaccagagaaggatctatccgctattggccaagccttgctggtgaagatacctacacagaggcttttgtagattcgggaggtgataagacttacagtttcctaacagcagtgcagggaggaagttttattttgtcttcatcaggaagccaactaattcggttgatacctgagagctcaggaaagattcatcagcatatcctgcctcaggggcaaggcatgctttcaggaattggtcgaaaactttcaagtgttctctgggatagagagagatcaagcttttatagcctgacgagttcaaacatcagtaaatgggaattagatgattcttcagaaaagcatgcatacagttgggatataaatagagccctgaaggaaaacattaccgatgctatttgggtaagaaacaataat

SEQ ID NO: 295163 - DNA, 706 bp, Homo sapiens
gtcagctccccagtgctcttctcgccggtcggccggcgtagctcgctaagctcgcggtaagtgatctccctggttgggtctggcaaccaacagcctcacgggccgcagtgggccggataggttgttgtctttagaagcctttggaaccggggcggcggaatagaatgccacagtattggaaaatagaccttttccactgctgcaggtagtatctgcttcgttttgattatcagttgatcagttgattccccactttgcatttttcatggatacctttgtgcagaagtgaagtacaaactggatttgcatcagtgtttacctacttcccacctactacccgtgtgatctggtgtaagtcactcgtgattttcttcatctgtgaaatggcgataatatatctcacctgagccagaggagttattatgaattgccacgatgcagatgtaaggtgatggtgataatgaggacctacaaccctgaaagatcattgtttaatgcctaacataccaactgacattaatatctgatgattggtaattaaagggtttctagctacggaatttaactttctaggtaaattataaggaaaaggctttacataagtgagctaagagtactgtgatagtttagttactaaaactgctcgtttggagcaccagtaaaatcatcacacacacacacccctccccacccccaacacacacca

SEQ ID NO: 295164 - DNA, 622 bp, Homo sapiens
aagaaaacccttcttggcttgagtaaattggctgcattagcttcagacttttcagaggatatgctacaagaaaaaattgaaggtgaaagaatttgagcaaaaggatttacaaattggtcatgccatcaattaactcatgatgtgttcctgtcatcagttagcaggatctatctcttagaaacaggacctgtctctaagaggaatgcatttagttaatgtccatgtgtagttactcaattatatacttggaatttttttagagaaaagtagtttgtattttaaataagaattcctaaagaatagactcaaatgattttgattggagaggtctgattatgtacctttagtgataaatattccaagggcaaaaagaactacaaagcaatcttgacctttacacagtgggtttgttgtaggtagtgtggtataggtgcaataattctgaactattttgtgtatattgtagatgaaaacgattacatatagtacagttggcccttcatattcttggattccacatctgcagattcgaccaaacatcaaaaatatttggggaaaaaagaattaaaaatattcaacaacaattaaaattacaacaagagaattaacaaaaaaattaaaa

SEQ ID NO: 295165 - DNA, 292 bp, Homo sapiens
tatcacctgaatccctgttcaatgtaattttccagcagtgatgaagaggcataatttttatgctattagtctttcctttagccatcactagatcccttactttaaccatattattttgtgtaatttcacagcaacaagtggtcctggtggcatccgaacggtaataatacgccagcatgagattgtcctgaaggtggcttatccacaggcagacagcaacctccgaaacatcgtgaccgagcagctggtagccctgatcgattgcttcctggatggttatgtttctcagctt

SEQ ID NO: 295166 - DNA, 602 bp, Homo sapiens
agtcaggagtttgagaccagcctggccaacagggtgaaatcttctctactaaaaatacaaaaattagccaggtgtggtgatggattcctgtaatcccagctactcaggaggctgaggcaggagaatcacttgaacctgggaggcagaagtttcagtgagctgagatcgtgccactgcaatccagcctgggtgacagagcaagactttgtctcaaaaaaaacaaacaaacaaacaaacaaaaaacaaactacaacttccttacaagacataatgacttcttttctccataaatgtctctagtattagttacatgattgtataatcttctaccttattttaacttgtcatagctatatatctgtgaagaaaatagaagagctaatgaatatgatttcaagaaagctttggacttgttggaatatattgatgaggtaagtaaaattgcttgagatgatctcaggcaactgaatacatatataaaaagagggagatccctcttttagtcaatcatgaaaatgaattaagcaaaaaagactgtatctgtggttcaactacctttaatccttagaatgtaaacaactcttcagaaaagctgtcaaggt

SEQ ID NO: 295167 - DNA, 324 bp, Homo sapiens
ggttctagctgctcacatgtacaaatcacttctaggcctcagtttctgcgactatgaaaattactagattgcactagcttgtctctaaaattgctgtgactccagatactttgcactgaagagaatctagggtgtttgatatctgtttcagttagggctaatgggaaatgtctagtaagataaatgtcaacttttgctgacttattatgagatgaaaaaccaaaggagagtgggcctaactcatgtgagcttgataactgatgaactcattgggagcattttaaacttttctacataaataataaatgagcactaatgaaagta

SEQ ID NO: 295168 - DNA, 1417 bp, Homo sapiens
ggtcgacagagactgagcgagggaaagagagagccaaagtggaaaggaccataaactggcaaagccgctctgcgctcgctgtggatgaaagccccgtgttggtgaagcctctcctcgcgagcagcgcgcacccctccagagcaccccgcggacccgcacctcggcgtggccaccatggtcgggagagttcaaccggatcggaaacagttgccactggtcctactgagattgctctgccttcttcccacaggactgcctgttcgcagcgtggattttaaccgaggcacggacaacatcaccgtgaggcagggggacacagccatcctcaggtgcgttctagaagacaagaactcaaaggtggcctggttgaaccgttctggcatcatttttgctggacatgacaagtggtctctggacccacgggttgagctggagaaacgccattctctggaatacagcctccgaatccagaaggtggatgtctatgatgagggttcctacacttgctcagttcagacacagcatgagcccaagacctcccaagtttacttgatcgtacaagtcccaccaaagatctccaatatctcctcggatgtcactgtgaatgagggcagcaacgtgactctggtctgcatggccaatggccgtcctgaacctgttatcacctggagacaccttacaccaactggaagggaatttgaaggagaagaagaatatctggagatccttggcatcaccagggagcagtcaggcaaatatgagtgcaaagctgccaacgaggtctcctcggcggatgtcaaacaagtcaaggtcactgtgaactatcctcccactatcacagaatccaagagcaatgaagccaccacaggacgacaagcttcactcaaatgtgaggcctcggcagtgcctgcacctgactttgagtggtaccgggatgacactaggataaatagtgccaatggccttgagattaagagcacggagggccagtcttccctgacggtgaccaacgtcactgaggagcactacggcaactacacctgtgtggctgccaacaagctgggggtcaccaatgccagcctagtccttttcagacctgggtcggtgagaggaataaatggatccatcagtctggccgtaccactgtggctgctggcagcatctctgctctgccttctcagcaaatgttaatagaataaaaatttaaaaataatttaaaaaacacacaaaaatgcgtcacacagaatacagagagagagagacagagagagagagagagagagagatgggggagaccgtttatttcacaactttgtgtgtttatacatgaagggggaaataagaaagtgaagaagaaaatacaacatttaaaacaattttacagtccatcattaaaaatttatgtatcattcaggat

SEQ ID NO: 295169 - DNA, 1127 bp, Homo sapiens
ggtcgacagagactgagcgagggaaagagagagccaaagtggaaaggaccataaactggcaaagccgctctgcgctcgctgtggatgaaagccccgtgttggtgaagcctctcctcgcgagcagcgcgcacccctccagagcaccccgcggacccgcacctcggcgtggccaccatggtcgggagagttcaaccggatcggaaacagttgccactggtcctactgagattgctctgccttcttcccacaggactgcctgttcgcagcgtggattttaaccgaggcacggacaacatcaccgtgaggcagggggacacagccatcctcaggaagggaatttgaaggagaagaagaatatctggagatccttggcatcaccagggagcagtcaggcaaatatgagtgcaaagctgccaacgaggtctcctcggcggatgtcaaacaagtcaaggtcactgtgaactatcctcccactatcacagaatccaagagcaatgaagccaccacaggacgacaagcttcactcaaatgtgaggcctcggcagtgcctgcacctgactttgagtggtaccgggatgacactaggataaatagtgccaatggccttgagattaagagcacggagggccagtcttccctgacggtgaccaacgtcactgaggagcactacggcaactacacctgtgtggctgccaacaagctgggggtcaccaatgccagcctagtccttttcaaacgtgttttacccacaatcccccaccccattcaagaaattggtaccaccgtgcacttcaagcaaaaaggacctgggtcggtgagaggaataaatggatccatcagtctggccgtaccactgtggctgctggcagcatctctgctctgccttctcagcaaatgttaatagaataaaaatttaaaaataatttaaaaaacacacaaaaatgcgtcacacagaatacagagagagagagacagagagagagagagagagagagatgggggagaccgtttatttcacaactttgtgtgtttatacatgaagggggaaataagaaagtgaagaagaaaatacaacatttaaaacaattttacagtccatcattaaaaatttatgtatcattcaggat

SEQ ID NO: 295170 - DNA, 1058 bp, Homo sapiens
ggtcgacagagactgagcgagggaaagagagagccaaagtggaaaggaccataaactggcaaagccgctctgcgctcgctgtggatgaaagccccgtgttggtgaagcctctcctcgcgagcagcgcgcacccctccagagcaccccgcggacccgcacctcggcgtggccaccatggtcgggagagttcaaccggatcggaaacagttgccactggtcctactgagattgctctgccttcttcccacaggactgcctgttcgcagcgtggattttaaccgaggcacggacaacatcaccgtgaggcagggggacacagccatcctcaggaagggaatttgaaggagaagaagaatatctggagatccttggcatcaccagggagcagtcaggcaaatatgagtgcaaagctgccaacgaggtctcctcggcggatgtcaaacaagtcaaggtcactgtgaactatcctcccactatcacagaatccaagagcaatgaagccaccacaggacgacaagcttcactcaaatgtgaggcctcggcagtgcctgcacctgactttgagtggtaccgggatgacactaggataaatagtgccaatggccttgagattaagagcacggagggccagtcttccctgacggtgaccaacgtcactgaggagcactacggcaactacacctgtgtggctgccaacaagctgggggtcaccaatgccagcctagtccttttcagacctgggtcggtgagaggaataaatggatccatcagtctggccgtaccactgtggctgctggcagcatctctgctctgccttctcagcaaatgttaatagaataaaaatttaaaaataatttaaaaaacacacaaaaatgcgtcacacagaatacagagagagagagacagagagagagagagagagagagatgggggagaccgtttatttcacaactttgtgtgtttatacatgaagggggaaataagaaagtgaagaagaaaatacaacatttaaaacaattttacagtccatcattaaaaatttatgtatcattcaggat

SEQ ID NO: 295171 - DNA, 1202 bp, Homo sapiens
  misc_feature (1191)..(1191): n is a, c, g, or t
ggtcgacagagactgagcgagggaaagagagagccaaagtggaaaggaccataaactggcaaagccgctctgcgctcgctgtggatgaaagccccgtgttggtgaagcctctcctcgcgagcagcgcgcacccctccagagcaccccgcggacccgcacctcggcgtggccaccatggtcgggagagttcaaccggatcggaaacagttgccactggtcctactgagattgctctgccttcttcccacaggactgcctgttcgcagcgtggattttaaccgaggcacggacaacatcaccgtgaggcagggggacacagccatcctcaggtgcgttctagaagacaagaactcaaaggtggcctggttgaaccgttctggcatcatttttgctggacatgacaagtggtctctggacccacgggttgagctggagaaacgccattctctggaatacagcctccgaatccagaaggtggatgtctatgatgagggttcctacacttgctcagttcagacacagcatgagcccaagacctcccaagtttacttgatcgtacaagtcccaccaaagatctccaatatctcctcggatgtcactgtgaatgagggcagcaacgtgactctggtctgcatggccaatggccgtcctgaacctgttatcacctggagacaccttacaccaactggaagggaatttgaaggagaagaagaatatctggagatccttggcatcaccagggagcagtcaggcaaatatgagtgcaaagctgccaacgaggtctcctcggcggatgtcaaacaagtcaaggtcactgtgaactatcctcccactatcacagaatccaagagcaatgaagccaccacaggacgacaagcttcactcaaatgtgaggcctcggcagtgcctgcacctgactttgagtggtaccgggatgacactaggataaatagtgccaatggccttgagattaagagcacggagggccagtcttccctgacggtgaccaacgtcactgaggagcactacggcaactacacctgtgtggctgccaacaagctgggggtcaccaatgccagcctagtccttttcagacctgggtcggtgagaggaataaatggatccatcagtctggccgtaccactgtggctgctggcagcatctctgctctgccttctccgcgatcgaagngtgggggatcc

SEQ ID NO: 295172 - DNA, 1453 bp, Homo sapiens
ggtcgacagagactgagcgagggaaagagagagccaaagtggaaaggaccataaactggcaaagccgctctgcgctcgctgtggatgaaagccccgtgttggtgaagcctctcctcgcgagcagcgcgcacccctccagagcaccccgcggacccgcacctcggcgtggccaccatggtcgggagagttcaaccggatcggaaacagttgccactggtcctactgagattgctctgccttcttcccacaggactgcctgttcgcagcgtggattttaaccgaggcacggacaacatcaccgtgaggcagggggacacagccatcctcaggtgcgttctagaagacaagaactcaaaggtggcctggttgaaccgttctggcatcatttttgctggacatgacaagtggtctctggacccacgggttgagctggagaaacgccattctctggaatacagcctccgaatccagaaggtggatgtctatgatgagggttcctacacttgctcagttcagacacagcatgagcccaagacctcccaagtttacttgatcgtacaagtcccaccaaagatctccaatatctcctcggatgtcactgtgaatgagggcagcaacgtgactctggtctgcatggccaatggccgtcctgaacctgttatcacctggagacaccttacaccaactggaagggaatttgaaggagaagaagaatatctggagatccttggcatcaccagggagcagtcaggcaaatatgagtgcaaagctgccaacgaggtctcctcggcggatgtcaaacaagtcaaggtcactgtgaactatcctcccactatcacagaatccaagagcaatgaagccaccacaggacgacaagcttcactcaaatgtgaggcctcggcagtgcctgcacctgactttgagtggtaccgggatgacactaggataaatagtgccaatggccttgagattaagagcacggagggccagtcttccctgacggtgaccaacgtcactgaggagcactacggcaactacacctgtgtggctgccaacaagctgggggtcaccaatgccagcctagtccttttcaaacgtgttttacccacaatcccccaccccattcaaggacctgggtcggtgagaggaataaatggatccatcagtctggccgtaccactgtggctgctggcagcatctctgctctgccttctcagcaaatgttaatagaataaaaatttaaaaataatttaaaaaacacacaaaaatgcgtcacacagaatacagagagagagagacagagagagagagagagagagagatgggggagaccgtttatttcacaactttgtgtgtttatacatgaagggggaaataagaaagtgaagaagaaaatacaacatttaaaacaattttacagtccatcattaaaaatttatgtatcattcaggat

SEQ ID NO: 295173 - DNA, 1315 bp, Homo sapiens
ggtcgacagagactgagcgagggaaagagagagccaaagtggaaaggaccataaactggcaaagccgctctgcgctcgctgtggatgaaagccccgtgttggtgaagcctctcctcgcgagcagcgcgcacccctccagagcaccccgcggacccgcacctcggcgtggccaccatggtcgggagagttcaaccggatcggaaacagttgccactggtcctactgagattgctctgccttcttcccacaggactgcctgttcgcagcgtggattttaaccgaggcacggacaacatcaccgtgaggcagggggacacagccatcctcaggtgcgttctagaagacaagaactcaaaggtggcctggttgaaccgttctggcatcatttttgctggacatgacaagtggtctctggacccacgggttgagctggagaaacgccattctctggaatacagcctccgaatccagaaggtggatgtctatgatgagggttcctacacttgctcagttcagacacagcatgagcccaagacctcccaagtttacttgatcgtacaagtcccaccaaagatctccaatatctcctcggatgtcactgtgaatgagggcagcaacgtgactctggtctgcatggccaatggccgtcctgaacctgttatcacctggagacaccttacaccaactggaagggaatttgaaggagaagaagaatatctggagatccttggcatcaccagggagcagtcaggcaaatatgagtgcaaagctgccaacgaggtctcctcggcggatgtcaaacaagtcaaggtcactgtgaactatcctcccactatcacagaatccaagagcaatgaagccaccacaggacgacaagcttcactcaaatgtgaggcctcggcagtgcctgcacctgactttgagtggtaccgggatgacactaggataaatagtgccaatggccttgagattaagagcacggagggccagtcttccctgacggtgaccaacgtcactgaggagcactacggcaactacacctgtgtggctgccaacaagctgggggtcaccaatgccagcctagtccttttcagtaagtatgccaaagcagggcccaacttgatggaattaaattgacttttcacatgaaaaacgtgaaaaccattcccttagctattaaaagttcacttaaaaacaaataaggatatatgcactgaaacaaaaatacagggttctcaactcctgtgcatagcagagatttataaatggaacaacttctctctatagtctttcttacttctgataactgccttgt

SEQ ID NO: 295174 - DNA, 1566 bp, Homo sapiens
ggtcgacagagactgagcgagggaaagagagagccaaagtggaaaggaccataaactggcaaagccgctctgcgctcgctgtggatgaaagccccgtgttggtgaagcctctcctcgcgagcagcgcgcacccctccagagcaccccgcggacccgcacctcggcgtggccaccatggtcgggagagttcaaccggatcggaaacagttgccactggtcctactgagattgctctgccttcttcccacaggactgcctgttcgcagcgtggattttaaccgaggcacggacaacatcaccgtgaggcagggggacacagccatcctcaggtgcgttctagaagacaagaactcaaaggtggcctggttgaaccgttctggcatcatttttgctggacatgacaagtggtctctggacccacgggttgagctggagaaacgccattctctggaatacagcctccgaatccagaaggtggatgtctatgatgagggttcctacacttgctcagttcagacacagcatgagcccaagacctcccaagtttacttgatcgtacaagtcccaccaaagatctccaatatctcctcggatgtcactgtgaatgagggcagcaacgtgactctggtctgcatggccaatggccgtcctgaacctgttatcacctggagacaccttacaccaactggaagggaatttgaaggagaagaagaatatctggagatccttggcatcaccagggagcagtcaggcaaatatgagtgcaaagctgccaacgaggtctcctcggcggatgtcaaacaagtcaaggtcactgtgaactatcctcccactatcacagaatccaagagcaatgaagccaccacaggacgacaagcttcactcaaatgtgaggcctcggcagtgcctgcacctgactttgagtggtaccgggatgacactaggataaatagtgccaatggccttgagattaagagcacggagggccagtcttccctgacggtgaccaacgtcactgaggagcactacggcaactacacctgtgtggctgccaacaagctgggggtcaccaatgccagcctagtccttttcaaacgtgttttacccacaatcccccaccccattcaagaaattggtaccaccgtgcacttcaagcaaaaagtcctgctgcagctgaattttgctccttgagtcaacattaaaagccttgacccatttcacaaatcaatgcctttgattcaggacctgggtcggtgagaggaataaatggatccatcagtctggccgtaccactgtggctgctggcagcatctctgctctgccttctcagcaaatgttaatagaataaaaatttaaaaataatttaaaaaacacacaaaaatgcgtcacacagaatacagagagagagagacagagagagagagagagagagagatgggggagaccgtttatttcacaactttgtgtgtttatacatgaagggggaaataagaaagtgaagaagaaaatacaacatttaaaacaattttacagtccatcattaaaaatttatgtatcattcaggat

SEQ ID NO: 295175 - DNA, 795 bp, Homo sapiens
cctgctctccctatcatgacccagagcctgcgtcaccccaccctggttttcacaccctccatccacaccctggagcagtcaatacccacttggcatctccgtaatcacagagatgtccaccttcatcccttgcaactattggaagccaaagaatgggagcaaaccacacgatgggcgttgggaagcaccgtaattacagggttgggaggcaggatgcctgcgctgggggaggaggtgcctttcaaacctgggatgcagctgggacagtgtcagctactaccccagcctccccactcacccccgcactgaaagctccccctggggcttcgtgctttcctgggcacttcccttcccccatgggatccaggcatcctgctctccaccatgtccttcttcaggcatgcaggggacctccaagcaatgatatccaaggaattccatctggcagccacccaggatgactgcagaaaaggaaggacacaggaggatatcctggttccctcttcccacccagagctgtttgcatcagtcctgccaatggctccggaagaagctgccaggctccagcaacctcagccccttcctcctccctcaggaatccacctatccgcctctaggaccttggctccaactctattgtactcgtctcctccctcccattctccttttggtctcagctccttgatctaagcctcccagagagacccctagaacgtttccctcaaggacctttctgcctggaagtctgttagcctttcagaagtaacatgtccaaaataaaatttgattcctccc

SEQ ID NO: 295176 - DNA, 855 bp, Homo sapiens
cctgctctccctatcatgacccagagcctgcgtcaccccaccctggttttcacaccctccatccacaccctggagcagtcaatacccacttggcatctccgtaatcacagagatgtccaccttcatcccttgcaactattggaagccaaagaatgggagcaaaccacacgatgggcgttgggaagcaccgtaattacagggttgggaggcaggatgcctgcgctgggggaggaggtgcctttcaaacctgggatgcagctgggacagtgtcagctactaccccagcctccccactcacccccgcactgaaagctccccctggggcttcgtgctttcctgggcacttcccttcccccatgggatccaggcatcctgctctccaccatgtccttcttcaggcatgcaggggacctccaagcaatgatatccaaggaattccatctggcagccacccaggatgactgcagaaaaggaaggacacaggaggatatcctggttccctcttcccacccagagctgtttgcatcagtcctgccaatggctccggaagaagctgccaggctccagcaacctcagccccttcctcctccctcaggaatccacctatccgcctctaggaccttggctccaactctattgtactcgtctcctccctcccattctccttttggtctcagctccttgatctaagcctcccagagagacccctagaacgtttccctcaaggacctttctgcctggaagtctgttagcctttcagaagtaacatgtccaaaataaaatttgattcctcccaggttgttccctgcctggtccgctaccccacagtaaggaacaccttattatgcaatggcg

SEQ ID NO: 295177 - DNA, 498 bp, Homo sapiens
ccccacccagccccagccccaggaggaggagcctgtctggacggacgcagcctgaactgacccacaaacagaccaaaaaagtcactctcaaagagctctcggcatgcaggggacctccaagcaatgatatccaaggaattccatctggcagccacccaggatgactgcagaaaaggaaggacacaggaggatatcctggttccctcttcccacccagagctgtttgcatcagtcctgccaatggctccggaagaagctgccaggctccagcaacctcagccccttcctcctccctcaggaatccacctatccgcctctaggaccttggctccaactctattgtactcgtctcctccctcccattctccttttggtctcagctccttgatctaagcctcccagagagacccctagaacgtttccctcaaggacctttctgcctggaagtctgttagcctttcagaagtaacatgtccaaaataaaatttgattcctccc

SEQ ID NO: 295178 - DNA, 465 bp, Homo sapiens
gcttccaggtgtcccagaaacccaggaaatcgagactcatgactcccagagaggatggcatctagaaggcatgcaggggacctccaagcaatgatatccaaggaattccatctggcagccacccaggatgactgcagaaaaggaaggacacaggaggatatcctggttccctcttcccacccagagctgtttgcatcagtcctgccaatggctccggaagaagctgccaggctccagcaacctcagccccttcctcctccctcaggaatccacctatccgcctctaggaccttggctccaactctattgtactcgtctcctccctcccattctccttttggtctcagctccttgatctaagcctcccagagagacccctagaacgtttccctcaaggacctttctgcctggaagtctgttagcctttcagaagtaacatgtccaaaataaaatttgattcctccc

SEQ ID NO: 295179 - DNA, 230 bp, Homo sapiens
tggaatctacagtccatgggccctgacttcttgccttcgtctcaaatagactctgcagccagccatctatgcagcgccccagtggctttgaaatgcaacagaaaccatcacccccggaccgtgggctccatgccagtgggcaaagcacaggtgcgttcactgagttcccagcacatagctgtggcaggcacttggtgatattttgaaataaaagaatggaagaatgtgtc

SEQ ID NO: 295180 - DNA, 920 bp, Homo sapiens
gcttccaggtgtcccagaaacccaggaaatcgagactcatgactcccagagaggatggcatctagaagtagacgatcaagggtggaatctacagtccatgggccctgacttcttgccttcgtctcaaatagactctgcagccagccatctatgcagcgccccagtggctttgaaatgcaacagaaaccatcacccccggaccgtgggctccatgccagtgggcaaagcacagcctgggaagaattggtttgcagccaggcagtcctccatccagtcttgactttggcacttgtgatatgacttgcacagaccaaaaaagtcactctcaaagagctctcggcacacagaccccagctttacaaggaccccagctccttaacacagatcccagctccaaggaaactcgtcccccccacgttaatcctgaccgactttgccacatggagccagcaaaccatttctggcatgcaggggacctccaagcaatgatatccaaggaattccatctggcagccacccaggatgactgcagaaaaggaaggacacaggaggatatcctggttccctcttcccacccagagctgtttgcatcagtcctgccaatggctccggaagaagctgccaggctccagcaacctcagccccttcctcctccctcaggaatccacctatccgcctctaggaccttggctccaactctattgtactcgtctcctccctcccattctccttttggtctcagctccttgatctaagcctcccagagagacccctagaacgtttccctcaaggacctttctgcctggaagtctgttagcctttcagaagtaacatgtccaaaataaaatttgattcctcccaggttgttccctgcctggtccgctaccccacagtaaggaacaccttattatgcaatggcg

SEQ ID NO: 295181 - DNA, 1704 bp, Homo sapiens
  misc_feature (10)..(10): n is a, c, g, or t
  misc_feature (12)..(12): n is a, c, g, or t
ggcggggcangnaggcagcatgctaaaccgggtgcgctcggccgtggcgcacctggtgagctccgggggcgctccgcctccgcgccccaaatccccggacctgcccaacgccgcctcggcgccgcccgccgccgctccagaagcgcccaggagccctcccgcgaaggctgggagcgggagcgcgacgcccgcgaaggctgttgaggctcgagcgagcttctccagaccgacctttctgcagctgagccccggggggctgcgacgcgccgatgaccacgcgggccgggctgtgcaaagccccccggacacgggccgccgcctgccctggagcacaggctacgccgaggtcatcaatgctggcaagagtcggcacaatgaggaccaggcttgctgtgaagtggtgtatgtggaaggtcggaggagtgttacaggagtacctagggagcctagccgaggccagggactctgcttctactactggggcctatttgatgggcatgcagggggcggagctgctgaaatggcctcacggctcctgcatcgccatatccgagagcagctaaaggacctggtagagatacttcaggacccttcgccaccacccctctgcctcccaaccactccggggaccccagattcctccgatccctctcacttgcttggccctcagtcctgctggtcttcacagaaggaagtgagccacgagagcctggtagtgggggccattgagaatgccttccagctcatggatgagcagatggcccgggagcggcgtggccaccaagtggaggggggctgctgtgcactggttgtgatctacctgctaggcaaggtgtacgtggccaatgcaggcgatagcagggccatcattgtccggaatggtgaaatcattccaatgtcccgggagtttaccccggagactgagcgccagcgtcttcagctgcttggcttcctgaaaccagagctgctaggcagtgaattcacccaccttgagttcccccgcagagttctgcccaaggagctggggcagaggatgttgtaccgggaccagaacatgaccggctgggcctacaaaaagatcgagctggaggatctcaggtttcctctggtctgtggggagggcaaaaaggctcgggtgatggccaccattggggtgacccgaggcttgggagaccacagccttaaggtctgcagttccaccctgcccatcaagccctttctctcctgcttccctgaggtacgagtgtatgacctgacacaatatgagcactgcccagatgatgtgctagtcctgggaacagatggcctgtgggatgtcactactgactgtgaggtagctgccactgtggacagggtgctgtcggcctatgagcctaatgaccacagcaggtatacagctctggcccaagctctggtcctgggggcccggggtaccccccgagaccgtggctggcgtctccccaacaacaagctgggttccggggatgacatctctgtcttcgtcatccccctgggagggccaggcagttactcctgaggggctgaacaccatccctcccactagcctctccatacttactcctctcacagcccaaattctgaagttgtctccctgacccttctttagtggcaacttaactgaagaagggatgtccgctatatccaaaattacagctattggcaaataaacgagatggataaagg

SEQ ID NO: 295182 - DNA, 2505 bp, Homo sapiens
  misc_feature (10)..(10): n is a, c, g, or t
  misc_feature (12)..(12): n is a, c, g, or t
ggcggggcangnaggcagcatgctaaaccgggtgcgctcggccgtggcgcacctggtgagctccgggggcgctccgcctccgcgccccaaatccccggacctgcccaacgccgcctcggcgccgcccgccgccgctccagaagcgcccaggagccctcccgcgaaggctgggagcgggagcgcgacgcccgcgaaggctgttgaggctcgagcgagcttctccagaccgacctttctgcagctgagccccggggggctgcgacgcgccgatgaccacgcgggccgggctgtgcaaagccccccggacacgggccgccgcctgccctggagcacaggctacgccgagtgagcgccccctggggcacccaaaccaggatggggctcccacccctctccccagctccgcatccccggcgctaggacgcgttccccacgccgcgtccgggccaggagctcccttttccgtggacctttgctatcctctggtcttcgggccgcaccccctcccaacccattttccagtggggggcagcctgtgtcaccttcttcacgtccttcccgctcattgactgccctcgcccacgccgcctcaggaccctgttctgccccagagcccggagggcggagagcccggcgaaggatgagttggccagttccccgtcgcggcccggcagcttaaaggctaagggaaaaggggtttcacgaaggagcggggttctttttaataggggacatagcggttgggaagactcgctcacccgcttcccggctccagcgccccagttccctgtccctcttaccgtagttcccctccccctccacacccagaaatagcccgcgacaccaggaggccgccagcttccccaggagcggggagggggacgcccggggtagaggagggtcccatttagatgcccttcagcctgccaactcgtgctggcctggcaaagaagcggaccccctgcccggagcggccggctggcccccgggctgtgtgtattttaaatgcatctgccgggaacgcagagcaccgagggagatgggggcgctcagttcgctgaggaaggtggctggtggcccatggacccaccaccacctcccttagcctcctgtgtgggaggagtttatgggtatgtggctcctgcccagtccaggtgggctttcacttctactctatttcagttcctctttcccgatctgggctggagagcttcctcattgttaaggcagcagaaactttcgctggatggttttaggataaggggtcatcaatgctggcaagagtcggcacaatgaggaccaggcttgctgtgaagtggtgtatgtggaaggtcggaggagtgttacaggagtacctagggagcctagccgaggccagggactctgcttctactactggggcctatttgatgggcatgcagggggcggagctgctgaaatggcctcacggctcctgcatcgccatatccgagagcagctaaaggacctgaaggaagtgagccacgagagcctggtagtgggggccattgagaatgccttccagctcatggatgagcagatggcccgggagcggcgtggccaccaagtggaggggggctgctgtgcactggttgtgatctacctgctaggcaaggtgtacgtggccaatgcaggcgatagcagggccatcattgtccggaatggtgaaatcattccaatgtcccgggagtttaccccggagactgagcgccagcgtcttcagctgcttggcttcctgaaaccagagctgctaggcagtgaattcacccaccttgagttcccccgcagagttctgcccaaggagctggggcagaggatgttgtaccgggaccagaacatgaccggctgggcctacaaaaagatcgagctggaggatctcaggtttcctctggtctgtggggagggcaaaaaggctcgggtgatggccaccattggggtgacccgaggcttgggagaccacagccttaaggtctgcagttccaccctgcccatcaagccctttctctcctgcttccctgaggtacgagtgtatgacctgacacaatatgagcactgcccagatgatgtgctagtcctgggaacagatggcctgtgggatgtcactactgactgtgaggtagctgccactgtggacagggtgctgtcggcctatgagcctaatgaccacagcaggtatacagctctggcccaagctctggtcctgggggcccggggtaccccccgagaccgtggctggcgtctccccaacaacaagctgggttccggggatgacatctctgtcttcgtcatccccctgggagggccaggcagttactcctgaggggctgaacaccatccctcccactagcctctccatacttactcctctcacagcccaaattctgaagttgtctccctgacccttctttagtggcaacttaactgaagaagggatgtccgctatatccaaaattacagctattggcaaataaacgagatggataaagg

SEQ ID NO: 295183 - DNA, 387 bp, Homo sapiens
cacatgtgggcctgtgtatctgtcttcccacatacatgttggtacatgaatgtgcatgtgtgctcctggcaggtatacagctctggcccaagctctggtcctgggggcccggggtaccccccgagaccgtggctggcgtctccccaacaacaagctgggttccggggatgacatctctgtcttcgtcatccccctgggagggccaggcagttactcctgaggggctgaacaccatccctcccactagcctctccatacttactcctctcacagcccaaattctgaagttgtctccctgacccttctttagtggcaacttaactgaagaagggatgtccgctatatccaaaattacagctattggcaaataaacgagatggataaagg

SEQ ID NO: 295184 - DNA, 796 bp, Homo sapiens
tgctgtgagcataatgccccctggctctctgttctgatcatccccaactccagggcttcctgaaaccagagctgctaggcagtgaattcacccaccttgagttcccccgcagagttctgcccaaggagctggggcagaggatgttgtaccgggaccagaacatgaccggctggctcgggtgatggccaccattggggtgacccgaggcttgggagaccacagccttaaggtctgcagttccaccctgcccatcaagccctttctctcctgcttccctgaggtacgagtgtatgacctgacacaatatgagcactgcccagatgatgtgctagtcctgggaacagatggcctgtgggatgtcactactgactgtgaggtagctgccactgtggacagggtgctgtcggcctatgagcctaatgaccacagcagccccaccatggctgcaatccgaaagaagctggtgatcgttggggatggtgcctgtgggaagacctgcctcctcatcgtcttcagcaaggatcagtttccggaggtctacgtccctactgtctttgagaactatattgcggacattgaggtggacggcaagcaggtggagctggctctgtgggacacagcagggcaggaagactatgatcgactgcggcctctctcctacccggacactgatgtcatcctcatgtgcttctccatcgacagccctgacagcctggaaaacattcctgagaagtggaccccagaggtgaagcacttctgccccaacgtgcccatcatcctggtggggaataagaag

SEQ ID NO: 295185 - DNA, 1824 bp, Homo sapiens
  misc_feature (10)..(10): n is a, c, g, or t
  misc_feature (12)..(12): n is a, c, g, or t
  misc_feature (1762)..(1762): n is a, c, g, or t
  misc_feature (1787)..(1787): n is a, c, g, or t
ggcggggcangnaggcagcatgctaaaccgggtgcgctcggccgtggcgcacctggtgagctccgggggcgctccgcctccgcgccccaaatccccggacctgcccaacgccgcctcggcgccgcccgccgccgctccagaagcgcccaggagccctcccgcgaaggctgggagcgggagcgcgacgcccgcgaaggctgttgaggctcgagcgagcttctccagaccgacctttctgcagctgagccccggggggctgcgacgcgccgatgaccacgcgggccgggctgtgcaaagccccccggacacgggccgccgcctgccctggagcacaggctacgccgaggtcatcaatgctggcaagagtcggcacaatgaggaccaggcttgctgtgaagtggtgtatgtggaaggtcggaggagtgttacaggagtacctagggagcctagccgaggccagggactctgcttctactactggggcctatttgatgggcatgcagggggcggagctgctgaaatggcctcacggctcctgcatcgccatatccgagagcagctaaaggacctggtagagatacttcaggacccttcgccaccacccctctgcctcccaaccactccggggaccccagattcctccgatccctctcacttgcttggccctcagtcctgctggtcttcacagaaggaagtgagccacgagagcctggtagtgggggccattgagaatgccttccagctcatggatgagcagatggcccgggagcggcgtggccaccaagtggaggggggctgctgtgcactggttgtgatctacctgctaggcaaggtgtacgtggccaatgcaggcgatagcagggccatcattgtccggaatggtgaaatcattccaatgtcccgggagtttaccccggagactgagcgccagcgtcttcagctgcttggcttcctgaaaccagagctgctaggcagtgaattcacccaccttgagttcccccgcagagttctgcccaaggagctggggcagaggatgttgtaccgggaccagaacatgaccggctgggcctacaaaaagatcgagctggaggatctcaggtttcctctggtctgtggggagggcaaaaaggctcgggtgatggccaccattggggtgacccgaggcttgggagaccacagccttaaggtctgcagttccaccctgcccatcaagccctttctctcctgcttccctgaggtacgagtgtatgacctgacacaatatgagcactgcccagatgatgtgctagtcctgggaacagatggcctgtgggatgtcactactgactgtgaggtagctgccactgtggacagggtgctgtcggcctatgagcctaatgaccacagcaggtatacagctctggcccaagctctggtcctgggggcccggggtaccccccgagaccgtggctggcgtctccccaacaacaagctgggttccggggatgacatctctgtcttcgtcatccccctgggagggccaggcagttactcctgaggggctgaacaccatccctcccactagcctctccatacttactcctctcacagcccaaattctgaagttgtctccctgacccttctttagtggcaacttaactgaagaagggatgtccgctatatccaaaattacagctattggcaaataaacgagatggataaaggaaaactcgtgccgttttagcgggtacaagatctaccccggacacgggaggcgctacgncagggaccgacgggaaaggtttttncagtttcttaatgcgaaatgcgagtcgggttttcttt

SEQ ID NO: 295186 - DNA, 1705 bp, Homo sapiens
  misc_feature (10)..(10): n is a, c, g, or t
  misc_feature (12)..(12): n is a, c, g, or t
ggcggggcangnaggcagcatgctaaaccgggtgcgctcggccgtggcgcacctggtgagctccgggggcgctccgcctccgcgccccaaatccccggacctgcccaacgccgcctcggcgccgcccgccgccgctccagaagcgcccaggagccctcccgcgaaggctgggagcgggagcgcgacgcccgcgaaggctgttgaggctcgagcgagcttctccagaccgacctttctgcagctgagccccggggggctgcgacgcgccgatgaccacgcgggccgggctgtgcaaagccccccggacacgggccgccgcctgccctggagcacaggctacgccgaggtcatcaatgctggcaagagtcggcacaatgaggaccaggcttgctgtgaagtggtgtatgtggaaggtcggaggagtgttacaggagtacctagggagcctagccgaggccagggactctgcttctactactggggcctatttgatgggcatgcagggggcggagctgctgaaatggcctcacggctcctgcatcgccatatccgagagcagctaaaggacctggtagagatacttcaggacccttcgccaccacccctctgcctcccaaccactccggggaccccagattcctccgatccctctcacttgcttggccctcagtcctgctggtcttcacagaaggaagtgagccacgagagcctggtagtgggggccattgagaatgccttccagctcatggatgagcagatggcccgggagcggcgtggccaccaagtggaggggggctgctgtgcactggttgtgatctacctgctaggcaaggtgtacgtggccaatgcaggcgatagcagggccatcattgtccggaatggtgaaatcattccaatgtcccgggagtttaccccggagactgagcgccagcgtcttcagctgcttggcttcctgaaaccagagctgctaggcagtgaattcacccaccttgagttcccccgcagagttctgcccaaggagctggggcagaggatgttgtaccgggaccagaacatgaccggctgggcctacaaaaagatcgagctggaggatctcaggtttcctctggtctgtggggagggcaaaaaggctcgggtgatggccaccattggggtgacccgaggcttgggagaccacagccttaaggtctgcagttccaccctgcccatcaagccctttctctcctgcttccctgaggtacgagtgtatgacctgacacaatatgagcactgcccagatgatgtgctagtcctgggaacagatggcctgtgggatgtcactactgactgtgaggtagctgccactgtggacagggtgctgtcggcctatgagcctaatgaccacagcaggtatacagctctggcccaagctctggtcctgggggcccggggtaccccccgagaccgtggctggcgtctccccaacaacaagctgggttccggggatgacatctctgtcttcgtcatccccctgggagggccaggcagttactcctgaggggctggccgcatacgtcgcactatcctctggatacgtcatcactctcgcagggcacagtcgacagtggtgctccttgaccattccttagtgaagaataaactaaacaacggatgcgcgcggatactcccgaagcacaggtaatggctgattgcgcgaatggatcat

SEQ ID NO: 295187 - DNA, 1810 bp, Homo sapiens
gcgcagacgggaagctgctcagcaccggcttcagcaggatgagtgagcggcaactcgcgctctgggacccgttttgctgcgtcgcgtgaaggatcctgcgctggcgcccccacctggtgatgccgagtccctgggggtggtttgctgtgactgcatgcggcgcgcagcggaacaacttcgaggagccagtggcactgcaggagatggacacaagcaacggggtcctattgcccttttacgatcccgactccagcatcgtctacctgtgtggcaagggcgacagcagcattcggtactttgagattaccgacgagccgcctttcgtgcactacctgaacacgttcagcagcaaagagccgcagcggggcatgggtttcatgcccaaaaggggactggatgtcagcaagtgtgagatcgcccggttctacaagctacacgaaagaaagtgtgaacctatcatcatgactgtgccccgcaagtcagacctcttccaggacgatctgtacccggatacgccaggcccggagccggccctagaagcggacgaatggctatccggccaggacgccgaacccgtgctcatttcgctgagggacggctatgtgccccccaagcaccgcgagctccgggtcacgaagcgcaacatcctggacgtgcgcccgccctccggcccccgccgcagccagtcggccagcgacgcccccttgtcgcagcacaccctggagacgctgctggaagagatcaaggccctccgcgagcgggtgcaggcccaggagcagcgcatcacggctctggagaacatgctgtgcgagctggtggacggcacggactagccccgcgcgccaggcaggcggagcggggcggggcgcacaagctcggccccgccccggcttttagtcccgaactccggaccccgccttcttgggctgggcccgggggcgggactggggagggaactccgcccctcgcgggagaccagaactcttggagcttaggggagacccacgtcgctccagcggaggctggactgcgagcctcgtctgggactcggctggagctggcctagggaggcctggggtaacctggggggctcagcaatggtgctgcacggcgaggtggtgtccccctttgtcctccgcccagggcagggaaagtgcttagtattagcgtgatgcttggggttattggagcctgagcttgacctcaaacgggtggcgatttgatgggtacccccaggctggggaaaatgacagcgcttctcctaatcagctcactggattccatcaccctgagcggtaaaccagatgggcgtcaccccagttctgcagacacatacacaacccgtttgctgcagagccggacccagtggctacacccacagcggtctgtggtagagaactctcttccttctttccaccgacaggggcgagggctgcttcctcgcggcagcccccgcgaagaaatctcgagagaactggcatgaggagttaggttcatcacaaatacacacacactgcccccaaccctctgccgttgcctctctcagaaaaacaagacgtactgaatgaaatattttactaagcgttcagtctgtgcctcctgcatgggtgggagtgaggggaacgagacccccagcctctgcaaatgctacccccaggctcctgggagacctggcgatgcactcctgggctcagggtccatcaggcagcctcttaccctagagctctctccactctgaggttcagaaggaccccaacccacaccgtaggcgttccccccaagtaaagttaggtagcaaaagccaaaaaaa

SEQ ID NO: 295188 - DNA, 2717 bp, Homo sapiens
cagctggggctgcagcggcgccgggctctagagagccgcaggatcggccagagtgcggagctggacacccgggtcccagatactacagacacccggagaggtggctccttcgccctgaagccttcctcggccccctacgcactcgggccccttccgcagaggattcgcagcgtgagcgccccgcagcccgctcaggaccagctatgagcagacgtgtggttcggcaaagcaagttccgccatgtgtttgggcaggcagcaaaggccgaccaggcctacgaggacatccgtgtgtccaaggtcacatgggacagctccttctgtgccgtcaaccccaaattcctggccattattgtggaggctggaggcgggggtgccttcatcgtcctgcctctggccaagacagggcgagtggataagaactacccactggtcactgggcacactgcccctgtgctggatattgactggtgtccacacaatgacaacgttatcgccagtgcctcagacgacaccaccatcatggtgtggcagattccagactatacccccatgcgcaacattacggaacctatcatcacacttgagggccactccaagcgtgtgggcatcctctcctggcaccctactgccaggaatgtcctgctcagtgcaggtggtgacaatgtgatcatcatctggaatgtgggcaccggggaggtgctgctgagcctggatgatatgcacccagacgtcatccacagtgtgtgctggaacagcaacggtagcctgctagccaccacctgcaaggacaagaccttgcgcatcattgaccccagaaaaggccaagtggtggcggagaggtttgcggcccacgaggggatgaggcccatgcgggccgtcttcacgcgccagggccatatcttcaccacgggcttcacccgcatgagccagcgagagctgggcctgtgggacccggtaacgcagctggaggcttgggttttgctgcgtcgcgtgaaggatcctgcgctggcgcccccacctggtgatgccgagtccctgggggtggtttgctgtgactgcatgcggcgcgcagcggaacaacttcgaggagccagtggcactgcaggagatggacacaagcaacggggtcctattgcccttttacgatcccgactccagcatcgtctacctgtgtggcaagggcgacagcagcattcggtactttgagattaccgacgagccgcctttcgtgcactacctgaacacgttcagcagcaaagagccgcagcggggcatgggtttcatgcccaaaaggggactggatgtcagcaagtgtgagatcgcccggttctacaagctacacgaaagaaagtgtgaacctatcatcatgactgtgccccgcaagtcagacctcttccaggacgatctgtacccggatacgccaggcccggagccggccctagaagcggacgaatggctatccggccaggacgccgaacccgtgctcatttcgctgagggacggctatgtgccccccaagcaccgcgagctccgggtcacgaagcgcaacatcctggacgtgcgcccgccctccggcccccgccgcagccagtcggccagcgacgcccccttgtcgcagcacaccctggagacgctgctggaagagatcaaggccctccgcgagcgggtgcaggcccaggagcagcgcatcacggctctggagaacatgctgtgcgagctggtggacggcacggactagccccgcgcgccaggcaggcggagcggggcggggcgcacaagctcggccccgccccggcttttagtcccgaactccggaccccgccttcttgggctgggcccgggggcgggactggggagggaactccgcccctcgcgggagaccagaactcttggagcttaggggagacccacgtcgctccagcggaggctggactgcgagcctcgtctgggactcggctggagctggcctagggaggcctggggtaacctggggggctcagcaatggtgctgcacggcgaggtggtgtccccctttgtcctccgcccagggcagggaaagtgcttagtattagcgtgatgcttggggttattggagcctgagcttgacctcaaacgggtggcgatttgatgggtacccccaggctggggaaaatgacagcgcttctcctaatcagctcactggattccatcaccctgagcggtaaaccagatgggcgtcaccccagttctgcagacacatacacaacccgtttgctgcagagccggacccagtggctacacccacagcggtctgtggtagagaactctcttccttctttccaccgacaggggcgagggctgcttcctcgcggcagcccccgcgaagaaatctcgagagaactggcatgaggagttaggttcatcacaaatacacacacactgcccccaaccctctgccgttgcctctctcagaaaaacaagacgtactgaatgaaatattttactaagcgttcagtctgtgcctcctgcatgggtgggagtgaggggaacgagacccccagcctctgcaaatgctacccccaggctcctgggagacctggcgatgcactcctgggctcagggtccatcaggcagcctcttaccctagagctctctccactctgaggttcagaaggaccccaacccacaccgtaggcgttccccccaagtaaagttaggtagcaaaagccaaaaaaa

SEQ ID NO: 295189 - DNA, 2596 bp, Homo sapiens
cagctggggctgcagcggcgccgggctctagagagccgcaggatcggccagagtgcggagctggacacccgggtcccagatactacagacacccggagaggtggctccttcgccctgaagccttcctcggccccctacgcactcgggccccttccgcagaggattcgcagcgtgagcgccccgcagcccgctcaggaccagctatgagcagacgtgtggttcggcaaagcaagttccgccatgtgtttgggcaggcagcaaaggccgaccaggcctacgaggacatccgtgtgtccaaggtcacatgggacagctccttctgtgccgtcaaccccaaattcctggccattattgtggaggctggaggcgggggtgccttcatcgtcctgcctctggccaagacagggcgagtggataagaactacccactggtcactgggcacactgcccctgtgctggatattgactggtgtccacacaatgacaacgttatcgccagtgcctcagacgacaccaccatcatggtgtggcagattccagactatacccccatgcgcaacattacggaacctatcatcacacttgagggccactccaagcgtgtgggcatcctctcctggcaccctactgccaggaatgtcctgctcagtgcaggtggtgacaatgtgatcatcatctggaatgtgggcaccggggaggtgctgctgagcctggatgatatgcacccagacgtcatccacagtgtgtgctggaacagcaacggtagcctgctagccaccacctgcaaggacaagaccttgcgcatcattgaccccagaaaaggccaagtggtggcggagaggtttgcggcccacgaggggatgaggcccatgcgggccgtcttcacgcgccagggccatatcttcaccacgggcttcacccgcatgagccagcgagagctgggcctgtgggacccgaacaacttcgaggagccagtggcactgcaggagatggacacaagcaacggggtcctattgcccttttacgatcccgactccagcatcgtctacctgtgtggcaagggcgacagcagcattcggtactttgagattaccgacgagccgcctttcgtgcactacctgaacacgttcagcagcaaagagccgcagcggggcatgggtttcatgcccaaaaggggactggatgtcagcaagtgtgagatcgcccggttctacaagctacacgaaagaaagtgtgaacctatcatcatgactgtgccccgcaagtcagacctcttccaggacgatctgtacccggatacgccaggcccggagccggccctagaagcggacgaatggctatccggccaggacgccgaacccgtgctcatttcgctgagggacggctatgtgccccccaagcaccgcgagctccgggtcacgaagcgcaacatcctggacgtgcgcccgccctccggcccccgccgcagccagtcggccagcgacgcccccttgtcgcagcacaccctggagacgctgctggaagagatcaaggccctccgcgagcgggtgcaggcccaggagcagcgcatcacggctctggagaacatgctgtgcgagctggtggacggcacggactagccccgcgcgccaggcaggcggagcggggcggggcgcacaagctcggccccgccccggcttttagtcccgaactccggaccccgccttcttgggctgggcccgggggcgggactggggagggaactccgcccctcgcgggagaccagaactcttggagcttaggggagacccacgtcgctccagcggaggctggactgcgagcctcgtctgggactcggctggagctggcctagggaggcctggggtaacctggggggctcagcaatggtgctgcacggcgaggtggtgtccccctttgtcctccgcccagggcagggaaagtgcttagtattagcgtgatgcttggggttattggagcctgagcttgacctcaaacgggtggcgatttgatgggtacccccaggctggggaaaatgacagcgcttctcctaatcagctcactggattccatcaccctgagcggtaaaccagatgggcgtcaccccagttctgcagacacatacacaacccgtttgctgcagagccggacccagtggctacacccacagcggtctgtggtagagaactctcttccttctttccaccgacaggggcgagggctgcttcctcgcggcagcccccgcgaagaaatctcgagagaactggcatgaggagttaggttcatcacaaatacacacacactgcccccaaccctctgccgttgcctctctcagaaaaacaagacgtactgaatgaaatattttactaagcgttcagtctgtgcctcctgcatgggtgggagtgaggggaacgagacccccagcctctgcaaatgctacccccaggctcctgggagacctggcgatgcactcctgggctcagggtccatcaggcagcctcttaccctagagctctctccactctgaggttcagaaggaccccaacccacaccgtaggcgttccccccaagtaaagttaggtagcaaaagccaaaaaaa

SEQ ID NO: 295190 - DNA, 1567 bp, Homo sapiens
cagctggggctgcagcggcgccgggctctagagagccgcaggatcggccagagtgcggagctggacacccgggtcccagatactacagacacccggagaggtggctccttcgccctgaagccttcctcggccccctacgcactcgggccccttccgcagaggattcgcagcgtgagcgccccgcagcccgctcaggaccagctatgagcagacgtgtggttcggcaaagcaagttccgccatgtgtttgggcaggcagcaaaggccgaccaggcctacgaggacatccgtgtgtccaaggtcacatgggacagctccttctgtgccgtcaaccccaaattcctggccattattgtggaggctggaggcgggggtgccttcatcgtcctgcctctggccaagacagggcgagtggataagaactacccactggtcactgggcacactgcccctgtgctggatattgactggtgtccacacaatgacaacgttatcgccagtgcctcagacgacaccaccatcatggtgtggcagattccagactatacccccatgcgcaacattacggaacctatcatcacacttgagggccactccaagcgtgtgggcatcctctcctggcaccctactgccaggaatgtcctgctcagtgcaggtggtgacaatgtgatcatcatctggaatgtgggcaccggggaggtgctgctgagcctggatgatatgcacccagacgtcatccacagtgtgtgctggaacagcaacggtagcctgctagccaccacctgcaaggacaagaccttgcgcatcattgaccccagaaaaggccaagtggtggcggagaggtttgcggcccacgaggggatgaggcccatgcgggccgtcttcacgcgccagggccatatcttcaccacgggcttcacccgcatgagccagcgagagctgggcctgtgggacccgaacaacttcgaggagccagtggcactgcaggagatggacacaagcaacggggtcctattgcccttttacgatcccgactccagcatcgtctacctgtgtggcaagggcgacagcagcattcggtactttgagattaccgacgagccgcctttcgtgcactacctgaacacgttcagcagcaaagagccgcgtagtcagatcgatctgactacgcggctcgatctgactacgcggctcgatctgactacgcggctcgatctgactacgcggctcgatctgactacgcggctcgatctgactacgcggctcgatctgactacgcggctcgatctgactacgcggctcgatctgactacgcggctcgatctgactactcggctcgatctgactacgcggctcgatctgactacgcggctcgatctgactacgcggctggccgacatgctggcgcacgtggaggagctggcccgtgacggggaggcgccgctggacaaggcctgcgctgaggacgacgacgaggaagacgaggaggaggaggaggaggagcccgacccgacccggagatggagcacgtctaggcagaggcctacgagagcgcgtgctgcctgctg

SEQ ID NO: 295191 - DNA, 990 bp, Homo sapiens
cagctggggctgcagcggcgccgggctctagagagccgcaggatcggccagagtgcggagctggacacccgggtcccagatactacagacacccggagaggtggctccttcgccctgaagccttcctcggccccctacgcactcgggccccttccgcagaggattcgcagcgtgagcgccccgcagcccgctcaggaccagctatgagcagacgtgtggttcggcaaagcaagttccgccatgtgtttgggcaggcagcaaaggccgaccaggcctacgaggacatccgtgtgtccaaggtcacatgggacagctccttctgtgccgtcaaccccaaattcctggccattattgtggaggctggaggcgggggtgccttcatcgtcctgcctctggccaagacagggcgagtggataagaactacccactggtcactgggcacactgcccctgtgctggatattgactggtgtccacacaatgacaacgttatcgccagtgcctcagacgacaccaccatcatggtgtggcagattccagactatacccccatgcgcaacattacggaacctatcatcacacttgagggccactccaagcgtgtgggcatcctctcctggcaccctactgccaggaatgtcctgctcagtgcaggtggtgacaatgtgatcatcatctggaatgtgggcaccggggaggtgctgctgagcctggatgatatgcacccagacgtcatccacagtgtgtgctggaacagcaacggtagcctgctagccaccacctgcaaggacaagaccttgcgcatcattgaccccagaaaaggccaagtggtggcggtctctgccctaagtaagcccccagcctgcaattctctgcccggctcctgttccctcccctcccttgcatctcagaagctcagagaagggctcctcgctttgggattgaggaggggagaagctggaaactccatcctcccaccagaacctgcat

SEQ ID NO: 295192 - DNA, 2067 bp, Homo sapiens
ctcggggactggcatcacgggagagtggccaggcgccccccacccgcagggcatgcccacctggacaggactgaaggctgctgccacctctgcagcgcctgccattctcacacccacccctctgcccagttttgctgcgtcgcgtgaaggatcctgcgctggcgcccccacctggtgatgccgagtccctgggggtggtttgctgtgactgcatgcggcgcgcagcgggtatatgtgcaggggaggaggagctatgtgcgcaggggaggaggagagatgtgcccaggggaggggcctgcaactctggtcactagaggtttggggcatagggtttgggaaggccaggaagcgtaaaggggcttctgggggtcccgaagtagcacgggagggtggggcagggctggtcacgcctcctgtgctcgggcagaacaacttcgaggagccagtggcactgcaggagatggacacaagcaacggggtcctattgcccttttacgatcccgactccagcatcgtctacctgtgtggcaagggcgacagcagcattcggtactttgagattaccgacgagccgcctttcgtgcactacctgaacacgttcagcagcaaagagccgcagcggggcatgggtttcatgcccaaaaggggactggatgtcagcaagtgtgagatcgcccggttctacaagctacacgaaagaaagtgtgaacctatcatcatgactgtgccccgcaagtcagacctcttccaggacgatctgtacccggatacgccaggcccggagccggccctagaagcggacgaatggctatccggccaggacgccgaacccgtgctcatttcgctgagggacggctatgtgccccccaagcaccgcgagctccgggtcacgaagcgcaacatcctggacgtgcgcccgccctccggcccccgccgcagccagtcggccagcgacgcccccttgtcgcagcacaccctggagacgctgctggaagagatcaaggccctccgcgagcgggtgcaggcccaggagcagcgcatcacggctctggagaacatgctgtgcgagctggtggacggcacggactagccccgcgcgccaggcaggcggagcggggcggggcgcacaagctcggccccgccccggcttttagtcccgaactccggaccccgccttcttgggctgggcccgggggcgggactggggagggaactccgcccctcgcgggagaccagaactcttggagcttaggggagacccacgtcgctccagcggaggctggactgcgagcctcgtctgggactcggctggagctggcctagggaggcctggggtaacctggggggctcagcaatggtgctgcacggcgaggtggtgtccccctttgtcctccgcccagggcagggaaagtgcttagtattagcgtgatgcttggggttattggagcctgagcttgacctcaaacgggtggcgatttgatgggtacccccaggctggggaaaatgacagcgcttctcctaatcagctcactggattccatcaccctgagcggtaaaccagatgggcgtcaccccagttctgcagacacatacacaacccgtttgctgcagagccggacccagtggctacacccacagcggtctgtggtagagaactctcttccttctttccaccgacaggggcgagggctgcttcctcgcggcagcccccgcgaagaaatctcgagagaactggcatgaggagttaggttcatcacaaatacacacacactgcccccaaccctctgccgttgcctctctcagaaaaacaagacgtactgaatgaaatattttactaagcgttcagtctgtgcctcctgcatgggtgggagtgaggggaacgagacccccagcctctgcaaatgctacccccaggctcctgggagacctggcgatgcactcctgggctcagggtccatcaggcagcctcttaccctagagctctctccactctgaggttcagaaggaccccaacccacaccgtaggcgttccccccaagtaaagttaggtagcaaaagccaaaaaaa

SEQ ID NO: 295193 - DNA, 2569 bp, Homo sapiens
actaaggaccaaaggcatttctgggcactgagatcctacctctctgcctgcagctatgagcagacgtgtggttcggcaaagcaagttccgccatgtgtttgggcaggcagcaaaggccgaccaggcctacgaggacatccgtgtgtccaaggtcacatgggacagctccttctgtgccgtcaaccccaaattcctggccattattgtggaggctggaggcgggggtgccttcatcgtcctgcctctggccaagacagggcgagtggataagaactacccactggtcactgggcacactgcccctgtgctggatattgactggtgtccacacaatgacaacgttatcgccagtgcctcagacgacaccaccatcatggtgtggcagattccagactatacccccatgcgcaacattacggaacctatcatcacacttgagggccactccaagcgtgtgggcatcctctcctggcaccctactgccaggaatgtcctgctcagtgcaggtggtgacaatgtgatcatcatctggaatgtgggcaccggggaggtgctgctgagcctggatgatatgcacccagacgtcatccacagtgtgtgctggaacagcaacggtagcctgctagccaccacctgcaaggacaagaccttgcgcatcattgaccccagaaaaggccaagtggtggcggagaggtttgcggcccacgaggggatgaggcccatgcgggccgtcttcacgcgccagggccatatcttcaccacgggcttcacccgcatgagccagcgagagctgggcctgtgggacccggtaacgcagctggaggcttgggttttgctgcgtcgcgtgaaggatcctgcgctggcgcccccacctggtgatgccgagtccctgggggtggtttgctgtgactgcatgcggcgcgcagcggaacaacttcgaggagccagtggcactgcaggagatggacacaagcaacggggtcctattgcccttttacgatcccgactccagcatcgtctacctgtgtggcaagggcgacagcagcattcggtactttgagattaccgacgagccgcctttcgtgcactacctgaacacgttcagcagcaaagagccgcagcggggcatgggtttcatgcccaaaaggggactggatgtcagcaagtgtgagatcgcccggttctacaagctacacgaaagaaagtgtgaacctatcatcatgactgtgccccgcaagtcagacctcttccaggacgatctgtacccggatacgccaggcccggagccggccctagaagcggacgaatggctatccggccaggacgccgaacccgtgctcatttcgctgagggacggctatgtgccccccaagcaccgcgagctccgggtcacgaagcgcaacatcctggacgtgcgcccgccctccggcccccgccgcagccagtcggccagcgacgcccccttgtcgcagcacaccctggagacgctgctggaagagatcaaggccctccgcgagcgggtgcaggcccaggagcagcgcatcacggctctggagaacatgctgtgcgagctggtggacggcacggactagccccgcgcgccaggcaggcggagcggggcggggcgcacaagctcggccccgccccggcttttagtcccgaactccggaccccgccttcttgggctgggcccgggggcgggactggggagggaactccgcccctcgcgggagaccagaactcttggagcttaggggagacccacgtcgctccagcggaggctggactgcgagcctcgtctgggactcggctggagctggcctagggaggcctggggtaacctggggggctcagcaatggtgctgcacggcgaggtggtgtccccctttgtcctccgcccagggcagggaaagtgcttagtattagcgtgatgcttggggttattggagcctgagcttgacctcaaacgggtggcgatttgatgggtacccccaggctggggaaaatgacagcgcttctcctaatcagctcactggattccatcaccctgagcggtaaaccagatgggcgtcaccccagttctgcagacacatacacaacccgtttgctgcagagccggacccagtggctacacccacagcggtctgtggtagagaactctcttccttctttccaccgacaggggcgagggctgcttcctcgcggcagcccccgcgaagaaatctcgagagaactggcatgaggagttaggttcatcacaaatacacacacactgcccccaaccctctgccgttgcctctctcagaaaaacaagacgtactgaatgaaatattttactaagcgttcagtctgtgcctcctgcatgggtgggagtgaggggaacgagacccccagcctctgcaaatgctacccccaggctcctgggagacctggcgatgcactcctgggctcagggtccatcaggcagcctcttaccctagagctctctccactctgaggttcagaaggaccccaacccacaccgtaggcgttccccccaagtaaagttaggtagcaaaagccaaaaaaa

SEQ ID NO: 295194 - DNA, 2110 bp, Homo sapiens
gatcggctgagagccgcgtgcctcctgctctctccaggcccggatgctctccaggtcaggggccagacgtggccccgcaggaagctgagtgcttaggccccatttgtctcttccccgcatccgctcctccaccccggacacccaagtcagcaagctggttgctcatccctccatgctcctcagggcaggcagctgggtgatgtccctccctgtctccccctccccccaggagaggtttgcggcccacgaggggatgaggcccatgcgggccgtcttcacgcgccagggccatatcttcaccacgggcttcacccgcatgagccagcgagagctgggcctgtgggacccggtaacgcagctggaggcttgggttttgctgcgtcgcgtgaaggatcctgcgctggcgcccccacctggtgatgccgagtccctgggggtggtttgctgtgactgcatgcggcgcgcagcggaacaacttcgaggagccagtggcactgcaggagatggacacaagcaacggggtcctattgcccttttacgatcccgactccagcatcgtctacctgtgtggcaagggcgacagcagcattcggtactttgagattaccgacgagccgcctttcgtgcactacctgaacacgttcagcagcaaagagccgcagcggggcatgggtttcatgcccaaaaggggactggatgtcagcaagtgtgagatcgcccggttctacaagctacacgaaagaaagtgtgaacctatcatcatgactgtgccccgcaagtcagacctcttccaggacgatctgtacccggatacgccaggcccggagccggccctagaagcggacgaatggctatccggccaggacgccgaacccgtgctcatttcgctgagggacggctatgtgccccccaagcaccgcgagctccgggtcacgaagcgcaacatcctggacgtgcgcccgccctccggcccccgccgcagccagtcggccagcgacgcccccttgtcgcagcacaccctggagacgctgctggaagagatcaaggccctccgcgagcgggtgcaggcccaggagcagcgcatcacggctctggagaacatgctgtgcgagctggtggacggcacggactagccccgcgcgccaggcaggcggagcggggcggggcgcacaagctcggccccgccccggcttttagtcccgaactccggaccccgccttcttgggctgggcccgggggcgggactggggagggaactccgcccctcgcgggagaccagaactcttggagcttaggggagacccacgtcgctccagcggaggctggactgcgagcctcgtctgggactcggctggagctggcctagggaggcctggggtaacctggggggctcagcaatggtgctgcacggcgaggtggtgtccccctttgtcctccgcccagggcagggaaagtgcttagtattagcgtgatgcttggggttattggagcctgagcttgacctcaaacgggtggcgatttgatgggtacccccaggctggggaaaatgacagcgcttctcctaatcagctcactggattccatcaccctgagcggtaaaccagatgggcgtcaccccagttctgcagacacatacacaacccgtttgctgcagagccggacccagtggctacacccacagcggtctgtggtagagaactctcttccttctttccaccgacaggggcgagggctgcttcctcgcggcagcccccgcgaagaaatctcgagagaactggcatgaggagttaggttcatcacaaatacacacacactgcccccaaccctctgccgttgcctctctcagaaaaacaagacgtactgaatgaaatattttactaagcgttcagtctgtgcctcctgcatgggtgggagtgaggggaacgagacccccagcctctgcaaatgctacccccaggctcctgggagacctggcgatgcactcctgggctcagggtccatcaggcagcctcttaccctagagctctctccactctgaggttcagaaggaccccaacccacaccgtaggcgttccccccaagtaaagttaggtagcaaaagccaaaaaaa

SEQ ID NO: 295195 - DNA, 714 bp, Homo sapiens
gggaggcgtcctccctggaccccggcgacttcctctctcggggaggagccccagccccgcgacgaggaggaagcggagctggagctgctgaggcagtttgacctggcctggcagtacgggccctgcaccgggatcacacggctgcagcgctggtgtcgggccaagcagatgggcttggagcctcccccagaggtgtggcaggtgctgaagacccaccccggagacccccgcttccagtgcagtctctggcatctctatcccctatgaggcaccacgtaagacctcctgcccttagctctcttgctcaccacccaagaacctcaggacagaagcgagagcccattgctcctgctcagctcagcccggctgcggaggaacccttggcaggcagaacctggaggtgtcagaggctcaactcctccatctaaccagcaggctcccagagtccccggaagagcctgcgcagctgaagcagagtgcttctagatggagagtggtcactggggaaaaggacctggccatcaccttccaatacctgctgcctgtctccctgacccatgatctggcaagttaggcacagtcagacatggacagttgatccatgaggaaaagatgctctcccacctaaggccaggaatctgagagcaggactggctgagctcccagggcaaggggttcactaatgcttatcaataaagaatattgagcctggaa

SEQ ID NO: 295196 - DNA, 172 bp, Homo sapiens
gcggccgcctactactactactactgctcgaattcaagcttctaacgatgtacggggacatgaggaaaagatgctctcccacctaaggccaggaatctgagagcaggactggctgagctcccagggcaaggggttcactaatgcttatcaataaagaatattgagcctggaa

SEQ ID NO: 295197 - DNA, 1258 bp, Homo sapiens
cgtggcctctggttctctgtgcccagtccagggtggcagtttgttggcttcttagggctcctctgtcctggagatcttcatgaaagtagctgactgtgaaaaccttgaattggggagtgtatggataggtgatcctgcagctgaaggagatagctgtgttggccagggaggcatgatgggcaggccggtgtgggtcactgactgtcctcctgccagtcgcagggtcccgggcagcagcagcacgccaaggaggagccagggggctgcggggagcccaggagggctgggaggcctggcagggccgccacctcacaggctggttctccatctgggggcctgcttgtctgcggcgactctttagatcttgtctgcccgccgctggcctggccccgtctgtctctctcagcagctgtctttctcgcgcccactggccggtctctcctcttccccgcagttgcctccttctctgcctgcctgggtggccgccatgggccggaagcggctcatcactgattcctacccggttgtgaagaggagggaggggcccgctgggcacagcaagggggagctggcacccgagctaggggaggagccccagccccgcgacgaggaggaagcggagctggagctgctgaggcagtttgacctggcctggcagtacgggccctgcaccgggatcacacggctgcagcgctggtgtcgggccaagcagatgggcttggagcctcccccagaggtgtggcaggtgctgaagacccaccccggagacccccgcttccagtgcagtctctggcatctctatcccctatgaggcaccacgtaagacctcctgcccttagctctcttgctcaccacccaagaacctcaggacagaagcgagagcccattgctcctgctcagctcagcccggctgcggaggaacccttggcaggcagaacctggaggtgtcagaggctcaactcctccatctaaccagcaggctcccagagtccccggaagagcctgcgcagctgaagcagagtgcttctagatggagagtggtcactggggaaaaggacctggccatcaccttccaatacctgctgcctgtctccctgacccatgatctggcaagttaggcacagtcagacatggacagttgatccatgaggaaaagatgctctcccacctaaggccaggaatctgagagcaggactggctgagctcccagggcaaggggttcactaatgcttatcaataaagaatattgagcctggaa

SEQ ID NO: 295198 - DNA, 888 bp, Homo sapiens
aaataggctaggtacgaggctgggtgtgaattggccgaggctgttttctcgcgcccactggccggtctctcctcttccccgcagttgcctccttctctgcctgcctgggtggccgccatgggccggaagcggctcatcactgattcctacccggttgtgaagaggagggaggggcccgctgggcacagcaagggggagctggcacccgagctaggggaggagccccagccccgcgacgaggaggaagcggagctggagctgctgaggcagtttgacctggcctggcagtacgggccctgcaccgggatcacacggctgcagcgctggtgtcgggccaagcagatgggcttggagcctcccccagaggtgtggcaggtgctgaagacccaccccggagacccccgcttccagtgcagtctctggcatctctatcccctatgaggcaccacgtaagacctcctgcccttagctctcttgctcaccacccaagaacctcaggacagaagcgagagcccattgctcctgctcagctcagcccggctgcggaggaacccttggcaggcagaacctggaggtgtcagaggctcaactcctccatctaaccagcaggctcccagagtccccggaagagcctgcgcagctgaagcagagtgcttctagatggagagtggtcactggggaaaaggacctggccatcaccttccaatacctgctgcctgtctccctgacccatgatctggcaagttaggcacagtcagacatggacagttgatccatgaggaaaagatgctctcccacctaaggccaggaatctgagagcaggactggctgagctcccagggcaaggggttcactaatgcttatcaataaagaatattgagcctggaa

SEQ ID NO: 295199 - DNA, 719 bp, Homo sapiens
cccacgcgtccggacccacgcgtccggagctggcacccgagctaggggaggagccccagccccgcgacgaggaggaagcggagctggagctgctgaggcagtttgacctggcctggcagtacgggccctgcaccgggatcacacggctgcagcgctggtgtcgggccaagcagatgggcttggagcctcccccagaggtgtggcaggtgctgaagacccaccccggagacccccgcttccagtgcagtctctggcatctctatcccctatgaggcaccacgtaagacctcctgcccttagctctcttgctcaccacccaagaacctcaggacagaagcgagagcccattgctcctgctcagctcagcccggctgcggaggaacccttggcaggcagaacctggaggtgtcagaggctcaactcctccatctaaccagcaggctcccagagtccccggaagagcctgcgcagctgaagcagagtgcttctagatggagagtggtcactggggaaaaggacctggccatcaccttccaatacctgctgcctgtctccctgacccatgatctggcaagttaggcacagtcagacatggacagttgatccatgaggaaaagatgctctcccacctaaggccaggaatctgagagcaggactggctgagctcccagggcaaggggttcactaatgcttatcaataaagaatattgagcctggaa

SEQ ID NO: 295200 - DNA, 377 bp, Homo sapiens
cggagacccccgcttccagtgcagtctctggcatctctatcccctatgaggcagaacctggaggtgtcagaggctcaactcctccatctaaccagcaggctcccagagtccccggaagagcctgcgcagctgaagcagagtgcttctagatggagagtggtcactggggaaaaggacctggccatcaccttccaatacctgctgcctgtctccctgacccatgatctggcaagttaggcacagtcagacatggacagttgatccatgaggaaaagatgctctcccacctaaggccaggaatctgagagcaggactggctgagctcccagggcaaggggttcactaatgcttatcaataaagaatattgagcctggaa

SEQ ID NO: 295201 - DNA, 560 bp, Homo sapiens
gggaggcgtcctccctggaccccggcgacttcctctctcgatcttgtctgcccgccgctggcctggccccgtctgtctctctcagcagctgtctttctcctgcccttagctctcttgctcaccacccaagaacctcaggacagaagcgagagcccattgctcctgctcagctcagcccggctgcggaggaacccttggcaggcagaacctggaggtgtcagaggctcaactcctccatctaaccagcaggctcccagagtccccggaagagcctgcgcagctgaagcagagtgcttctagatggagagtggtcactggggaaaaggacctggccatcaccttccaatacctgctgcctgtctccctgacccatgatctggcaagttaggcacagtcagacatggacagttgatccatgaggaaaagatgctctcccacctaaggccaggaatctgagagcaggactggctgagctcccagggcaaggggttcactaatgcttatcaataaagaatattgagcctggaataaaaaaaacaacaagacaacaaaaaaaaaca

SEQ ID NO: 295202 - DNA, 937 bp, Homo sapiens
gccattacggctaggtaccgaggcctgggtgtggttgttgatcttgtctgcccgccgctggcctggccccgtctgtctctctcagcagctgtctttctcgcgcccactggccggtctctcctcttccccgcagttgcctccttctctgcctgcctgggtggccgccatgggccggaagcggctcatcactgattcctacccggttgtgaagaggagggaggggcccgctgggcacagcaagggggagctggcacccgagctaggggaggagccccagccccgcgacgaggaggaagcggagctggagctgctgaggcagtttgacctggcctggcagtacgggccctgcaccgggatcacacggctgcagcgctggtgtcgggccaagcagatgggcttggagcctcccccagaggtgtggcaggtgctgaagacccaccccggagacccccgcttccagtgcagtctctggcatctctatcccctatgaggcaccacgtaagacctcctgcccttagctctcttgctcaccacccaagaacctcaggacagaagcgagagcccattgctcctgctcagctcagcccggctgcggaggaacccttggcaggcagaacctggaggtgtcagaggctcaactcctccatctaaccagcaggctcccagagtccccggaagagcctgcgcagctgaagcagagtgcttctagatggagagtggtcactggggaaaaggacctggccatcaccttccaatacctgctgcctgtctccctgacccatgatctggcaagttaggcacagtcagacatggacagttgatccatgaggaaaagatgctctcccacctaaggccaggaatctgagagcaggactggctgagctcccagggcaaggggttcactaatgcttatcaataaagaatattgagcctggaa

SEQ ID NO: 295203 - DNA, 937 bp, Homo sapiens
gggaggcgtcctccctggaccccggcgacttcctctctcgatcttgtctgcccgccgctggcctggccccgtctgtctctctcagcagctgtctttctcgcgcccactggccggtctctcctcttccccgcagttgcctccttctctgcctgcctgggtggccgccatgggccggaagcggctcatcactgattcctacccggttgtgaagaggagggaggggcccgctgggcacagcaagggggagctggcacccgagctaggggaggagccccagccccgcgacgaggaggaagcggagctggagctgctgaggcagtttgacctggcctggcagtacgggccctgcaccgggatcacacggctgcagcgctggtgtcgggccaagcagatgggcttggagcctcccccagaggtgtggcaggtgctgaagacccaccccggagacccccgcttccagtgcagtctctggcatctctatcccctatgaggcaccacgtaagacctcctgcccttagctctcttgctcaccacccaagaacctcaggacagaagcgagagcccattgctcctgctcagctcagcccggctgcggaggaacccttggcaggcagaacctggaggtgtcagaggctcaactcctccatctaaccagcaggctcccagagtccccggaagagcctgcgcagctgaagcagagtgcttctagatggagagtggtcactggggaaaaggacctggccatcaccttccaatacctgctgcctgtctccctgacccatgatctggcaagttaggcacagtcagacatggacagttgatccatgaggaaaagatgctctcccacctaaggccaggaatctgagagcaggactggctgagctcccagggcaaggggttcactaatgcttatcaataaagaatattgagcctggaa

SEQ ID NO: 295204 - DNA, 1190 bp, Homo sapiens
cgtggcctctggttctctgtgcccagtccagggtggcagtttgttggcttcttagggctcctctgtcctggagatcttcatgaaagtagctgactgtgaaaaccttgaattggggagtgtatggataggtgatcctgcagctgaaggagatagctgtgttggccagggaggcatgatgggcaggccggtgtgggtcactgactgtcctcctgccagtcgcagggtcccgggcagcagcagcacgccaaggaggagccagggggctgcggggagcccaggagggctgggaggcctggcagggccgccacctcacaggctggttctccatctgggggcctgcttgtctgcggcgactctttagatcttgtctgcccgccgctggcctggccccgtctgtctctctcagcagctgtctttctcgcgcccactggccggtctctcctcttccccgcagttgcctccttctctgcctgcctgggtggccgccatgggccggaagcggctcatcactgattcgggaggagccccagccccgcgacgaggaggaagcggagctggagctgctgaggcagtttgacctggcctggcagtacgggccctgcaccgggatcacacggctgcagcgctggtgtcgggccaagcagatgggcttggagcctcccccagaggtgtggcaggtgctgaagacccaccccggagacccccgcttccagtgcagtctctggcatctctatcccctatgaggcaccacgtaagacctcctgcccttagctctcttgctcaccacccaagaacctcaggacagaagcgagagcccattgctcctgctcagctcagcccggctgcggaggaacccttggcaggcagaacctggaggtgtcagaggctcaactcctccatctaaccagcaggctcccagagtccccggaagagcctgcgcagctgaagcagagtgcttctagatggagagtggtcactggggaaaaggacctggccatcaccttccaatacctgctgcctgtctccctgacccatgatctggcaagttaggcacagtcagacatggacagttgatccatgaggaaaagatgctctcccacctaaggccaggaatctgagagcaggactggctgagctcccagggcaaggggttcactaatgcttatcaataaagaatattgagcctggaa

SEQ ID NO: 295205 - DNA, 1482 bp, Homo sapiens
cgtggcctctggttctctgtgcccagtccagggtggcagtttgttggcttcttagggctcctctgtcctggagatcttcatgaaagtagctgactgtgaaaaccttgaattggggagtgtatggataggtgatcctgcagctgaaggagatagctgtgttggccagggaggcatgatgggcaggccggtgtgggtcactgactgtcctcctgccagtcgcagggtcccgggcagcagcagcacgccaaggaggagccagggggctgcggggagcccaggagggctgggaggcctggcagggccgccacctcacaggctggttctccatctgggggcctgcttgtctgcggcgactctttagatcttgtctgcccgccgctggcctggccccgtctgtctctctcagcagctgtctttctcgcgcccactggccggtctctcctcttccccgcagttgcctccttctctgcctgcctgggtggccgccatgggccggaagcggctcatcactgattcctacccggttgtgaagaggagggaggggcccgctgggcacagcaagggggagctggcacccgagctagtctctgaggtgtgagggaggcaggaggagtggacacggaggggcctagaggaggcccctagaggggcggaggggccgatggaaagggaaaggtggcctgtcctcccctcccgacaccaggtctagctgcggggtggcagaggcaaagcggtggtgaggaaggctgggaggtgaggggcaggagactgaagccaacctcgtactgaagagcagctgtcattgcaggggaggagccccagccccgcgacgaggaggaagcggagctggagctgctgaggcagtttgacctggcctggcagtacgggccctgcaccgggatcacacggctgcagcgctggtgtcgggccaagcagatgggcttggagcctcccccagaggtgtggcaggtgctgaagacccaccccggagacccccgcttccagtgcagtctctggcatctctatcccctatgaggcaccacgtaagacctcctgcccttagctctcttgctcaccacccaagaacctcaggacagaagcgagagcccattgctcctgctcagctcagcccggctgcggaggaacccttggcaggcagaacctggaggtgtcagaggctcaactcctccatctaaccagcaggctcccagagtccccggaagagcctgcgcagctgaagcagagtgcttctagatggagagtggtcactggggaaaaggacctggccatcaccttccaatacctgctgcctgtctccctgacccatgatctggcaagttaggcacagtcagacatggacagttgatccatgaggaaaagatgctctcccacctaaggccaggaatctgagagcaggactggctgagctcccagggcaaggggttcactaatgcttatcaataaagaatattgagcctggaa

SEQ ID NO: 295206 - DNA, 1377 bp, Homo sapiens
cgtggcctctggttctctgtgcccagtccagggtggcagtttgttggcttcttagggctcctctgtcctggagatcttcatgaaagtagctgactgtgaaaaccttgaattggggagtgtatggataggtgatcctgcagctgaaggagatagctgtgttggccagggaggcatgatgggcaggccggtgtgggtcactgactgtcctcctgccagtcgcagggtcccgggcagcagcagcacgccaaggaggagccagggggctgcggggagcccaggagggctgggaggcctggcagggccgccacctcacaggctggttctccatctgggggcctgcttgtctgcggcgactctttagatcttgtctgcccgccgctggcctggccccgtctgtctctctcagcagctgtctttctcgcgcccactggccggtctctcctcttccccgcagttgcctccttctctgcctgcctgggtggccgccatgggccggaagcggctcatcactgattcctacccggttgtgaagaggagggaggggcccgctgggcacagcaagggggagctggcacccgagctagtctctgaggtgtgagggaggcaggaggagtggacacggaggggcctagaggaggcccctagaggggcggaggggccgatggaaagggaaaggtggcctgtcctcccctcccgacaccaggggaggagccccagccccgcgacgaggaggaagcggagctggagctgctgaggcagtttgacctggcctggcagtacgggccctgcaccgggatcacacggctgcagcgctggtgtcgggccaagcagatgggcttggagcctcccccagaggtgtggcaggtgctgaagacccaccccggagacccccgcttccagtgcagtctctggcatctctatcccctatgaggcaccacgtaagacctcctgcccttagctctcttgctcaccacccaagaacctcaggacagaagcgagagcccattgctcctgctcagctcagcccggctgcggaggaacccttggcaggcagaacctggaggtgtcagaggctcaactcctccatctaaccagcaggctcccagagtccccggaagagcctgcgcagctgaagcagagtgcttctagatggagagtggtcactggggaaaaggacctggccatcaccttccaatacctgctgcctgtctccctgacccatgatctggcaagttaggcacagtcagacatggacagttgatccatgaggaaaagatgctctcccacctaaggccaggaatctgagagcaggactggctgagctcccagggcaaggggttcactaatgcttatcaataaagaatattgagcctggaa

SEQ ID NO: 295207 - DNA, 737 bp, Homo sapiens
agcctccgggagaggagccgcacccggccggcccggccccagccccatggacctccgagctaggggaggagccccagccccgcgacgaggaggaagcggagctggagctgctgaggcagtttgacctggcctggcagtacgggccctgcaccgggatcacacggctgcagcgctggtgtcgggccaagcagatgggcttggagcctcccccagaggtgtggcaggtgctgaagacccaccccggagacccccgcttccagtgcagtctctggcatctctatcccctatgaggcaccacgtaagacctcctgcccttagctctcttgctcaccacccaagaacctcaggacagaagcgagagcccattgctcctgctcagctcagcccggctgcggaggaacccttggcaggcagaacctggaggtgtcagaggctcaactcctccatctaaccagcaggctcccagagtccccggaagagcctgcgcagctgaagcagagtgcttctagatggagagtggtcactggggaaaaggacctggccatcaccttccaatacctgctgcctgtctccctgacccatgatctggcaagttaggcacagtcagacatggacagttgatccatgaggaaaagatgctctcccacctaaggccaggaatctgagagcaggactggctgagctcccagggcaaggggttcactaatgcttatcaataaagaatattgagcctggaa

SEQ ID NO: 295208 - DNA, 1667 bp, Homo sapiens
cgtggcctctggttctctgtgcccagtccagggtggcagtttgttggcttcttagggctcctctgtcctggagatcttcatgaaagtagctgactgtgaaaaccttgaattggggagtgtatggataggtgatcctgcagctgaaggagatagctgtgttggccagggaggcatgatgggcaggccggtgtgggtcactgactgtcctcctgccagtcgcagggtcccgggcagcagcagcacgccaaggaggagccagggggctgcggggagcccaggagggctgggaggcctggcagggccgccacctcacaggctggttctccatctgggggcctgcttgtctgcggcgactctttagatcttgtctgcccgccgctggcctggccccgtctgtctctctcagcagctgtctttctcgcgcccactggccggtctctcctcttccccgcagttgcctccttctctgcctgcctgggtggccgccatgggccggaagcggctcatcactgattcctacccggttgtgaagaggagggaggggcccgctgggcacagcaagggggagctggcacccgagctagtctctgaggtgtgagggaggcaggaggagtggacacggaggggcctagaggaggcccctagaggggcggaggggccgatggaaagggaaaggtggcctgtcctcccctcccgacaccaggtctagctgcggggtggcagaggcaaagcggtggtgaggaaggctgggaggtgaggggcaggagactgaagccaacctcgtactgaagagcagctgtcattgcaggggaggagccccagccccgcgacgaggaggaagcggagctggagctgctgaggcagtttgacctggcctggcagtacgggccctgcaccggtgagaacccacccagccccacggaggcgcctctcccagccagtcacccacacgtctctgaagtcacccaagcgcttgcgtgactctgaccctcaggaactgtctccccccaacacacacattctccagctcagactctaccccaccccccacaagtctccagagtcttcttcccaccctggcagggatcacacggctgcagcgctggtgtcgggccaagcagatgggcttggagcctcccccagaggtgtggcaggtgctgaagacccaccccggagacccccgcttccagtgcagtctctggcatctctatcccctatgaggcaccacgtaagacctcctgcccttagctctcttgctcaccacccaagaacctcaggacagaagcgagagcccattgctcctgctcagctcagcccggctgcggaggaacccttggcaggcagaacctggaggtgtcagaggctcaactcctccatctaaccagcaggctcccagagtccccggaagagcctgcgcagctgaagcagagtgcttctagatggagagtggtcactggggaaaaggacctggccatcaccttccaatacctgctgcctgtctccctgacccatgatctggcaagttaggcacagtcagacatggacagttgatccatgaggaaaagatgctctcccacctaaggccaggaatctgagagcaggactggctgagctcccagggcaaggggttcactaatgcttatcaataaagaatattgagcctggaa

SEQ ID NO: 295209 - DNA, 1443 bp, Homo sapiens
cgtggcctctggttctctgtgcccagtccagggtggcagtttgttggcttcttagggctcctctgtcctggagatcttcatgaaagtagctgactgtgaaaaccttgaattggggagtgtatggataggtgatcctgcagctgaaggagatagctgtgttggccagggaggcatgatgggcaggccggtgtgggtcactgactgtcctcctgccagtcgcagggtcccgggcagcagcagcacgccaaggaggagccagggggctgcggggagcccaggagggctgggaggcctggcagggccgccacctcacaggctggttctccatctgggggcctgcttgtctgcggcgactctttagatcttgtctgcccgccgctggcctggccccgtctgtctctctcagcagctgtctttctcgcgcccactggccggtctctcctcttccccgcagttgcctccttctctgcctgcctgggtggccgccatgggccggaagcggctcatcactgattcctacccggttgtgaagaggagggaggggcccgctgggcacagcaagggggagctggcacccgagctaggggaggagccccagccccgcgacgaggaggaagcggagctggagctgctgaggcagtttgacctggcctggcagtacgggccctgcaccggtgagaacccacccagccccacggaggcgcctctcccagccagtcacccacacgtctctgaagtcacccaagcgcttgcgtgactctgaccctcaggaactgtctccccccaacacacacattctccagctcagactctaccccaccccccacaagtctccagagtcttcttcccaccctggcagggatcacacggctgcagcgctggtgtcgggccaagcagatgggcttggagcctcccccagaggtgtggcaggtgctgaagacccaccccggagacccccgcttccagtgcagtctctggcatctctatcccctatgaggcaccacgtaagacctcctgcccttagctctcttgctcaccacccaagaacctcaggacagaagcgagagcccattgctcctgctcagctcagcccggctgcggaggaacccttggcaggcagaacctggaggtgtcagaggctcaactcctccatctaaccagcaggctcccagagtccccggaagagcctgcgcagctgaagcagagtgcttctagatggagagtggtcactggggaaaaggacctggccatcaccttccaatacctgctgcctgtctccctgacccatgatctggcaagttaggcacagtcagacatggacagttgatccatgaggaaaagatgctctcccacctaaggccaggaatctgagagcaggactggctgagctcccagggcaaggggttcactaatgcttatcaataaagaatattgagcctggaa

SEQ ID NO: 295210 - DNA, 1100 bp, Homo sapiens
cgtggcctctggttctctgtgcccagtccagggtggcagtttgttggcttcttagggctcctctgtcctggagatcttcatgaaagtagctgactgtgaaaaccttgaattggggagtgtatggataggtgatcctgcagctgaaggagatagctgtgttggccagggaggcatgatgggcaggccggtgtgggtcactgactgtcctcctgccagtcgcagggtcccgggcagcagcagcacgccaaggaggagccagggggctgcggggagcccaggagggctgggaggcctggcagggccgccacctcacaggctggttctccatctgggggcctgcttgtctgcggcgactctttagatcttgtctgcccgccgctggcctggccccgtctgtctctctcagcagctgtctttctcgcgcccactggccggtctctcctcttccccgcagttgcctccttctctgcctgcctgggtggccgccatgggccggaagcggctcatcactgattcggatcacacggctgcagcgctggtgtcgggccaagcagatgggcttggagcctcccccagaggtgtggcaggtgctgaagacccaccccggagacccccgcttccagtgcagtctctggcatctctatcccctatgaggcaccacgtaagacctcctgcccttagctctcttgctcaccacccaagaacctcaggacagaagcgagagcccattgctcctgctcagctcagcccggctgcggaggaacccttggcaggcagaacctggaggtgtcagaggctcaactcctccatctaaccagcaggctcccagagtccccggaagagcctgcgcagctgaagcagagtgcttctagatggagagtggtcactggggaaaaggacctggccatcaccttccaatacctgctgcctgtctccctgacccatgatctggcaagttaggcacagtcagacatggacagttgatccatgaggaaaagatgctctcccacctaaggccaggaatctgagagcaggactggctgagctcccagggcaaggggttcactaatgcttatcaataaagaatattgagcctggaa

SEQ ID NO: 295211 - DNA, 1932 bp, Homo sapiens
cgtggcctctggttctctgtgcccagtccagggtggcagtttgttggcttcttagggctcctctgtcctggagatcttcatgaaagtagctgactgtgaaaaccttgaattggggagtgtatggataggtgatcctgcagctgaaggagatagctgtgttggccagggaggcatgatgggcaggccggtgtgggtcactgactgtcctcctgccagtcgcagggtcccgggcagcagcagcacgccaaggaggagccagggggctgcggggagcccaggagggctgggaggcctggcagggccgccacctcacaggctggttctccatctgggggcctgcttgtctgcggcgactctttagatcttgtctgcccgccgctggcctggccccgtctgtctctctcagcagctgtctttctcgcgcccactggccggtctctcctcttccccgcagttgcctccttctctgcctgcctgggtggccgccatgggccggaagcggctcatcactgattcctacccggttgtgaagaggagggaggggcccgctgggcacagcaagggggagctggcacccgagctaggggaggagccccagccccgcgacgaggaggaagcggagctggagctgctgaggcagtttgacctggcctggcagtacgggccctgcaccgggatcacacggctgcagcgctggtgtcgggccaagcagatgggcttggagcctcccccagaggtgtggcaggtgctgaagacccaccccggagacccccgcttccagtgcagaggtcagagacaggccgggagggctttcaggggagccagggccttctccaggcactgtcaccctgctgtcctgacctgagggagaaatggatggagggttggaaggccttgctgaacaggcaagaagattctatgaggtgcctggctcaggaggacacgccactataataattctttttttttgagacagagtcttgctctgttgcccaggctggagtgcagtggcgcgatctcggctcactgcaaactccgcctctcgggttcacgccattctcctgtctcagcctcccaagtagctgggactacaggcgcccgccaacacgcccggctaattttttctatttttagtagagacagggtttcaccgtgttagccaggatggtcttgatctcctgacctcgtgatcccacccacctcagcctcccaaagtgctgggattacaggcgtgagccaccacacccggccaataattcttacctctacaagctagtggggggcaaaggtacacccaggacccaaggaactatctatttagaactgaggggtttcccaaggactatgggcatggccaagaataagctggtgaaatcagatccagggactcaacaactgattctctgtttctctctctctctctctggggtatccctccctcccaccccatcttccacagttctctggcatctctatcccctatgaggcaccacgtaagacctcctgcccttagctctcttgctcaccacccaagaacctcaggacagaagcgagagcccattgctcctgctcagctcagcccggctgcggaggaacccttggcaggcagaacctggaggtgtcagaggctcaactcctccatctaaccagcaggctcccagagtccccggaagagcctgcgcagctgaagcagagtgcttctagatggagagtggtcactggggaaaaggacctggccatcaccttccaatacctgctgcctgtctccctgacccatgatctggcaagttaggcacagtcagacatggacagttgatccatgaggaaaagatgctctcccacctaaggccaggaatctgagagcaggactggctgagctcccagggcaaggggttcactaatgcttatcaataaagaatattgagcctggaa

SEQ ID NO: 295212 - DNA, 1835 bp, Homo sapiens
gggaggcgtcctccctggaccccggcgacttcctctctcgatcttgtctgcccgccgctggcctggccccgtctgtctctctcagcagctgtctttctcgcgcccactggccggtctctcctcttccccgcagttgcctccttctctgcctgcctgggtggccgccatgggccggaagcggctcatcactgattcctacccggttgtgaagaggagggaggggcccgctgggcacagcaagggggagctggcacccgagctagtctctgaggtgtgagggaggcaggaggagtggacacggaggggcctagaggaggcccctagaggggcggaggggccgatggaaagggaaaggtggcctgtcctcccctcccgacaccaggtctagctgcggggtggcagaggcaaagcggtggtgaggaaggctgggaggtgaggggcaggagactgaagccaacctcgtactgaagagcagctgtcattgcaggggaggagccccagccccgcgacgaggaggaagcggagctggagctgctgaggcagtttgacctggcctggcagtacgggccctgcaccgggatcacacggctgcagcgctggtgtcgggccaagcagatgggcttggagcctcccccagaggtgtggcaggtgctgaagacccaccccggagacccccgcttccagtgcagaggtcagagacaggccgggagggctttcaggggagccagggccttctccaggcactgtcaccctgctgtcctgacctgagggagaaatggatggagggttggaaggccttgctgaacaggcaagaagattctatgaggtgcctggctcaggaggacacgccactataataattctttttttttgagacagagtcttgctctgttgcccaggctggagtgcagtggcgcgatctcggctcactgcaaactccgcctctcgggttcacgccattctcctgtctcagcctcccaagtagctgggactacaggcgcccgccaacacgcccggctaattttttctatttttagtagagacagggtttcaccgtgttagccaggatggtcttgatctcctgacctcgtgatcccacccacctcagcctcccaaagtgctgggattacaggcgtgagccaccacacccggccaataattcttacctctacaagctagtggggggcaaaggtacacccaggacccaaggaactatctatttagaactgaggggtttcccaaggactatgggcatggccaagaataagctggtgaaatcagatccagggactcaacaactgattctctgtttctctctctctctctctggggtatccctccctcccaccccatcttccacagttctctggcatctctatcccctatgaggcaccacgtaagacctcctgcccttagctctcttgctcaccacccaagaacctcaggacagaagcgagagcccattgctcctgctcagctcagcccggctgcggaggaacccttggcaggcagaacctggaggtgtcagaggctcaactcctccatctaaccagcaggctcccagagtccccggaagagcctgcgcagctgaagcagagtgcttctagatggagagtggtcactggggaaaaggacctggccatcaccttccaatacctgctgcctgtctccctgacccatgatctggcaagttaggcacagtcagacatggacagttgatccatgaggaaaagatgctctcccacctaaggccaggaatctgagagcaggactggctgagctcccagggcaaggggttcactaatgcttatcaataaagaatattgagcctggaa

SEQ ID NO: 295213 - DNA, 1444 bp, Homo sapiens
gggaggcgtcctccctggaccccggcgacttcctctctcgatcttgtctgcccgccgctggcctggccccgtctgtctctctcagcagctgtctttctcgcgcccactggccggtctctcctcttccccgcagttgcctccttctctgcctgcctgggtggccgccatgggccggaagcggctcatcactgattcctacccggttgtgaagaggagggaggggcccgctgggcacagcaagggggagctggcacccgagctagtctctgaggtgtgagggaggcaggaggagtggacacggaggggcctagaggaggcccctagaggggcggaggggccgatggaaagggaaaggtggcctgtcctcccctcccgacaccaggtctagctgcggggtggcagaggcaaagcggtggtgaggaaggctgggaggtgaggggcaggagactgaagccaacctcgtactgaagagcagctgtcattgcaggggaggagccccagccccgcgacgaggaggaagcggagctggagctgctgaggcagtttgacctggcctggcagtacgggccctgcaccgggatcacacggctgcagcgctggtgtcgggccaagcagatgggcttggagcctcccccagaggtgtggcaggtgctgaagacccaccccggagacccccgcttccagtgcagaggtcagagacaggccgggagggctttcaggggagccagggccttctccaggcactgtcaccctgctgtcctgacctgagggagaaatggatggagggttggaaggccttgctgaacaggcaagaagattctatgaggtgcctggctcaggaggacacgccactataataattcttacctctacaagctagtggggggcaaaggtacacccaggacccaaggaactatctatttagaactgaggggtttcccaaggactatgggcatggccaagaataagctgtctctggcatctctatcccctatgaggcaccacgtaagacctcctgcccttagctctcttgctcaccacccaagaacctcaggacagaagcgagagcccattgctcctgctcagctcagcccggctgcggaggaacccttggcaggcagaacctggaggtgtcagaggctcaactcctccatctaaccagcaggctcccagagtccccggaagagcctgcgcagctgaagcagagtgcttctagatggagagtggtcactggggaaaaggacctggccatcaccttccaatacctgctgcctgtctccctgacccatgatctggcaagttaggcacagtcagacatggacagttgatccatgaggaaaagatgctctcccacctaaggccaggaatctgagagcaggactggctgagctcccagggcaaggggttcactaatgcttatcaataaagaatattgagcctggaa

SEQ ID NO: 295214 - DNA, 2117 bp, Homo sapiens
cgtggcctctggttctctgtgcccagtccagggtggcagtttgttggcttcttagggctcctctgtcctggagatcttcatgaaagtagctgactgtgaaaaccttgaattggggagtgtatggataggtgatcctgcagctgaaggagatagctgtgttggccagggaggcatgatgggcaggccggtgtgggtcactgactgtcctcctgccagtcgcagggtcccgggcagcagcagcacgccaaggaggagccagggggctgcggggagcccaggagggctgggaggcctggcagggccgccacctcacaggctggttctccatctgggggcctgcttgtctgcggcgactctttagatcttgtctgcccgccgctggcctggccccgtctgtctctctcagcagctgtctttctcgcgcccactggccggtctctcctcttccccgcagttgcctccttctctgcctgcctgggtggccgccatgggccggaagcggctcatcactgattcctacccggttgtgaagaggagggaggggcccgctgggcacagcaagggggagctggcacccgagctaggggaggagccccagccccgcgacgaggaggaagcggagctggagctgctgaggcagtttgacctggcctggcagtacgggccctgcaccggtgagaacccacccagccccacggaggcgcctctcccagccagtcacccacacgtctctgaagtcacccaagcgcttgcgtgactctgaccctcaggaactgtctccccccaacacacacattctccagctcagactctaccccaccccccacaagtctccagagtcttcttcccaccctggcagggatcacacggctgcagcgctggtgtcgggccaagcagatgggcttggagcctcccccagaggtgtggcaggtgctgaagacccaccccggagacccccgcttccagtgcagaggtcagagacaggccgggagggctttcaggggagccagggccttctccaggcactgtcaccctgctgtcctgacctgagggagaaatggatggagggttggaaggccttgctgaacaggcaagaagattctatgaggtgcctggctcaggaggacacgccactataataattctttttttttgagacagagtcttgctctgttgcccaggctggagtgcagtggcgcgatctcggctcactgcaaactccgcctctcgggttcacgccattctcctgtctcagcctcccaagtagctgggactacaggcgcccgccaacacgcccggctaattttttctatttttagtagagacagggtttcaccgtgttagccaggatggtcttgatctcctgacctcgtgatcccacccacctcagcctcccaaagtgctgggattacaggcgtgagccaccacacccggccaataattcttacctctacaagctagtggggggcaaaggtacacccaggacccaaggaactatctatttagaactgaggggtttcccaaggactatgggcatggccaagaataagctggtgaaatcagatccagggactcaacaactgattctctgtttctctctctctctctctggggtatccctccctcccaccccatcttccacagttctctggcatctctatcccctatgaggcaccacgtaagacctcctgcccttagctctcttgctcaccacccaagaacctcaggacagaagcgagagcccattgctcctgctcagctcagcccggctgcggaggaacccttggcaggcagaacctggaggtgtcagaggctcaactcctccatctaaccagcaggctcccagagtccccggaagagcctgcgcagctgaagcagagtgcttctagatggagagtggtcactggggaaaaggacctggccatcaccttccaatacctgctgcctgtctccctgacccatgatctggcaagttaggcacagtcagacatggacagttgatccatgaggaaaagatgctctcccacctaaggccaggaatctgagagcaggactggctgagctcccagggcaaggggttcactaatgcttatcaataaagaatattgagcctggaa

SEQ ID NO: 295215 - DNA, 1146 bp, Homo sapiens
cgtggcctctggttctctgtgcccagtccagggtggcagtttgttggcttcttagggctcctctgtcctggagatcttcatgaaagtagctgactgtgaaaaccttgaattggggagtgtatggataggtgatcctgcagctgaaggagatagctgtgttggccagggaggcatgatgggcaggccggtgtgggtcactgactgtcctcctgccagtcgcagggtcccgggcagcagcagcacgccaaggaggagccagggggctgcggggagcccaggagggctgggaggcctggcagggccgccacctcacaggctggttctccatctgggggcctgcttgtctgcggcgactctttagatcttgtctgcccgccgctggcctggccccgtctgtctctctcagcagctgtctttctcgcgcccactggccggtctctcctcttccccgcagttgcctccttctctgcctgcctgggtggccgccatgggccggaagcggctcatcactgattcctacccggttgtgaagaggagggaggggcccgctgggcacagcaagggggagctggcacccgagctaggggaggagccccagccccgcgacgaggaggaagcggagctggagctgctgaggcagtttgacctggcctggcagtacgggccctgcaccgtctctggcatctctatcccctatgaggcaccacgtaagacctcctgcccttagctctcttgctcaccacccaagaacctcaggacagaagcgagagcccattgctcctgctcagctcagcccggctgcggaggaacccttggcaggcagaacctggaggtgtcagaggctcaactcctccatctaaccagcaggctcccagagtccccggaagagcctgcgcagctgaagcagagtgcttctagatggagagtggtcactggggaaaaggacctggccatcaccttccaatacctgctgcctgtctccctgacccatgatctggcaagttaggcacagtcagacatggacagttgatccatgaggaaaagatgctctcccacctaaggccaggaatctgagagcaggactggctgagctcccagggcaaggggttcactaatgcttatcaataaagaatattgagcctggaa

SEQ ID NO: 295216 - DNA, 1204 bp, Homo sapiens
cgtggcctctggttctctgtgcccagtccagggtggcagtttgttggcttcttagggctcctctgtcctggagatcttcatgaaagtagctgactgtgaaaaccttgaattggggagtgtatggataggtgatcctgcagctgaaggagatagctgtgttggccagggaggcatgatgggcaggccggtgtgggtcactgactgtcctcctgccagtcgcagggtcccgggcagcagcagcacgccaaggaggagccagggggctgcggggagcccaggagggctgggaggcctggcagggccgccacctcacaggctggttctccatctgggggcctgcttgtctgcggcgactctttagatcttgtctgcccgccgctggcctggccccgtctgtctctctcagcagctgtctttctcgcgcccactggccggtctctcctcttccccgcagttgcctccttctctgcctgcctgggtggccgccatgggccggaagcggctcatcactgattcctacccggttgtgaagaggagggaggggcccgctgggcacagcaagggggagctggcacccgagctaggggaggagccccagccccgcgacgaggaggaagcggagctggagctgctgaggcagtttgacctggcctggcagtacgggccctgcaccgggatcacacggctgcagcgctggtgtcgggccaagcagatgggcttggagcctcccccagaggtgtggcaggtgctgaagacccaccccggagacccccgcttccagtgcagtctctggcatctctatcccctatgaggcaccacgtaagacctcctgcccttagctctcttgctcaccacccaagaacctcaggacagaagcgagagcccattgctcctgctcagctcagcccggctgcggaggaacccttggcaggcagaacctggaggtgtcagaggctcaactcctccatctaaccagcaggctcccagagtccccggaagagcctgcgcagctgaagcagagtgcttctagatggagagtggtcactggggaaaaggacctggccatcaccttccaatacctgctgcctgtctccctgacccatgatctggcaagttaggcacagtcagacatggacagttgatccatgaggcccagggcaaggggttcactaatgcttatcaataaagaatattgagcctggaa

SEQ ID NO: 295217 - DNA, 1203 bp, Homo sapiens
cgtggcctctggttctctgtgcccagtccagggtggcagtttgttggcttcttagggctcctctgtcctggagatcttcatgaaagtagctgactgtgaaaaccttgaattggggagtgtatggataggtgatcctgcagctgaaggagatagctgtgttggccagggaggcatgatgggcaggccggtgtgggtcactgactgtcctcctgccagtcgcagggtcccgggcagcagcagcacgccaaggaggagccagggggctgcggggagcccaggagggctgggaggcctggcagggccgccacctcacaggctggttctccatctgggggcctgcttgtctgcggcgactctttagatcttgtctgcccgccgctggcctggccccgtctgtctctctcagcagctgtctttctcgcgcccactggccggtctctcctcttccccgcagttgcctccttctctgcctgcctgggtggccgccatgggccggaagcggctcatcactgattcctacccggttgtgaagaggagggaggggcccgctgggcacagcaagggggagctggcacccgagctaggggaggagccccagccccgcgacgaggaggaagcggagctggagctgctgaggcagtttgacctggcctggcagtacgggccctgcaccgggatcacacggctgcagcgctggtgtcgggccaagcagatgggcttggagcctcccccagaggtgtggcaggtgctgaagacccaccccggagacccccgcttccagtgcagtctctggcatctctatcccctatgaggcaccacgtaagacctcctgcccttagctctcttgctcaccacccaagaacctcaggacagaagcgagagcccattgctcctgctggctcaactcctccatctaaccagcaggctcccagagtccccggaagagcctgcgcagctgaagcagagtgcttctagatggagagtggtcactggggaaaaggacctggccatcaccttccaatacctgctgcctgtctccctgacccatgatctggcaagttaggcacagtcagacatggacagttgatccatgaggaaaagatgctctcccacctaaggccaggaatctgagagcaggactggctgagctcccagggcaaggggttcactaatgcttatcaataaagaatattgagcctggaa

SEQ ID NO: 295218 - DNA, 1181 bp, Homo sapiens
cgtggcctctggttctctgtgcccagtccagggtggcagtttgttggcttcttagggctcctctgtcctggagatcttcatgaaagtagctgactgtgaaaaccttgaattggggagtgtatggataggtgatcctgcagctgaaggagatagctgtgttggccagggaggcatgatgggcaggccggtgtgggtcactgactgtcctcctgccagtcgcagggtcccgggcagcagcagcacgccaaggaggagccagggggctgcggggagcccaggagggctgggaggcctggcagggccgccacctcacaggctggttctccatctgggggcctgcttgtctgcggcgactctttagatcttgtctgcccgccgctggcctggccccgtctgtctctctcagcagctgtctttctcgcgcccactggccggtctctcctcttccccgcagttgcctccttctctgcctgcctgggtggccgccatgggccggaagcggctcatcactgattcctacccggttgtgaagaggagggaggggcccgctgggcacagcaagggggagctggcacccgagctaggggaggagccccagccccgcgacgaggaggaagcggagctggagctgctgaggcagtttgacctggcctggcagtacgggccctgcaccgggatcacacggctgcagcgctggtgtcgggccaagcagatgggcttggagcctcccccagaggtgtggcaggtgctgaagacccaccccggagacccccgcttccagtgcagtctctggcatctctatcccctatgaggcaccacgtaagacctcctgcccttagctctcttgctcaccacccaagaacctcaggacagaagcgagagcccattgctcctgctagcaggctcccagagtccccggaagagcctgcgcagctgaagcagagtgcttctagatggagagtggtcactggggaaaaggacctggccatcaccttccaatacctgctgcctgtctccctgacccatgatctggcaagttaggcacagtcagacatggacagttgatccatgaggaaaagatgctctcccacctaaggccaggaatctgagagcaggactggctgagctcccagggcaaggggttcactaatgcttatcaataaagaatattgagcctggaa

SEQ ID NO: 295219 - DNA, 1092 bp, Homo sapiens
cgtggcctctggttctctgtgcccagtccagggtggcagtttgttggcttcttagggctcctctgtcctggagatcttcatgaaagtagctgactgtgaaaaccttgaattggggagtgtatggataggtgatcctgcagctgaaggagatagctgtgttggccagggaggcatgatgggcaggccggtgtgggtcactgactgtcctcctgccagtcgcagggtcccgggcagcagcagcacgccaaggaggagccagggggctgcggggagcccaggagggctgggaggcctggcagggccgccacctcacaggctggttctccatctgggggcctgcttgtctgcggcgactctttagatcttgtctgcccgccgctggcctggccccgtctgtctctctcagcagctgtctttctcgcgcccactggccggtctctcctcttccccgcagttgcctccttctctgcctgcctgggtggccgccatgggccggaagcggctcatcactgattcctacccggttgtgaagaggagggaggggcccgctgggcacagcaagggggagctggcacccgagctaggggaggagccccagccccgcgacgaggaggaagcggagctggagctgctgaggcagtttgacctggcctggcagtacgggccctgcaccgggatcacacggctgcagcgctggtgtcgggccaagcagatgggcttggagcctcccccagaggtgtggcaggtgctgaagacccaccccggagacccccgcttccagtgcagggctcaactcctccatctaaccagcaggctcccagagtccccggaagagcctgcgcagctgaagcagagtgcttctagatggagagtggtcactggggaaaaggacctggccatcaccttccaatacctgctgcctgtctccctgacccatgatctggcaagttaggcacagtcagacatggacagttgatccatgaggaaaagatgctctcccacctaaggccaggaatctgagagcaggactggctgagctcccagggcaaggggttcactaatgcttatcaataaagaatattgagcctggaa

SEQ ID NO: 295220 - DNA, 709 bp, Homo sapiens
ggagctggaactccggcttcatttcacccctgctgggatgccaggttcccacctcagcaccctgggattcctgagtgtcagtgacttgggattcccacccaggcagtcaagccagccacccccttctttcccccctgcactgatatctctgggggtttctccttcctatgtcctgcccctgctacctgcttcattgtccatcccctgggggcgggcagagggccctctgccctcccccagaggtgtggcaggtgctgaagacccaccccggagacccccgcttccagtgcagtctctggcatctctatcccctatgaggcaccacgtaagacctcctgcccttagctctcttgctcaccacccaagaacctcaggacagaagcgagagcccattgctcctgctggctcaactcctccatctaaccagcaggctcccagagtccccggaagagcctgcgcagctgaagcagagtgcttctagatggagagtggtcactggggaaaaggacctggccatcaccttccaatacctgctgcctgtctccctgacccatgatctggcaagttaggcacagtcagacatggacagttgatccatgaggaaaagatgctctcccacctaaggccaggaatctgagagcaggactggctgagctcccagggcaaggggttcactaatgcttatcaataaagaatattgagcctggaa

SEQ ID NO: 295221 - DNA, 1283 bp, Homo sapiens
cgtggcctctggttctctgtgcccagtccagggtggcagtttgttggcttcttagggctcctctgtcctggagatcttcatgaaagtagctgactgtgaaaaccttgaattggggagtgtatggataggtgatcctgcagctgaaggagatagctgtgttggccagggaggcatgatgggcaggccggtgtgggtcactgactgtcctcctgccagtcgcagggtcccgggcagcagcagcacgccaaggaggagccagggggctgcggggagcccaggagggctgggaggcctggcagggccgccacctcacaggctggttctccatctgggggcctgcttgtctgcggcgactctttagatcttgtctgcccgccgctggcctggccccgtctgtctctctcagcagctgtctttctcgcgcccactggccggtctctcctcttccccgcagttgcctccttctctgcctgcctgggtggccgccatgggccggaagcggctcatcactgattcgggaggagccccagccccgcgacgaggaggaagcggagctggagctgctgaggcagtttgacctggcctggcagtacgggccctgcaccgggatcacacggctgcagcgctggtgtcgggccaagcagatgggcttggagcctcccccagaggtgtggcaggtgctgaagacccaccccggagacccccgcttccagtgcagtctctggcatctctatcccctatgaggcaccacgtaagacctcctgcccttagctctcttgctcaccacccaagaacctcaggacagaagcgagagcccattgctcctgctcagctcagcccggctgcggaggaacccttggcaggcagaacctggaggtgtcagaggctcaactcctccatctaaccagcaggctcccagagtccccggaagagcctgcgcagctgaagcagagtgcttctagatggagagtggtcactggggaaaaggacctggccatcaccttccaatacctgctgcctgtctccctgacccatgatctggcaagttaggcacagtcagacatggacagttgatccatgaggaaaagatgctctcccacctaaggccaggaatctgagagcaggactggctgagctcccagggcaaggggttcactaatgcttatcaataaagaatattgagcctggaaaaaaaaaagaaaaccgggctttatgggggggggaaaggttgaaggcctggtagggttcccgcccctttgtaagggaacgggcccaaggggaag

SEQ ID NO: 295222 - DNA, 1076 bp, Homo sapiens
cgtggcctctggttctctgtgcccagtccagggtggcagtttgttggcttcttagggctcctctgtcctggagatcttcatgaaagtagctgactgtgaaaaccttgaattggggagtgtatggataggtgatcctgcagctgaaggagatagctgtgttggccagggaggcatgatgggcaggccggtgtgggtcactgactgtcctcctgccagtcgcagggtcccgggcagcagcagcacgccaaggaggagccagggggctgcggggagcccaggagggctgggaggcctggcagggccgccacctcacaggctggttctccatctgggggcctgcttgtctgcggcgactctttagatcttgtctgcccgccgctggcctggccccgtctgtctctctcagcagctgtctttctcgcgcccactggccggtctctcctcttccccgcagttgcctccttctctgcctgcctgggtggccgccatgggccggaagcggctcatcactgattcctacccggttgtgaagaggagggaggggcccgctgggcacagcaagggggagctggcacccgagctaggggaggagccccagccccgcgacgaggaggaagcggagctggagctgctgaggcagtttgacctggcctggcagtacgggccctgcaccgggatcacacggctgcagcgctggtgtcgggccaagcagatgggcttggagcctcccccagaggtgtggcaggtgctgaagacccaccccggagacccccgcttccagtgcagtctctggcatctctatcccctatgaggcaccacgtaagacctcctgcccttagctctcttgctcaccacccaagaacctcaggacagaagcgagagcccattgctcctgctctgctgcctgtctccctgacccatgatctggcaagttaggcacagtcagacatggacagttgatccatgaggaaaagatgctctcccacctaaggccaggaatctgagagcaggactggctgagctcccagggcaaggggttcactaatgcttatcaataaagaatattgagcctggaa

SEQ ID NO: 295223 - DNA, 172 bp, Homo sapiens
gagttgctgactttgtaacatatgaatatataaaaatcccttgcaattcaggtagtcaatgcaagggatttttatatattcatatgttacaaagtcagcaactctcctgttggttcattattgaatgtgctgtaaattaagtcgtttgcaattaaaacaaggtttgcccaca

SEQ ID NO: 295224 - DNA, 138 bp, Homo sapiens
ttttttttttgcgggcaaaccttgttgcaagggatttttatatattcatatgttacaaagtcagcaactctcctgttggttcattattgaatgtgctgtaaattaagtcgtttgcaattaaaacaaggtttgcccaca

SEQ ID NO: 295225 - DNA, 2045 bp, Homo sapiens
agtccgccccgccccctccccgtccccgccgctgcagccgtcgccttcggagcgaagggtaccgacccggcagaagctcggagctctcggggtatcgaggaggcaggcccgcgggcgcacgggcgagcgggccgggagccggagcggcggaggagccggcagcagcggcgcggcgggctccaggcgaggcggtcgacgctcctgaaaacttgcgcgcgcgctcgcgccactgcgcccggagcgatgaagatggtcgcgccctggacgcggttctactccaacagctgctgcttgtgctgccatgtccgcaccggcaccatcctgctcggcgtctggtatctgatcatcaatgctgtggtactgttgattttattgagtgccctggctgatccggatcagtataacttttcaagttctgaactgggaggtgactttgagttcatggatgatgccaacatgtgcattgccattgcgatttctcttctcatgatcctgatatgtgctatggctacttacggagcgtacaagcaacgcgcagcctggatcatcccattcttctgttaccagatctttgactttgccctgaacatgttggttgcaatcactgtgcttatttatccaaactccattcaggaatacatacggcaactgcctcctaattttccctacagagatgatgtcatgtcagtgaatcctacctgtttggtccttattattcttctgtttattagcattatcttgacttttaagggttacttgattagctgtgtttggaactgctaccgatacatcaatggtaggaactcctctgatgtcctggtttatgttaccagcaatgacactacggtgctgctacccccgtatgatgatgccactgtgaatggtgctgccaaggagccaccgccaccttacgtgtctgcctaagccttcaagtgggcggagctgagggcagcagcttgactttgcagacatctgagcaatagttctgttatttcacttttgccatgagcctctctgagcttgtttgttgctgaaatgctactttttaaaatttagatgttagattgaaaactgtagttttcaacatatgctttgctagaacactgtgatagattaactgtagaattcttcctgtacgattggggatataacgggcttcactaaccttccctaggcattgaaacttcccccaaatctgatggacctagaagtctgcttttgtacctgctgggccccaaagttgggcatttttctctctgttccctctcttttgaaaatgtaaaataaaaccaaaaatagacaactttttcttcagccattccagcatagagaacaaaaccttatggaaacaggaatgtcaattgtgtaatcattgttctaattaggtaaatagaagtccttatgtatgtgttacaagaatttcccccacaacatcctttatgactgaagttcaatgacagtttgtgtttggtggtaaaggattttctccatggcctgaattaagaccattagaaagcaccaggccgtgggagcagtgaccatctgctgactgttcttgtggatcttgtgtccagggacatggggtgacatgcctcgtatgtgttagagggtggaatggatgtgtttggcgctgcatgggatctggtgcccctcttctcctggattcacatccccacccagggcccgcttttactaagtgttctgccctagattggttcaaggaggtcatccaactgactttatcaagtggaattgggatatatttgatatacttctgcctaacaacatggaaaagggttttcttttccctgcaagctacatcctactgctttgaacttccaagtatgtctagtcaccttttaaaatgtaaacattttcagaaaaatgaggattgccttccttgtatgcgctttttaccttgactacctgaattgcaagggatttttatatattcatatgttacaaagtcagcaactctcctgttggttcattattgaatgtgctgtaaattaagtcgtttgcaattaaaacaaggtttgcccaca

SEQ ID NO: 295226 - DNA, 2225 bp, Homo sapiens
agtccgccccgccccctccccgtccccgccgctgcagccgtcgccttcggagcgaagggtaccgacccggcagaagctcggagctctcggggtatcgaggaggcaggcccgcgggcgcacgggcgagcgggccgggagccggagcggcggaggagccggcagcagcggcgcggcgggctccaggcgaggcggtcgacgctcctgaaaacttgcgcgcgcgctcgcgccactgcgcccggagcgatgaagatggtcgcgccctggacgcggttctactccaacagctgctgcttgtgctgccatgtccgcaccggcaccatcctgctcggcgtctggtatctgatcatcaatgctgtggtactgttgattttattgagtgccctggctgatccggatcagtataacttttcaagttctgaactgggaggtgactttgagttcatggatgatgccaacatgtgcattgccattgcgatttctcttctcatgatcctgatatgtgctatggctacttacggagcgtacaagcaacgcgcagcctggatcatcccattcttctgttaccagatctttgactttgccctgaacatgttggttgcaatcactgtgcttatttatccaaactccattcaggaatacatacggcaactgcctcctaattttccctacagagatgatgtcatgtcagtgaatcctacctgtttggtccttattattcttctgtttattagcattatcttgacttttaagggttacttgattagctgtgtttggaactgctaccgatacatcaatggtaggaactcctctgatgtcctggtttatgttaccagcaatgacactacggtgctgctacccccgtatgatgatgccactgtgaatggtgctgccaaggagccaccgccaccttacgtgtctgcctaagccttcaagtgggcggagctgagggcagcagcttgactttgcagacatctgagcaatagttctgttatttcacttttgccatgagcctctctgagcttgtttgttgctgaaatgctactttttaaaatttagatgttagattgaaaactgtagttttcaacatatgctttgctagaacactgtgatagattaactgtagaattcttcctgtacgattggggatataacgggcttcactaaccttccctaggcattgaaacttcccccaaatctgatggacctagaagtctgcttttgtacctgctgggccccaaagttgggcatttttctctctgttccctctcttttgaaaatgtaaaataaaaccaaaaatagacaactttttcttcagccattccagcatagagaacaaaaccttatggaaacaggaatgtcaattgtgtaatcattgttctaattaggtaaatagaagtccttatgtatgtgttacaagaatttcccccacaacatcctttatgactgaagttcaatgacagtttgtgtttggtggtaaaggattttctccatggcctgaattaagaccattagaaagcaccaggccgtgggagcagtgaccatctgctgactgttcttgtggatcttgtgtccagggacatggggtgacatgcctcgtatgtgttagagggtggaatggatgtgtttggcgctgcatgggatctggtgcccctcttctcctggattcacatccccacccagggcccgcttttactaagtgttctgccctagattggttcaaggaggtcatccaactgactttatcaagtggaattgggatatatttgatatacttctgcctaacaacatggaaaagggttttcttttccctgcaagctacatcctactgctttgaacttccaagtatgtctagtcaccttttaaaatgtaaacattttcagaaaaatgaggattgccttccttgtatgcgctttttaccttgactacctgaattgcaagggatttttatatattcatatgttacaaagtcagcaactctcctgttggttcattattgaatgtgctgtaaattaagtcgtttgcaattaaaacaaggtttgcccacaaaaaaaaaaaagggggcgcctaaaatatccccgaaggtccacgctaccggacccaggttttggacaaaggccaaggcgccgtaaaaacacagaggcggcgaaacacgcgacggaaccgcgcgggacggaagcccaccggggcaaggacaccacagagacgcgagaaacccgtcacggcag

SEQ ID NO: 295227 - DNA, 2319 bp, Homo sapiens
agtccgccccgccccctccccgtccccgccgctgcagccgtcgccttcggagcgaagggtaccgacccggcagaagctcggagctctcggggtatcgaggaggcaggcccgcgggcgcacgggcgagcgggccgggagccggagcggcggaggagccggcagcagcggcgcggcgggctccaggcgaggcggtcgacgctcctgaaaacttgcgcgcgcgctcgcgccactgcgcccggagcgatgaagatggtcgcgccctggacgcggttctactccaacagctgctgcttgtgctgccatgtccgcaccggcaccatcctgctcggcgtctggtatctgatcatcaatgctgtggtactgttgattttattgagtgccctggctgatccggatcagtataacttttcaagttctgaactgggaggtgactttgagttcatggatgatgccaacatgtgcattgccattgcgatttctcttctcatgatcctgatatgtgctatggctacttacggagcgtacaagcaacgcgcagcctggatcatcccattcttctgttaccagatctttgactttgccctgaacatgttggttgcaatcactgtgcttatttatccaaactccattcaggaatacatacggcaactgcctcctaattttccctacagagatgatgtcatgtcagtgaatcctacctgtttggtccttattattcttctgtttattagcattatcttgacttttaagggttacttgattagctgtgtttggaactgctaccgatacatcaatggtaggaactcctctgatgtcctggtttatgttaccagcaatgacactacggtgctgctacccccgtatgatgatgccactgtgaatggtgctgccaaggagccaccgccaccttacgtgtctgcctaagccttcaagtgggcggagctgagggcagcagcttgactttgcagacatctgagcaatagttctgttatttcacttttgccatgagcctctctgagcttgtttgttgctgaaatgctactttttaaaatttagatgttagattgaaaactgtagttttcaacatatgctttgctagaacactgtgatagattaactgtagaattcttcctgtacgattggggatataacgggcttcactaaccttccctaggcattgaaacttcccccaaatctgatggacctagaagtctgcttttgtacctgctgggccccaaagttgggcatttttctctctgttccctctcttttgaaaatgtaaaataaaaccaaaaatagacaactttttcttcagccattccagcatagagaacaaaaccttatggaaacaggaatgtcaattgtgtaatcattgttctaattaggtaaatagaagtccttatgtatgtgttacaagaatttcccccacaacatcctttatgactgaagttcaatgacagtttgtgtttggtggtaaaggattttctccatggcctgaattaagaccattagaaagcaccaggccgtgggagcagtgaccatctgctgactgttcttgtggatcttgtgtccagggacatggggtgacatgcctcgtatgtgttagagggtggaatggatgtgtttggcgctgcatgggatctggtgcccctcttctcctggattcacatccccacccagggcccgcttttactaagtgttctgccctagattggttcaaggaggtcatccaactgactttatcaagtggaattgggatatatttgatatacttctgcctaacaacatggaaaagggttttcttttccctgcaagctacatcctactgctttgaacttccaagtatgtctagtcaccttttaaaatgtaaacattttcagaaaaatgaggattgccttccttgtatgcgctttttaccttgactacctgaattgcaagggatttttatatattcatatgttacaaagtcagcaactctcctgttggttcattattgaatgtgctgtaaattaagtcgtttgcaattaaaacaaggtttgcccacacacaacagcatgccgcgcacattcctacctacacatgcaactaggttctcctgatcccttcatcaattgagtaggatagcttcgctccccaattgacgaactacatagcgcgcgcccgcctattcaggctgtgccaccatcctaactttatcagcgatactttaccacgcgctcatctagtggacatgtgctttgacaccatgcttctcaccatctcatatatgctgcactgcccgccttaccaagctcgcctgccctctgctacgattctgta

SEQ ID NO: 295228 - DNA, 2387 bp, Homo sapiens
agtccgccccgccccctccccgtccccgccgctgcagccgtcgccttcggagcgaagggtaccgacccggcagaagctcggagctctcggggtatcgaggaggcaggcccgcgggcgcacgggcgagcgggccgggagccggagcggcggaggagccggcagcagcggcgcggcgggctccaggcgaggcggtcgacgctcctgaaaacttgcgcgcgcgctcgcgccactgcgcccggagcgatgaagatggtcgcgccctggacgcggttctactccaacagctgctgcttgtgctgccatgtccgcaccggcaccatcctgctcggcgtctggtatctgatcatcaatgctgtggtactgttgattttattgagtgccctggctgatccggatcagtataacttttcaagttctgaactgggaggtgactttgagttcatggatgatgccaacatgtgcattgccattgcgatttctcttctcatgatcctgatatgtgctatggctacttacggagcgtacaagcaacgcgcagcctggatcatcccattcttctgttaccagatctttgactttgccctgaacatgttggttgcaatcactgtgcttatttatccaaactccattcaggaatacatacggcaactgcctcctaattttccctacagagatgatgtcatgtcagtgaatcctacctgtttggtccttattattcttctgtttattagcattatcttgacttttaagggttacttgattagctgtgtttggaactgctaccgatacatcaatggtaggaactcctctgatgtcctggtttatgttaccagcaatgacactacggtgctgctacccccgtatgatgatgccactgtgaatggtgctgccaaggagccaccgccaccttacgtgtctgcctaagccttcaagtgggcggagctgagggcagcagcttgactttgcagacatctgagcaatagttctgttatttcacttttgccatgagcctctctgagcttgtttgttgctgaaatgctactttttaaaatttagatgttagattgaaaactgtagttttcaacatatgctttgctagaacactgtgatagattaactgtagaattcttcctgtacgattggggatataacgggcttcactaaccttccctaggcattgaaacttcccccaaatctgatggacctagaagtctgcttttgtacctgctgggccccaaagttgggcatttttctctctgttccctctcttttgaaaatgtaaaataaaaccaaaaatagacaactttttcttcagccattccagcatagagaacaaaaccttatggaaacaggaatgtcaattgtgtaatcattgttctaattaggtaaatagaagtccttatgtatgtgttacaagaatttcccccacaacatcctttatgactgaagttcaatgacagtttgtgtttggtggtaaaggattttctccatggcctgaattaagaccattagaaagcaccaggccgtgggagcagtgaccatctgctgactgttcttgtggatcttgtgtccagggacatggggtgacatgcctcgtatgtgttagagggtggaatggatgtgtttggcgctgcatgggatctggtgcccctcttctcctggattcacatccccacccagggcccgcttttactaagtgttctgccctagattggttcaaggaggtcatccaactgactttatcaagtggaattgggatatatttgatatacttctgcctaacaacatggaaaagggttttcttttccctgcaagctacatcctactgctttgaacttccaagtatgtctagtcaccttttaaaatgtaaacattttcagaaaaatgaggattgccttccttgtatgcgctttttaccttgactacctgaattgcaagggatttttatatattcatatgttacaaagtcagcaactctcctgttggttcattattgaatgtgctgtaaattaagtcgtttgcaattaaaacaaggtttgcccacaaaacaaaaaagcagatcagcacacagacaccaagaagaagagacaatgcaaaagcaacaacgaaccgacgtacgccacgacacacacaacaaacagtaacacggaagcacacacaacgcacacaccacccacaccaacaccagcccgaaaaaaaaacaacggagcagggctcctaacaaccacgcgcgggccactccccgacgcgcacgtagtcgcaggggcgccgccagctgccataacagagcgccagacaggaccaccacgacacatccgactcgatcaacagaacacatgtgtgggaacagccacaccacaaagcgacgcgaatacagtgtaggccgc

SEQ ID NO: 295229 - DNA, 2105 bp, Homo sapiens
agtccgccccgccccctccccgtccccgccgctgcagccgtcgccttcggagcgaagggtaccgacccggcagaagctcggagctctcggggtatcgaggaggcaggcccgcgggcgcacgggcgagcgggccgggagccggagcggcggaggagccggcagcagcggcgcggcgggctccaggcgaggcggtcgacgctcctgaaaacttgcgcgcgcgctcgcgccactgcgcccggagcgatgaagatggtcgcgccctggacgcggttctactccaacagctgctgcttgtgctgccatgtccgcaccggcaccatcctgctcggcgtctggtatctgatcatcaatgctgtggtactgttgattttattgagtgccctggctgatccggatcagtataacttttcaagttctgaactgggaggtgactttgagttcatggatgatgccaacatgtgcattgccattgcgatttctcttctcatgatcctgatatgtgctatggctacttacggagcgtacaagcaacgcgcagcctggatcatcccattcttctgttaccagatctttgactttgccctgaacatgttggttgcaatcactgtgcttatttatccaaactccattcaggaatacatacggcaactgcctcctaattttccctacagagatgatgtcatgtcagtgaatcctacctgtttggtccttattattcttctgtttattagcattatcttgacttttaagggttacttgattagctgtgtttggaactgctaccgatacatcaatggtaggaactcctctgatgtcctggtttatgttaccagcaatgacactacggtgctgctacccccgtatgatgatgccactgtgaatggtgctgccaaggagccaccgccaccttacgtgtctgcctaagccttcaagtgggcggagctgagggcagcagcttgactttgcagacatctgagcaatagttctgttatttcacttttgccatgagcctctctgagcttgtttgttgctgaaatgctactttttaaaatttagatgttagattgaaaactgtagttttcaacatatgctttgctagaacactgtgatagattaactgtagaattcttcctgtacgattggggatataacgggcttcactaaccttccctaggcattgaaacttcccccaaatctgatggacctagaagtctgcttttgtacctgctgggccccaaagttgggcatttttctctctgttccctctcttttgaaaatgtaaaataaaaccaaaaatagacaactttttcttcagccattccagcatagagaacaaaaccttatggaaacaggaatgtcaattgtgtaatcattgttctaattaggtaaatagaagtccttatgtatgtgttacaagaatttcccccacaacatcctttatgactgaagttcaatgacagtttgtgtttggtggtaaaggattttctccatggcctgaattaagaccattagaaagcaccaggccgtgggagcagtgaccatctgctgactgttcttgtggatcttgtgtccagggacatggggtgacatgcctcgtatgtgttagagggtggaatggatgtgtttggcgctgcatgggatctggtgcccctcttctcctggattcacatccccacccagggcccgcttttactaagtgttctgccctagattggttcaaggaggtcatccaactgactttatcaagtggaattgggatatatttgatatacttctgcctaacaacatggaaaagggttttcttttccctgcaagctacatcctactgctttgaacttccaagtatgtctagtcaccttttaaaatgtaaacattttcagaaaaatgaggattgccttccttgtatgcgctttttaccttgactacctgaattgcaagggatttttatatattcatatgttacaaagtcagcaactctcctgttggttcattattgaatgtgctgtaaattaagtcgtttgcaattaaaacaaggtttgcccacaaaaaacaacaacaaacaaacaaaaacgaaaacaacaaaaacaaaacaaaacacaaaaagg

SEQ ID NO: 295230 - DNA, 1522 bp, Homo sapiens
tataagtgctatagatgggcccggtgtgtaatcaggccgaggagatctccgacgggttcctgaacatgttggttgcaatcactgtgcttatttatccaaactccattcaggaatacatacggcaactgcctcctaattttccctacagagatgatgtcatgtcagtgaatcctacctgtttggtccttattattcttctgtttattagcattatcttgacttttaagggttacttgattagctgtgtttggaactgctaccgatacatcaatggtaggaactcctctgatgtcctggtttatgttaccagcaatgacactacggtgctgctacccccgtatgatgatgccactgtgaatggtgctgccaaggagccaccgccaccttacgtgtctgcctaagccttcaagtgggcggagctgagggcagcagcttgactttgcagacatctgagcaatagttctgttatttcacttttgccatgagcctctctgagcttgtttgttgctgaaatgctactttttaaaatttagatgttagattgaaaactgtagttttcaacatatgctttgctagaacactgtgatagattaactgtagaattcttcctgtacgattggggatataacgggcttcactaaccttccctaggcattgaaacttcccccaaatctgatggacctagaagtctgcttttgtacctgctgggccccaaagttgggcatttttctctctgttccctctcttttgaaaatgtaaaataaaaccaaaaatagacaactttttcttcagccattccagcatagagaacaaaaccttatggaaacaggaatgtcaattgtgtaatcattgttctaattaggtaaatagaagtccttatgtatgtgttacaagaatttcccccacaacatcctttatgactgaagttcaatgacagtttgtgtttggtggtaaaggattttctccatggcctgaattaagaccattagaaagcaccaggccgtgggagcagtgaccatctgctgactgttcttgtggatcttgtgtccagggacatggggtgacatgcctcgtatgtgttagagggtggaatggatgtgtttggcgctgcatgggatctggtgcccctcttctcctggattcacatccccacccagggcccgcttttactaagtgttctgccctagattggttcaaggaggtcatccaactgactttatcaagtggaattgggatatatttgatatacttctgcctaacaacatggaaaagggttttcttttccctgcaagctacatcctactgctttgaacttccaagtatgtctagtcaccttttaaaatgtaaacattttcagaaaaatgaggattgccttccttgtatgcgctttttaccttgactacctgaattgcaagggatttttatatattcatatgttacaaagtcagcaactctcctgttggttcattattgaatgtgctgtaaattaagtcgtttgcaattaaaacaaggtttgcccaca

SEQ ID NO: 295231 - DNA, 2060 bp, Homo sapiens
agtccgccccgccccctccccgtccccgccgctgcagccgtcgccttcggagcgaagggtaccgacccggcagaagctcggagctctcggggtatcgaggaggcaggcccgcgggcgcacgggcgagcgggccgggagccggagcggcggaggagccggcagcagcggcgcggcgggctccaggcgaggcggtcgacgctcctgaaaacttgcgcgcgcgctcgcgccactgcgcccggagcgatgaagatggtcgcgccctggacgcggttctactccaacagctgctgcttgtgctgccatgtccgcaccggcaccatcctgctcggcgtctggtatctgatcatcaatgctgtggtactgttgattttattgagtgccctggctgatccggatcagtataacttttcaagttctgaactgggaggtgactttgagttcatggatgatgccaacatgtgcattgccattgcgatttctcttctcatgatcctgatatgtgctatggctacttacggagcgtacaagcaacgcgcagcctggatcatcccattcttctgttaccagatctttgactttgccctgaacatgttggttgcaatcactgtgcttatttatccaaactccattcaggaatacatacggcaactgcctcctaattttccctacagagatgatgtcatgtcagtgaatcctacctgtttggtccttattattcttctgtttattagcattatcttgacttttaagggttacttgattagctgtgtttggaactgctaccgatacatcaatggtaggaactcctctgatgtcctggtttatgttaccagcaatgacactacggtgctgctacccccgtatgatgatgccactgtgaatggtgctgccaaggagccaccgccaccttacgtgtctgcctaagccttcaagtgggcggagctgagggcagcagcttgactttgcagacatctgagcaatagttctgttatttcacttttgccatgagcctctctgagcttgtttgttgctgaaatgctactttttaaaatttagatgttagattgaaaactgtagttttcaacatatgctttgctagaacactgtgatagattaactgtagaattcttcctgtacgattggggatataacgggcttcactaaccttccctaggcattgaaacttcccccaaatctgatggacctagaagtctgcttttgtacctgctgggccccaaagttgggcatttttctctctgttccctctcttttgaaaatgtaaaataaaaccaaaaatagacaactttttcttcagccattccagcatagagaacaaaaccttatggaaacaggaatgtcaattgtgtaatcattgttctaattaggtaaatagaagtccttatgtatgtgttacaagaatttcccccacaacatcctttatgactgaagttcaatgacagtttgtgtttggtggtaaaggattttctccatggcctgaattaagaccattagaaagcaccaggccgtgggagcagtgaccatctgctgactgttcttgtggatcttgtgtccagggacatggggtgacatgcctcgtatgtgttagagggtggaatggatgtgtttggcgctgcatgggatctggtgcccctcttctcctggattcacatccccacccagggcccgcttttactaagtgttctgccctagattggttcaaggaggtcatccaactgactttatcaagtggaattgggatatatttgatatacttctgcctaacaacatggaaaagggttttcttttccctgcaagctacatcctactgctttgaacttccaagtatgtctagtcaccttttaccccgccccgtcttcaggtaaatcaagggtctgctccggggcacatttctagcttggccgccgtttgtgaccttgggcaagttcactatactctatgtgtgccaagacttcctcctctgtaaatggtgcacagtccctgcccctcccaacctcacaggcatgttgtaagaataaattaggtaacgtgtaccaaaaaaa

SEQ ID NO: 295232 - DNA, 1253 bp, Homo sapiens
acaacccgccccaaccatgtgtggcgccgtcctcccacactcggtccccttcaggtgctgctacccccgtatgatgatgccactgtgaatggtgctgccaaggagccaccgccaccttacgtgtctgcctaagccttcaagtgggcggagctgagggcagcagcttgactttgcagacatctgagcaatagttctgttatttcacttttgccatgagcctctctgagcttgtttgttgctgaaatgctactttttaaaatttagatgttagattgaaaactgtagttttcaacatatgctttgctagaacactgtgatagattaactgtagaattcttcctgtacgattggggatataacgggcttcactaaccttccctaggcattgaaacttcccccaaatctgatggacctagaagtctgcttttgtacctgctgggccccaaagttgggcatttttctctctgttccctctcttttgaaaatgtaaaataaaaccaaaaatagacaactttttcttcagccattccagcatagagaacaaaaccttatggaaacaggaatgtcaattgtgtaatcattgttctaattaggtaaatagaagtccttatgtatgtgttacaagaatttcccccacaacatcctttatgactgaagttcaatgacagtttgtgtttggtggtaaaggattttctccatggcctgaattaagaccattagaaagcaccaggccgtgggagcagtgaccatctgctgactgttcttgtggatcttgtgtccagggacatggggtgacatgcctcgtatgtgttagagggtggaatggatgtgtttggcgctgcatgggatctggtgcccctcttctcctggattcacatccccacccagggcccgcttttactaagtgttctgccctagattggttcaaggaggtcatccaactgactttatcaagtggaattgggatatatttgatatacttctgcctaacaacatggaaaagggttttcttttccctgcaagctacatcctactgctttgaacttccaagtatgtctagtcaccttttaaaatgtaaacattttcagaaaaatgaggattgccttccttgtatgcgctttttaccttgactacctgaattgcaagggatttttatatattcatatgttacaaagtcagcaactctcctgttggttcattattgaatgtgctgtaaattaagtcgtttgcaattaaaacaaggtttgcccaca

SEQ ID NO: 295233 - DNA, 1256 bp, Homo sapiens
attaatttacatatcgcccgttatataacgacacacggaacaataatatttcgtgaggtgctgctacccccgtatgatgatgccactgtgaatggtgctgccaaggagccaccgccaccttacgtgtctgcctaagccttcaagtgggcggagctgagggcagcagcttgactttgcagacatctgagcaatagttctgttatttcacttttgccatgagcctctctgagcttgtttgttgctgaaatgctactttttaaaatttagatgttagattgaaaactgtagttttcaacatatgctttgctagaacactgtgatagattaactgtagaattcttcctgtacgattggggatataacgggcttcactaaccttccctaggcattgaaacttcccccaaatctgatggacctagaagtctgcttttgtacctgctgggccccaaagttgggcatttttctctctgttccctctcttttgaaaatgtaaaataaaaccaaaaatagacaactttttcttcagccattccagcatagagaacaaaaccttatggaaacaggaatgtcaattgtgtaatcattgttctaattaggtaaatagaagtccttatgtatgtgttacaagaatttcccccacaacatcctttatgactgaagttcaatgacagtttgtgtttggtggtaaaggattttctccatggcctgaattaagaccattagaaagcaccaggccgtgggagcagtgaccatctgctgactgttcttgtggatcttgtgtccagggacatggggtgacatgcctcgtatgtgttagagggtggaatggatgtgtttggcgctgcatgggatctggtgcccctcttctcctggattcacatccccacccagggcccgcttttactaagtgttctgccctagattggttcaaggaggtcatccaactgactttatcaagtggaattgggatatatttgatatacttctgcctaacaacatggaaaagggttttcttttccctgcaagctacatcctactgctttgaacttccaagtatgtctagtcaccttttaaaatgtaaacattttcagaaaaatgaggattgccttccttgtatgcgctttttaccttgactacctgaattgcaagggatttttatatattcatatgttacaaagtcagcaactctcctgttggttcattattgaatgtgctgtaaattaagtcgtttgcaattaaaacaaggtttgcccaca

SEQ ID NO: 295234 - DNA, 1253 bp, Homo sapiens
aaaaatatacatgagtagaaaaatacgagtccacaacataaaaaaaactttcaggtgctgctacccccgtatgatgatgccactgtgaatggtgctgccaaggagccaccgccaccttacgtgtctgcctaagccttcaagtgggcggagctgagggcagcagcttgactttgcagacatctgagcaatagttctgttatttcacttttgccatgagcctctctgagcttgtttgttgctgaaatgctactttttaaaatttagatgttagattgaaaactgtagttttcaacatatgctttgctagaacactgtgatagattaactgtagaattcttcctgtacgattggggatataacgggcttcactaaccttccctaggcattgaaacttcccccaaatctgatggacctagaagtctgcttttgtacctgctgggccccaaagttgggcatttttctctctgttccctctcttttgaaaatgtaaaataaaaccaaaaatagacaactttttcttcagccattccagcatagagaacaaaaccttatggaaacaggaatgtcaattgtgtaatcattgttctaattaggtaaatagaagtccttatgtatgtgttacaagaatttcccccacaacatcctttatgactgaagttcaatgacagtttgtgtttggtggtaaaggattttctccatggcctgaattaagaccattagaaagcaccaggccgtgggagcagtgaccatctgctgactgttcttgtggatcttgtgtccagggacatggggtgacatgcctcgtatgtgttagagggtggaatggatgtgtttggcgctgcatgggatctggtgcccctcttctcctggattcacatccccacccagggcccgcttttactaagtgttctgccctagattggttcaaggaggtcatccaactgactttatcaagtggaattgggatatatttgatatacttctgcctaacaacatggaaaagggttttcttttccctgcaagctacatcctactgctttgaacttccaagtatgtctagtcaccttttaaaatgtaaacattttcagaaaaatgaggattgccttccttgtatgcgctttttaccttgactacctgaattgcaagggatttttatatattcatatgttacaaagtcagcaactctcctgttggttcattattgaatgtgctgtaaattaagtcgtttgcaattaaaacaaggtttgcccaca

SEQ ID NO: 295235 - DNA, 1254 bp, Homo sapiens
acccaaatttatatataattccgacacaatagaataaagttagacgaaaattagagtgctgctacccccgtatgatgatgccactgtgaatggtgctgccaaggagccaccgccaccttacgtgtctgcctaagccttcaagtgggcggagctgagggcagcagcttgactttgcagacatctgagcaatagttctgttatttcacttttgccatgagcctctctgagcttgtttgttgctgaaatgctactttttaaaatttagatgttagattgaaaactgtagttttcaacatatgctttgctagaacactgtgatagattaactgtagaattcttcctgtacgattggggatataacgggcttcactaaccttccctaggcattgaaacttcccccaaatctgatggacctagaagtctgcttttgtacctgctgggccccaaagttgggcatttttctctctgttccctctcttttgaaaatgtaaaataaaaccaaaaatagacaactttttcttcagccattccagcatagagaacaaaaccttatggaaacaggaatgtcaattgtgtaatcattgttctaattaggtaaatagaagtccttatgtatgtgttacaagaatttcccccacaacatcctttatgactgaagttcaatgacagtttgtgtttggtggtaaaggattttctccatggcctgaattaagaccattagaaagcaccaggccgtgggagcagtgaccatctgctgactgttcttgtggatcttgtgtccagggacatggggtgacatgcctcgtatgtgttagagggtggaatggatgtgtttggcgctgcatgggatctggtgcccctcttctcctggattcacatccccacccagggcccgcttttactaagtgttctgccctagattggttcaaggaggtcatccaactgactttatcaagtggaattgggatatatttgatatacttctgcctaacaacatggaaaagggttttcttttccctgcaagctacatcctactgctttgaacttccaagtatgtctagtcaccttttaaaatgtaaacattttcagaaaaatgaggattgccttccttgtatgcgctttttaccttgactacctgaattgcaagggatttttatatattcatatgttacaaagtcagcaactctcctgttggttcattattgaatgtgctgtaaattaagtcgtttgcaattaaaacaaggtttgcccaca

SEQ ID NO: 295236 - DNA, 1252 bp, Homo sapiens
aaaaatttaatatattgtatctatactgtggcgtattaataaataacttctaggtgctgctacccccgtatgatgatgccactgtgaatggtgctgccaaggagccaccgccaccttacgtgtctgcctaagccttcaagtgggcggagctgagggcagcagcttgactttgcagacatctgagcaatagttctgttatttcacttttgccatgagcctctctgagcttgtttgttgctgaaatgctactttttaaaatttagatgttagattgaaaactgtagttttcaacatatgctttgctagaacactgtgatagattaactgtagaattcttcctgtacgattggggatataacgggcttcactaaccttccctaggcattgaaacttcccccaaatctgatggacctagaagtctgcttttgtacctgctgggccccaaagttgggcatttttctctctgttccctctcttttgaaaatgtaaaataaaaccaaaaatagacaactttttcttcagccattccagcatagagaacaaaaccttatggaaacaggaatgtcaattgtgtaatcattgttctaattaggtaaatagaagtccttatgtatgtgttacaagaatttcccccacaacatcctttatgactgaagttcaatgacagtttgtgtttggtggtaaaggattttctccatggcctgaattaagaccattagaaagcaccaggccgtgggagcagtgaccatctgctgactgttcttgtggatcttgtgtccagggacatggggtgacatgcctcgtatgtgttagagggtggaatggatgtgtttggcgctgcatgggatctggtgcccctcttctcctggattcacatccccacccagggcccgcttttactaagtgttctgccctagattggttcaaggaggtcatccaactgactttatcaagtggaattgggatatatttgatatacttctgcctaacaacatggaaaagggttttcttttccctgcaagctacatcctactgctttgaacttccaagtatgtctagtcaccttttaaaatgtaaacattttcagaaaaatgaggattgccttccttgtatgcgctttttaccttgactacctgaattgcaagggatttttatatattcatatgttacaaagtcagcaactctcctgttggttcattattgaatgtgctgtaaattaagtcgtttgcaattaaaacaaggtttgcccaca

SEQ ID NO: 295237 - DNA, 1348 bp, Homo sapiens
agtccgccccgccccctccccgtccccgccgctgcagccgtcgccttcggagcgaagggtaccgacccggcagaagctcggagctctcggggtatcgaggaggcaggcccgcgggcgcacgggcgagcgggccgggagccggagcggcggaggagccggcagcagcggcgcggcgggctccaggcgaggcggtcgacgctcctgaaaacttgcgcgcgcgctcgcgccactgcgcccggagcgatgaagatggtcgcgccctggacgcggttctactccaacagctgctgcttgtgctgccatgtccgcaccggcaccatcctgctcggcgtctggtatctgatcatcaatgctgtggtactgttgattttattgagtgccctggctgatccggatcagtataacttttcaagttctgaactgggaggtgactttgagttcatggatgatgccaacatgtgcattgccattgcgatttctcttctcatgatcctgatatgtgctatggctacttacggagcgtacaagcaacgcgcagcctggatcatcccattcttctgttaccagatctttgactttgccctgaacatgttggttgcaatcactgtgcttatttatccaaactccattcaggaatacatacggcaactgcctcctaattttccctacagagatgatgtcatgtcagtgaatcctacctgtttggtccttattattcttctgtttattagcattatcttgacttttaagggttacttgattagctgtgtttggaactgctaccgatacatcaatggtaggaactcctctgatgtcctggtttatgttaccagcaatgacactacggtgctgctacccccgtatgatgatgccactgtgaatggtgctgccaaggagccaccgccaccttacgtgtctgcctaagccttcaagtgggcggagctgagggcagcagcttgactttgcagacatctgagcaatagttctgttatttcacttttgccatgagcctctctgagcttgtttgttgctgaaatgctactttttaaaatttagatgttagattgaaaactgtagttttcaacatatgctttgctagaacactgtgatagattaactgtagaattcttcctgtacgattggggatataacgggcttcactaaccttccctaggcattgaaacttcccccaaatctgatggacctagaagtctgcttttgtacctgctgggccccaaagttgggcatttttctctctgttccctctcttttgaaaatgtaaaataactcaacagccccccaactagactaaataaaacaaagaatgggcctctttggcctaagagga

SEQ ID NO: 295238 - DNA, 1329 bp, Homo sapiens
agtccgccccgccccctccccgtccccgccgctgcagccgtcgccttcggagcgaagggtaccgacccggcagaagctcggagctctcggggtatcgaggaggcaggcccgcgggcgcacgggcgagcgggccgggagccggagcggcggaggagccggcagcagcggcgcggcgggctccaggcgaggcggtcgacgctcctgaaaacttgcgcgcgcgctcgcgccactgcgcccggagcgatgaagatggtcgcgccctggacgcggttctactccaacagctgctgcttgtgctgccatgtccgcaccggcaccatcctgctcggcgtctggtatctgatcatcaatgctgtggtactgttgattttattgagtgccctggctgatccggatcagtataacttttcaagttctgaactgggaggtgactttgagttcatggatgatgccaacatgtgcattgccattgcgatttctcttctcatgatcctgatatgtgctatggctacttacggagcgtacaagcaacgcgcagcctggatcatcccattcttctgttaccagatctttgactttgccctgaacatgttggttgcaatcactgtgcttatttatccaaactccattcaggaatacatacggcaactgcctcctaattttccctacagagatgatgtcatgtcagtgaatcctacctgtttggtccttattattcttctgtttattagcattatcttgacttttaagggttacttgattagctgtgtttggaactgctaccgatacatcaatggtaggaactcctctgatgtcctggtttatgttaccagcaatgacactacggtgctgctacccccgtatgatgatgccactgtgaatggtgctgccaaggagccaccgccaccttacgtgtctgcctaagccttcaagtgggcggagctgagggcagcagcttgactttgcagacatctgagcaatagttctgttatttcacttttgccatgagcctctctgagcttgtttgttgctgaaatgctactttttaaaatttagatgttagattgaaaactgtagttttcaacatatgctttgctagaacactgtgatagattaactgtagaattcttcctgtacgattggggatataacgggcttcactaaccttccctaggcattgaaacttcccccaaatctgatggacctagaagtctgcttttgtacctgctgggccccaaagttgggcatgtgttgtcgttccttctattaaaaacccttcggtgcggtcttctttgaaagagaacgtggtgaaaaaattaaacccaaatt

SEQ ID NO: 295239 - DNA, 697 bp, Homo sapiens
  misc_feature (16)..(16): n is a, c, g, or t
  misc_feature (20)..(20): n is a, c, g, or t
cctagttttagaagtncaanagcattgttctaattaggtaaatagaagtccttatgtatgtgttacaagaatttcccccacaacatcctttatgactgaagttcaatgacagtttgtgtttggtggtaaaggattttctccatggcctgaattaagaccattagaaagcaccaggccgtgggagcagtgaccatctgctgactgttcttgtggatcttgtgtccagggacatggggtgacatgcctcgtatgtgttagagggtggaatggatgtgtttggcgctgcatgggatctggtgcccctcttctcctggattcacatccccacccagggcccgcttttactaagtgttctgccctagattggttcaaggaggtcatccaactgactttatcaagtggaattgggatatatttgatatacttctgcctaacaacatggaaaagggttttcttttccctgcaagctacatcctactgctttgaacttccaagtatgtctagtcaccttttaaaatgtaaacattttcagaaaaatgaggattgccttccttgtatgcgctttttaccttgactacctgaattgcaagggatttttatatattcatatgttacaaagtcagcaactctcctgttggttcattattgaatgtgctgtaaattaagtcgtttgcaattaaaacaaggtttgcccaca

SEQ ID NO: 295240 - DNA, 648 bp, Homo sapiens
agtccgccccgccccctccccgtccccgccgctgcagccgtcgccttcggagcgaagggtaccgacccggcagaagctcggagctctcggggtatcgaggaggcaggcccgcgggcgcacgggcgagcgggccgggagccggagcggcggaggagccggcagcagcggcgcggcgggctccaggcgaggcggtcgacgctcctgaaaacttgcgcgcgcgctcgcgccactgcgcccggagcgatgaagatggtcgcgccctggacgcggttctactccaacagctgctgcttgtgctgccatgtccgcaccggcaccatcctgctcggcgtctggtatctgatcatcaatgctgtggtactgttgattttattgagtgccctggctgatccggatcagtataacttttcaagttctgaactgggaggtgactttgagttcatggatgatgccaacatgtgcattgccattgcgatttctcttctcatgatcctgatatgtgctatggctacttacggagcgtacaagcaacgcgcagcctggatcatcccattcttctgttaccagatctttgactttgccctgttggttcattattgaatgtgctgtaaattaagtcgtttgcaattaaaacaaggtttgcccaca

SEQ ID NO: 295241 - DNA, 371 bp, Homo sapiens
ttgactacctgaattgcaagggatttttatatattcatatgttacaaagtcagcaactctcctgttggttcattattgaatgtgctgtaaattaagtcgtttgcaattaaaacaaggtttgcccacaatccaagatgaccttgtgattttgtgctgattgtgtctgaggacctttccctccacatatggtctggcagatgcacccagttcagcctaaggagtaggcttttttttgggggggggaggtcgggtgggggggatttttaatcttttaattttcaagatggttaaaatattgaaatgtttaagtggataactatattattcataaaatgactgagtgaaaactaatacactatgagatgaaaagt

SEQ ID NO: 295242 - DNA, 2169 bp, Homo sapiens
  misc_feature (2073)..(2073): n is a, c, g, or t
agtccgccccgccccctccccgtccccgccgctgcagccgtcgccttcggagcgaagggtaccgacccggcagaagctcggagctctcggggtatcgaggaggcaggcccgcgggcgcacgggcgagcgggccgggagccggagcggcggaggagccggcagcagcggcgcggcgggctccaggcgaggcggtcgacgctcctgaaaacttgcgcgcgcgctcgcgccactgcgcccggagcgatgaagatggtcgcgccctggacgcggttctactccaacagctgctgcttgtgctgccatgtccgcaccggcaccatcctgctcggcgtctggtatctgatcatcaatgctgtggtactgttgattttattgagtgccctggctgatccggatcagtataacttttcaagttctgaactgggaggtgactttgagttcatggatgatgccaacatgtgcattgccattgcgatttctcttctcatgatcctgatatgtgctatggctacttacggagcgtacaagcaacgcgcagcctggatcatcccattcttctgttaccagatctttgactttgccctgaacatgttggttgcaatcactgtgcttatttatccaaactccattcaggaatacatacggcaactgcctcctaattttccctacagagatgatgtcatgtcagtgaatcctacctgtttggtccttattattcttctgtttattagcattatcttgacttttaagggttacttgattagctgtgtttggaactgctaccgatacatcaatggtaggaactcctctgatgtcctggtttatgttaccagcaatgacactacggtgctgctacccccgtatgatgatgccactgtgaatggtgctgccaaggagccaccgccaccttacgtgtctgcctaagccttcaagtgggcggagctgagggcagcagcttgactttgcagacatctgagcaatagttctgttatttcacttttgccatgagcctctctgagcttgtttgttgctgaaatgctactttttaaaatttagatgttagattgaaaactgtagttttcaacatatgctttgctagaacactgtgatagattaactgtagaattcttcctgtacgattggggatataacgggcttcactaaccttccctaggcattgaaacttcccccaaatctgatggacctagaagtctgcttttgtacctgctgggccccaaagttgggcatttttctctctgttccctctcttttgaaaatgtaaaataaaaccaaaaatagacaactttttcttcagccattccagcatagagaacaaaaccttatggaaacaggaatgtcaattgtgtaatcattgttctaattaggtaaatagaagtccttatgtatgtgttacaagaatttcccccacaacatcctttatgactgaagttcaatgacagtttgtgtttggtggtaaaggattttctccatggcctgaattaagaccattagaaagcaccaggccgtgggagcagtgaccatctgctgactgttcttgtggatcttgtgtccagggacatggggtgacatgcctcgtatgtgttagagggtggaatggatgtgtttggcgctgcatgggatctggtgcccctcttctcctggattcacatccccacccagggcccgcttttactaagtgttctgccctagattggttcaaggaggtcatccaactgactttatcaagtggaattgggatatatttgatatacttctgcctaacaacatggaaaagggttttcttttccctgcaagctacatcctactgctttgaacttccaagtatgtctagtcaccttttaaaatgtaaacattttcagaaaaatgaggattgccttccttgtatgcgctttttaccttgactacctgaattgcaagggatttttatatattcatatgttacaaagtcagcaactctcctgttggttcattattgaatgtgctgtaaattaagtcgtttgcaattaaaacaaggtttgcccacaaaaaaaaaaacaaaaaaaaaaaaaaaanacgaagacacacgaacaggaacagcggaggcggaggaagggcaaagaagacgaaaaacgagagggaaggaaggcaagaagagcggggggggagacg

SEQ ID NO: 295243 - DNA, 2069 bp, Homo sapiens
agtccgccccgccccctccccgtccccgccgctgcagccgtcgccttcggagcgaagggtaccgacccggcagaagctcggagctctcggggtatcgaggaggcaggcccgcgggcgcacgggcgagcgggccgggagccggagcggcggaggagccggcagcagcggcgcggcgggctccaggcgaggcggtcgacgctcctgaaaacttgcgcgcgcgctcgcgccactgcgcccggagcgatgaagatggtcgcgccctggacgcggttctactccaacagctgctgcttgtgctgccatgtccgcaccggcaccatcctgctcggcgtctggtatctgatcatcaatgctgtggtactgttgattttattgagtgccctggctgatccggatcagtataacttttcaagttctgaactgggaggtgactttgagttcatggatgatgccaaaattctttttaatctttcggcagacatgtgcattgccattgcgatttctcttctcatgatcctgatatgtgctatggctacttacggagcgtacaagcaacgcgcagcctggatcatcccattcttctgttaccagatctttgactttgccctgaacatgttggttgcaatcactgtgcttatttatccaaactccattcaggaatacatacggcaactgcctcctaattttccctacagagatgatgtcatgtcagtgaatcctacctgtttggtccttattattcttctgtttattagcattatcttgacttttaagggttacttgattagctgtgtttggaactgctaccgatacatcaatggtaggaactcctctgatgtcctggtttatgttaccagcaatgacactacggtgctgctacccccgtatgatgatgccactgtgaatggtgctgccaaggagccaccgccaccttacgtgtctgcctaagccttcaagtgggcggagctgagggcagcagcttgactttgcagacatctgagcaatagttctgttatttcacttttgccatgagcctctctgagcttgtttgttgctgaaatgctactttttaaaatttagatgttagattgaaaactgtagttttcaacatatgctttgctagaacactgtgatagattaactgtagaattcttcctgtacgattggggatataacgggcttcactaaccttccctaggcattgaaacttcccccaaatctgatggacctagaagtctgcttttgtacctgctgggccccaaagttgggcatttttctctctgttccctctcttttgaaaatgtaaaataaaaccaaaaatagacaactttttcttcagccattccagcatagagaacaaaaccttatggaaacaggaatgtcaattgtgtaatcattgttctaattaggtaaatagaagtccttatgtatgtgttacaagaatttcccccacaacatcctttatgactgaagttcaatgacagtttgtgtttggtggtaaaggattttctccatggcctgaattaagaccattagaaagcaccaggccgtgggagcagtgaccatctgctgactgttcttgtggatcttgtgtccagggacatggggtgacatgcctcgtatgtgttagagggtggaatggatgtgtttggcgctgcatgggatctggtgcccctcttctcctggattcacatccccacccagggcccgcttttactaagtgttctgccctagattggttcaaggaggtcatccaactgactttatcaagtggaattgggatatatttgatatacttctgcctaacaacatggaaaagggttttcttttccctgcaagctacatcctactgctttgaacttccaagtatgtctagtcaccttttaaaatgtaaacattttcagaaaaatgaggattgccttccttgtatgcgctttttaccttgactacctgaattgcaagggatttttatatattcatatgttacaaagtcagcaactctcctgttggttcattattgaatgtgctgtaaattaagtcgtttgcaattaaaacaaggtttgcccaca

SEQ ID NO: 295244 - DNA, 1642 bp, Homo sapiens
ggtcccgtcttatagtgttgggaggtgacttcgagttcatgtgatatgccaacatgtgcattgccattgcgatttctcttctcatgatcctgatatgtgctatggctacttacggagcgtacaagcaacgcgcagcctggatcatcccattcttctgttaccagatctttgactttgccctgaacatgttggttgcaatcactgtgcttatttatccaaactccattcaggaatacatacggcaactgcctcctaattttccctacagagatgatgtcatgtcagtgaatcctacctgtttggtccttattattcttctgtttattagcattatcttgacttttaagggttacttgattagctgtgtttggaactgctaccgatacatcaatggtaggaactcctctgatgtcctggtttatgttaccagcaatgacactacggtgctgctacccccgtatgatgatgccactgtgaatggtgctgccaaggagccaccgccaccttacgtgtctgcctaagccttcaagtgggcggagctgagggcagcagcttgactttgcagacatctgagcaatagttctgttatttcacttttgccatgagcctctctgagcttgtttgttgctgaaatgctactttttaaaatttagatgttagattgaaaactgtagttttcaacatatgctttgctagaacactgtgatagattaactgtagaattcttcctgtacgattggggatataacgggcttcactaaccttccctaggcattgaaacttcccccaaatctgatggacctagaagtctgcttttgtacctgctgggccccaaagttgggcatttttctctctgttccctctcttttgaaaatgtaaaataaaaccaaaaatagacaactttttcttcagccattccagcatagagaacaaaaccttatggaaacaggaatgtcaattgtgtaatcattgttctaattaggtaaatagaagtccttatgtatgtgttacaagaatttcccccacaacatcctttatgactgaagttcaatgacagtttgtgtttggtggtaaaggattttctccatggcctgaattaagaccattagaaagcaccaggccgtgggagcagtgaccatctgctgactgttcttgtggatcttgtgtccagggacatggggtgacatgcctcgtatgtgttagagggtggaatggatgtgtttggcgctgcatgggatctggtgcccctcttctcctggattcacatccccacccagggcccgcttttactaagtgttctgccctagattggttcaaggaggtcatccaactgactttatcaagtggaattgggatatatttgatatacttctgcctaacaacatggaaaagggttttcttttccctgcaagctacatcctactgctttgaacttccaagtatgtctagtcaccttttaaaatgtaaacattttcagaaaaatgaggattgccttccttgtatgcgctttttaccttgactacctgaattgcaagggatttttatatattcatatgttacaaagtcagcaactctcctgttggttcattattgaatgtgctgtaaattaagtcgtttgcaattaaaacaaggtttgcccaca

SEQ ID NO: 295245 - DNA, 1563 bp, Homo sapiens
  misc_feature (18)..(18): n is a, c, g, or t
  misc_feature (30)..(30): n is a, c, g, or t
agctgacctagaggattnccaggcaaagcnctacggcgcgtacaagcaacgcgcagcctggatcatcccattcttctgttaccagatctttgactttgccctgaacatgttggttgcaatcactgtgcttatttatccaaactccattcaggaatacatacggcaactgcctcctaattttccctacagagatgatgtcatgtcagtgaatcctacctgtttggtccttattattcttctgtttattagcattatcttgacttttaagggttacttgattagctgtgtttggaactgctaccgatacatcaatggtaggaactcctctgatgtcctggtttatgttaccagcaatgacactacggtgctgctacccccgtatgatgatgccactgtgaatggtgctgccaaggagccaccgccaccttacgtgtctgcctaagccttcaagtgggcggagctgagggcagcagcttgactttgcagacatctgagcaatagttctgttatttcacttttgccatgagcctctctgagcttgtttgttgctgaaatgctactttttaaaatttagatgttagattgaaaactgtagttttcaacatatgctttgctagaacactgtgatagattaactgtagaattcttcctgtacgattggggatataacgggcttcactaaccttccctaggcattgaaacttcccccaaatctgatggacctagaagtctgcttttgtacctgctgggccccaaagttgggcatttttctctctgttccctctcttttgaaaatgtaaaataaaaccaaaaatagacaactttttcttcagccattccagcatagagaacaaaaccttatggaaacaggaatgtcaattgtgtaatcattgttctaattaggtaaatagaagtccttatgtatgtgttacaagaatttcccccacaacatcctttatgactgaagttcaatgacagtttgtgtttggtggtaaaggattttctccatggcctgaattaagaccattagaaagcaccaggccgtgggagcagtgaccatctgctgactgttcttgtggatcttgtgtccagggacatggggtgacatgcctcgtatgtgttagagggtggaatggatgtgtttggcgctgcatgggatctggtgcccctcttctcctggattcacatccccacccagggcccgcttttactaagtgttctgccctagattggttcaaggaggtcatccaactgactttatcaagtggaattgggatatatttgatatacttctgcctaacaacatggaaaagggttttcttttccctgcaagctacatcctactgctttgaacttccaagtatgtctagtcaccttttaaaatgtaaacattttcagaaaaatgaggattgccttccttgtatgcgctttttaccttgactacctgaattgcaagggatttttatatattcatatgttacaaagtcagcaactctcctgttggttcattattgaatgtgctgtaaattaagtcgtttgcaattaaaacaaggtttgcccaca

SEQ ID NO: 295246 - DNA, 1991 bp, Homo sapiens
agtccgccccgccccctccccgtccccgccgctgcagccgtcgccttcggagcgaagggtaccgacccggcagaagctcggagctctcggggtatcgaggaggcaggcccgcgggcgcacgggcgagcgggccgggagccggagcggcggaggagccggcagcagcggcgcggcgggctccaggcgaggcggtcgacgctcctgaaaacttgcgcgcgcgctcgcgccactgcgcccggagcgatgaagatggtcgcgccctggacgcggttctactccaacagctgctgcttgtgctgccatgtccgcaccggcaccatcctgctcggcgtctggtatctgatcatcaatgctgtggtactgttgattttattgagtgccctggctgatccggatcagtataacttttcaagttctgaactgggaggtgactttgagttcatggatgatgccaacatgtgcattgccattgcgatttctcttctcatgatcctgatatgtgctatggctacttacggagcgtacaagcaacgcgcagcctggatcatcccattcttctgttaccagatctttgactttgccctgaacatgttggttgcaatcactgtgcttatttatccaaactccattcaggaatacatacggcaactgcctcctaattttccctacagagatgatgtcatgtcagtgaatcctacctgtttggtccttattattcttctgtttattagcattatcttgacttttaagggttacttgattagctgtgtttggaactgctaccgatacatcaatggtaggaactcctctgatgtcctggtttatgttaccagcaatgacactacggtgctgctacccccgtatgatgatgccactgtgaatggtgctgccaaggagccaccgccaccttacgtgtctgcctaagccttcaagtgggcggagctgagggcagcagcttgactttgcagacatctgagcaatagttctgttatttcacttttgccatgagcctctctgagcttgtttgttgctgaaatgctactttttaaaatttagatgttagattgaaaactgtagttttcaacatatgctttgctagaacactgtgatagattaactgtagaattcttcctgtacgattggggatataacgggcttcactaaccttccctaggcattgaaacttcccccaaatctgatggacctagaagtctgcttttgtacctgctgggccccaaagttgggcatttttctctctgttccctctcttttgaaaatgtaaaataaaaccaaaaatagacaactttttcttcagccattccagcatagagaacaaaacaagtccttatgtatgtgttacaagaatttcccccacaacatcctttatgactgaagttcaatgacagtttgtgtttggtggtaaaggattttctccatggcctgaattaagaccattagaaagcaccaggccgtgggagcagtgaccatctgctgactgttcttgtggatcttgtgtccagggacatggggtgacatgcctcgtatgtgttagagggtggaatggatgtgtttggcgctgcatgggatctggtgcccctcttctcctggattcacatccccacccagggcccgcttttactaagtgttctgccctagattggttcaaggaggtcatccaactgactttatcaagtggaattgggatatatttgatatacttctgcctaacaacatggaaaagggttttcttttccctgcaagctacatcctactgctttgaacttccaagtatgtctagtcaccttttaaaatgtaaacattttcagaaaaatgaggattgccttccttgtatgcgctttttaccttgactacctgaattgcaagggatttttatatattcatatgttacaaagtcagcaactctcctgttggttcattattgaatgtgctgtaaattaagtcgtttgcaattaaaacaaggtttgcccaca

SEQ ID NO: 295247 - DNA, 1363 bp, Homo sapiens
tagggtcgaggctgggggtgaatcggccgaggtatcttctgtttattagcattatcttgacttttaagggttacttgattagctgtgtttggaactgctaccgatacatcaatggtaggaactcctctgatgtcctggtttatgttaccagcaatgacactacggtgctgctacccccgtatgatgatgccactgtgaatggtgctgccaaggagccaccgccaccttacgtgtctgcctaagccttcaagtgggcggagctgagggcagcagcttgactttgcagacatctgagcaatagttctgttatttcacttttgccatgagcctctctgagcttgtttgttgctgaaatgctactttttaaaatttagatgttagattgaaaactgtagttttcaacatatgctttgctagaacactgtgatagattaactgtagaattcttcctgtacgattggggatataacgggcttcactaaccttccctaggcattgaaacttcccccaaatctgatggacctagaagtctgcttttgtacctgctgggccccaaagttgggcatttttctctctgttccctctcttttgaaaatgtaaaataaaaccaaaaatagacaactttttcttcagccattccagcatagagaacaaaaccttatggaaacaggaatgtcaattgtgtaatcattgttctaattaggtaaatagaagtccttatgtatgtgttacaagaatttcccccacaacatcctttatgactgaagttcaatgacagtttgtgtttggtggtaaaggattttctccatggcctgaattaagaccattagaaagcaccaggccgtgggagcagtgaccatctgctgactgttcttgtggatcttgtgtccagggacatggggtgacatgcctcgtatgtgttagagggtggaatggatgtgtttggcgctgcatgggatctggtgcccctcttctcctggattcacatccccacccagggcccgcttttactaagtgttctgccctagattggttcaaggaggtcatccaactgactttatcaagtggaattgggatatatttgatatacttctgcctaacaacatggaaaagggttttcttttccctgcaagctacatcctactgctttgaacttccaagtatgtctagtcaccttttaaaatgtaaacattttcagaaaaatgaggattgccttccttgtatgcgctttttaccttgactacctgaattgcaagggatttttatatattcatatgttacaaagtcagcaactctcctgttggttcattattgaatgtgctgtaaattaagtcgtttgcaattaaaacaaggtttgcccaca

SEQ ID NO: 295248 - DNA, 927 bp, Homo sapiens
agtccgccccgccccctccccgtccccgccgctgcagccgtcgccttcggagcgaagggtaccgacccggcagaagctcggagctctcggggtatcgaggaggcaggcccgcgggcgcacgggcgagcgggccgggagccggagcggcggaggagccggcagcagcggcgcggcgggctccaggcgaggcggtcgacgctcctgaaaacttgcgcgcgcgctcgcgccactgcgcccggagcgatgaagatggtcgcgccctggacgcggttctactccaacagctgctgcttgtgctgccatgtccgcaccggcaccatcctgctcggcgtctggtatctgatcatcaatgctgtggtactgttgattttattgagtgccctggctgatccggatcagtataacttttcaagttctgaactgggaggtgactttgagttcatggatgatgccaacatgtgcattgccattgcgatttctcttctcatgatcctgatatgtgctatggctacttacggagcgtacaagcaacgcgcagcctggatcatcccattcttctgttaccagatctttgactttgccctgaacatgttggttgcaatcactgtgcttatttatccaaactccattcaggaatacatacggcaactgcctcctaattttccctacagagatgatgtcatgtcagtgaatcctacctgtttggtccttattattcttctgtttattagcattatcttgacttttaagggttacttgattagctgtgtttggaactgctaccgatacatcaatggtaggaactcctctgatgtcctggtttatgttaccagcaatgacactacgggttgtacccgttgatgatgcctgtaatgtgtgcaggagccggccttgtgttggtagctaagggggaagggagagtgattg

SEQ ID NO: 295249 - DNA, 628 bp, Homo sapiens
aacttagaaaatggattctatataaatgaccaaaaagcagatcttctgctcctggaaaataaaaaattaaaagaatatattttatacttgaagaataacatagagaaatacagagaaggacaagaagccctcatgcacacctcaagcgacttgtctcggcaactaatagctcaggaggcacaatataaggatttgtgggctgaatttcagaccacagttaagatcttggtggacaatggtgaagagaccttgcaagacataaacaatctaacagacaagctgcgtgaaagagatgaaaaaatgcagcatgtcagtacatggctacgagggagtcttgaagggctgcgtttgcttgtggaacaggaatcaccaatggaccttcttaagaagaagaaacacattcgtacaagggttcatttcccagtggttaaatgtactgagaaaaatacattaacaaagtaactcaaggatacaactgctgtgaattcaaaagacagactactacaggaaaagaacaataatccaaacaaatcttgaaccaatctataaacagaaaacctgttatataaattattatctatttttgcaatacatcaaaatactgtattgatgaaaataaatagataac

SEQ ID NO: 295250 - DNA, 1915 bp, Homo sapiens
gcggccgcgcgcactcgcacccgctgcccccgaggccctcctgcactctccccggcgccgctctccggccctcgccctgtccgccgccaccgccgccgccgccagagtcgccatgcagatcccgcgcgccgctcttctcccgctgctgctgctgctgctggcggcgcccgcctcggcgcagctgtcccgggccggccgctcggcgcctttggccgccgggtgcccagaccgggcgcgcgcaggccggcctctgtgtgtgcgccagcagcgagccggtgtgcggcagcgacgccaacacctacgccaacctgtgccagctgcgcgccgccagccgccgctccgagaggctgcaccggccgccggtcatcgtcctgcagcgcggagcctgcggccaagggcaggaagatcccaacagtttgcgccataaatataactttatcgcggacgtggtggagaagatcgcccctgccgtggttcatatcgaattgtttcgcaagcttccgttttctaaacgagaggtgccggtggctagtgggtctgggtttattgtgtcggaagatggactgatcgtgacaaatgcccacgtggtgaccaacaagcaccgggtcaaagttgagctgaagaacggtgccacttacgaagccaaaatcaaggatgtggatgagaaagcagacatcgcactcatcaaaattgaccaccagggcaagctgcctgtcctgctgcttggccgctcctcagagctgcggccgggagagttcgtggtcgccatcggaagcccgttttcccttcaaaacacagtcaccaccgggatcgtgagcaccacccagcgaggcggcaaagagctggggctccgcaactcagacatggactacatccagaccgacgccatcatcaactatggaaactcgggaggcccgttagtaaacctggacggtgaagtgattggaattaacactttgaaagtgacagctggaatctcctttgcaatcccatctgataagattaaaaagttcctcacggagtcccatgaccgacaggccaaaggaaaagccatcaccaagaagaagtatattggtatccgaatgatgtcactcacgtccagcaaagccaaagagctgaaggaccggcaccgggacttcccagacgtgatctcaggagcgtatataattgaagtaattcctgataccccagcagaagctggtggtctcaaggaaaacgacgtcataatcagcatcaatggacagtccgtggtctccgccaatgatgtcagcgacgtcattaaaagggaaagcaccctgaacatggtggtccgcaggggtaatgaagatatcatgatcacagtgattcccgaagaaattgacccataggcagaggcatgagctggacttcatgtttccctcaaagactctcccgtggatgacggatgaggactctgggctgctggaataggacactcaagacttttgactgccattttgtttgttcagtggagactccctggccaacagaatccttcttgatagtttgcaggcaaaacaaatgtaatgttgcagatccgcaggcagaagctctgcccttctgtatcctatgtatgcagtgtgctttttcttgccagcttgggccattcttgcttagacagtcagcatttgtctcctcctttaactgagtcatcatcttagtccaactaatgcagtcgatacaatgcgtagatagaagaagccccacgggagccaggatgggactggtcgtgtttgtgcttttctccaagtcagcacccaaaggtcaatgcacagagaccccgggtgggtgagcgctggcttctcaaacggccgaagttgcctcttttaggaatctctttggaattgggagcacgatgactctgagtttgagctattaaagtacttcttacacattg

SEQ ID NO: 295251 - DNA, 1031 bp, Homo sapiens
  misc_feature (1016)..(1016): n is a, c, g, or t
gcggccgcgcgcactcgcacccgctgcccccgaggccctcctgcactctccccggcgccgctctccggccctcgccctgtccgccgccaccgccgccgccgccagagtcgccatgcagatcccgcgcgccgctcttctcccgctgctgctgctgctgctggcggcgcccgcctcggcgcagctgtcccgggccggccgctcggcgcctttggccgccgggtgcccagaccgctgcgagccggcgcgctgcccgccgcagccggagcactgcgagggcggccgggcccgggacgcgtgcggctgctgcgaggtgtgcggcgcgcccgagggcgccgcgtgcggcctgcaggagggcccgtgcggcgaggggctgcagtgcgtggtgcccttcggggtgccagcctcggccacggtgcggcggcgcgcgcaggccggcctctgtgtgtgcgccagcagcgagccggtgtgcggcagcgacgccaacacctacgccaacctgtgccagctgcgcgccgccagccgccgctccgagaggctgcaccggccgccggtcatcgtcctgcagcgcggagcctgcggccaagggcaggaagatcccaacagtttgcgccataaatataactttatcgcggacgtggtggagaagatcgcccctgccgtggttcatatcgaattgtttcgcaagcttccgttttctaaacgagaggtgccggtggctagtgggtctgggtttattgtgtcggaagatggactgatcgtgacaaatgcccacgtggtgaccaacaagcaccgggtcaaagttgagctgaagaacggtgccacttacgaagccaaaatcaaggatgtggatgagaaagcagacatcgcactcatcaaaattgaccaccagaatgacacaggcagctgctgtctgtgttgcgtctcaagtggcggaatctgtccatcgagcgtttctcaacatcacacggtcgtacacacacgagcgcaaatggtcgcatcaacatgatcatcaacgngctctcatagaatcg

SEQ ID NO: 295252 - DNA, 2041 bp, Homo sapiens
tgtgaagagactgaagcccatcgatgaatactgccgggcacttgtccggctgcccccccacatctcacagtgtgacgaagtcttccggttcttcgaggctcgacccgaggatgtcaaccctccaaaagaggactatggcagttccaagaggaaatcagggcaggaagatcccaacagtttgcgccataaatataactttatcgcggacgtggtggagaagatcgcccctgccgtggttcatatcgaattgtttcgcaagtaaagagagccttcctttttcctataacctccgaagctttcaccgccactagcaaaacatgagagctatttttgagatacattaaagtgtcaaagtgtcactgaatatcttcctacttaagataagtgtgtctcccttagaacattttccctattcgactatataaatctacattcttgacccttctgaatgtttaaagaacctcgggctctgaagagattctctaagaatattttgtaagtggaagtttttgatgcatcgatggctaggtgtgtgtggctgttgcacaacccattaatcaatgcgttgaagcgttcattttaaggtgctacaggcttaagtgtgtactcctttggattttaggcttccgttttctaaacgagaggtgccggtggctagtgggtctgggtttattgtgtcggaagatggactgatcgtgacaaatgcccacgtggtgaccaacaagcaccgggtcaaagttgagctgaagaacggtgccacttacgaagccaaaatcaaggatgtggatgagaaagcagacatcgcactcatcaaaattgaccaccagggcaagctgcctgtcctgctgcttggccgctcctcagagctgcggccgggagagttcgtggtcgccatcggaagcccgttttcccttcaaaacacagtcaccaccgggatcgtgagcaccacccagcgaggcggcaaagagctggggctccgcaactcagacatggactacatccagaccgacgccatcatcaactatggaaactcgggaggcccgttagtaaacctggacggtgaagtgattggaattaacactttgaaagtgacagctggaatctcctttgcaatcccatctgataagattaaaaagttcctcacggagtcccatgaccgacaggccaaaggaaaagccatcaccaagaagaagtatattggtatccgaatgatgtcactcacgtccagcaaagccaaagagctgaaggaccggcaccgggacttcccagacgtgatctcaggagcgtatataattgaagtaattcctgataccccagcagaagctggtggtctcaaggaaaacgacgtcataatcagcatcaatggacagtccgtggtctccgccaatgatgtcagcgacgtcattaaaagggaaagcaccctgaacatggtggtccgcaggggtaatgaagatatcatgatcacagtgattcccgaagaaattgacccataggcagaggcatgagctggacttcatgtttccctcaaagactctcccgtggatgacggatgaggactctgggctgctggaataggacactcaagacttttgactgccattttgtttgttcagtggagactccctggccaacagaatccttcttgatagtttgcaggcaaaacaaatgtaatgttgcagatccgcaggcagaagctctgcccttctgtatcctatgtatgcagtgtgctttttcttgccagcttgggccattcttgcttagacagtcagcatttgtctcctcctttaactgagtcatcatcttagtccaactaatgcagtcgatacaatgcgtagatagaagaagccccacgggagccaggatgggactggtcgtgtttgtgcttttctccaagtcagcacccaaaggtcaatgcacagagaccccgggtgggtgagcgctggcttctcaaacggccgaagttgcctcttttaggaatctctttggaattgggagcacgatgactctgagtttgagctattaaagtacttcttacacattg

SEQ ID NO: 295253 - DNA, 2324 bp, Homo sapiens
gcggccgcgcgcactcgcacccgctgcccccgaggccctcctgcactctccccggcgccgctctccggccctcgccctgtccgccgccaccgccgccgccgccagagtcgccatgcagatcccgcgcgccgctcttctcccgctgctgctgctgctgctggcggcgcccgcctcggcgcagctgtcccgggccggccgctcggcgcctttggccgccgggtgcccagaccgctgcgagccggcgcgctgcccgccgcagccggagcactgcgagggcggccgggcccgggacgcgtgcggctgctgcgaggtgtgcggcgcgcccgagggcgccgcgtgcggcctgcaggagggcccgtgcggcgaggggctgcagtgcgtggtgcccttcggggtgccagcctcggccacggtgcggcggcgcgcgcaggccggcctctgtgtgtgcgccagcagcgagccggtgtgcggcagcgacgccaacacctacgccaacctgtgccagctgcgcgccgccagccgccgctccgagaggctgcaccggccgccggtcatcgtcctgcagcgcggagcctgcggccaagggcaggaagatcccaacagtttgcgccataaatataactttatcgcggacgtggtggagaagatcgcccctgccgtggttcatatcgaattgtttcgcaagcttccgttttctaaacgagaggtgccggtggctagtgggtctgggtttattgtgtcggaagatggactgatcgtgacaaatgcccacgtggtgaccaacaagcaccgggtcaaagttgagctgaagaacggtgccacttacgaagccaaaatcaaggatgtggatgagaaagcagacatcgcactcatcaaaattgaccaccagggcaagctgcctgtcctgctgcttggccgctcctcagagctgcggccgggagagttcgtggtcgccatcggaagcccgttttcccttcaaaacacagtcaccaccgggatcgtgagcaccacccagcgaggcggcaaagagctggggctccgcaactcagacatggactacatccagaccgacgccatcatcaactatggaaactcgggaggcccgttagtaaacctggacggtgaagtgattggaattaacactttgaaagtgacagctggaatctcctttgcaatcccatctgataagattaaaaagttcctcacggagtcccatgaccgacaggccaaaggaaaagccatcaccaagaagaagtatattggtatccgaatgatgtcactcacgtccagcaaagccaaagagctgaaggaccggcaccgggacttcccagacgtgatctcaggagcgtatataattgaagtaattcctgataccccagcagaagctggtggtctcaaggaaaacgacgtcataatcagcatcaatggacagtccgtggtctccgccaatgatgtcagcgacgtcattaaaagggaaagcaccctgaacatggtggtccgcaggggtaatgaagatatcatgatcacagtgattcccgaagaaattgacccataggcagaggcatgagctggacttcatgtttccctcaaagactctcccgtggatgacggatgaggactctgggctgctggaataggacactcaagacttttgactgccattttgtttgttcagtggagactccctggccaacagaatccttcttgatagtttgcaggcaaaacaaatgtaatgttgcagatccgcaggcagaagctctgcccttctgtatcctatgtatgcagtgtgctttttcttgccagcttgggccattcttgcttagacagtcagcatttgtctcctcctttaactgagtcatcatcttagtccaactaatgcagtcgatacaatgcgtagatagaagaagccccacgggagccaggatgggactggtcgtgtttgtgcttttctccaagtcagcacccaaaggtcaatgcacagagaccccgggtgggtgagcgctggcttctcaaacggccgaagttgcctcttttaggaatctctttggaattgggagcacgatgactctgagtttgagctattaaagtacttcttacacattgaaaaaaaaaaaaaaaaaacaaaaaaaaacaacaacaaaaaacacaaaaacaaaacaccaccacaccacaacacaacaaaccaaaaacaaaacactcaaacgtagcaaaaaactaatacaaacagaacaaacagcaaaacaaccaacaaaacacaaacatacgccacagatacacaaaccgcacacgcaccatcaaccacgactaacccaccaagcacacac

SEQ ID NO: 295254 - DNA, 2049 bp, Homo sapiens
gcggccgcgcgcactcgcacccgctgcccccgaggccctcctgcactctccccggcgccgctctccggccctcgccctgtccgccgccaccgccgccgccgccagagtcgccatgcagatcccgcgcgccgctcttctcccgctgctgctgctgctgctggcggcgcccgcctcggcgcagctgtcccgggccggccgctcggcgcctttggccgccgggtgcccagaccgctgcgagccggcgcgctgcccgccgcagccggagcactgcgagggcggccgggcccgggacgcgtgcggctgctgcgaggtgtgcggcgcgcccgagggcgccgcgtgcggcctgcaggagggcccgtgcggcgaggggctgcagtgcgtggtgcccttcggggtgccagcctcggccacggtgcggcggcgcgcgcaggccggcctctgtgtgtgcgccagcagcgagccggtgtgcggcagcgacgccaacacctacgccaacctgtgccagctgcgcgccgccagccgccgctccgagaggctgcaccggccgccggtcatcgtcctgcagcgcggagcctgcggccaagggcaggaagatcccaacagtttgcgccataaatataactttatcgcggacgtggtggagaagatcgcccctgccgtggttcatatcgaattgtttcgcaagcttccgttttctaaacgagaggtgccggtggctagtgggtctgggtttattgtgtcggaagatggactgatcgtgacaaatgcccacgtggtgaccaacaagcaccgggtcaaagttgagctgaagaacggtgccacttacgaagccaaaatcaaggatgtggatgagaaagcagacatcgcactcatcaaaattgaccaccagggcaagctgcctgtcctgctgcttggccgctcctcagagctgcggccgggagagttcgtggtcgccatcggaagcccgttttcccttcaaaacacagtcaccaccgggatcgtgagcaccacccagcgaggcggcaaagagctggggctccgcaactcagacatggactacatccagaccgacgccatcatcaactatggaaactcgggaggcccgttagtaaacctggacggtgaagtgattggaattaacactttgaaagtgacagctggaatctcctttgcaatcccatctgataagattaaaaagttcctcacggagtcccatgaccgacaggccaaaggaaaagccatcaccaagaagaagtatattggtatccgaatgatgtcactcacgtccagcaaagccaaagagctgaaggaccggcaccgggacttcccagacgtgatctcaggagcgtatataattgaagtaattcctgataccccagcagaagctggtggtctcaaggaaaacgacgtcataatcagcatcaatggacagtccgtggtctccgccaatgatgtcagcgacgtcattatcacagtgattcccgaagaaattgacccataggcagaggcatgagctggacttcatgtttccctcaaagactctcccgtggatgacggatgaggactctgggctgctggaataggacactcaagacttttgactgccattttgtttgttcagtggagactccctggccaacagaatccttcttgatagtttgcaggcaaaacaaatgtaatgttgcagatccgcaggcagaagctctgcccttctgtatcctatgtatgcagtgtgctttttcttgccagcttgggccattcttgcttagacagtcagcatttgtctcctcctttaactgagtcatcatcttagtccaactaatgcagtcgatacaatgcgtagatagaagaagccccacgggagccaggatgggactggtcgtgtttgtgcttttctccaagtcagcacccaaaggtcaatgcacagagaccccgggtgggtgagcgctggcttctcaaacggccgaagttgcctcttttaggaatctctttggaattgggagcacgatgactctgagtttgagctattaaagtacttcttacacattg

SEQ ID NO: 295255 - DNA, 2011 bp, Homo sapiens
gcggccgcgcgcactcgcacccgctgcccccgaggccctcctgcactctccccggcgccgctctccggccctcgccctgtccgccgccaccgccgccgccgccagagtcgccatgcagatcccgcgcgccgctcttctcccgctgctgctgctgctgctggcggcgcccgcctcggcgcagctgtcccgggccggccgctcggcgcctttggccgccgggtgcccagaccgctgcgagccggcgcgctgcccgccgcagccggagcactgcgagggcggccgggcccgggacgcgtgcggctgctgcgaggtgtgcggcgcgcccgagggcgccgcgtgcggcctgcaggagggcccgtgcggcgaggggctgcagtgcgtggtgcccttcggggtgccagcctcggccacggtgcggcggcgcgcgcaggccggcctctgtgtgtgcgccagcagcgagccggtgtgcggcagcgacgccaacacctacgccaacctgtgccagctgcgcgccgccagccgccgctccgagaggctgcaccggccgccggtcatcgtcctgcagcgcggagcctgcggccaagggcaggaagatcccaacagtttgcgccataaatataactttatcgcggacgtggtggagaagatcgcccctgccgtggttcatatcgaattgtttcgcaagcttccgttttctaaacgagaggtgccggtggctagtgggtctgggtttattgtgtcggaagatggactgatcgtgacaaatgcccacgtggtgaccaacaagcaccgggtcaaagttgagctgaagaacggtgccacttacgaagccaaaatcaaggatgtggatgagaaagcagacatcgcactcatcaaaattgaccaccagggcaagctgcctgtcctgctgcttggccgctcctcagagctgcggccgggagagttcgtggtcgccatcggaagcccgttttcccttcaaaacacagtcaccaccgggatcgtgagcaccacccagcgaggcggcaaagagctggggctccgcaactcagacatggactacatccagaccgacgccatcatcaactatggaaactcgggaggcccgttagtaaacctggacggtgaagtgattggaattaacactttgaaagtgacagctggaatctcctttgcaatcccatctgataagattaaaaagttcctcacggagtcccatgaccgacaggccaaaggaaaagccatcaccaagaagaagtatattggtatccgaatgatgtcactcacgtccagcaaagccaaagagctgaaggaccggcaccgggacttcccagacgtgatctcaggagcgtatataattgaagtaattcctgataccccagcagaagctggtggtctcaaggaaaacgacgtcataatcagcatcaatggacagtccgtggtctccgccaatgatgtcagcgacgtcattaaaagggaaagcaccctgaacatggtggtccgcaggggtaatgaagatatcatgatcacagtgattcccgaagaaattgacccataggcagaggcatgagctggacttcatgtttccctcaaagactctcccgtggatgacggatgaggactctgggctgctggaataggacactcaagacttttgactgccattttgtttgttcagtggagactccctggccaacagaatccttcttgatagtttgcaggcaaaacaaatgtaatgttgcagatccgcaggcagaagctctgcccttctgtatcctatgtatgcagtgtgctttttcttgccagcttgggccattcttgcttagacaccaggatgggactggtcgtgtttgtgcttttctccaagtcagcacccaaaggtcaatgcacagagaccccgggtgggtgagcgctggcttctcaaacggccgaagttgcctcttttaggaatctctttggaattgggagcacgatgactctgagtttgagctattaaagtacttcttacacattg

SEQ ID NO: 295256 - DNA, 576 bp, Homo sapiens
tctagcaggatcttacgctggcccaatggcagaggcatgagctggacttcatgtttccctcaaagactctcccgtggatgacggatgaggactctgggctgctggaataggacactcaagacttttgactgccattttgtttgttcagtggagactccctggccaacagaatccttcttgatagtttgcaggcaaaacaaatgtaatgttgcagatccgcaggcagaagctctgcccttctgtatcctatgtatgcagtgtgctttttcttgccagcttgggccattcttgcttagacagtcagcatttgtctcctcctttaactgagtcatcatcttagtccaactaatgcagtcgatacaatgcgtagatagaagaagccccacgggagccaggatgggactggtcgtgtttgtgcttttctccaagtcagcacccaaaggtcaatgcacagagaccccgggtgggtgagcgctggcttctcaaacggccgaagttgcctcttttaggaatctctttggaattgggagcacgatgactctgagtttgagctattaaagtacttcttacacattg

SEQ ID NO: 295257 - DNA, 2103 bp, Homo sapiens
gcggccgcgcgcactcgcacccgctgcccccgaggccctcctgcactctccccggcgccgctctccggccctcgccctgtccgccgccaccgccgccgccgccagagtcgccatgcagatcccgcgcgccgctcttctcccgctgctgctgctgctgctggcggcgcccgcctcggcgcagctgtcccgggccggccgctcggcgcctttggccgccgggtgcccagaccgctgcgagccggcgcgctgcccgccgcagccggagcactgcgagggcggccgggcccgggacgcgtgcggctgctgcgaggtgtgcggcgcgcccgagggcgccgcgtgcggcctgcaggagggcccgtgcggcgaggggctgcagtgcgtggtgcccttcggggtgccagcctcggccacggtgcggcggcgcgcgcaggccggcctctgtgtgtgcgccagcagcgagccggtgtgcggcagcgacgccaacacctacgccaacctgtgccagctgcgcgccgccagccgccgctccgagaggctgcaccggccgccggtcatcgtcctgcagcgcggagcctgcggccaagggcaggaagatcccaacagtttgcgccataaatataactttatcgcggacgtggtggagaagatcgcccctgccgtggttcatatcgaattgtttcgcaagcttccgttttctaaacgagaggtgccggtggctagtgggtctgggtttattgtgtcggaagatggactgatcgtgacaaatgcccacgtggtgaccaacaagcaccgggtcaaagttgagctgaagaacggtgccacttacgaagccaaaatcaaggatgtggatgagaaagcagacatcgcactcatcaaaattgaccaccagggcaagctgcctgtcctgctgcttggccgctcctcagagctgcggccgggagagttcgtggtcgccatcggaagcccgttttcccttcaaaacacagtcaccaccgggatcgtgagcaccacccagcgaggcggcaaagagctggggctccgcaactcagacatggactacatccagaccgacgccatcatcaactatggaaactcgggaggcccgttagtaaacctggacggtgaagtgattggaattaacactttgaaagtgacagctggaatctcctttgcaatcccatctgataagattaaaaagttcctcacggagtcccatgaccgacaggccaaaggaaaagccatcaccaagaagaagtatattggtatccgaatgatgtcactcacgtccagcaaagccaaagagctgaaggaccggcaccgggacttcccagacgtgatctcaggagcgtatataattgaagtaattcctgataccccagcagaagctggtggtctcaaggaaaacgacgtcataatcagcatcaatggacagtccgtggtctccgccaatgatgtcagcgacgtcattaaaagggaaagcaccctgaacatggtggtccgcaggggtaatgaagatatcatgatcacagtgattcccgaagaaattgacccataggcagaggcatgagctggacttcatgtttccctcaaagactctcccgtggatgacggatgaggactctgggctgctggaataggacactcaagacttttgactgccattttgtttgttcagtggagactccctggccaacagaatccttcttgatagtttgcaggcaaaacaaatgtaatgttgcagatccgcaggcagaagctctgcccttctgtatcctatgtatgcagtgtgctttttcttgccagcttgggccattcttgcttagacagtcagcatttgtctcctcctttaactgagtcatcatcttagtccaactaatgcagtcgatacaatgcgtagatagaagaagccccacgggagccaggatgggactggtcgtgtttgtgcttttctccaagtcagcacccaaaggtcaatgcacagagaccccgggtgggtgagcgctggcttctcaaacggccgaagttgcctcttttaggaatctctttggaattgggagcacgatgactctgagtttgagctattaaagtacttcttacacattg

SEQ ID NO: 295258 - DNA, 1989 bp, Homo sapiens
gcggccgcgcgcactcgcacccgctgcccccgaggccctcctgcactctccccggcgccgctctccggccctcgccctgtccgccgccaccgccgccgccgccagagtcgccatgcagatcccgcgcgccgctcttctcccgctgctgctgctgctgctggcggcgcccgcccgggacgcgtgcggctgctgcgaggtgtgcggcgcgcccgagggcgccgcgtgcggcctgcaggagggcccgtgcggcgaggggctgcagtgcgtggtgcccttcggggtgccagcctcggccacggtgcggcggcgcgcgcaggccggcctctgtgtgtgcgccagcagcgagccggtgtgcggcagcgacgccaacacctacgccaacctgtgccagctgcgcgccgccagccgccgctccgagaggctgcaccggccgccggtcatcgtcctgcagcgcggagcctgcggccaagggcaggaagatcccaacagtttgcgccataaatataactttatcgcggacgtggtggagaagatcgcccctgccgtggttcatatcgaattgtttcgcaagcttccgttttctaaacgagaggtgccggtggctagtgggtctgggtttattgtgtcggaagatggactgatcgtgacaaatgcccacgtggtgaccaacaagcaccgggtcaaagttgagctgaagaacggtgccacttacgaagccaaaatcaaggatgtggatgagaaagcagacatcgcactcatcaaaattgaccaccagggcaagctgcctgtcctgctgcttggccgctcctcagagctgcggccgggagagttcgtggtcgccatcggaagcccgttttcccttcaaaacacagtcaccaccgggatcgtgagcaccacccagcgaggcggcaaagagctggggctccgcaactcagacatggactacatccagaccgacgccatcatcaactatggaaactcgggaggcccgttagtaaacctggacggtgaagtgattggaattaacactttgaaagtgacagctggaatctcctttgcaatcccatctgataagattaaaaagttcctcacggagtcccatgaccgacaggccaaaggaaaagccatcaccaagaagaagtatattggtatccgaatgatgtcactcacgtccagcaaagccaaagagctgaaggaccggcaccgggacttcccagacgtgatctcaggagcgtatataattgaagtaattcctgataccccagcagaagctggtggtctcaaggaaaacgacgtcataatcagcatcaatggacagtccgtggtctccgccaatgatgtcagcgacgtcattaaaagggaaagcaccctgaacatggtggtccgcaggggtaatgaagatatcatgatcacagtgattcccgaagaaattgacccataggcagaggcatgagctggacttcatgtttccctcaaagactctcccgtggatgacggatgaggactctgggctgctggaataggacactcaagacttttgactgccattttgtttgttcagtggagactccctggccaacagaatccttcttgatagtttgcaggcaaaacaaatgtaatgttgcagatccgcaggcagaagctctgcccttctgtatcctatgtatgcagtgtgctttttcttgccagcttgggccattcttgcttagacagtcagcatttgtctcctcctttaactgagtcatcatcttagtccaactaatgcagtcgatacaatgcgtagatagaagaagccccacgggagccaggatgggactggtcgtgtttgtgcttttctccaagtcagcacccaaaggtcaatgcacagagaccccgggtgggtgagcgctggcttctcaaacggccgaagttgcctcttttaggaatctctttggaattgggagcacgatgactctgagtttgagctattaaagtacttcttacacattg

SEQ ID NO: 295259 - DNA, 1502 bp, Homo sapiens
gtcgatctctagcaggatccccactgattgcggtcttcatagtcgatcgcccctgccgtggttcatatcgacttgtttcgcacgcttccgttttctaaacgagaggtgccggtggctagtgggtctgggtttattgtgtcggaagatggactgatcgtgacaaatgcccacgtggtgaccaacaagcaccgggtcaaagttgagctgaagaacggtgccacttacgaagccaaaatcaaggatgtggatgagaaagcagacatcgcactcatcaaaattgaccaccagggcaagctgcctgtcctgctgcttggccgctcctcagagctgcggccgggagagttcgtggtcgccatcggaagcccgttttcccttcaaaacacagtcaccaccgggatcgtgagcaccacccagcgaggcggcaaagagctggggctccgcaactcagacatggactacatccagaccgacgccatcatcaactatggaaactcgggaggcccgttagtaaacctggacggtgaagtgattggaattaacactttgaaagtgacagctggaatctcctttgcaatcccatctgataagattaaaaagttcctcacggagtcccatgaccgacaggccaaaggaaaagccatcaccaagaagaagtatattggtatccgaatgatgtcactcacgtccagcaaagccaaagagctgaaggaccggcaccgggacttcccagacgtgatctcaggagcgtatataattgaagtaattcctgataccccagcagaagctggtggtctcaaggaaaacgacgtcataatcagcatcaatggacagtccgtggtctccgccaatgatgtcagcgacgtcattaaaagggaaagcaccctgaacatggtggtccgcaggggtaatgaagatatcatgatcacagtgattcccgaagaaattgacccataggcagaggcatgagctggacttcatgtttccctcaaagactctcccgtggatgacggatgaggactctgggctgctggaataggacactcaagacttttgactgccattttgtttgttcagtggagactccctggccaacagaatccttcttgatagtttgcaggcaaaacaaatgtaatgttgcagatccgcaggcagaagctctgcccttctgtatcctatgtatgcagtgtgctttttcttgccagcttgggccattcttgcttagacagtcagcatttgtctcctcctttaactgagtcatcatcttagtccaactaatgcagtcgatacaatgcgtagatagaagaagccccacgggagccaggatgggactggtcgtgtttgtgcttttctccaagtcagcacccaaaggtcaatgcacagagaccccgggtgggtgagcgctggcttctcaaacggccgaagttgcctcttttaggaatctctttggaattgggagcacgatgactctgagtttgagctattaaagtacttcttacacattg

SEQ ID NO: 295260 - DNA, 1232 bp, Homo sapiens
aggagcgggacttcactgtgtccctgcgaaagactctcccgtggatgacggatgaggactctgggctgctggagtaggacactcaagacttttgactgccatttggttggttcagtgcgagactccctggccaacagaatccttcttgatagtttgcaggcaaaacaaatgtaatgttgcagggactacatccagaccgaggccatcatcaactatggaaactcgggaggcgcgttagtaaacctggacggtgaagtgattggaattaacactttgaaagtgacagctggaatctcctttgcaatcccatctgataagattaaaaagttcctcacggagtcccatgaccgacaggccaaaggaaaagccatcaccaagaagaagtatattggtatccgaatgatgtcactcacgtccagcaaagccaaagagctgaaggaccggcaccgggacttcccagacgtgatctcaggagcgtatataattgaagtaattcctgataccccagcagaagctggtggtctcaaggaaaacgacgtcataatcagcatcaatggacagtccgtggtctccgccaatgatgtcagcgacgtcattaaaagggaaagcaccctgaacatggtggtccgcaggggtaatgaagatatcatgatcacagtgattcccgaagaaattgacccataggcagaggcatgagctggacttcatgtttccctcaaagactctcccgtggatgacggatgaggactctgggctgctggaataggacactcaagacttttgactgccattttgtttgttcagtggagactccctggccaacagaatccttcttgatagtttgcaggcaaaacaaatgtaatgttgcagatccgcaggcagaagctctgcccttctgtatcctatgtatgcagtgtgctttttcttgccagcttgggccattcttgcttagacagtcagcatttgtctcctcctttaactgagtcatcatcttagtccaactaatgcagtcgatacaatgcgtagatagaagaagccccacgggagccaggatgggactggtcgtgtttgtgcttttctccaagtcagcacccaaaggtcaatgcacagagaccccgggtgggtgagcgctggcttctcaaacggccgaagttgcctcttttaggaatctctttggaattgggagcacgatgactctgagtttgagctattaaagtacttcttacacattg

SEQ ID NO: 295261 - DNA, 1773 bp, Homo sapiens
  misc_feature (1606)..(1606): n is a, c, g, or t
gcggccgcgcgcactcgcacccgctgcccccgaggccctcctgcactctccccggcgccgctctccggccctcgccctgtccgccgccaccgccgccgccgccagagtcgccatgcagatcccgcgcgccgctcttctcccgctgctgctgctgctgctggcggcgcccgcctcggcgcagctgtcccgggccggccgctcggcgcctttggccgccgggtgcccagaccgctgcgagccggcgcgctgcccgccgcagccggagcactgcgagggcggccgggcccgggacgcgtgcggctgctgcgaggtgtgcggcgcgcccgagggcgccgcgtgcggcctgcaggagggcccgtgcggcgaggggctgcagtgcgtggtgcccttcggggtgccagcctcggccacggtgcggcggcgcgcgcaggccggcctctgtgtgtgcgccagcagcgagccggtgtgcggcagcgacgccaacacctacgccaacctgtgccagctgcgcgccgccagccgccgctccgagaggctgcaccggccgccggtcatcgtcctgcagcgcggagcctgcggccaagggcaggaagatcccaacagtttgcgccataaatataactttatcgcggacgtggtggagaagatcgcccctgccgtggttcatatcgaattgtttcgcaagcttccgttttctaaacgagaggtgccggtggctagtgggtctgggtttattgtgtcggaagatggactgatcgtgacaaatgcccacgtggtgaccaacaagcaccgggtcaaagttgagctgaagaacggtgccacttacgaagccaaaatcaaggatgtggatgagaaagcagacatcgcactcatcaaaattgaccaccagggcaagctgcctgtcctgctgcttggccgctcctcagagctgcggccgggagagttcgtggtcgccatcggaagcccgttttcccttcaaaacacagtcaccaccgggatcgtgagcaccacccagcgaggcggcaaagagctggggctccgcaactcagacatggactacatccagaccgacgccatcatcaactatggaaactcgggaggcccgttagtaaacctggacggtgaagtgattggaattaacactttgaaagtgacagctggaatctcctttgcaatcccatctgataagattaaaaagttcctcacggagtcccatgaccgacaggccaaaggaaaagccatcaccaagaagaagtatattggtatccgaatgatgtcactcacgtccaggcaaagccaagagctgaaggacggcaccgggactttccagaagtgacatcagagacggaattatgaagtactccggtacccagaaaaagggggggctcaggaacggggactaacacacaagggcaccggggtcccgcaatgtttgggggcttaagggaagccccaaagtgggccgggtaagaaataatcaggaccccaaaagtacacgggggagggaggtctcccacacgcgaagagaagagggcaaacacaagacgagtggaggaccaccaattgaaggtcgcccctttttgtcacgatatatgtgatgcgtggncagccacgacagacagcgcgacgagaataaacgagtcgatgatagaaacacacaacgccacgacagtatgatagaacgaagatctgatactacaagaaataacgggtagcaactaagatatgcatcgaacaatcaaccagggatactgagcacaatgaggacactcc

SEQ ID NO: 295262 - DNA, 4625 bp, Homo sapiens
acgcgccggcggaggagtggcgcgcggaggagtggcgcgctgagacgccgctcgaagcgccgagtcgcggggcagcagaggcgtaaggagtaggcggggcgagccggctgggctcagggtccaccagctcacccgggtcgaggggcaatctgaggcgactggtgacgcgcttatccacttccctcctcccgcctccccccggggtggcgctcgctggtgacgtagtgagtgtgatggccgccgcgaggccgggaaggtgaagtcaggactggtggagtcaacacagtcaatcaatagccaacctcaacctgagacaggacagaagagaactcagaatctttttgtcttttggacttcagccatgtccatgatgcctaccctgtgaagatctctcaccatccaaaaaacgcaatgtccctgctcttctctcgatgcaactctatcgtcacagtcaagaaaaataagagacacatggctgaggtgaatgcatccccacttaagcactttgtcactgccaagaagaagatcaatggcatttttgagcagctgggggcctacatccaggagagcgccaccttccttgaagacacgtacaggaatgcagaactggaccccgttaccacagaagaacaggttctggacgtcaaaggttacctatccaaagtgagaggcatcagtgaggtgctggctcggaggcacatgaaagtggctttttttggccggacgagcaatgggaagagcaccgtgatcaatgccatgctctgggacaaagttctgccctctgggattggccacaccaccaattgcttcctgcgggtagagggcacagatggccatgaggcctttctccttaccgagggctcagaggaaaagaggagtgccaagactgtgaaccagctggcccatgccctccaccaggacaagcagctccatgccggcagcctagtgagtgtgatgtggcccaactctaagtgcccacttctgaaggatgacctcgttttgatggacagccctggtattgatgtcaccacagagctggacagctggattgacaagttttgtctggatgctgatgtgtttgtgctggtggccaactcagagtccaccctgatgcagacggaaaagcacttcttccacaaggtgagtgagcgtctctcccggccaaacatcttcatcctgaacaaccgctgggatgcatctgcctcagagcccgagtacatggaggaggtgcggcggcagcacatggagcgttgtaccagcttcctggtggatgagctgggcgtggtggatcgatcccaggccggggaccgcatcttctttgtgtctgctaaggaggtgctcaacgccaggattcagaaagcccagggcatgcctgaaggagggggcgctctcgcagaaggctttcaagtgaggatgtttgagtttcagaattttgagaggagatttgaggagtgcatctcccagtctgcagtgaagaccaagtttgagcagcacacggtccgggccaagcagattgcagaggcggttcgactcatcatggactccctgcacatggcggctcgggagcagcaggtttactgcgaggaaatgcgtgaagagcggcaagaccgactgaaatttattgacaaacagctggagctcttggctcaagactataagctgcgaattaagcagattacggaggaagtggagaggcaggtgtcgactgcaatggccgaggagatcaggcgcctctctgtactggtggacgattaccagatggacttccacccttctccagtagtcctcaaggtttataagaatgagctgcaccgccacatagaggaaggactgggtcgaaacatgtctgaccgctgctccacggccatcaccaactccctgcagaccatgcagcaggacatgatagatggcttgaaacccctccttcctgtgtctgtgcggagtcagatagacatgctggtcccacgccagtgcttctccctcaactatgacctaaactgtgacaagctgtgtgctgacttccaggaagacattgagttccatttctctctcggatggaccatgctggtgaataggttcctgggccccaagaacagccgtcgggccttgatgggctacaatgaccaggtccagcgtcccatccctctgacgccagccaaccccagcatgcccccactgccacagggctcgctcacccaggaggagttcatggtttccatggttaccggcctggcctccttgacatccaggacctccatgggcattcttgttgttggaggagtggtgtggaaggcagtgggctggcggctcattgccctctcctttgggctctatggcctcctctacgtctatgagcgtctgacctggaccaccaaggccaaggagagggccttcaagcgccagtttgtggagcatgccagcgagaagctgcagcttgtcatcagctacactggctccaactgcagccaccaagtccagcaggaactgtctgggacctttgctcatctgtgtcagcaagttgacgtcacccgggagaacctggagcaggaaattgccgccatgaacaagaaaattgaggttcttgactcacttcagagcaaagcaaagctgctcaggaataaagccggttggttggacagtgagctcaacatgttcacacaccagtacctgcagcccagcagatagtgggcacctgaggcggagtctgcgtggagaggggcggtgctgccagccctaagtgccgtgtgggctcccccaggggcacgtgtggctcctgccccctggccactgccaagagaatgaagcacccagtctcgtaccattttgagccctccagcactacttattttcccccacctttgcctgctgttgctggaagagctggctcatacccccaaaggacactttcagcgacagctatggacagcatggtaccaaggagttaagttgaggctttttccagctttctctggttcatttgattgcttgataaggcctcaggatctcagcattgcacaatgcctcatggaagcctttgagggtatcacacagacacccccaccttcctccagcctgtgcgcacctgccctccttgcagcccagcacacctgcaggtgtaagggacgattggagtttcttcccagagagtctgtcccagaaggactgtggcttgtgtgtgtccatctcgcctgttggctcagtgcttcatcccatttgcagagcctcagacacgtcttggtggtgaggctcagttacccctgggcttaggctgaggcgggccctgtgctgggggtggtagaaaggatgctgctgaggcagctggaggagtgggagtagctcagaggggagggctgttggatgtatggggagctggcagagcaggtggcagtcactgggacaaggagggacttgcctctcttctcattattgtgtcctttgctttagtgtcagtcctggacttgtgcaggcctgttttgtgtagatctgttttggaagatggcatggtctaggtggttgaaggatgtagtagaaggatggatggtggaaggtggggacgttggtggctggctgaggtgcatgggccccacacaggacagctggagaatgggccgtccacttggcctcgttctgcgaggggctcatgggtctgagagcccccacccactaggcttgattgcatccctgttgtgccctttaagagacatgtttccaccccacccccaaccttgtcccaagtgccctggactaaatttcctgtgccagtgactgcagttggccaagggacaatgtggaaaacccagtgtccatctttccaccctccctgatctccagaaccttcgactgacccccttgtctttatgctgatgttgagttttgggattgttactggttgaagtgggggcagatgcctgtcaccaaggtgttgactgtgtgagaaaagcagtttgggtgacaaatcctgtgtggcacaagttggatcgcttcctagaaataagcaacacctctcccaaaaagcagcccacaaggcaggggcccagcagcccagccatcactcatctttgaggaaatgagttggtagcctctgtgcactgtttggtggccacatcacaggtgatgtcctgttcacatacctgcttgtatttaaagccctcagtctgtcctgttgtgtggggcgaagtgatggactctgccaggtggacatgctgtgggtggatgttcccggcgtgtgccgggcctgaatggacaggggccacttcacagcatgtcagggaaaatcactgtcacacaattccaatggattttgtgctctttttgaaaaaaaaaaattctttagcgtaaacatgaattttttttcaatgtagcccctggggaatgaatgaaattttgagcttcttcaatacgtaaaattaaatttataccactgagggagagaccctttctgaaagaagtatggccaaaagcactttaatgctgctgacattgttgtttttatgttcatttgctggagcgcaagacgtgctgacacagtgagttttctctgatgtatttaaggtgatgtatttgcttgagttactcctgtatcattgctcataatattggaaactaaaataaaacctagttggaaa

SEQ ID NO: 295263 - DNA, 1912 bp, Homo sapiens
acgcgccggcggaggagtggcgcgcggaggagtggcgcgctgagacgccgctcgaagcgccgagtcgcggggcagcagaggcgtaaggagtaggcggggcgagccggctgggctcagggtccaccagctcacccgggtcgaggggcaatctgaggcgactggtgacgcgcttatccacttccctcctcccgcctccccccggggtggcgctcgctggtgacgtagtgagtgtgatggccgccgcgaggccgggaaggtgaagtcaggactggtggagtcaacacagtcaatcaatagccaacctcaacctgagacaggacagaagagaactcagaatctttttgtcttttggacttcagccatgtccatgatgcctaccctgtgaagatctctcaccatccaaaaaacgcaatgtccctgctcttctctcgatgcaactctatcgtcacagtcaagaaaaataagagacacatggctgaggtgaatgcatccccacttaagcactttgtcactgccaagaagaagatcaatggcatttttgagcagctgggggcggggcgctctcgcagaaggctttcaagtgaggatgtttgagtttcagaattttgagaggagatttgaggagtgcatctcccagtctgcagtgaagaccaagtttgagcagcacacggtccgggccaagcagattgcagaggcggttcgactcatcatggactccctgcacatggcggctcgggagcagcaggtttactgcgaggaaatgcgtgaagagcggcaagaccgactgaaatttattgacaaacagctggagctcttggctcaagactataagctgcgaattaagcagattacggaggaagtggagaggcaggtgtcgactgcaatggccgaggagatcaggcgcctctctgtactggtggacgattaccagatggacttccacccttctccagtagtcctcaaggtttataagaatgagctgcaccgccacatagaggaaggactgggtcgaaacatgtctgaccgctgctccacggccatcaccaactccctgcagaccatgcagcaggacatgatagatggcttgaaacccctccttcctgtgtctgtgcggagtcagatagacatgctggtcccacgccagtgcttctccctcaactatgacctaaactgtgacaagctgtgtgctgacttccaggaagacattgagttccatttctctctcggatggaccatgctggtgaataggttcctgggccccaagaacagccgtcgggccttgatgggctacaatgaccaggtccagcgtcccatccctctgacgccagccaaccccagcatgcccccactgccacagggctcgctcacccaggaggagttcatggtttccatggttaccggcctggcctccttgacatccaggacctccatgggcattcttgttgttggaggagtggtgtggaaggcagtgggctggcggctcattgccctctcctttgggctctatggcctcctctacgtctatgagcgtctgacctggaccaccaaggccaaggagagggccttcaagcgccagtttgtggagcatgccagcgagaagctgcagcttgtcatcagctacactggctccaactgcagccaccaagtccagcaggaactgtctgggacctttgctcatctgtgtcagcaagttgacgtcacccgggagaacgggagagaccctttctgaaagaagtatggccaaaagcactttaatgctgctgacattgttgtttttatgttcatttgctggagcgcaagacgtgctgacacagtgagttttctctgatgtatttaaggtgatgtatttgcttgagttactcctgtatcattgctcataatattggaaactaaaataaaacctagttggaaa

SEQ ID NO: 295264 - DNA, 1034 bp, Homo sapiens
acgcgccggcggaggagtggcgcgcggaggagtggcgcgctgagacgccgctcgaagcgccgagtcgcggggcagcagaggcgtaaggagtaggcggggcgagccggctgggctcagggtccaccagctcacccgggtcgaggggcaatctgaggcgactgcgcaatgtccctgctcttctctcgatgcaactctatcgtcacagtcaagaaaaataagagacacatggctgaggtgaatgcatccccacttaagcactttgtcactgccaagaagaagatcaatggcatttttgagcagctgggggcctacatccaggagagcgccaccttccttgaagacacgtacaggaatgcagaactggaccccgttaccacagaagaacaggttctggacgtcaaaggttacctatccaaagtgagaggcatcagtgaggtgctggctcggaggcacatgaaagtggctttttttggccggacgagcaatgggaagagcaccgtgatcaatgccatgctctgggacaaagttctgccctctgggattggccacaccaccaattgcttcctgcgggtagagggcacagatggccatgaggcctttctccttaccgagggctcagaggaaaagaggagtgccaagactgtgaaccagctggcccatgccctccaccaggacaagcagctccatgccggcagcctagtgagtgtgatgtggcccaactctaagtgcccacttctgaaggatgacctcgttttgatggacagccctggtattgatgtcaccacagagctggacagctggattgacaagttttgtctggatgctgatgtgtttgtgctggtggccaactcagagtccaccctgatgcagacggaaaagcacttcttccacaaggtgagtgagcgtctctcccggccaaacatcttcatcctgaacaaccgctgggatgcatctgcctcagagcccgagtacatggaggagggacggggagacatggagggtgaacattctgggataaagggatggggatgtca

SEQ ID NO: 295265 - DNA, 4812 bp, Homo sapiens
tcaagtattccagccctctgtcccacagaatagagaattaagtgagatactttacagtagctgaacacattggctttcagtcagttcttctgttcctcaatagtcagctgttccacagtcctcaagcccagttttgttcctagttttgctctgtcctcttctcccctctctggatgtacctttcccagggctcctgcagggacctccgtggtgcctcaaacccgcacatggcggaatacgtgtgcacagtcaggattggtcccacacctctgcgtttttttccccagggcacttcctcacatgccagcgcaactccccaatacctcaatgagtaagcttccctcagggatgagtttgtttggcttgaaacctgattagacatgttttgtacaccagtgttttttttttttggacaccggatccatctcccttttcggttttctaataagtcaggactggtggagtcaacacagtcaatcaatagccaacctcaacctgagacaggacagaagagaactcagaatctttttgtcttttggacttcagccatgtccatgatgcctaccctgtgaagatctctcaccatccaaaaaacgcaatgtccctgctcttctctcgatgcaactctatcgtcacagtcaagaaaaataagagacacatggctgaggtgaatgcatccccacttaagcactttgtcactgccaagaagaagatcaatggcatttttgagcagctgggggcctacatccaggagagcgccaccttccttgaagacacgtacaggaatgcagaactggaccccgttaccacagaagaacaggttctggacgtcaaaggttacctatccaaagtgagaggcatcagtgaggtgctggctcggaggcacatgaaagtggctttttttggccggacgagcaatgggaagagcaccgtgatcaatgccatgctctgggacaaagttctgccctctgggattggccacaccaccaattgcttcctgcgggtagagggcacagatggccatgaggcctttctccttaccgagggctcagaggaaaagaggagtgccaagactgtgaaccagctggcccatgccctccaccaggacaagcagctccatgccggcagcctagtgagtgtgatgtggcccaactctaagtgcccacttctgaaggatgacctcgttttgatggacagccctggtattgatgtcaccacagagctggacagctggattgacaagttttgtctggatgctgatgtgtttgtgctggtggccaactcagagtccaccctgatgcagacggaaaagcacttcttccacaaggtgagtgagcgtctctcccggccaaacatcttcatcctgaacaaccgctgggatgcatctgcctcagagcccgagtacatggaggaggtgcggcggcagcacatggagcgttgtaccagcttcctggtggatgagctgggcgtggtggatcgatcccaggccggggaccgcatcttctttgtgtctgctaaggaggtgctcaacgccaggattcagaaagcccagggcatgcctgaaggagggggcgctctcgcagaaggctttcaagtgaggatgtttgagtttcagaattttgagaggagatttgaggagtgcatctcccagtctgcagtgaagaccaagtttgagcagcacacggtccgggccaagcagattgcagaggcggttcgactcatcatggactccctgcacatggcggctcgggagcagcaggtttactgcgaggaaatgcgtgaagagcggcaagaccgactgaaatttattgacaaacagctggagctcttggctcaagactataagctgcgaattaagcagattacggaggaagtggagaggcaggtgtcgactgcaatggccgaggagatcaggcgcctctctgtactggtggacgattaccagatggacttccacccttctccagtagtcctcaaggtttataagaatgagctgcaccgccacatagaggaaggactgggtcgaaacatgtctgaccgctgctccacggccatcaccaactccctgcagaccatgcagcaggacatgatagatggcttgaaacccctccttcctgtgtctgtgcggagtcagatagacatgctggtcccacgccagtgcttctccctcaactatgacctaaactgtgacaagctgtgtgctgacttccaggaagacattgagttccatttctctctcggatggaccatgctggtgaataggttcctgggccccaagaacagccgtcgggccttgatgggctacaatgaccaggtccagcgtcccatccctctgacgccagccaaccccagcatgcccccactgccacagggctcgctcacccaggaggagttcatggtttccatggttaccggcctggcctccttgacatccaggacctccatgggcattcttgttgttggaggagtggtgtggaaggcagtgggctggcggctcattgccctctcctttgggctctatggcctcctctacgtctatgagcgtctgacctggaccaccaaggccaaggagagggccttcaagcgccagtttgtggagcatgccagcgagaagctgcagcttgtcatcagctacactggctccaactgcagccaccaagtccagcaggaactgtctgggacctttgctcatctgtgtcagcaagttgacgtcacccgggagaacctggagcaggaaattgccgccatgaacaagaaaattgaggttcttgactcacttcagagcaaagcaaagctgctcaggaataaagccggttggttggacagtgagctcaacatgttcacacaccagtacctgcagcccagcagatagtgggcacctgaggcggagtctgcgtggagaggggcggtgctgccagccctaagtgccgtgtgggctcccccaggggcacgtgtggctcctgccccctggccactgccaagagaatgaagcacccagtctcgtaccattttgagccctccagcactacttattttcccccacctttgcctgctgttgctggaagagctggctcatacccccaaaggacactttcagcgacagctatggacagcatggtaccaaggagttaagttgaggctttttccagctttctctggttcatttgattgcttgataaggcctcaggatctcagcattgcacaatgcctcatggaagcctttgagggtatcacacagacacccccaccttcctccagcctgtgcgcacctgccctccttgcagcccagcacacctgcaggtgtaagggacgattggagtttcttcccagagagtctgtcccagaaggactgtggcttgtgtgtgtccatctcgcctgttggctcagtgcttcatcccatttgcagagcctcagacacgtcttggtggtgaggctcagttacccctgggcttaggctgaggcgggccctgtgctgggggtggtagaaaggatgctgctgaggcagctggaggagtgggagtagctcagaggggagggctgttggatgtatggggagctggcagagcaggtggcagtcactgggacaaggagggacttgcctctcttctcattattgtgtcctttgctttagtgtcagtcctggacttgtgcaggcctgttttgtgtagatctgttttggaagatggcatggtctaggtggttgaaggatgtagtagaaggatggatggtggaaggtggggacgttggtggctggctgaggtgcatgggccccacacaggacagctggagaatgggccgtccacttggcctcgttctgcgaggggctcatgggtctgagagcccccacccactaggcttgattgcatccctgttgtgccctttaagagacatgtttccaccccacccccaaccttgtcccaagtgccctggactaaatttcctgtgccagtgactgcagttggccaagggacaatgtggaaaacccagtgtccatctttccaccctccctgatctccagaaccttcgactgacccccttgtctttatgctgatgttgagttttgggattgttactggttgaagtgggggcagatgcctgtcaccaaggtgttgactgtgtgagaaaagcagtttgggtgacaaatcctgtgtggcacaagttggatcgcttcctagaaataagcaacacctctcccaaaaagcagcccacaaggcaggggcccagcagcccagccatcactcatctttgaggaaatgagttggtagcctctgtgcactgtttggtggccacatcacaggtgatgtcctgttcacatacctgcttgtatttaaagccctcagtctgtcctgttgtgtggggcgaagtgatggactctgccaggtggacatgctgtgggtggatgttcccggcgtgtgccgggcctgaatggacaggggccacttcacagcatgtcagggaaaatcactgtcacacaattccaatggattttgtgctctttttgaaaaaaaaaaattctttagcgtaaacatgaattttttttcaatgtagcccctggggaatgaatgaaattttgagcttcttcaatacgtaaaattaaatttataccactgagggagagaccctttctgaaagaagtatggccaaaagcactttaatgctgctgacattgttgtttttatgttcatttgctggagcgcaagacgtgctgacacagtgagttttctctgatgtatttaaggtgatgtatttgcttgagttactcctgtatcattgctcataatattggaaactaaaataaaacctagttggaaa

SEQ ID NO: 295266 - DNA, 4880 bp, Homo sapiens
tcaagtattccagccctctgtcccacagaatagagaattaagtgagatactttacagtagctgaacacattggctttcagtcagttcttctgttcctcaatagtcagctgttccacagtcctcaagcccagttttgttcctagttttgctctgtcctcttctcccctctctggatgtacctttcccagggctcctgcagggacctccgtggtgcctcaaacccgcacatggcggaatacgtgtgcacagtcaggattggtcccacacctctgcgtttttttccccagggcacttcctcacatgccagcgcaactccccaatacctcaatgagtaagcttccctcagggatgagtttgtttggcttgaaacctgattagacatgttttgtacaccagtgttttttttttttggacaccggatccatctcccttttcggttttctaataagtcaggactggtggagtcaacacagtcaatcaatagccaacctcaacctgagacaggacagaagagaactcagaatctttttgtcttttggacttcagccatgtccatgatgcctaccctgtgaagatctctcaccatccaaaaaattgtgccagcagacgatccgtggatccattttattttccctgctaggagttgctgtacataacactggcgcaatgtccctgctcttctctcgatgcaactctatcgtcacagtcaagaaaaataagagacacatggctgaggtgaatgcatccccacttaagcactttgtcactgccaagaagaagatcaatggcatttttgagcagctgggggcctacatccaggagagcgccaccttccttgaagacacgtacaggaatgcagaactggaccccgttaccacagaagaacaggttctggacgtcaaaggttacctatccaaagtgagaggcatcagtgaggtgctggctcggaggcacatgaaagtggctttttttggccggacgagcaatgggaagagcaccgtgatcaatgccatgctctgggacaaagttctgccctctgggattggccacaccaccaattgcttcctgcgggtagagggcacagatggccatgaggcctttctccttaccgagggctcagaggaaaagaggagtgccaagactgtgaaccagctggcccatgccctccaccaggacaagcagctccatgccggcagcctagtgagtgtgatgtggcccaactctaagtgcccacttctgaaggatgacctcgttttgatggacagccctggtattgatgtcaccacagagctggacagctggattgacaagttttgtctggatgctgatgtgtttgtgctggtggccaactcagagtccaccctgatgcagacggaaaagcacttcttccacaaggtgagtgagcgtctctcccggccaaacatcttcatcctgaacaaccgctgggatgcatctgcctcagagcccgagtacatggaggaggtgcggcggcagcacatggagcgttgtaccagcttcctggtggatgagctgggcgtggtggatcgatcccaggccggggaccgcatcttctttgtgtctgctaaggaggtgctcaacgccaggattcagaaagcccagggcatgcctgaaggagggggcgctctcgcagaaggctttcaagtgaggatgtttgagtttcagaattttgagaggagatttgaggagtgcatctcccagtctgcagtgaagaccaagtttgagcagcacacggtccgggccaagcagattgcagaggcggttcgactcatcatggactccctgcacatggcggctcgggagcagcaggtttactgcgaggaaatgcgtgaagagcggcaagaccgactgaaatttattgacaaacagctggagctcttggctcaagactataagctgcgaattaagcagattacggaggaagtggagaggcaggtgtcgactgcaatggccgaggagatcaggcgcctctctgtactggtggacgattaccagatggacttccacccttctccagtagtcctcaaggtttataagaatgagctgcaccgccacatagaggaaggactgggtcgaaacatgtctgaccgctgctccacggccatcaccaactccctgcagaccatgcagcaggacatgatagatggcttgaaacccctccttcctgtgtctgtgcggagtcagatagacatgctggtcccacgccagtgcttctccctcaactatgacctaaactgtgacaagctgtgtgctgacttccaggaagacattgagttccatttctctctcggatggaccatgctggtgaataggttcctgggccccaagaacagccgtcgggccttgatgggctacaatgaccaggtccagcgtcccatccctctgacgccagccaaccccagcatgcccccactgccacagggctcgctcacccaggaggagttcatggtttccatggttaccggcctggcctccttgacatccaggacctccatgggcattcttgttgttggaggagtggtgtggaaggcagtgggctggcggctcattgccctctcctttgggctctatggcctcctctacgtctatgagcgtctgacctggaccaccaaggccaaggagagggccttcaagcgccagtttgtggagcatgccagcgagaagctgcagcttgtcatcagctacactggctccaactgcagccaccaagtccagcaggaactgtctgggacctttgctcatctgtgtcagcaagttgacgtcacccgggagaacctggagcaggaaattgccgccatgaacaagaaaattgaggttcttgactcacttcagagcaaagcaaagctgctcaggaataaagccggttggttggacagtgagctcaacatgttcacacaccagtacctgcagcccagcagatagtgggcacctgaggcggagtctgcgtggagaggggcggtgctgccagccctaagtgccgtgtgggctcccccaggggcacgtgtggctcctgccccctggccactgccaagagaatgaagcacccagtctcgtaccattttgagccctccagcactacttattttcccccacctttgcctgctgttgctggaagagctggctcatacccccaaaggacactttcagcgacagctatggacagcatggtaccaaggagttaagttgaggctttttccagctttctctggttcatttgattgcttgataaggcctcaggatctcagcattgcacaatgcctcatggaagcctttgagggtatcacacagacacccccaccttcctccagcctgtgcgcacctgccctccttgcagcccagcacacctgcaggtgtaagggacgattggagtttcttcccagagagtctgtcccagaaggactgtggcttgtgtgtgtccatctcgcctgttggctcagtgcttcatcccatttgcagagcctcagacacgtcttggtggtgaggctcagttacccctgggcttaggctgaggcgggccctgtgctgggggtggtagaaaggatgctgctgaggcagctggaggagtgggagtagctcagaggggagggctgttggatgtatggggagctggcagagcaggtggcagtcactgggacaaggagggacttgcctctcttctcattattgtgtcctttgctttagtgtcagtcctggacttgtgcaggcctgttttgtgtagatctgttttggaagatggcatggtctaggtggttgaaggatgtagtagaaggatggatggtggaaggtggggacgttggtggctggctgaggtgcatgggccccacacaggacagctggagaatgggccgtccacttggcctcgttctgcgaggggctcatgggtctgagagcccccacccactaggcttgattgcatccctgttgtgccctttaagagacatgtttccaccccacccccaaccttgtcccaagtgccctggactaaatttcctgtgccagtgactgcagttggccaagggacaatgtggaaaacccagtgtccatctttccaccctccctgatctccagaaccttcgactgacccccttgtctttatgctgatgttgagttttgggattgttactggttgaagtgggggcagatgcctgtcaccaaggtgttgactgtgtgagaaaagcagtttgggtgacaaatcctgtgtggcacaagttggatcgcttcctagaaataagcaacacctctcccaaaaagcagcccacaaggcaggggcccagcagcccagccatcactcatctttgaggaaatgagttggtagcctctgtgcactgtttggtggccacatcacaggtgatgtcctgttcacatacctgcttgtatttaaagccctcagtctgtcctgttgtgtggggcgaagtgatggactctgccaggtggacatgctgtgggtggatgttcccggcgtgtgccgggcctgaatggacaggggccacttcacagcatgtcagggaaaatcactgtcacacaattccaatggattttgtgctctttttgaaaaaaaaaaattctttagcgtaaacatgaattttttttcaatgtagcccctggggaatgaatgaaattttgagcttcttcaatacgtaaaattaaatttataccactgagggagagaccctttctgaaagaagtatggccaaaagcactttaatgctgctgacattgttgtttttatgttcatttgctggagcgcaagacgtgctgacacagtgagttttctctgatgtatttaaggtgatgtatttgcttgagttactcctgtatcattgctcataatattggaaactaaaataaaacctagttggaaa

SEQ ID NO: 295267 - DNA, 4480 bp, Homo sapiens
acgcgccggcggaggagtggcgcgcggaggagtggcgcgctgagacgccgctcgaagcgccgagtcgcggggcagcagaggcgtaaggagtaggcggggcgagccggctgggctcagggtccaccagctcacccgggtcgaggggcaatctgaggcgactggtgacgcgcttatccacttccctcctcccgcctccccccggggtggcgctcgctggtgacgtagtgagtgtgatggccgccgcgaggccgggaaggtgaagcgcaatgtccctgctcttctctcgatgcaactctatcgtcacagtcaagaaaaataagagacacatggctgaggtgaatgcatccccacttaagcactttgtcactgccaagaagaagatcaatggcatttttgagcagctgggggcctacatccaggagagcgccaccttccttgaagacacgtacaggaatgcagaactggaccccgttaccacagaagaacaggttctggacgtcaaaggttacctatccaaagtgagaggcatcagtgaggtgctggctcggaggcacatgaaagtggctttttttggccggacgagcaatgggaagagcaccgtgatcaatgccatgctctgggacaaagttctgccctctgggattggccacaccaccaattgcttcctgcgggtagagggcacagatggccatgaggcctttctccttaccgagggctcagaggaaaagaggagtgccaagactgtgaaccagctggcccatgccctccaccaggacaagcagctccatgccggcagcctagtgagtgtgatgtggcccaactctaagtgcccacttctgaaggatgacctcgttttgatggacagccctggtattgatgtcaccacagagctggacagctggattgacaagttttgtctggatgctgatgtgtttgtgctggtggccaactcagagtccaccctgatgcagacggaaaagcacttcttccacaaggtgagtgagcgtctctcccggccaaacatcttcatcctgaacaaccgctgggatgcatctgcctcagagcccgagtacatggaggaggtgcggcggcagcacatggagcgttgtaccagcttcctggtggatgagctgggcgtggtggatcgatcccaggccggggaccgcatcttctttgtgtctgctaaggaggtgctcaacgccaggattcagaaagcccagggcatgcctgaaggagggggcgctctcgcagaaggctttcaagtgaggatgtttgagtttcagaattttgagaggagatttgaggagtgcatctcccagtctgcagtgaagaccaagtttgagcagcacacggtccgggccaagcagattgcagaggcggttcgactcatcatggactccctgcacatggcggctcgggagcagcaggtttactgcgaggaaatgcgtgaagagcggcaagaccgactgaaatttattgacaaacagctggagctcttggctcaagactataagctgcgaattaagcagattacggaggaagtggagaggcaggtgtcgactgcaatggccgaggagatcaggcgcctctctgtactggtggacgattaccagatggacttccacccttctccagtagtcctcaaggtttataagaatgagctgcaccgccacatagaggaaggactgggtcgaaacatgtctgaccgctgctccacggccatcaccaactccctgcagaccatgcagcaggacatgatagatggcttgaaacccctccttcctgtgtctgtgcggagtcagatagacatgctggtcccacgccagtgcttctccctcaactatgacctaaactgtgacaagctgtgtgctgacttccaggaagacattgagttccatttctctctcggatggaccatgctggtgaataggttcctgggccccaagaacagccgtcgggccttgatgggctacaatgaccaggtccagcgtcccatccctctgacgccagccaaccccagcatgcccccactgccacagggctcgctcacccaggaggagttcatggtttccatggttaccggcctggcctccttgacatccaggacctccatgggcattcttgttgttggaggagtggtgtggaaggcagtgggctggcggctcattgccctctcctttgggctctatggcctcctctacgtctatgagcgtctgacctggaccaccaaggccaaggagagggccttcaagcgccagtttgtggagcatgccagcgagaagctgcagcttgtcatcagctacactggctccaactgcagccaccaagtccagcaggaactgtctgggacctttgctcatctgtgtcagcaagttgacgtcacccgggagaacctggagcaggaaattgccgccatgaacaagaaaattgaggttcttgactcacttcagagcaaagcaaagctgctcaggaataaagccggttggttggacagtgagctcaacatgttcacacaccagtacctgcagcccagcagatagtgggcacctgaggcggagtctgcgtggagaggggcggtgctgccagccctaagtgccgtgtgggctcccccaggggcacgtgtggctcctgccccctggccactgccaagagaatgaagcacccagtctcgtaccattttgagccctccagcactacttattttcccccacctttgcctgctgttgctggaagagctggctcatacccccaaaggacactttcagcgacagctatggacagcatggtaccaaggagttaagttgaggctttttccagctttctctggttcatttgattgcttgataaggcctcaggatctcagcattgcacaatgcctcatggaagcctttgagggtatcacacagacacccccaccttcctccagcctgtgcgcacctgccctccttgcagcccagcacacctgcaggtgtaagggacgattggagtttcttcccagagagtctgtcccagaaggactgtggcttgtgtgtgtccatctcgcctgttggctcagtgcttcatcccatttgcagagcctcagacacgtcttggtggtgaggctcagttacccctgggcttaggctgaggcgggccctgtgctgggggtggtagaaaggatgctgctgaggcagctggaggagtgggagtagctcagaggggagggctgttggatgtatggggagctggcagagcaggtggcagtcactgggacaaggagggacttgcctctcttctcattattgtgtcctttgctttagtgtcagtcctggacttgtgcaggcctgttttgtgtagatctgttttggaagatggcatggtctaggtggttgaaggatgtagtagaaggatggatggtggaaggtggggacgttggtggctggctgaggtgcatgggccccacacaggacagctggagaatgggccgtccacttggcctcgttctgcgaggggctcatgggtctgagagcccccacccactaggcttgattgcatccctgttgtgccctttaagagacatgtttccaccccacccccaaccttgtcccaagtgccctggactaaatttcctgtgccagtgactgcagttggccaagggacaatgtggaaaacccagtgtccatctttccaccctccctgatctccagaaccttcgactgacccccttgtctttatgctgatgttgagttttgggattgttactggttgaagtgggggcagatgcctgtcaccaaggtgttgactgtgtgagaaaagcagtttgggtgacaaatcctgtgtggcacaagttggatcgcttcctagaaataagcaacacctctcccaaaaagcagcccacaaggcaggggcccagcagcccagccatcactcatctttgaggaaatgagttggtagcctctgtgcactgtttggtggccacatcacaggtgatgtcctgttcacatacctgcttgtatttaaagccctcagtctgtcctgttgtgtggggcgaagtgatggactctgccaggtggacatgctgtgggtggatgttcccggcgtgtgccgggcctgaatggacaggggccacttcacagcatgtcagggaaaatcactgtcacacaattccaatggattttgtgctctttttgaaaaaaaaaaattctttagcgtaaacatgaattttttttcaatgtagcccctggggaatgaatgaaattttgagcttcttcaatacgtaaaattaaatttataccactgagggagagaccctttctgaaagaagtatggccaaaagcactttaatgctgctgacattgttgtttttatgttcatttgctggagcgcaagacgtgctgacacagtgagttttctctgatgtatttaaggtgatgtatttgcttgagttactcctgtatcattgctcataatattggaaactaaaataaaacctagttggaaa

SEQ ID NO: 295268 - DNA, 4810 bp, Homo sapiens
acgcgccggcggaggagtggcgcgcggaggagtggcgcgctgagacgccgctcgaagcgccgagtcgcggggcagcagaggcgtaaggagtaggcggggcgagccggctgggctcagggtccaccagctcacccgggtcgaggggcaatctgaggcgactggtgacgcgcttatccacttccctcctcccgcctccccccggggtggcgctcgctggtgacgtagtgagtgtgatggccgccgcgaggccgggaaggtgaagtcaggactggtggagtcaacacagtcaatcaatagccaacctcaacctgagacaggacagaagagaactcagaatctttttgtcttttggacttcagccatgtccatgatgcctaccctgtgaagatctctcaccatccaaaaaacgcaatgtccctgctcttctctcgatgcaactctatcgtcacagtcaagaaaaataagagacacatggctgaggtgaatgcatccccacttaagcactttgtcactgccaagaagaagatcaatggcatttttgagcagctgggggcctacatccaggagagcgccaccttccttgaaggaaactaagacccagaaaggttcttttgcttgaggccacagagctagaaagtggtaagaaccagcttcagaaccaggcagtgttgctcctgagccatcttcttaaccaccacaccgtggggccaccatagaggatctggagctcagcctgtcggctgcagggtgccagaggtggactcgtttaggacacgtacaggaatgcagaactggaccccgttaccacagaagaacaggttctggacgtcaaaggttacctatccaaagtgagaggcatcagtgaggtgctggctcggaggcacatgaaagtggctttttttggccggacgagcaatgggaagagcaccgtgatcaatgccatgctctgggacaaagttctgccctctgggattggccacaccaccaattgcttcctgcgggtagagggcacagatggccatgaggcctttctccttaccgagggctcagaggaaaagaggagtgccaagactgtgaaccagctggcccatgccctccaccaggacaagcagctccatgccggcagcctagtgagtgtgatgtggcccaactctaagtgcccacttctgaaggatgacctcgttttgatggacagccctggtattgatgtcaccacagagctggacagctggattgacaagttttgtctggatgctgatgtgtttgtgctggtggccaactcagagtccaccctgatgcagacggaaaagcacttcttccacaaggtgagtgagcgtctctcccggccaaacatcttcatcctgaacaaccgctgggatgcatctgcctcagagcccgagtacatggaggaggtgcggcggcagcacatggagcgttgtaccagcttcctggtggatgagctgggcgtggtggatcgatcccaggccggggaccgcatcttctttgtgtctgctaaggaggtgctcaacgccaggattcagaaagcccagggcatgcctgaaggagggggcgctctcgcagaaggctttcaagtgaggatgtttgagtttcagaattttgagaggagatttgaggagtgcatctcccagtctgcagtgaagaccaagtttgagcagcacacggtccgggccaagcagattgcagaggcggttcgactcatcatggactccctgcacatggcggctcgggagcagcaggtttactgcgaggaaatgcgtgaagagcggcaagaccgactgaaatttattgacaaacagctggagctcttggctcaagactataagctgcgaattaagcagattacggaggaagtggagaggcaggtgtcgactgcaatggccgaggagatcaggcgcctctctgtactggtggacgattaccagatggacttccacccttctccagtagtcctcaaggtttataagaatgagctgcaccgccacatagaggaaggactgggtcgaaacatgtctgaccgctgctccacggccatcaccaactccctgcagaccatgcagcaggacatgatagatggcttgaaacccctccttcctgtgtctgtgcggagtcagatagacatgctggtcccacgccagtgcttctccctcaactatgacctaaactgtgacaagctgtgtgctgacttccaggaagacattgagttccatttctctctcggatggaccatgctggtgaataggttcctgggccccaagaacagccgtcgggccttgatgggctacaatgaccaggtccagcgtcccatccctctgacgccagccaaccccagcatgcccccactgccacagggctcgctcacccaggaggagttcatggtttccatggttaccggcctggcctccttgacatccaggacctccatgggcattcttgttgttggaggagtggtgtggaaggcagtgggctggcggctcattgccctctcctttgggctctatggcctcctctacgtctatgagcgtctgacctggaccaccaaggccaaggagagggccttcaagcgccagtttgtggagcatgccagcgagaagctgcagcttgtcatcagctacactggctccaactgcagccaccaagtccagcaggaactgtctgggacctttgctcatctgtgtcagcaagttgacgtcacccgggagaacctggagcaggaaattgccgccatgaacaagaaaattgaggttcttgactcacttcagagcaaagcaaagctgctcaggaataaagccggttggttggacagtgagctcaacatgttcacacaccagtacctgcagcccagcagatagtgggcacctgaggcggagtctgcgtggagaggggcggtgctgccagccctaagtgccgtgtgggctcccccaggggcacgtgtggctcctgccccctggccactgccaagagaatgaagcacccagtctcgtaccattttgagccctccagcactacttattttcccccacctttgcctgctgttgctggaagagctggctcatacccccaaaggacactttcagcgacagctatggacagcatggtaccaaggagttaagttgaggctttttccagctttctctggttcatttgattgcttgataaggcctcaggatctcagcattgcacaatgcctcatggaagcctttgagggtatcacacagacacccccaccttcctccagcctgtgcgcacctgccctccttgcagcccagcacacctgcaggtgtaagggacgattggagtttcttcccagagagtctgtcccagaaggactgtggcttgtgtgtgtccatctcgcctgttggctcagtgcttcatcccatttgcagagcctcagacacgtcttggtggtgaggctcagttacccctgggcttaggctgaggcgggccctgtgctgggggtggtagaaaggatgctgctgaggcagctggaggagtgggagtagctcagaggggagggctgttggatgtatggggagctggcagagcaggtggcagtcactgggacaaggagggacttgcctctcttctcattattgtgtcctttgctttagtgtcagtcctggacttgtgcaggcctgttttgtgtagatctgttttggaagatggcatggtctaggtggttgaaggatgtagtagaaggatggatggtggaaggtggggacgttggtggctggctgaggtgcatgggccccacacaggacagctggagaatgggccgtccacttggcctcgttctgcgaggggctcatgggtctgagagcccccacccactaggcttgattgcatccctgttgtgccctttaagagacatgtttccaccccacccccaaccttgtcccaagtgccctggactaaatttcctgtgccagtgactgcagttggccaagggacaatgtggaaaacccagtgtccatctttccaccctccctgatctccagaaccttcgactgacccccttgtctttatgctgatgttgagttttgggattgttactggttgaagtgggggcagatgcctgtcaccaaggtgttgactgtgtgagaaaagcagtttgggtgacaaatcctgtgtggcacaagttggatcgcttcctagaaataagcaacacctctcccaaaaagcagcccacaaggcaggggcccagcagcccagccatcactcatctttgaggaaatgagttggtagcctctgtgcactgtttggtggccacatcacaggtgatgtcctgttcacatacctgcttgtatttaaagccctcagtctgtcctgttgtgtggggcgaagtgatggactctgccaggtggacatgctgtgggtggatgttcccggcgtgtgccgggcctgaatggacaggggccacttcacagcatgtcagggaaaatcactgtcacacaattccaatggattttgtgctctttttgaaaaaaaaaaattctttagcgtaaacatgaattttttttcaatgtagcccctggggaatgaatgaaattttgagcttcttcaatacgtaaaattaaatttataccactgagggagagaccctttctgaaagaagtatggccaaaagcactttaatgctgctgacattgttgtttttatgttcatttgctggagcgcaagacgtgctgacacagtgagttttctctgatgtatttaaggtgatgtatttgcttgagttactcctgtatcattgctcataatattggaaactaaaataaaacctagttggaaa

SEQ ID NO: 295269 - DNA, 3895 bp, Homo sapiens
gtgagccgagatcgtgccattgcactccagcccgggcgacagagcaagactctatatccaaaaacaaaacaaaacaaaacaaaacactcatttccaggcaatctggaaggataggaaatgggaagtaaaatccgttaatgagggccaggcctgatttctctcccgtccctggctttctcctccatgacctgcctgcctcacaagtcccaggtctgttctcagcaggaagaatagggctcctgctctgcctgatgatttggtttacccctgtcacctttagccctggtattgatgtcaccacagagctggacagctggattgacaagttttgtctggatgctgatgtgtttgtgctggtggccaactcagagtccaccctgatgcagacggaaaagcacttcttccacaaggtgagtgagcgtctctcccggccaaacatcttcatcctgaacaaccgctgggatgcatctgcctcagagcccgagtacatggaggaggtgcggcggcagcacatggagcgttgtaccagcttcctggtggatgagctgggcgtggtggatcgatcccaggccggggaccgcatcttctttgtgtctgctaaggaggtgctcaacgccaggattcagaaagcccagggcatgcctgaaggagggggcgctctcgcagaaggctttcaagtgaggatgtttgagtttcagaattttgagaggagatttgaggagtgcatctcccagtctgcagtgaagaccaagtttgagcagcacacggtccgggccaagcagattgcagaggcggttcgactcatcatggactccctgcacatggcggctcgggagcagcaggtttactgcgaggaaatgcgtgaagagcggcaagaccgactgaaatttattgacaaacagctggagctcttggctcaagactataagctgcgaattaagcagattacggaggaagtggagaggcaggtgtcgactgcaatggccgaggagatcaggcgcctctctgtactggtggacgattaccagatggacttccacccttctccagtagtcctcaaggtttataagaatgagctgcaccgccacatagaggaaggactgggtcgaaacatgtctgaccgctgctccacggccatcaccaactccctgcagaccatgcagcaggacatgatagatggcttgaaacccctccttcctgtgtctgtgcggagtcagatagacatgctggtcccacgccagtgcttctccctcaactatgacctaaactgtgacaagctgtgtgctgacttccaggaagacattgagttccatttctctctcggatggaccatgctggtgaataggttcctgggccccaagaacagccgtcgggccttgatgggctacaatgaccaggtccagcgtcccatccctctgacgccagccaaccccagcatgcccccactgccacagggctcgctcacccaggaggagttcatggtttccatggttaccggcctggcctccttgacatccaggacctccatgggcattcttgttgttggaggagtggtgtggaaggcagtgggctggcggctcattgccctctcctttgggctctatggcctcctctacgtctatgagcgtctgacctggaccaccaaggccaaggagagggccttcaagcgccagtttgtggagcatgccagcgagaagctgcagcttgtcatcagctacactggctccaactgcagccaccaagtccagcaggaactgtctgggacctttgctcatctgtgtcagcaagttgacgtcacccgggagaacctggagcaggaaattgccgccatgaacaagaaaattgaggttcttgactcacttcagagcaaagcaaagctgctcaggaataaagccggttggttggacagtgagctcaacatgttcacacaccagtacctgcagcccagcagatagtgggcacctgaggcggagtctgcgtggagaggggcggtgctgccagccctaagtgccgtgtgggctcccccaggggcacgtgtggctcctgccccctggccactgccaagagaatgaagcacccagtctcgtaccattttgagccctccagcactacttattttcccccacctttgcctgctgttgctggaagagctggctcatacccccaaaggacactttcagcgacagctatggacagcatggtaccaaggagttaagttgaggctttttccagctttctctggttcatttgattgcttgataaggcctcaggatctcagcattgcacaatgcctcatggaagcctttgagggtatcacacagacacccccaccttcctccagcctgtgcgcacctgccctccttgcagcccagcacacctgcaggtgtaagggacgattggagtttcttcccagagagtctgtcccagaaggactgtggcttgtgtgtgtccatctcgcctgttggctcagtgcttcatcccatttgcagagcctcagacacgtcttggtggtgaggctcagttacccctgggcttaggctgaggcgggccctgtgctgggggtggtagaaaggatgctgctgaggcagctggaggagtgggagtagctcagaggggagggctgttggatgtatggggagctggcagagcaggtggcagtcactgggacaaggagggacttgcctctcttctcattattgtgtcctttgctttagtgtcagtcctggacttgtgcaggcctgttttgtgtagatctgttttggaagatggcatggtctaggtggttgaaggatgtagtagaaggatggatggtggaaggtggggacgttggtggctggctgaggtgcatgggccccacacaggacagctggagaatgggccgtccacttggcctcgttctgcgaggggctcatgggtctgagagcccccacccactaggcttgattgcatccctgttgtgccctttaagagacatgtttccaccccacccccaaccttgtcccaagtgccctggactaaatttcctgtgccagtgactgcagttggccaagggacaatgtggaaaacccagtgtccatctttccaccctccctgatctccagaaccttcgactgacccccttgtctttatgctgatgttgagttttgggattgttactggttgaagtgggggcagatgcctgtcaccaaggtgttgactgtgtgagaaaagcagtttgggtgacaaatcctgtgtggcacaagttggatcgcttcctagaaataagcaacacctctcccaaaaagcagcccacaaggcaggggcccagcagcccagccatcactcatctttgaggaaatgagttggtagcctctgtgcactgtttggtggccacatcacaggtgatgtcctgttcacatacctgcttgtatttaaagccctcagtctgtcctgttgtgtggggcgaagtgatggactctgccaggtggacatgctgtgggtggatgttcccggcgtgtgccgggcctgaatggacaggggccacttcacagcatgtcagggaaaatcactgtcacacaattccaatggattttgtgctctttttgaaaaaaaaaaattctttagcgtaaacatgaattttttttcaatgtagcccctggggaatgaatgaaattttgagcttcttcaatacgtaaaattaaatttataccactgagggagagaccctttctgaaagaagtatggccaaaagcactttaatgctgctgacattgttgtttttatgttcatttgctggagcgcaagacgtgctgacacagtgagttttctctgatgtatttaaggtgatgtatttgcttgagttactcctgtatcattgctcataatattggaaactaaaataaaacctagttggaaa

SEQ ID NO: 295270 - DNA, 3798 bp, Homo sapiens
acgcgccggcggaggagtggcgcgcggaggagtggcgcgctgagacgccgctcgaagcgccgagtcgcggggcagcagaggcgtaaggagtaggcggggcgagccggctgggctcagggtccaccagctcacccgggtcgaggggcaatctgaggcgactggtgacgcgcttatccacttccctcctcccgcctccccccggggtggcgctcgctggtgacgtagtgagtgtgatggccgccgcgaggccgggaaggtgaagtcaggactggtggagtcaacacagtcaatcaatagccaacctcaacctgagacaggacagaagagaactcagaatctttttgtcttttggacttcagccatgtccatgatgcctaccctgtgaagatctctcaccatccaaaaaacgcaatgtccctgctcttctctcgatgcaactctatcgtcacagtcaagaaaaataagagacacatggctgaggtgaatgcatccccacttaagcactttgtcactgccaagaagaagatcaatggcatttttgagcagctgggggcggggcgctctcgcagaaggctttcaagtgaggatgtttgagtttcagaattttgagaggagatttgaggagtgcatctcccagtctgcagtgaagaccaagtttgagcagcacacggtccgggccaagcagattgcagaggcggttcgactcatcatggactccctgcacatggcggctcgggagcagcaggtttactgcgaggaaatgcgtgaagagcggcaagaccgactgaaatttattgacaaacagctggagctcttggctcaagactataagctgcgaattaagcagattacggaggaagtggagaggcaggtgtcgactgcaatggccgaggagatcaggcgcctctctgtactggtggacgattaccagatggacttccacccttctccagtagtcctcaaggtttataagaatgagctgcaccgccacatagaggaaggactgggtcgaaacatgtctgaccgctgctccacggccatcaccaactccctgcagaccatgcagcaggacatgatagatggcttgaaacccctccttcctgtgtctgtgcggagtcagatagacatgctggtcccacgccagtgcttctccctcaactatgacctaaactgtgacaagctgtgtgctgacttccaggaagacattgagttccatttctctctcggatggaccatgctggtgaataggttcctgggccccaagaacagccgtcgggccttgatgggctacaatgaccaggtccagcgtcccatccctctgacgccagccaaccccagcatgcccccactgccacagggctcgctcacccaggaggagttcatggtttccatggttaccggcctggcctccttgacatccaggacctccatgggcattcttgttgttggaggagtggtgtggaaggcagtgggctggcggctcattgccctctcctttgggctctatggcctcctctacgtctatgagcgtctgacctggaccaccaaggccaaggagagggccttcaagcgccagtttgtggagcatgccagcgagaagctgcagcttgtcatcagctacactggctccaactgcagccaccaagtccagcaggaactgtctgggacctttgctcatctgtgtcagcaagttgacgtcacccgggagaacctggagcaggaaattgccgccatgaacaagaaaattgaggttcttgactcacttcagagcaaagcaaagctgctcaggaataaagccggttggttggacagtgagctcaacatgttcacacaccagtacctgcagcccagcagatagtgggcacctgaggcggagtctgcgtggagaggggcggtgctgccagccctaagtgccgtgtgggctcccccaggggcacgtgtggctcctgccccctggccactgccaagagaatgaagcacccagtctcgtaccattttgagccctccagcactacttattttcccccacctttgcctgctgttgctggaagagctggctcatacccccaaaggacactttcagcgacagctatggacagcatggtaccaaggagttaagttgaggctttttccagctttctctggttcatttgattgcttgataaggcctcaggatctcagcattgcacaatgcctcatggaagcctttgagggtatcacacagacacccccaccttcctccagcctgtgcgcacctgccctccttgcagcccagcacacctgcaggtgtaagggacgattggagtttcttcccagagagtctgtcccagaaggactgtggcttgtgtgtgtccatctcgcctgttggctcagtgcttcatcccatttgcagagcctcagacacgtcttggtggtgaggctcagttacccctgggcttaggctgaggcgggccctgtgctgggggtggtagaaaggatgctgctgaggcagctggaggagtgggagtagctcagaggggagggctgttggatgtatggggagctggcagagcaggtggcagtcactgggacaaggagggacttgcctctcttctcattattgtgtcctttgctttagtgtcagtcctggacttgtgcaggcctgttttgtgtagatctgttttggaagatggcatggtctaggtggttgaaggatgtagtagaaggatggatggtggaaggtggggacgttggtggctggctgaggtgcatgggccccacacaggacagctggagaatgggccgtccacttggcctcgttctgcgaggggctcatgggtctgagagcccccacccactaggcttgattgcatccctgttgtgccctttaagagacatgtttccaccccacccccaaccttgtcccaagtgccctggactaaatttcctgtgccagtgactgcagttggccaagggacaatgtggaaaacccagtgtccatctttccaccctccctgatctccagaaccttcgactgacccccttgtctttatgctgatgttgagttttgggattgttactggttgaagtgggggcagatgcctgtcaccaaggtgttgactgtgtgagaaaagcagtttgggtgacaaatcctgtgtggcacaagttggatcgcttcctagaaataagcaacacctctcccaaaaagcagcccacaaggcaggggcccagcagcccagccatcactcatctttgaggaaatgagttggtagcctctgtgcactgtttggtggccacatcacaggtgatgtcctgttcacatacctgcttgtatttaaagccctcagtctgtcctgttgtgtggggcgaagtgatggactctgccaggtggacatgctgtgggtggatgttcccggcgtgtgccgggcctgaatggacaggggccacttcacagcatgtcagggaaaatcactgtcacacaattccaatggattttgtgctctttttgaaaaaaaaaaattctttagcgtaaacatgaattttttttcaatgtagcccctggggaatgaatgaaattttgagcttcttcaatacgtaaaattaaatttataccactgagggagagaccctttctgaaagaagtatggccaaaagcactttaatgctgctgacattgttgtttttatgttcatttgctggagcgcaagacgtgctgacacagtgagttttctctgatgtatttaaggtgatgtatttgcttgagttactcctgtatcattgctcataatattggaaactaaaataaaacctagttggaaa

SEQ ID NO: 295271 - DNA, 3278 bp, Homo sapiens
ggtgacaagctgtgtgctgacttccaggaagacattgagttccatttctctctcggatggaccatgctggtgaataggttcctgggccccaagaacagccgtcgggccttgatgggctacaatgaccaggtccagcgtcccatccctctgacgccagccaaccccagcatgcccccactgccacagggctcgctcaccctgcacatggcggctcgggagcagcaggtttactgcgaggaaatgcgtgaagagcggcaagaccgactgaaatttattgacaaacagctggagctcttggctcaagactataagctgcgaattaagcagattacggaggaagtggagaggcaggtgtcgactgcaatggccgaggagatcaggcgcctctctgtactggtggacgattaccagatggacttccacccttctccagtagtcctcaaggtttataagaatgagctgcaccgccacatagaggaaggactgggtcgaaacatgtctgaccgctgctccacggccatcaccaactccctgcagaccatgcagcaggacatgatagatggcttgaaacccctccttcctgtgtctgtgcggagtcagatagacatgctggtcccacgccagtgcttctccctcaactatgacctaaactgtgacaagctgtgtgctgacttccaggaagacattgagttccatttctctctcggatggaccatgctggtgaataggttcctgggccccaagaacagccgtcgggccttgatgggctacaatgaccaggtccagcgtcccatccctctgacgccagccaaccccagcatgcccccactgccacagggctcgctcacccaggaggagttcatggtttccatggttaccggcctggcctccttgacatccaggacctccatgggcattcttgttgttggaggagtggtgtggaaggcagtgggctggcggctcattgccctctcctttgggctctatggcctcctctacgtctatgagcgtctgacctggaccaccaaggccaaggagagggccttcaagcgccagtttgtggagcatgccagcgagaagctgcagcttgtcatcagctacactggctccaactgcagccaccaagtccagcaggaactgtctgggacctttgctcatctgtgtcagcaagttgacgtcacccgggagaacctggagcaggaaattgccgccatgaacaagaaaattgaggttcttgactcacttcagagcaaagcaaagctgctcaggaataaagccggttggttggacagtgagctcaacatgttcacacaccagtacctgcagcccagcagatagtgggcacctgaggcggagtctgcgtggagaggggcggtgctgccagccctaagtgccgtgtgggctcccccaggggcacgtgtggctcctgccccctggccactgccaagagaatgaagcacccagtctcgtaccattttgagccctccagcactacttattttcccccacctttgcctgctgttgctggaagagctggctcatacccccaaaggacactttcagcgacagctatggacagcatggtaccaaggagttaagttgaggctttttccagctttctctggttcatttgattgcttgataaggcctcaggatctcagcattgcacaatgcctcatggaagcctttgagggtatcacacagacacccccaccttcctccagcctgtgcgcacctgccctccttgcagcccagcacacctgcaggtgtaagggacgattggagtttcttcccagagagtctgtcccagaaggactgtggcttgtgtgtgtccatctcgcctgttggctcagtgcttcatcccatttgcagagcctcagacacgtcttggtggtgaggctcagttacccctgggcttaggctgaggcgggccctgtgctgggggtggtagaaaggatgctgctgaggcagctggaggagtgggagtagctcagaggggagggctgttggatgtatggggagctggcagagcaggtggcagtcactgggacaaggagggacttgcctctcttctcattattgtgtcctttgctttagtgtcagtcctggacttgtgcaggcctgttttgtgtagatctgttttggaagatggcatggtctaggtggttgaaggatgtagtagaaggatggatggtggaaggtggggacgttggtggctggctgaggtgcatgggccccacacaggacagctggagaatgggccgtccacttggcctcgttctgcgaggggctcatgggtctgagagcccccacccactaggcttgattgcatccctgttgtgccctttaagagacatgtttccaccccacccccaaccttgtcccaagtgccctggactaaatttcctgtgccagtgactgcagttggccaagggacaatgtggaaaacccagtgtccatctttccaccctccctgatctccagaaccttcgactgacccccttgtctttatgctgatgttgagttttgggattgttactggttgaagtgggggcagatgcctgtcaccaaggtgttgactgtgtgagaaaagcagtttgggtgacaaatcctgtgtggcacaagttggatcgcttcctagaaataagcaacacctctcccaaaaagcagcccacaaggcaggggcccagcagcccagccatcactcatctttgaggaaatgagttggtagcctctgtgcactgtttggtggccacatcacaggtgatgtcctgttcacatacctgcttgtatttaaagccctcagtctgtcctgttgtgtggggcgaagtgatggactctgccaggtggacatgctgtgggtggatgttcccggcgtgtgccgggcctgaatggacaggggccacttcacagcatgtcagggaaaatcactgtcacacaattccaatggattttgtgctctttttgaaaaaaaaaaattctttagcgtaaacatgaattttttttcaatgtagcccctggggaatgaatgaaattttgagcttcttcaatacgtaaaattaaatttataccactgagggagagaccctttctgaaagaagtatggccaaaagcactttaatgctgctgacattgttgtttttatgttcatttgctggagcgcaagacgtgctgacacagtgagttttctctgatgtatttaaggtgatgtatttgcttgagttactcctgtatcattgctcataatattggaaactaaaataaaacctagttggaaa

SEQ ID NO: 295272 - DNA, 5015 bp, Homo sapiens
acgcgccggcggaggagtggcgcgcggaggagtggcgcgctgagacgccgctcgaagcgccgagtcgcggggcagcagaggcgtaaggagtaggcggggcgagccggctgggctcagggtccaccagctcacccgggtcgaggggcaatctgaggcgactggtgacgcgcttatccacttccctcctcccgcctccccccggggtggcgctcgctggtgacgtagtgagtgtgatggccgccgcgaggccgggaaggtgaagtcaggactggtggagtcaacacagtcaatcaatagccaacctcaacctgagacaggacagaagagaactcagaatctttttgtcttttggacttcagccatgtccatgatgcctaccctgtgaagatctctcaccatccaaaaaacgcaatgtccctgctcttctctcgatgcaactctatcgtcacagtcaagaaaaataagagacacatggctgaggtgaatgcatccccacttaagcactttgtcactgccaagaagaagatcaatggcatttttgagcagctgggggcctacatccaggagagcgccaccttccttgaagacacgtacaggaatgcagaactggaccccgttaccacagaagaacaggttctggacgtcaaaggttacctatccaaagtgagaggcatcagtgaggtgctggctcggaggcacatgaaagtggctttttttggccggacgagcaatgggaagagcaccgtgatcaatgccatgctctgggacaaagttctgccctctgggattggccacaccaccaattgcttcctgcgggtagagggcacagatggccatgaggcctttctccttaccgagggctcagaggaaaagaggagtgccaagactgtgaaccagctggcccatgccctccaccaggacaagcagctccatgccggcagcctagtgagtgtgatgtggcccaactctaagtgcccacttctgaaggatgacctcgttttgatggacagccctggtattgatgtcaccacagagctggacagctggattgacaagttttgtctggatgctgatgtgtttgtgctggtggccaactcagagtccaccctgatgcagacggaaaagcacttcttccacaaggtgagtgagcgtctctcccggccaaacatcttcatcctgaacaaccgctgggatgcatctgcctcagagcccgagtacatggaggaggtgcggcggcagcacatggagcgttgtaccagcttcctggtggatgagctgggcgtggtggatcgatcccaggccggggaccgcatcttctttgtgtctgctaaggaggtgctcaacgccaggattcagaaagcccagggcatgcctgaaggagggggcgctctcgcagaaggctttcaagtgaggatgtttgagtttcagaattttgagaggagatttgaggagtgcatctcccagtctgcagtgaagaccaagtttgagcagcacacggtccgggccaagcagattgcagaggcggttcgactcatcatggactccctgcacatggcggctcgggagcagcaggtttactgcgaggaaatgcgtgaagagcggcaagaccgactgaaatttattgacaaacagctggagctcttggctcaagactataagctgcgaattaagcagattacggaggaagtggagaggcaggtgagaaatgaggaggaggcattctgggaagatttggactccgagtagagtccagaagaaagcagacctcctcctcttagggacttctcagcctttcagaagaaagttgtggccctgtttcaagaatacagagctgccgtttgggttccattgtcgggttgtgtgatgctgggcatgttccctttcctctggacctccacagatcatgtgggcgtttgatcagccagtttcccagaccctctcacttcagaggctttaattccatagaggagctgaggaggctgctggtttgagaggaaggatgtgccatctgctaggatctctcctggtgctgcaggagtgaactttggtcttccttgatacttaacagtgtgcttccttttgctgtaggtgtcgactgcaatggccgaggagatcaggcgcctctctgtactggtggacgattaccagatggacttccacccttctccagtagtcctcaaggtttataagaatgagctgcaccgccacatagaggaaggactgggtcgaaacatgtctgaccgctgctccacggccatcaccaactccctgcagaccatgcagcaggacatgatagatggcttgaaacccctccttcctgtgtctgtgcggagtcagatagacatgctggtcccacgccagtgcttctccctcaactatgacctaaactgtgacaagctgtgtgctgacttccaggaagacattgagttccatttctctctcggatggaccatgctggtgaataggttcctgggccccaagaacagccgtcgggccttgatgggctacaatgaccaggtccagcgtcccatccctctgacgccagccaaccccagcatgcccccactgccacagggctcgctcacccaggaggagttcatggtttccatggttaccggcctggcctccttgacatccaggacctccatgggcattcttgttgttggaggagtggtgtggaaggcagtgggctggcggctcattgccctctcctttgggctctatggcctcctctacgtctatgagcgtctgacctggaccaccaaggccaaggagagggccttcaagcgccagtttgtggagcatgccagcgagaagctgcagcttgtcatcagctacactggctccaactgcagccaccaagtccagcaggaactgtctgggacctttgctcatctgtgtcagcaagttgacgtcacccgggagaacctggagcaggaaattgccgccatgaacaagaaaattgaggttcttgactcacttcagagcaaagcaaagctgctcaggaataaagccggttggttggacagtgagctcaacatgttcacacaccagtacctgcagcccagcagatagtgggcacctgaggcggagtctgcgtggagaggggcggtgctgccagccctaagtgccgtgtgggctcccccaggggcacgtgtggctcctgccccctggccactgccaagagaatgaagcacccagtctcgtaccattttgagccctccagcactacttattttcccccacctttgcctgctgttgctggaagagctggctcatacccccaaaggacactttcagcgacagctatggacagcatggtaccaaggagttaagttgaggctttttccagctttctctggttcatttgattgcttgataaggcctcaggatctcagcattgcacaatgcctcatggaagcctttgagggtatcacacagacacccccaccttcctccagcctgtgcgcacctgccctccttgcagcccagcacacctgcaggtgtaagggacgattggagtttcttcccagagagtctgtcccagaaggactgtggcttgtgtgtgtccatctcgcctgttggctcagtgcttcatcccatttgcagagcctcagacacgtcttggtggtgaggctcagttacccctgggcttaggctgaggcgggccctgtgctgggggtggtagaaaggatgctgctgaggcagctggaggagtgggagtagctcagaggggagggctgttggatgtatggggagctggcagagcaggtggcagtcactgggacaaggagggacttgcctctcttctcattattgtgtcctttgctttagtgtcagtcctggacttgtgcaggcctgttttgtgtagatctgttttggaagatggcatggtctaggtggttgaaggatgtagtagaaggatggatggtggaaggtggggacgttggtggctggctgaggtgcatgggccccacacaggacagctggagaatgggccgtccacttggcctcgttctgcgaggggctcatgggtctgagagcccccacccactaggcttgattgcatccctgttgtgccctttaagagacatgtttccaccccacccccaaccttgtcccaagtgccctggactaaatttcctgtgccagtgactgcagttggccaagggacaatgtggaaaacccagtgtccatctttccaccctccctgatctccagaaccttcgactgacccccttgtctttatgctgatgttgagttttgggattgttactggttgaagtgggggcagatgcctgtcaccaaggtgttgactgtgtgagaaaagcagtttgggtgacaaatcctgtgtggcacaagttggatcgcttcctagaaataagcaacacctctcccaaaaagcagcccacaaggcaggggcccagcagcccagccatcactcatctttgaggaaatgagttggtagcctctgtgcactgtttggtggccacatcacaggtgatgtcctgttcacatacctgcttgtatttaaagccctcagtctgtcctgttgtgtggggcgaagtgatggactctgccaggtggacatgctgtgggtggatgttcccggcgtgtgccgggcctgaatggacaggggccacttcacagcatgtcagggaaaatcactgtcacacaattccaatggattttgtgctctttttgaaaaaaaaaaattctttagcgtaaacatgaattttttttcaatgtagcccctggggaatgaatgaaattttgagcttcttcaatacgtaaaattaaatttataccactgagggagagaccctttctgaaagaagtatggccaaaagcactttaatgctgctgacattgttgtttttatgttcatttgctggagcgcaagacgtgctgacacagtgagttttctctgatgtatttaaggtgatgtatttgcttgagttactcctgtatcattgctcataatattggaaactaaaataaaacctagttggaaa

SEQ ID NO: 295273 - DNA, 2947 bp, Homo sapiens
acgcgccggcggaggagtggcgcgcggaggagtggcgcgctgagacgccgctcgaagcgccgagtcgcggggcagcagaggcgtaaggagtaggcggggcgagccggctgggctcagggtccaccagctcacccgggtcgaggggcaatctgaggcgactggtgacgcgcttatccacttccctcctcccgcctccccccggggtggcgctcgctggtgacgtagtgagtgtgatggccgccgcgaggccgggaaggtgaagtcaggactggtggagtcaacacagtcaatcaatagccaacctcaactatgacctaaactgtgacaagctgtgtgctgacttccaggaagacattgagttccatttctctctcggatggaccatgctggtgaataggttcctgggccccaagaacagccgtcgggccttgatgggctacaatgaccaggtccagcgtcccatccctctgacgccagccaaccccagcatgcccccactgccacagggctcgctcacccaggaggagttcatggtttccatggttaccggcctggcctccttgacatccaggacctccatgggcattcttgttgttggaggagtggtgtggaaggcagtgggctggcggctcattgccctctcctttgggctctatggcctcctctacgtctatgagcgtctgacctggaccaccaaggccaaggagagggccttcaagcgccagtttgtggagcatgccagcgagaagctgcagcttgtcatcagctacactggctccaactgcagccaccaagtccagcaggaactgtctgggacctttgctcatctgtgtcagcaagttgacgtcacccgggagaacctggagcaggaaattgccgccatgaacaagaaaattgaggttcttgactcacttcagagcaaagcaaagctgctcaggaataaagccggttggttggacagtgagctcaacatgttcacacaccagtacctgcagcccagcagatagtgggcacctgaggcggagtctgcgtggagaggggcggtgctgccagccctaagtgccgtgtgggctcccccaggggcacgtgtggctcctgccccctggccactgccaagagaatgaagcacccagtctcgtaccattttgagccctccagcactacttattttcccccacctttgcctgctgttgctggaagagctggctcatacccccaaaggacactttcagcgacagctatggacagcatggtaccaaggagttaagttgaggctttttccagctttctctggttcatttgattgcttgataaggcctcaggatctcagcattgcacaatgcctcatggaagcctttgagggtatcacacagacacccccaccttcctccagcctgtgcgcacctgccctccttgcagcccagcacacctgcaggtgtaagggacgattggagtttcttcccagagagtctgtcccagaaggactgtggcttgtgtgtgtccatctcgcctgttggctcagtgcttcatcccatttgcagagcctcagacacgtcttggtggtgaggctcagttacccctgggcttaggctgaggcgggccctgtgctgggggtggtagaaaggatgctgctgaggcagctggaggagtgggagtagctcagaggggagggctgttggatgtatggggagctggcagagcaggtggcagtcactgggacaaggagggacttgcctctcttctcattattgtgtcctttgctttagtgtcagtcctggacttgtgcaggcctgttttgtgtagatctgttttggaagatggcatggtctaggtggttgaaggatgtagtagaaggatggatggtggaaggtggggacgttggtggctggctgaggtgcatgggccccacacaggacagctggagaatgggccgtccacttggcctcgttctgcgaggggctcatgggtctgagagcccccacccactaggcttgattgcatccctgttgtgccctttaagagacatgtttccaccccacccccaaccttgtcccaagtgccctggactaaatttcctgtgccagtgactgcagttggccaagggacaatgtggaaaacccagtgtccatctttccaccctccctgatctccagaaccttcgactgacccccttgtctttatgctgatgttgagttttgggattgttactggttgaagtgggggcagatgcctgtcaccaaggtgttgactgtgtgagaaaagcagtttgggtgacaaatcctgtgtggcacaagttggatcgcttcctagaaataagcaacacctctcccaaaaagcagcccacaaggcaggggcccagcagcccagccatcactcatctttgaggaaatgagttggtagcctctgtgcactgtttggtggccacatcacaggtgatgtcctgttcacatacctgcttgtatttaaagccctcagtctgtcctgttgtgtggggcgaagtgatggactctgccaggtggacatgctgtgggtggatgttcccggcgtgtgccgggcctgaatggacaggggccacttcacagcatgtcagggaaaatcactgtcacacaattccaatggattttgtgctctttttgaaaaaaaaaaattctttagcgtaaacatgaattttttttcaatgtagcccctggggaatgaatgaaattttgagcttcttcaatacgtaaaattaaatttataccactgagggagagaccctttctgaaagaagtatggccaaaagcactttaatgctgctgacattgttgtttttatgttcatttgctggagcgcaagacgtgctgacacagtgagttttctctgatgtatttaaggtgatgtatttgcttgagttactcctgtatcattgctcataatattggaaactaaaataaaacctagttggaaa

SEQ ID NO: 295274 - DNA, 2097 bp, Homo sapiens
  misc_feature (7)..(7): n is a, c, g, or t
  misc_feature (11)..(11): n is a, c, g, or t
  misc_feature (18)..(18): n is a, c, g, or t
  misc_feature (69)..(69): n is a, c, g, or t
ctgtccnaccnaccggcnttattcctgagcagctttgctttgctctgaagtgagtcaagaacctcaatnttcttgttcatggcggcaatttcctgctccaggttctcccgggtgactcaacatgttcacacaccagtacctgcagcccagcagatagtgggcacctgaggcggagtctgcgtggagaggggcggtgctgccagccctaagtgccgtgtgggctcccccaggggcacgtgtggctcctgccccctggccactgccaagagaatgaagcacccagtctcgtaccattttgagccctccagcactacttattttcccccacctttgcctgctgttgctggaagagctggctcatacccccaaaggacactttcagcgacagctatggacagcatggtaccaaggagttaagttgaggctttttccagctttctctggttcatttgattgcttgataaggcctcaggatctcagcattgcacaatgcctcatggaagcctttgagggtatcacacagacacccccaccttcctccagcctgtgcgcacctgccctccttgcagcccagcacacctgcaggtgtaagggacgattggagtttcttcccagagagtctgtcccagaaggactgtggcttgtgtgtgtccatctcgcctgttggctcagtgcttcatcccatttgcagagcctcagacacgtcttggtggtgaggctcagttacccctgggcttaggctgaggcgggccctgtgctgggggtggtagaaaggatgctgctgaggcagctggaggagtgggagtagctcagaggggagggctgttggatgtatggggagctggcagagcaggtggcagtcactgggacaaggagggacttgcctctcttctcattattgtgtcctttgctttagtgtcagtcctggacttgtgcaggcctgttttgtgtagatctgttttggaagatggcatggtctaggtggttgaaggatgtagtagaaggatggatggtggaaggtggggacgttggtggctggctgaggtgcatgggccccacacaggacagctggagaatgggccgtccacttggcctcgttctgcgaggggctcatgggtctgagagcccccacccactaggcttgattgcatccctgttgtgccctttaagagacatgtttccaccccacccccaaccttgtcccaagtgccctggactaaatttcctgtgccagtgactgcagttggccaagggacaatgtggaaaacccagtgtccatctttccaccctccctgatctccagaaccttcgactgacccccttgtctttatgctgatgttgagttttgggattgttactggttgaagtgggggcagatgcctgtcaccaaggtgttgactgtgtgagaaaagcagtttgggtgacaaatcctgtgtggcacaagttggatcgcttcctagaaataagcaacacctctcccaaaaagcagcccacaaggcaggggcccagcagcccagccatcactcatctttgaggaaatgagttggtagcctctgtgcactgtttggtggccacatcacaggtgatgtcctgttcacatacctgcttgtatttaaagccctcagtctgtcctgttgtgtggggcgaagtgatggactctgccaggtggacatgctgtgggtggatgttcccggcgtgtgccgggcctgaatggacaggggccacttcacagcatgtcagggaaaatcactgtcacacaattccaatggattttgtgctctttttgaaaaaaaaaaattctttagcgtaaacatgaattttttttcaatgtagcccctggggaatgaatgaaattttgagcttcttcaatacgtaaaattaaatttataccactgagggagagaccctttctgaaagaagtatggccaaaagcactttaatgctgctgacattgttgtttttatgttcatttgctggagcgcaagacgtgctgacacagtgagttttctctgatgtatttaaggtgatgtatttgcttgagttactcctgtatcattgctcataatattggaaactaaaataaaacctagttggaaa

SEQ ID NO: 295275 - DNA, 4959 bp, Homo sapiens
acgcgccggcggaggagtggcgcgcggaggagtggcgcgctgagacgccgctcgaagcgccgagtcgcggggcagcagaggcgtaaggagtaggcggggcgagccggctgggctcagggtccaccagctcacccgggtcgaggggcaatctgaggcgactggtgacgcgcttatccacttccctcctcccgcctccccccggggtggcgctcgctggtgacgtagtgagtgtgatggccgccgcgaggccgggaaggtgaagtcaggactggtggagtcaacacagtcaatcaatagccaacctcaacctgagacaggacagaagagaactcagaatctttttgtcttttggacttcagccatgtccatgatgcctaccctgtgaagatctctcaccatccaaaaaacgcaatgtccctgctcttctctcgatgcaactctatcgtcacagtcaagaaaaataagagacacatggctgaggtgaatgcatccccacttaagcactttgtcactgccaagaagaagatcaatggcatttttgagcagctgggggcctacatccaggagagcgccaccttccttgaagacacgtacaggaatgcagaactggaccccgttaccacagaagaacaggttctggacgtcaaaggttacctatccaaagtgagaggcatcagtgaggtgctggctcggaggcacatgaaagtggctttttttggccggacgagcaatgggaagagcaccgtgatcaatgccatgctctgggacaaagttctgccctctgggattggccacaccaccaattgcttcctgcgggtagagggcacagatggccatgaggcctttctccttaccgagggctcagaggaaaagaggagtgccaagactgtgaaccagctggcccatgccctccaccaggacaagcagctccatgccggcagcctagtgagtgtgatgtggcccaactctaagtgcccacttctgaaggatgacctcgttttgatggacagccctggtattgatgtcaccacagagctggacagctggattgacaagttttgtctggatgctgatgtgtttgtgctggtggccaactcagagtccaccctgatgcagacggaaaagcacttcttccacaaggtgagtgagcgtctctcccggccaaacatcttcatcctgaacaaccgctgggatgcatctgcctcagagcccgagtacatggaggaggtgcggcggcagcacatggagcgttgtaccagcttcctggtggatgagctgggcgtggtggatcgatcccaggccggggaccgcatcttctttgtgtctgctaaggaggtgctcaacgccaggattcagaaagcccagggcatgcctgaaggagggggcgctctcgcagaaggctttcaagtgaggatgtttgagtttcagaattttgagaggagatttgaggagtgcatctcccagtctgcagtgaagaccaagtttgagcagcacacggtccgggccaagcagattgcagaggcggttcgactcatcatggactccctgcacatggcggctcgggagcagcaggtttactgcgaggaaatgcgtgaagagcggcaagaccgactgaaatttattgacaaacagctggagctcttggctcaagactataagctgcgaattaagcagattacggaggaagtggagaggcaggtgtcgactgcaatggccgaggagatcaggcgcctctctgtactggtggacgattaccagatggacttccacccttctccagtagtcctcaaggtttataagaatgagctgcaccgccacatagaggaaggactgggtcgaaacatgtctgaccgctgctccacggccatcaccaactccctgcagaccatgcagcaggacatgatagatggcttgaaacccctccttcctgtgtctgtgcggagtcagatagacatgctggtcccacgccagtgcttctccctcaactatgacctaaactgtgacaagctgtgtgctgacttccaggaagacattgagttccatttctctctcggatggaccatgctggtgaataggttcctgggccccaagaacagccgtcgggccttgatgggctacaatgaccaggtccagcgtcccatccctctgacgccagccaaccccagcatgcccccactgccacagggctcgctcacccaggaggagttcatggtttccatggttaccggcctggcctccttgacatccaggacctccatgggcattcttgttgttggaggagtggtgtggaaggcagtgggctggcggctcattgccctctcctttgggctctatggcctcctctacgtctatgagcgtctgacctggaccaccaaggccaaggagagggccttcaagcgccagtttgtggagcatgccagcgagaagctgcagcttgtcatcagctacactggctccaactgcagccaccaagtccagcaggaactgtctgggacctttgctcatctgtgtcagcaagttgacgtcacccgggagaacctggagcaggaaattgccgccatgaacaagaaaattgaggttcttgactcacttcagagcaaagcaaagctgctcaggaataaagccggttggttggacagtgagctcaacatgttcacacaccagtacctgcagcccagcagatagtgggcacctgaggcggagtctgcgtggagaggggcggtgctgccagccctaagtgccgtgtgggctcccccaggggcacgtgtggctcctgccccctggccactgccaagagaatgaagcacccagtctcgtaccattttgagccctccagcactacttattttcccccacctttgcctgctgttgctggaagagctggctcatacccccaaaggacactttcagcgacagctatggacagcatggtaccaaggagttaagttgaggctttttccagctttctctggttcatttgattgcttgataaggcctcaggatctcagcattgcacaatgcctcatggaagcctttgagggtatcacacagacacccccaccttcctccagcctgtgcgcacctgccctccttgcagcccagcacacctgcaggtgtaagggacgattggagtttcttcccagagagtctgtcccagaaggactgtggcttgtgtgtgtccatctcgcctgttggctcagtgcttcatcccatttgcagagcctcagacacgtcttggtggtgaggctcagttacccctgggcttaggctgaggcgggccctgtgctgggggtggtagaaaggatgctgctgaggcagctggaggagtgggagtagctcagaggggagggctgttggatgtatggggagctggcagagcaggtggcagtcactgggacaaggagggacttgcctctcttctcattattgtgtcctttgctttagtgtcagtcctggacttgtgcaggcctgttttgtgtagatctgttttggaagatggcatggtctaggtggttgaaggatgtagtagaaggatggatggtggaaggtggggacgttggtggctggctgaggtgcatgggccccacacaggacagctggagaatgggccgtccacttggcctcgttctgcgaggggctcatgggtctgagagcccccacccactaggcttgattgcatccctgttgtgccctttaagagacatgtttccaccccacccccaaccttgtcccaagtgccctggactaaatttcctgtgccagtgactgcagttggccaagggacaatgtggaaaacccagtgtccatctttccaccctccctgatctccagaaccttcgactgacccccttgtctttatgctgatgttgagttttgggattgttactggttgaagtgggggcagatgcctgtcaccaaggtgttgactgtgtgagaaaagcagtttgggtgacaaatcctgtgtggcacaagttggatcgcttcctagaaataagcaacacctctcccaaaaagcagcccacaaggcaggggcccagcagcccagccatcactcatctttgaggaaatgagttggtagcctctgtgcactgtttggtggccacatcacaggtgatgtcctgttcacatacctgcttgtatttaaagccctcagtctgtcctgttgtgtggggcgaagtgatggactctgccaggtggacatgctgtgggtggatgttcccggcgtgtgccgggcctgaatggacaggggccacttcacagcatgtcagggaaaatcactgtcacacaattccaatggattttgtgctctttttgaaaaaaaaaaattctttagcgtaaacatgaattttttttcaatgtagcccctggggaatgaatgaaattttgagcttcttcaatacgtaaaattaaatttataccactgagggagagaccctttctgaaagaagtatggccaaaagcactttaatgctgctgacattgttgtttttatgttcatttgctggagcgcaagacgtgctgacacagtgagttttctctgatgtatttaaggtgatgtatttgcttgagttactcctgtatcattgctcataatattggaaactaaaataaaacctagttggaaacaacacaaataaaaaaataaataataaaaaaaaagagaggggcgggccgcgcctccaaagagttttcccccgagggggggcccacagttttggcgcttttaccccggttttttttgtttcacaaagggggccccctatgtgggaggcgcattatttttaagcatctagaggcccatgagcccgcacgtttataacaacaggttgtggaagggtggaacaacgttgctagcctggggaactccttgtggtaagaggaacctttaatactcggggggggggcacccaattgggggccacaaattcaccaacgaaatttttaaaggctctaagagaa

SEQ ID NO: 295276 - DNA, 2234 bp, Homo sapiens
acgcgccggcggaggagtggcgcgcggaggagtggcgcgctgagacgccgctcgaagcgccgagtcgcggggcagcagaggcgtaaggagtaggcggggcgagccggctgggctcagggtccaccagctcacccgggtcgaggggcaatctgaggcgactggtgacgcgcttatccacttccctcctcccgcctccccccggggtggcgctcgctggtgacgtagtgagtgtgatggccgccgcgaggccgggaaggtgaagtcaggactggtggagtcaacacagtcaatcaatagccaacctcaacctgagacaggacagaagagaactcagaatctttttgtcttttggacttcagccatgtccatgatgcctaccctgtgaagatctctcaccatccaaaaaacgcaatgtccctgctcttctctcgatgcaactctatcgtcacagtcaagaaaaataagagacacatggctgaggtgaatgcatccccacttaagcactttgtcactgccaagaagaagatcaatggcatttttgagcagctgggggcctacatccaggagagcgccaccttccttgaagacacgtacaggaatgcagaactggaccccgttaccacagaagaacaggttctggacgtcaaaggttacctatccaaagtgagaggcatcagtgaggtgctggctcggaggcacatgaaagtggctttttttggccggacgagcaatgggaagagcaccgtgatcaatgccatgctctgggacaaagttctgccctctgggattggccacaccaccaattgcttcctgcgggtagagggcacagatggccatgaggcctttctccttaccgagggctcagaggaaaagaggagtgccaagactgtgaaccagctggcccatgccctccaccaggacaagcagctggaggagtgggagtagctcagaggggagggctgttggatgtatggggagctggcagagcaggtggcagtcactgggacaaggagggacttgcctctcttctcattattgtgtcctttgctttagtgtcagtcctggacttgtgcaggcctgttttgtgtagatctgttttggaagatggcatggtctaggtggttgaaggatgtagtagaaggatggatggtggaaggtggggacgttggtggctggctgaggtgcatgggccccacacaggacagctggagaatgggccgtccacttggcctcgttctgcgaggggctcatgggtctgagagcccccacccactaggcttgattgcatccctgttgtgccctttaagagacatgtttccaccccacccccaaccttgtcccaagtgccctggactaaatttcctgtgccagtgactgcagttggccaagggacaatgtggaaaacccagtgtccatctttccaccctccctgatctccagaaccttcgactgacccccttgtctttatgctgatgttgagttttgggattgttactggttgaagtgggggcagatgcctgtcaccaaggtgttgactgtgtgagaaaagcagtttgggtgacaaatcctgtgtggcacaagttggatcgcttcctagaaataagcaacacctctcccaaaaagcagcccacaaggcaggggcccagcagcccagccatcactcatctttgaggaaatgagttggtagcctctgtgcactgtttggtggccacatcacaggtgatgtcctgttcacatacctgcttgtatttaaagccctcagtctgtcctgttgtgtggggcgaagtgatggactctgccaggtggacatgctgtgggtggatgttcccggcgtgtgccgggcctgaatggacaggggccacttcacagcatgtcagggaaaatcactgtcacacaattccaatggattttgtgctctttttgaaaaaaaaaaattctttagcgtaaacatgaattttttttcaatgtagcccctggggaatgaatgaaattttgagcttcttcaatacgtaaaattaaatttataccactgagggagagaccctttctgaaagaagtatggccaaaagcactttaatgctgctgacattgttgtttttatgttcatttgctggagcgcaagacgtgctgacacagtgagttttctctgatgtatttaaggtgatgtatttgcttgagttactcctgtatcattgctcataatattggaaactaaaataaaacctagttggaaa

SEQ ID NO: 295277 - DNA, 2029 bp, Homo sapiens
ggacgcgtgggtcgacccacgcgttcggatggccgccgcgaggccgggaaggtgaagtcaggactggtggagtcaacacagtcaatcaatagccaacctcaacctgagacaggacagaagagaactcagaatctttttgtcttttggacttcagccatgtccatgatgcctaccctgtgaagatctctcaccatccaaaaaacgcaatgtccctgctcttctctcgatgcaactctatcgtcacagtcaagaaaaataagagacacatggctgaggtgaatgcatccccacttaagcactttgtcactgccaagaagaagatcaatggcatttttgagcagctgggggcctacatccaggagagcgccaccttccttgaagacacgtacaggaatgcagaactggaccccgttaccacagaagaacaggttctggacgtcaaaggttacctatccaaagtgagaggcatcagtgaggtgctggctcggaggcacatgaaagtggctttttttggccggacgagcaatgggaagagcaccgtgatcaatgccatgctctgggacaaagttctgccctctgggattggccacaccaccaattgcttcctgcgggtagagggcacagatggccatgaggcctttctccttaccgagggctcagaggaaaagaggagtgccaagactgtgaaccagctggcccatgccctccaccaggacaagcagctggaggagtgggagtagctcagaggggagggctgttggatgtatggggagctggcagagcaggtggcagtcactgggacaaggagggacttgcctctcttctcattattgtgtcctttgctttagtgtcagtcctggacttgtgcaggcctgttttgtgtagatctgttttggaagatggcatggtctaggtggttgaaggatgtagtagaaggatggatggtggaaggtggggacgttggtggctggctgaggtgcatgggccccacacaggacagctggagaatgggccgtccacttggcctcgttctgcgaggggctcatgggtctgagagcccccacccactaggcttgattgcatccctgttgtgccctttaagagacatgtttccaccccacccccaaccttgtcccaagtgccctggactaaatttcctgtgccagtgactgcagttggccaagggacaatgtggaaaacccagtgtccatctttccaccctccctgatctccagaaccttcgactgacccccttgtctttatgctgatgttgagttttgggattgttactggttgaagtgggggcagatgcctgtcaccaaggtgttgactgtgtgagaaaagcagtttgggtgacaaatcctgtgtggcacaagttggatcgcttcctagaaataagcaacacctctcccaaaaagcagcccacaaggcaggggcccagcagcccagccatcactcatctttgaggaaatgagttggtagcctctgtgcactgtttggtggccacatcacaggtgatgtcctgttcacatacctgcttgtatttaaagccctcagtctgtcctgttgtgtggggcgaagtgatggactctgccaggtggacatgctgtgggtggatgttcccggcgtgtgccgggcctgaatggacaggggccacttcacagcatgtcagggaaaatcactgtcacacaattccaatggattttgtgctctttttgaaaaaaaaaaattctttagcgtaaacatgaattttttttcaatgtagcccctggggaatgaatgaaattttgagcttcttcaatacgtaaaattaaatttataccactgagggagagaccctttctgaaagaagtatggccaaaagcactttaatgctgctgacattgttgtttttatgttcatttgctggagcgcaagacgtgctgacacagtgagttttctctgatgtatttaaggtgatgtatttgcttgagttactcctgtatcattgctcataatattggaaactaaaataaaacctagttggaaa

SEQ ID NO: 295278 - DNA, 4415 bp, Homo sapiens
acgcgccggcggaggagtggcgcgcggaggagtggcgcgctgagacgccgctcgaagcgccgagtcgcggggcagcagaggcgtaaggagtaggcggggcgagccggctgggctcagggtccaccagctcacccgggtcgaggggcaatctgaggcgactggtgacgcgcttatccacttccctcctcccgcctccccccggggtggcgctcgctggtgacgtagtgagtgtgatggccgccgcgaggccgggaaggtgaagtcaggactggtggagtcaacacagtcaatcaatagccaacctcaacctgagacaggacagaagagaactcagaatctttttgtcttttggacttcagccatgtccatgatgcctaccctgtgaagatctctcaccatccaaaaaacgcaatgtccctgctcttctctcgatgcaactctatcgtcacagtcaagaaaaataagagacacatggctgaggtgaatgcatccccacttaagcactttgtcactgccaagaagaagatcaatggcatttttgagcagctgggggcctacatccaggagagcgccaccttccttgaagacacgtacaggaatgcagaactggaccccgttaccacagaagaacaggttctggacgtcaaaggttacctatccaaagtgagaggcatcagtgaggtgctggctcggaggcacatgaaagtggctttttttggccggacgagcaatgggaagagcaccgtgatcaatgccatgctctgggacaaagttctgccctctgggattggccacaccaccaattgcttcctgcgggtagagggcacagatggccatgaggcctttctccttaccgagggctcagaggaaaagaggagtgccaagactgtgaaccagctggcccatgccctccaccaggacaagcagctccatgccggcagcctagtgagtgtgatgtggcccaactctaagtgcccacttctgaaggatgacctcgttttgatggacagccctggtattgatgtcaccacagagctggacagctggattgacaagttttgtctggatgctgatgtgtttgtgctggtggccaactcagagtccaccctgatgcagacggaaaagcacttcttccacaaggtgagtgagcgtctctcccggccaaacatcttcatcctgaacaaccgctgggatgcatctgcctcagagcccgagtacatggaggaggtgcggcggcagcacatggagcgttgtaccagcttcctggtggatgagctgggcgtggtggatcgatcccaggccggggaccgcatcttctttgtgtctgctaaggaggtgctcaacgccaggattcagaaagcccagggcatgcctgaaggagggggcgctctcgcagaaggctttcaagtgaggatgtttgagtttcagaattttgagaggagatttgaggagtgcatctcccagtctgcagtgaagaccaagtttgagcagcacacggtccgggccaagcagattgcagaggcggttcgactcatcatggactccctgcacatggcggctcgggagcagcaggtttactgcgaggaaatgcgtgaagagcggcaagaccgactgaaatttattgacaaacagctggagctcttggctcaagactataagctgcgaattaagcagattacggaggaagtggagaggcaggtgtcgactgcaatggccgaggagatcaggcgcctctctgtactggtggacgattaccagatggacttccacccttctccagtagtcctcaaggtttataagaatgagctgcaccgccacatagaggaaggactgggtcgaaacatgtctgaccgctgctccacggccatcaccaactccctgcagaccatgcagcaggacatgatagatggcttgaaacccctccttcctgtgtctgtgcggagtcagatagacatgctggtcccacgccagtgcttctccctcaactatgacctaaactgtgacaagctgtgtgctgacttccaggaagacattgagttccatttctctctcggatggaccatgctggtgaataggttcctgggccccaagaacagccgtcgggccttgatgggctacaatgaccaggtccagcgtcccatccctctgacgccagccaaccccagcatgcccccactgccacagggctcgctcacccaggaggagttcatggtttccatggttaccggcctggcctccttgacatccaggacctccatgggcattcttgttgttggaggagtggtgtggaaggcagtgggctggcggctcattgccctctcctttgggctctatggcctcctctacgtctatgagcgtctgacctggaccaccaaggccaaggagagggccttcaagcgccagtttgtggagcatgccagcgagaagctgcagcttgtcatcagctacactggctccaactgcagccaccaagtccagcaggaactgtctgggacctttgctcatctgtgtcagcaagttgacgtcacccgggagaacctggagcaggaaattgccgccatgaacaagaaaattgaggttcttgactcacttcagagcaaagcaaagctgctcaggaataaagccggttggttggacagtgagctcaacatgttcacacaccagtacctgcagcccagcagatagtgggcacctgaggcggagtctgcgtggagaggggcggtgctgccagccctaagtgccgtgtgggctcccccaggggcacgtgtggctcctgccccctggccactgccaagagaatgaagcacccagtctcgtaccattttgagccctccagcactacttattttcccccacctttgcctgctgttgctggaagagctggctcatacccccaaaggacactttcagcgacagctatggacagcatggtaccaaggagttaagttgaggctttttccagctttctctggttcatttgattgcttgataaggcctcaggatctcagcattgcacaatgcctcatggaagcctttgagggtatcacacagacacccccaccttcctccagcctgtgcgcacctgccctccttgcagcccagcacacctgcaggtgtaagggacgattggagtttcttcccagagagtctgtcccagaaggactgtggcttgtgtgtgtccatctcgcctgttggctcagtgcttcatcccatttgcagagcctcagacacgtcttggtggtgaggctcagttacccctgggcttaggctgaggcgggccctgtgctgggggtggtagaaaggatgctgctgaggcagctggaggagtgggagtagctcagaggggagggctgttggatgtatggggagctggcagagcaggtggcagtcactgggacaaggagggacttgcctctcttctcattattgtgtcctttgctttagtgtcagtcctggacttgtgcaggcctgttttgtgtagatctgttttggaagatggcatggtctaggtggttgaaggatgtagtagaaggatggatggtggaaggtggggacgttggtggctggctgaggtgcatgggccccacacaggacagctggagaatgggccgtccacttggcctcgttctgcgaggggctcatgggtctgagagcccccacccactaggcttgattgcatccctgttgtgccctttaagagacatgtttccaccccacccccaaccttgtcccaagtgccctggactaaatttcctgtgccagtgactgcagttggccaagggacaatgtggaaaacccagtgtccatctttccaccctccctgatctccagaaccttcgactgacccccttgtctttatgctgatgttgagttttgggattgttactggttgaagtgggggcagatgcctgtcaccaaggtgttgactgtgtgagaaaagcagtttgggtgacaaatcctgtgtggcacaagttggatcgcttcctagaaataagcaacacctctcccaaaaagcagcccacaaggcaggggcccagcagcccagccatcactcatctttgaggaaatgagttggtagcctctgtgcactgtttggtggccacatcacaggtgatgtcctgttcacatacctgcttgtatttaaagccctcagtctgtcctgttgtgtggggcgaagtgatggactctgccaggtggacatgctgtgggtggatgggagagaccctttctgaaagaagtatggccaaaagcactttaatgctgctgacattgttgtttttatgttcatttgctggagcgcaagacgtgctgacacagtgagttttctctgatgtatttaaggtgatgtatttgcttgagttactcctgtatcattgctcataatattggaaactaaaataaaacctagttggaaa

SEQ ID NO: 295279 - DNA, 3357 bp, Homo sapiens
acgcgccggcggaggagtggcgcgcggaggagtggcgcgctgagacgccgctcgaagcgccgagtcgcggggcagcagaggcgtaaggagtaggcggggcgagccggctgggctcagggtccaccagctcacccgggtcgaggggcaatctgaggcgactggtgacgcgcttatccacttccctcctcccgcctccccccggggtggcgctcgctggtgacgtagtgagtgtgatggccgccgcgaggccgggaaggtgaagtcaggactggtggagtcaacacagtcaatcaatagccaacctcaacctgagacaggacagaagagaactcagaatctttttgtcttttggacttcagccatgtccatgatgcctaccctgtgaagatctctcaccatccaaaaaacgcaatgtccctgctcttctctcgatgcaactctatcgtcacagtcaagaaaaataagagacacatggctgaggtgaatgcatccccacttaagcactttgtcactgccaagaagaagatcaatggcatttttgagcagctgggggcctacatccaggagagcgccaccttccttgaagacacgtacaggaatgcagaactggaccccgttaccacagaagaacaggttctggacgtcaaaggttacctatccaaagtgagaggcatcagtgaggtgctggctcggaggcacatgaaagtggctttttttggccggacgagcaatgggaagagcaccgtgatcaatgccatgctctgggacaaagttctgccctctgggattggccacaccaccaattgcttcctgcgggtagagggcacagatggccatgaggcctttctccttaccgagggctcagaggaaaagaggagtgccaagactgtgaaccagctggcccatgccctccaccaggacaagcagctccatgccggcagcctagtgagtgtgatgtggcccaactctaagtgcccacttctgaaggatgacctcgttttgatggacagccctggtattgatgtcaccacagagctggacagctggattgacaagttttgtctggatgctgatgtgtttgtgctggtggccaactcagagtccaccctgatgcagacggaaaagcacttcttccacaaggtgagtgagcgtctctcccggccaaacatcttcatcctgaacaaccgctgggatgcatctgcctcagagcccgagtacatggaggaggtgcggcggcagcacatggagcgttgtaccagcttcctggtggatgagctgggcgtggtggatcgatcccaggccggggaccgcatcttctttgtgtctgctaaggaggtgctcaacgccaggattcagaaagcccagggcatgcctgaaggagggggcgctctcgcagaaggctttcaagtgaggatgtttgagtttcagaattttgagaggagatttgaggagtgcatctcccagtctgcagtgaagaccaagtttgagcagcacacggtccgggccaagcagattgcagaggcggttcgactcatcatggactccctgcacatggcggctcgggagcagcaggtttactgcgaggaaatgcgtgaagagcggcaagaccgactgaaatttattgacaaacagctggagctcttggctcaagactataagctgcgaattaagcagattacggaggaagtggagaggcaggtgtcgactgcaatggccgaggagatcaggcgcctctctgtactggtggacgattaccagatggacttccacccttctccagtagtcctcaaggtttataagaatgagctgcaccgccacatagaggaaggactgggtcgaaacatgtctgaccgctgctccacggccatcaccaactccctgcagaccatgcagcaggacatgatagatggcttgaaacccctccttcctgtgtctgtgcggagtcagatagacatgctggtcccacgccagtgcttctccctcaactatgacctaaactgtgacaagctgtgtgctgacttccaggaagacattgagttccatttctctctcggatggaccatgctggtgaataggttcctgggccccaagaacagccgtcgggccttgatgggctacaatgaccaggtccagcgtcccatccctctgacgccagccaaccccagcatgcccccactgccacagggctcgctcacccaggaggagttcatggtttccatggttaccggcctggcctccttgacatccaggacctccatgggcattcttgttgttggaggagtggtgtggaaggcagtgggctggcggctcattgccctctcctttgggctctatggcctcctctacgtctatgagcgtctgacctggaccaccaaggccaaggagagggccttcaagcgccagtttgtggagcatgccagcgagaagctgcagcttgtcatcagctacactggctccaactgcagccaccaagtccagcaggaactgtctgggacctttgctcatctgtgtcagcaagttgacgtcacccgggagaacctggagcaggaaattgccgccatgaacaagaaaattgaggttcttgactcacttcagagcaaagcaaagctgctcaggaataaagccggttggttggacagtgagctcaacatgttcacacaccagtacctgcagcccagcagatagtgggcacctgaggcggagtctgcgtggagaggggcggtgctgccagccctaagtgccgtgtgggctcccccagcaggggcccagcagcccagccatcactcatctttgaggaaatgagttggtagcctctgtgcactgtttggtggccacatcacaggtgatgtcctgttcacatacctgcttgtatttaaagccctcagtctgtcctgttgtgtggggcgaagtgatggactctgccaggtggacatgctgtgggtggatgttcccggcgtgtgccgggcctgaatggacaggggccacttcacagcatgtcagggaaaatcactgtcacacaattccaatggattttgtgctctttttgaaaaaaaaaaattctttagcgtaaacatgaattttttttcaatgtagcccctggggaatgaatgaaattttgagcttcttcaatacgtaaaattaaatttataccactgagggagagaccctttctgaaagaagtatggccaaaagcactttaatgctgctgacattgttgtttttatgttcatttgctggagcgcaagacgtgctgacacagtgagttttctctgatgtatttaaggtgatgtatttgcttgagttactcctgtatcattgctcataatattggaaactaaaataaaacctagttggaaa

SEQ ID NO: 295280 - DNA, 984 bp, Homo sapiens
aatgtcggtatgtctaatgtcggtgtgtctaatgtcggtatgtctaatgtcggtgtgtctcatgtttccaccccacccccaaccttgtcccaagtgccctggactaaatttcctgtgccagtgactgcagttggccaagggacaatgtggaaaacccagtgtccatctttccaccctccctgatctccagaaccttcgactgacccccttgtctttatgctgatgttgagttttgggattgttactggttgaagtgggggcagatgcctgtcaccaaggtgttgactgtgtgagaaaagcagtttgggtgacaaatcctgtgtggcacaagttggatcgcttcctagaaataagcaacacctctcccaaaaagcagcccacaaggcaggggcccagcagcccagccatcactcatctttgaggaaatgagttggtagcctctgtgcactgtttggtggccacatcacaggtgatgtcctgttcacatacctgcttgtatttaaagccctcagtctgtcctgttgtgtggggcgaagtgatggactctgccaggtggacatgctgtgggtggatgttcccggcgtgtgccgggcctgaatggacaggggccacttcacagcatgtcagggaaaatcactgtcacacaattccaatggattttgtgctctttttgaaaaaaaaaaattctttagcgtaaacatgaattttttttcaatgtagcccctggggaatgaatgaaattttgagcttcttcaatacgtaaaattaaatttataccactgagggagagaccctttctgaaagaagtatggccaaaagcactttaatgctgctgacattgttgtttttatgttcatttgctggagcgcaagacgtgctgacacagtgagttttctctgatgtatttaaggtgatgtatttgcttgagttactcctgtatcattgctcataatattggaaactaaaataaaacctagttggaaa

SEQ ID NO: 295281 - DNA, 1679 bp, Homo sapiens
tcaagtattccagccctctgtcccacagaatagagaattaagtgagatactttacagtagctgaacacattggctttcagtcagttcttctgttcctcaatagtcagctgttccacagtcctcaagcccagttttgttcctagttttgctctgtcctcttctcccctctctggatgtacctttcccagggctcctgcagggacctccgtggtgcctcaaacccgcacatggcggaatacgtgtgcacagtcaggattggtcccacacctctgcgtttttttccccagggcacttcctcacatgccagcgcaactccccaatacctcaatgagtaagcttccctcagggatgagtttgtttggcttgaaacctgattagacatgttttgtacaccagtgttttttttttttggacaccggatccatctcccttttcggttttctaataagtcaggactggtggagtcaacacagtcaatcaatagccaacctcaacctgagacaggacagaagagaactcagaatctttttgtcttttggacttcagccatgtccatgatgcctaccctgtgaagatctctcaccatccaaaaaacgcaatgtccctgctcttctctcgatgcaactctatcgtcacagtcaagaaaaataagagacacatggctgaggtgaatgcatccccacttaagcactttgtcactgccaagaagaagatcaatggcatttttgagcagctgggggcctacatccaggagagcgccaccttccttgaagacacgtacaggaatgcagaactggactaaatttcctgtgccagtgactgcagttggccaagggacaatgtggaaaacccagtgtccatctttccaccctccctgatctccagaaccttcgactgacccccttgtctttatgctgatgttgagttttgggattgttactggttgaagtgggggcagatgcctgtcaccaaggtgttgactgtgtgagaaaagcagtttgggtgacaaatcctgtgtggcacaagttggatcgcttcctagaaataagcaacacctctcccaaaaagcagcccacaaggcaggggcccagcagcccagccatcactcatctttgaggaaatgagttggtagcctctgtgcactgtttggtggccacatcacaggtgatgtcctgttcacatacctgcttgtatttaaagccctcagtctgtcctgttgtgtggggcgaagtgatggactctgccaggtggacatgctgtgggtggatgttcccggcgtgtgccgggcctgaatggacaggggccacttcacagcatgtcagggaaaatcactgtcacacaattccaatggattttgtgctctttttgaaaaaaaaaaattctttagcgtaaacatgaattttttttcaatgtagcccctggggaatgaatgaaattttgagcttcttcaatacgtaaaattaaatttataccactgagggagagaccctttctgaaagaagtatggccaaaagcactttaatgctgctgacattgttgtttttatgttcatttgctggagcgcaagacgtgctgacacagtgagttttctctgatgtatttaaggtgatgtatttgcttgagttactcctgtatcattgctcataatattggaaactaaaataaaacctagttggaaa

SEQ ID NO: 295282 - DNA, 2551 bp, Homo sapiens
acgcgccggcggaggagtggcgcgcggaggagtggcgcgctgagacgccgctcgaagcgccgagtcgcggggcagcagaggcgtaaggagtaggcggggcgagccggctgggctcagggtccaccagctcacccgggtcgaggggcaatctgaggcgactggtgacgcgcttatccacttccctcctcccgcctccccccggggtggcgctcgctggtgacgtagtgagtgtgatggccgccgcgaggccgggaaggtgaagtcaggactggtggagtcaacacagtcaatcaatagccaacctcaacctgagacaggacagaagagaactcagaatctttttgtcttttggacttcagccatgtccatgatgcctaccctgtgaagatctctcaccatccaaaaaacgcaatgtccctgctcttctctcgatgcaactctatcgtcacagtcaagaaaaataagagacacatggctgaggtgaatgcatccccacttaagcactttgtcactgccaagaagaagatcaatggcatttttgagcagctgggggcctacatccaggagagcgccaccttccttgaagacacgtacaggaatgcagaactggaccccgttaccacagaagaacaggttctggacgtcaaaggttacctatccaaagtgagaggcatcagtgaggtgctggctcggaggcacatgaaagtggctttttttggccggacgagcaatgggaagagcaccgtgatcaatgccatgctctgggacaaagttctgccctctgggattggccacaccaccaattgcttcctgcgggtagagggcacagatggccatgaggcctttctccttaccgagggctcagaggaaaagaggagtgccaagactgtgaaccagctggcccatgccctccaccaggacaagcagctccatgccggcagcctagtgagtgtgatgtggcccaactctaagtgcccacttctgaaggatgacctcgttttgatggacagccctggtattgatgtcaccacagagctggacagctggattgacaagttttgtctggatgctgatgtgtttgtgctggtggccaactcagagtccaccctgatgcagacggaaaagcacttcttccacaaggtgagtgagcgtctctcccggccaaacatcttcatcctgaacaaccgctgggatgcatctgcctcagagcccgagtacatggaggaggtgcggcggcagcacatggagcgttgtaccagcttcctggtggatgagctgggcgtggtggatcgatcccaggccggggaccgcatcttctttgtgtctgctaaggaggtgctcaacgccaggattcagaaagcccagggcatgcctgaaggagggggcgctctcgcagaaggctttcaagtgaggatgtttgagtttcagaattttgagaggagatttgaggagtgcatctcccagtctgcagtgaagaccaagtttgagcagcacacggtccgggccaagcagattgcagaggcggttcgactcatcatggactccctgcacatggcggctcgggagcagcaggtttactgcgaggaaatgcgtgaagagcggcaagaccgactgaaatttattgacaaacagctggagctcttggctcaagactataagctgcgaattaagcagattacggaggaagtggagaggcaggtgtcgactgcaatggccgaggagatcaggcgcctctctgtactggtggacgattaccagatggacttccacccttctccagtagtcctcaaggtttataagaatgagctgcaccgccacatagaggaaggactgggtcgaaacatgtctgaccgctgctccacggccatcaccaactccctgcagaccatgcagcaggacatgatagatggcttgaaacccctccttcctgtgtctgtgcggagtcagatagacatgctggtcccacgccagtgcttctccctcaactatgacctaaactgtgacaagctgtgcactgtttggtggccacatcacaggtgatgtcctgttcacatacctgcttgtatttaaagccctcagtctgtcctgttgtgtggggcgaagtgatggactctgccaggtggacatgctgtgggtggatgttcccggcgtgtgccgggcctgaatggacaggggccacttcacagcatgtcagggaaaatcactgtcacacaattccaatggattttgtgctctttttgaaaaaaaaaaattctttagcgtaaacatgaattttttttcaatgtagcccctggggaatgaatgaaattttgagcttcttcaatacgtaaaattaaatttataccactgagggagagaccctttctgaaagaagtatggccaaaagcactttaatgctgctgacattgttgtttttatgttcatttgctggagcgcaagacgtgctgacacagtgagttttctctgatgtatttaaggtgatgtatttgcttgagttactcctgtatcattgctcataatattggaaactaaaataaaacctagttggaaa

SEQ ID NO: 295283 - DNA, 3787 bp, Homo sapiens
  misc_feature (3608)..(3609): n is a, c, g, or t
  misc_feature (3611)..(3611): n is a, c, g, or t
  misc_feature (3616)..(3616): n is a, c, g, or t
  misc_feature (3651)..(3651): n is a, c, g, or t
  misc_feature (3684)..(3684): n is a, c, g, or t
  misc_feature (3686)..(3686): n is a, c, g, or t
  misc_feature (3746)..(3746): n is a, c, g, or t
acgcgccggcggaggagtggcgcgcggaggagtggcgcgctgagacgccgctcgaagcgccgagtcgcggggcagcagaggcgtaaggagtaggcggggcgagccggctgggctcagggtccaccagctcacccgggtcgaggggcaatctgaggcgactggtgacgcgcttatccacttccctcctcccgcctccccccggggtggcgctcgctggtgacgtagtgagtgtgatggccgccgcgaggccgggaaggtgaagtcaggactggtggagtcaacacagtcaatcaatagccaacctcaacctgagacaggacagaagagaactcagaatctttttgtcttttggacttcagccatgtccatgatgcctaccctgtgaagatctctcaccatccaaaaaacgcaatgtccctgctcttctctcgatgcaactctatcgtcacagtcaagaaaaataagagacacatggctgaggtgaatgcatccccacttaagcactttgtcactgccaagaagaagatcaatggcatttttgagcagctgggggcctacatccaggagagcgccaccttccttgaagacacgtacaggaatgcagaactggaccccgttaccacagaagaacaggttctggacgtcaaaggttacctatccaaagtgagaggcatcagtgaggtgctggctcggaggcacatgaaagtggctttttttggccggacgagcaatgggaagagcaccgtgatcaatgccatgctctgggacaaagttctgccctctgggattggccacaccaccaattgcttcctgcgggtagagggcacagatggccatgaggcctttctccttaccgagggctcagaggaaaagaggagtgccaagactgtgaaccagctggcccatgccctccaccaggacaagcagctccatgccggcagcctagtgagtgtgatgtggcccaactctaagtgcccacttctgaaggatgacctcgttttgatggacagccctggtattgatgtcaccacagagctggacagctggattgacaagttttgtctggatgctgatgtgtttgtgctggtggccaactcagagtccaccctgatgcagacggaaaagcacttcttccacaaggtgagtgagcgtctctcccggccaaacatcttcatcctgaacaaccgctgggatgcatctgcctcagagcccgagtacatggaggaggtgcggcggcagcacatggagcgttgtaccagcttcctggtggatgagctgggcgtggtggatcgatcccaggccggggaccgcatcttctttgtgtctgctaaggaggtgctcaacgccaggattcagaaagcccagggcatgcctgaaggagggggcgctctcgcagaaggctttcaagtgaggatgtttgagtttcagaattttgagaggagatttgaggagtgcatctcccagtctgcagtgaagaccaagtttgagcagcacacggtccgggccaagcagattgcagaggcggttcgactcatcatggactccctgcacatggcggctcgggagcagcaggtttactgcgaggaaatgcgtgaagagcggcaagaccgactgaaatttattgacaaacagctggagctcttggctcaagactataagctgcgaattaagcagattacggaggaagtggagaggcaggtgtcgactgcaatggccgaggagatcaggcgcctctctgtactggtggacgattaccagatggacttccacccttctccagtagtcctcaaggtttataagaatgagctgcaccgccacatagaggaaggactgggtcgaaacatgtctgaccgctgctccacggccatcaccaactccctgcagaccatgcagcaggacatgatagatggcttgaaacccctccttcctgtgtctgtgcggagtcagatagacatgctggtcccacgccagtgcttctccctcaactatgacctaaactgtgacaagctgtgtgctgacttccaggaagacattgagttccatttctctctcggatggaccatgctggtgaataggttcctgggccccaagaacagccgtcgggccttgatgggctacaatgaccaggtccagcgtcccatccctctgacgccagccaaccccagcatgcccccactgccacagggctcgctcacccaggaggagttcatggtttccatggttaccggcctggcctccttgacatccaggacctccatgggcattcttgttgttggaggagtggtgtggaaggcagtgggctggcggctcattgccctctcctttgggctctatggcctcctctacgtctatgagcgtctgacctggaccaccaaggccaaggagagggccttcaagcgccagtttgtggagcatgccagcgagaagctgcagcttgtcatcagctacactggctccaactgcagccaccaagtccagcaggaactgtctgggacctttgctcatctgtgtcagcaagttgacgtcacccgggagaacctggagcaggaaattgccgccatgaacaagaaaattgaggttcttgactcacttcagagcaaagcaaagctgctcaggaataaagccggttggttggacagtgagctcaacatgttcacacaccagtacctgcagcccagcagatagtgggcacctgaggcggagtctgcgtggagaggggcggtgctgccagccctaagtgccgtgtgggctcccccaggggcacgtgtggctcctgccccctggccactgccaagagaatgaagcacccagtctcgtaccattttgagccctccagcactacttattttcccccacctttgcctgctgttgctggaagagctggctcatacccccaaaggacactttcagcgacagctatggacagcatggtaccaaggagttaagttgaggctttttccagctttctctggttcatttgattgcttgataaggcctcaggatctcagcattgcacaatgcctcatggaagcctttgagggtatcacacagacacccccaccttcctccagcctgtgcgcacctgccctccttgcagcccagcacacctgcaggtgtaagggacgattggagtttcttcccagagagtctgtcccagaaggactgtggcttgtgtgtgtccatctcgcctgttggctcagtgcttcatcccatttgcagagcctcagacacgtcttggtggtgaggctcagttacccctgggcttaggctgaggcgggccctgtgctgggggtggtagaaaggatgctgctgaggcagctggaggagtgggagtagctcagaggggagggctgttggatgtatggggagctggcagagcaggtggcagtcactgggacaaggagggacttgcctctcttctcattattgtgtcctttgctttagtgtcagtcctggacttgtgcaggcctgttttgtgtagatctgttttggaagatggcatggtctaggtggttgaaggatgtagtagaaggatggatggtggaaggtggggacgttggtggctggctgaggtgcatgggccccacacaggacagctggagcctaanncnagggntaactgagcctcaccaccaagacgtgtctaaggcnctgcaaatgggatgaagcactgagccaacaggngngatggacacacacaagccacagtccttcttcccagagagtctgtcccagaaggactgttngcttgtgtcggaattcgccgatactaacgggctccagagtc

SEQ ID NO: 295284 - DNA, 409 bp, Homo sapiens
cctctctctctctctctctctctctctctctctctctctctctctctctccgggaaaatcactgtcacacaattccaatggattttgtgctctttttgaaaaaaaaaaattctttagcgtaaacatgaattttttttcaatgtagcccctggggaatgaatgaaattttgagcttcttcaatacgtaaaattaaatttataccactgagggagagaccctttctgaaagaagtatggccaaaagcactttaatgctgctgacattgttgtttttatgttcatttgctggagcgcaagacgtgctgacacagtgagttttctctgatgtatttaaggtgatgtatttgcttgagttactcctgtatcattgctcataatattggaaactaaaataaaacctagttggaaa

SEQ ID NO: 295285 - DNA, 1280 bp, Homo sapiens
acgcgccggcggaggagtggcgcgcggaggagtggcgcgctgagacgccgctcgaagcgccgagtcgcggggcagcagaggcgtaaggagtaggcggggcgagccggctgggctcagggtccaccagctcacccgggtcgaggggcaatctgaggcgactggtgacgcgcttatccacttccctcctcccgcctccccccggggtggcgctcgctggtgacgtagtgagtgtgatggccgccgcgaggccgggaaggtgaagtcaggactggtggagtcaacacagtcaatcaatagccaacctcaacctgagacaggacagaagagaactcagaatctttttgtcttttggacttcagccatgtccatgatgcctaccctgtgaagatctctcaccatccaaaaaacgcaatgtccctgctcttctctcgatgcaactctatcgtcacagtcaagaaaaataagagacacatggctgaggtgaatgcatccccacttaagcactttgtcactgccaagaagaagatcaatggcatttttgagcagctgggggcctacatccaggagagcgccaccttccttgaagacacgtacaggaatgcagaactggaccccgttaccacagaagaacaggttctggacgtcaaaggttacctatccaaagtgagaggcatcagtgaggtgctggctcggaggcacatgaaagtggctttttttggccggacgagcaatgggaagagcaccgtgatcaatgccatgctctgggacaaagttctgccctctgggattggccacaccaccaattgcttcctgcgggtagagggcacagatggccatgaggcctttctccttaccgagggctcagaggaaaagaggagtgccaagactgtgaaccagctggcccatgccctccaccaggacaagcagctccatgccggcagcctagtgagtgtgatgtggcccaactctaagtgcccacttctgaaggatgacctcgttttgatggacagccctggtattgatgtcaccacagagctggacagctggattgacaagttttgtctggatgctgatgtgtttgtgctggtggccaactcagagtccaccctgatgcagacggaaaagcacttcttccacaaggtgagtgagcgtctctcccggccaaacatcttcatcctgaacaaccgctgggatgcatctgcctcagagcccgagtacatggaggagggacggggagacatggagggtgaacattctgggataaagggatggggatgtca

SEQ ID NO: 295286 - DNA, 3079 bp, Homo sapiens
acgcgccggcggaggagtggcgcgcggaggagtggcgcgctgagacgccgctcgaagcgccgagtcgcggggcagcagaggcgtaaggagtaggcggggcgagccggctgggctcagggtccaccagctcacccgggtcgaggggcaatctgaggcgactggtgacgcgcttatccacttccctcctcccgcctccccccggggtggcgctcgctggtgacgtagtgagtgtgatggccgccgcgaggccgggaaggtgaagtcaggactggtggagtcaacacagtcaatcaatagccaacctcaacctgagacaggacagaagagaactcagaatctttttgtcttttggacttcagccatgtccatgatgcctaccctgtgaagatctctcaccatccaaaaaacgcaatgtccctgctcttctctcgatgcaactctatcgtcacagtcaagaaaaataagagacacatggctgaggtgaatgcatccccacttaagcactttgtcactgccaagaagaagatcaatggcatttttgagcagctgggggcctacatccaggagagcgccaccttccttgaagacacgtacaggaatgcagaactggaccccgttaccacagaagaacaggttctggacgtcaaaggttacctatccaaagtgagaggcatcagtgaggtgctggctcggaggcacatgaaagtggctttttttggccggacgagcaatgggaagagcaccgtgatcaatgccatgctctgggacaaagttctgccctctgggattggccacaccaccaattgcttcctgcgggtagagggcacagatggccatgaggcctttctccttaccgagggctcagaggaaaagaggagtgccaagactgtgaaccagctggcccatgccctccaccaggacaagcagctccatgccggcagcctagtgagtgtgatgtggcccaactctaagtgcccacttctgaaggatgacctcgttttgatggacagccctggtattgatgtcaccacagagctggacagctggattgacaagttttgtctggatgctgatgtgtttgtgctggtggccaactcagagtccaccctgatgcagacggaaaagcacttcttccacaaggtgagtgagcgtctctcccggccaaacatcttcatcctgaacaaccgctgggatgcatctgcctcagagcccgagtacatggaggaggtgcggcggcagcacatggagcgttgtaccagcttcctggtggatgagctgggcgtggtggatcgatcccaggccggggaccgcatcttctttgtgtctgctaaggaggtgctcaacgccaggattcagaaagcccagggcatgcctgaaggagggggcgctctcgcagaaggctttcaagtgaggatgtttgagtttcagaattttgagaggagatttgaggagtgcatctcccagtctgcagtgaagaccaagtttgagcagcacacggtccgggccaagcagattgcagaggcggttcgactcatcatggactccctgcacatggcggctcgggagcagcaggtttactgcgaggaaatgcgtgaagagcggcaagaccgactgaaatttattgacaaacagctggagctcttggctcaagactataagctgcgaattaagcagattacggaggaagtggagaggcaggtgtcgactgcaatggccgaggagatcaggcgcctctctgtactggtggacgattaccagatggacttccacccttctccagtagtcctcaaggtttataagaatgagctgcaccgccacatagaggaaggactgggtcgaaacatgtctgaccgctgctccacggccatcaccaactccctgcagaccatgcagcaggacatgatagatggcttgaaacccctccttcctgtgtctgtgcggagtcagatagacatgctggtcccacgccagtgcttctccctcaactatgacctaaactgtgacaagctgtgtgctgacttccaggaagacattgagttccatttctctctcggatggaccatgctggtgaataggttcctgggccccaagaacagccgtcgggccttgatgggctacaatgaccaggtccagcgtcccatccctctgacgccagccaaccccagcatgcccccactgccacagggctcgctcacccaggaggagttcatggtttccatggttaccggcctggcctccttgacatccaggacctccatgggcattcttgttgttggaggagtggtgtggaaggcagtgggctggcggctcattgccctctcctttgggctctatggcctcctctacgtctatgagcgtctgacctggaccaccaaggccaaggagagggccttcaagcgccagtttgtggagcatgccagcgagaagctgcagcttgtcatcagctacactggctccaactgcagccaccaagtccagcacaggggcccagcagcccagccatcactcatctttgaggaaatgagttggtagcctctgtgcactgtttggtggccacatcacaggtgatgtcctgttcacatacctgcttgtatttaaagccctcagtctgtcctgttgtgtggggcgaagtgatggactctgccaggtggacatgctgtgggtggatgttcccggcgtgtgccgggcctgaatggacaggggccacttcacagcatgtcagggaaaatcactgtcacacaattccaatggattttgtgctctttttgaaaaaaaaaaattctttagcgtaaacatgaattttttttcaatgtagcccctggggaatgaatgaaattttgagcttcttcaatacgtaaaattaaatttataccactgagggagagaccctttctgaaagaagtatggccaaaagcactttaatgctgctgacattgttgtttttatgttcatttgctggagcgcaagacgtgctgacacagtgagttttctctgatgtatttaaggtgatgtatttgcttgagttactcctgtatcattgctcataatattggaaactaaaataaaacctagttggaaa

SEQ ID NO: 295287 - DNA, 2739 bp, Homo sapiens
acgcgccggcggaggagtggcgcgcggaggagtggcgcgctgagacgccgctcgaagcgccgagtcgcggggcagcagaggcgtaaggagtaggcggggcgagccggctgggctcagggtccaccagctcacccgggtcgaggggcaatctgaggcgactggtgacgcgcttatccacttccctcctcccgcctccccccggggtggcgctcgctggtgacgtagtgagtgtgatggccgccgcgaggccgggaaggtgaagtcaggactggtggagtcaacacagtcaatcaatagccaacctcaacctgagacaggacagaagagaactcagaatctttttgtcttttggacttcagccatgtccatgatgcctaccctgtgaagatctctcaccatccaaaaaacgcaatgtccctgctcttctctcgatgcaactctatcgtcacagtcaagaaaaataagagacacatggctgaggtgaatgcatccccacttaagcactttgtcactgccaagaagaagatcaatggcatttttgagcagctgggggcctacatccaggagagcgccaccttccttgaagacacgtacaggaatgcagaactggaccccgttaccacagaagaacaggttctggacgtcaaaggttacctatccaaagtgagaggcatcagtgaggtgctggctcggaggcacatgaaagtggctttttttggccggacgagcaatgggaagagcaccgtgatcaatgccatgctctgggacaaagttctgccctctgggattggccacaccaccaattgcttcctgcgggtagagggcacagatggccatgaggcctttctccttaccgagggctcagaggaaaagaggagtgccaagactgtgaaccagctggcccatgccctccaccaggacaagcagctccatgccggcagcctagtgagtgtgatgtggcccaactctaagtgcccacttctgaaggatgacctcgttttgatggacagccctggtattgatgtcaccacagagctggacagctggattgacaagttttgtctggatgctgatgtgtttgtgctggtggccaactcagagtccaccctgatgcagacggaaaagcacttcttccacaaggtgagtgagcgtctctcccggccaaacatcttcatcctgaacaaccgctgggatgcatctgcctcagagcccgagtacatggaggaggtgcggcggcagcacatggagcgttgtaccagcttcctggtggatgagctgggcgtggtggatcgatcccaggccggggaccgcatcttctttgtgtctgctaaggaggtgctcaacgccaggattcagaaagcccagggcatgcctgaaggagggggcgctctcgcagaaggctttcaagtgaggatgtttgagtttcagaattttgagaggagatttgaggagtgcatctcccagtctgcagtgaagaccaagtttgagcagcacacggtccgggccaagcagattgcagaggcggttcgactcatcatggactccctgcacatggcggctcgggagcagcaggtttactgcgaggaaatgcgtgaagagcggcaagaccgactgaaatttattgacaaacagctggagctcttggctcaagactataagctgcgaattaagcagattacggaggaagtggagaggcaggtgtcgactgcaatggccgaggagatcaggcgcctctctgtactggtggacgattaccagatggacttccacccttctccagtagtcctcaaggtttataagaatgagctgcaccgccacatagaggaaggactgggtcgaaacatgtctgaccgctgctccacggccatcaccaactccctgcagaccatgcagcaggacatgatagatggcttgaaacccctccttcctgtgtctgtgcggagtcagatagacatgctggtcccacgccagtgcttctccctcaactatgacctaaactgtgacaagctgtgtgctgacttccaggaagacattgagttccatttctctctcggatggaccatgctggtgaataggttcctgggccccaagaacagccgtcgggccttgatgggctacaatgaccaggtccagcgtcccatccctctgacgccagccaaccccagcatgcccccactgccacagggctcgctcacccaggaggagttcatggtttccatggttaccggcctggcctccttgacatccaggacctccatgggcattcttgttgttggaggagtggtgtggaaggcagtgggctggcggctcattgccctctcctttgggctctatggcctcctctacgtctatgagcgtctgacctggaccaccaaggccaaggagagggccttcaagcgccagtttgtggagcatgccagcgagaagctgcagcttgtcatcagctacactggctccaactgcagccaccaagtccagcaggaactgtctgggacctttgctcatctgtgtcagcaagttgacgtcacccgggagaacgggagagaccctttctgaaagaagtatggccaaaagcactttaatgctgctgacattgttgtttttatgttcatttgctggagcgcaagacgtgctgacacagtgagttttctctgatgtatttaaggtgatgtatttgcttgagttactcctgtatcattgctcataatattggaaactaaaataaaacctagttggaaa

SEQ ID NO: 295288 - DNA, 1365 bp, Homo sapiens
acgcgccggcggaggagtggcgcgcggaggagtggcgcgctgagacgccgctcgaagcgccgagtcgcggggcagcagaggcgtaaggagtaggcggggcgagccggctgggctcagggtccaccagctcacccgggtcgaggggcaatctgaggcgactggtgacgcgcttatccacttccctcctcccgcctccccccggggtggcgctcgctggtgacgtagtgagtgtgatggccgccgcgaggccgggaaggtgaagtcaggactggtggagtcaacacagtcaatcaatagccaacctcaacctgagacaggacagaagagaactcagaatctttttgtcttttggacttcagccatgtccatgatgcctaccctgtgaagatctctcaccatccaaaaaacgcaatgtccctgctcttctctcgatgcaactctatcgtcacagtcaagaaaaataagagacacatggctgaggtgaatgcatccccacttaagcactttgtcactgccaagaagaagatcaatggcatttttgagcagctgggggcctacatccaggagagcgccaccttccttgaagacacgtacaggaatgcagaactggaccccgttaccacagaagaacaggttctggacgtcaaaggttacctatccaaagtgagaggcatcagtgaggtgctggctcggaggcacatgaaagtggctttttttggccggacgagcaatgggaagagcaccgtgatcaatgccatgctctgggacaaagttctgccctctgggattggccacaccaccaattgcttcctgcgggtagagggcacagatggccatgaggcctttctccttaccgagggctcagaggaaaagaggagtgccaagactgtgaaccagctggcccatgccctccaccaggacaagcagctccatgccggcagcctagtgagtgtgatgtggcccaactctaagtgcccacttctgaaggatgacctcgttttgatggacaggtaagagggaggtgccctcctaggaggtccaaactggaaggcaccaggtttccatttctggataatctaggccagggtccctgggccccatccttgctctgcttaagtattactacctttcagatgggctcaaccaaatcctctggcctcttggctttcctctggagtctggttactatacctatttatcagtaccctgcagatgtcccagggatggtctgtaaaagataggagggatgctcaaaagttggtgggggaggttctcaatctcagcccagtgccagcatgtgtactgggggtggggagttgtggcggagtcagaggtgtattttatttcccttgaagaaacactttg

SEQ ID NO: 295289 - DNA, 815 bp, Homo sapiens
aggtccccttccacactgttgaagctttgttcttttgctctttgcactaaatcttgctactgctcactctttgggtccacactgcttttatgagctgtaacactcaccgtgaaggtctgcagcttcactcctgaagccagcaagaccacgaacccaccaggaggaatgaacaactccagacgcaccaccctaagagctgtaacactcaccgcgaaggtctgcagcttcactcctgagccagcgagaccatgaacccaccaaaaggaagaaactctgaacacatcttgacatcagaaggaagaaacaaactccagacacgccacctttaagaactgtaataacactcaccgcgagggtctgcggctttgttcttgaagtcagtgagaccaagaacccacaattctggactcaataactttattcataattaccaaaaatgagaaaaaaacaagatgtacttcaataggaccgcggcggctaggtcacctcctccggacgccgacacgcgctgccctggcaaccgtcaccagggaaacaagcgacgtcacttgcgcgttttcaacgctactctacgggggccgagggggcgccaagagttctgaaagtgacagaggcgctgatggcgcgctgggctggatccaagcgagcacgatctcgagtgcgctggagattttaaatcttctggagtatatttttaaaaaagttttgtggaccaaacgttctgcacagagatgcccattccgctctcctgttggggagttaaaaagcgaacgatctcaccatgaaatttaaagtagccattcagatatatttga

SEQ ID NO: 295290 - DNA, 788 bp, Homo sapiens
agcgtgtgggcagcgcgtgtcggcgtccggaggaggtgacctagccgccgcggtcctagaagggagaagtggagagagaccgctggcaggatggcagcagatgaaagctcacagaacactttgcggctccagttcaaggcaatgcaggagatgcagcacaaacggttacagaagcagatggagaaaaagagggaaaaagaactgagcctcaaaagcagagctgacgaccaagaggagcccttggaggtttcagatggcctcagccttctccacgcaggggagccaaactcgaaaaatagctttgagaagagggtgcttgaagatgagattgaacaccttcgaaatgagctcagggaaacggtggacgagaacgggcgattgtataagctgctgaaggaaagggactttgaaatcaaacacctcaaaaagaaaatagaagaggacagatttgccttcacagggacagccggtgtagccggagacgtggtcgccaccaaaattgtggagctatcaaaaaagaaccggctgttgatggcagaatcagagggtgcaaaaaccagggtgaagcagctgaccaatcgcatccaggagctggagcgggaagtgaggggccttggtcattctccctctggaggggactcctagcatgggcaagagggaacctccctagcttctccatatgtagccgggagagctgaagttggaaggttaagaggctttctcaagtcacgcagtatatggtggtgctgcattttaaatccaattctgttgccctccaacaggcttct

SEQ ID NO: 295291 - DNA, 774 bp, Homo sapiens
agcgtgtgggcagcgcgtgtcggcgtccggaggaggtgacctagccgccgcggtcctagaagggagaagtggagagagaccgctggcaggatggcagcagatgaaagctcacagaacactttgcggctccagttcaaggcaatgcaggagatgcagcacaaacggttacagaagcagatggagaaaaagagggaaaaagaactgagcctcaaaagcagagctgacgaccaagaggagcccttggaggtttcagatggcctcagccttctccacgcaggggagccaaactcgaaaaatagctttgagaagagggtgcttgaagatgagattgaacaccttcgaaatgagctcagggaaacggtggacgagaacgggcgattgtataagctgctgaaggaaagggactttgaaatcaaacacctcaaaaagaaaatagaagaggacagatttgccttcacagggacagccggtgtagccggagacgtggtcgccaccaaaattgtggagctatcaaaaaagaaccggctgttgatggcagaatcagagggtgcaaaaaccagggtgaagcagctgaccaatcgcatccaggagctggagcgggaactgcagacagccctgaccaggctgtcagccaagggggccaccgacgcaggagccaagccaccgagggcccagatgggagacagagcattgctggagaccccagaggtgaaggccctgcaggacaggctggtggccaccaacttgaagatgagtgacctccgaaaccagatc

SEQ ID NO: 295292 - DNA, 3883 bp, Homo sapiens
caagactggaagcagagagagagagcaagagtgagagagagcgagcgagcgtagtcaggagatggtgttgtattccaggagaaaaacgtttcttcatttcaactcaaacttgctgctaaagcgcctaaatctgaaaaggaaatggacccagaatatgaagagaaaatgaaagccgaccgagcaaagagatttgaatttttactgaagcagacagaactttttgcacatttcattcagccttcagcacagaaatctccaacatctccactgaacatgaaattgggacgtccccgaataaagaaagatgaaaagcagagcttaatttctgctggagactaccgccataggcgcacagagcaagaagaagatgaagagctactgtctgagagtcggaaaacatctaatgtgtgtattagatttgaggtgtcaccttcatatgtgaaaggggggccactgagagattatcagattcgaggactgaattggttgatctctttatatgaaaatggagtcaatggcattttggctgatgaaatgggccttgggaaaactttacaaacaattgctttgcttggttacctgaaacactaccgaaatattcctggacctcacatggttttagttccaaagtctactttacacaactggatgaatgaatttaaacgatgggtcccatctctccgtgtcatttgttttgtcggagacaaggatgccagagctgcttttattcgtgatgaaatgatgccaggagagtgggatgtttgcgttacttcttatgagatggtaattaaagaaaaatctgtattcaaaaagtttcactggcgatacctggtcattgatgaagctcacagaataaagaatgaaaaatctaagctttcagagattgttcgtgagttcaagtcgactaaccgcttgctcctaactggaacacctttgcagaataacctgcatgaactgtgggccttactcaactttttattgcctgatgtctttaattctgcagatgactttgattcttggtttgacactaaaaattgtcttggtgatcaaaaactcgtggaaagacttcatgcagttttaaaaccatttttgttacgccgtataaaaactgatgtagagaagagtctgccacctaaaaaggaaataaagatttacttggggctgagtaagatgcaacgagaatggtatacaaaaatcctgatgaaagatattgatgttttaaactcttctggcaagatggacaagatgcgactcttaaacattctgatgcagcttcgaaagtgttgtaatcatccatatctgtttgatggtgctgaacctggtccaccttataccactgatgagcatattgtcagcaacagtggtaaaatggtagttctggataaactattggccaaactcaaagaacagggttcaagggttctcattttcagccagatgactcgcttgctggatattttggaagattattgcatgtggcgtggttatgagtattgtcgactggatggacaaaccccgcatgaagaaagagaggataaattcctagaagtggaatttctgggtcaaagggaagcaatagaggcttttaatgctcctaatagtagcaaattcatctttatgctaagtaccagggctggaggtctcggaattaacctggcaagtgctgatgtggttatactatatgattcagactggaacccacaggttgatctacaagctatggatcgagcacatcgtattggtcagaagaaaccagtacgtgtattccgtctcatcactgacaacactgttgaagagaggattgtagaaagagctgagataaaactgagactcgattcaattgttatacaacaaggaagactcattgaccaacagtctaacaagctggcaaaagaggaaatgttacaaatgatacggcatggagccacccatgtttttgcttctaaagagagtgagttgacagatgaagacattacaactattctggaaagaggggaaaagaagactgcagagatgaatgaacgcctgcaaaaaatgggagagtcttctctaagaaattttagaatggacattgaacaaagtttatacaaatttgagggagaagattatagagaaaaacagaagcttggcatggtggaatggattgaacctcctaaacgagaacgcaaagcaaactacgcagtggatgcctactttagagaggctttgcgtgtcagcgagccaaagattccaaaggctccacggcctccaaaacagccaaatgttcaggattttcaatttttcccaccacgcttatttgagctcctggaaaaggaaattctttattatcggaagacaataggctataaggttccaaggaatcctgatatcccaaatccagctctggctcaaagagaagagcaaaaaaagattgatggagctgaacctcttacaccagaagagactgaagaaaaggaaaaacttctcacacaaggtttcacaaactggactaaacgagattttaaccagtttattaaagctaatgagaaatatggaagagatgacattgataacatagctcgagaggtagagggcaaatcccctgaggaggtcatggagtattcagctgtattttgggaacgttgcaatgaattacaggacattgagaaaattatggctcaaattgaacgtggagaagcaagaattcaacgaaggatcagtatcaagaaagccctggatgccaaaattgcaagatacaaggctccatttcatcagttgcgcattcagtatggaaccagcaaaggaaagaactatactgaggaagaagatagattcttgatttgtatgttacacaaaatgggctttgatagagaaaatgtatatgaagaattaagacagtgtgtacgaaatgctccccagtttagatttgactggtttatcaagtctaggactgccatggaattccagagacgctgtaacactctgatttcattgattgagaaagaaaatatggaaattgaggaaagagagagagcagaaaagaagaaacgggcaactaaaactccaatggtaaaattttcagcattttcctaacttttagatttaacattgttgggccatttaaaatgtgcatattggagcagaacattaaatctgtttccattttagtcacagaaaagaaaagcagagtcagctactgagagctctggaaagaaggatgtcaagaaggtgaaatcctaaagcctagaaataaagttttaaatgggaaactgctattttcttgttcccatcttcaaatgctaattgccagttccagtgtattcatggtactctaagaaaaatctctttggttttgatttcttgcatattttatatattttacaatgctttctacctgaaatgtgtagctttatattttatggcattctagtatttttgtgtactgtattttgtgcatttcatgtcttcatcaaaatcctctcagtccttgttcttttgaagcttgtgctgaggttttagcttttctatgttttatatgccgctgctttgaaagagaacctagattctatagttgtattattgttgtttcatactttaaatttatatggctgtggaaaaacgaattaaaatgttttgaggagaaagactttttcacttctttgttgctttcttttctattgagtctgggcttgtttgtgttactgcatactgtgattagcataataattgtttctttgaggtcatctaaatatttttttcctaaaggaataaagggtgaggaaagaaaaatattaaaaaagctaatatttgatactgtgcttgctgtcagtatgcattacatttaaattattctctattcaagtgggaaaatataataaagaaatgtctataagaaaaaaaaaaa

SEQ ID NO: 295293 - DNA, 4399 bp, Homo sapiens
aaaattcactatgatcaagtgggattcatcctaggaatgtaagactggttccacatatgcaaattaataagcattatagatcacattagcagaaccaagaacaaagaccatatgatcttttcaatagacattgaaaaagtgtttgataaaattcaatattcctttattttaaaaaccctcaaaaactcagtatacatggagtataataataataaaggccataaatttacagcaaacttcatactgaatggagaaaaattgaaagcctttcccctaaaatctggaaaaaaccaagaatgctcactttcaccatttttatgcaacataccctgctccatctagctctttccagtgcagccactgccgccgcccaggagccctcgtcccctgccttgtccccctactcgttcccgctcccacggcatggagcaggacactgccgcagtggcagccaccgtggcagccgcggatgcgaccgccactatcgtggtcatagaggacgagcagcccgggccgtccacctctcaggaggagggagcggccgccgcggccaccgaagccaccgcggccacggagaagggcgagaagaagaaggagaaaaacgtttcttcatttcaactcaaacttgctgctaaagcgcctaaatctgaaaaggaaatggacccagaatatgaagagaaaatgaaagccgaccgagcaaagagatttgaatttttactgaagcagacagaactttttgcacatttcattcagccttcagcacagaaatctccaacatctccactgaacatgaaattgggacgtccccgaataaagaaagatgaaaagcagagcttaatttctgctggagactaccgccataggcgcacagagcaagaagaagatgaagagctactgtctgagagtcggaaaacatctaatgtgtgtattagatttgaggtgtcaccttcatatgtgaaaggggggccactgagagattatcagattcgaggactgaattggttgatctctttatatgaaaatggagtcaatggcattttggctgatgaaatgggccttgggaaaactttacaaacaattgctttgcttggttacctgaaacactaccgaaatattcctggacctcacatggttttagttccaaagtctactttacacaactggatgaatgaatttaaacgatgggtcccatctctccgtgtcatttgttttgtcggagacaaggatgccagagctgcttttattcgtgatgaaatgatgccaggagagtgggatgtttgcgttacttcttatgagatggtaattaaagaaaaatctgtattcaaaaagtttcactggcgatacctggtcattgatgaagctcacagaataaagaatgaaaaatctaagctttcagagattgttcgtgagttcaagtcgactaaccgcttgctcctaactggaacacctttgcagaataacctgcatgaactgtgggccttactcaactttttattgcctgatgtctttaattctgcagatgactttgattcttggtttgacactaaaaattgtcttggtgatcaaaaactcgtggaaagacttcatgcagttttaaaaccatttttgttacgccgtataaaaactgatgtagagaagagtctgccacctaaaaaggaaataaagatttacttggggctgagtaagatgcaacgagaatggtatacaaaaatcctgatgaaagatattgatgttttaaactcttctggcaagatggacaagatgcgactcttaaacattctgatgcagcttcgaaagtgttgtaatcatccatatctgtttgatggtgctgaacctggtccaccttataccactgatgagcatattgtcagcaacagtggtaaaatggtagttctggataaactattggccaaactcaaagaacagggttcaagggttctcattttcagccagatgactcgcttgctggatattttggaagattattgcatgtggcgtggttatgagtattgtcgactggatggacaaaccccgcatgaagaaagagaggataaattcctagaagtggaatttctgggtcaaagggaagcaatagaggcttttaatgctcctaatagtagcaaattcatctttatgctaagtaccagggctggaggtctcggaattaacctggcaagtgctgatgtggttatactatatgattcagactggaacccacaggttgatctacaagctatggatcgagcacatcgtattggtcagaagaaaccagtacgtgtattccgtctcatcactgacaacactgttgaagagaggattgtagaaagagctgagataaaactgagactcgattcaattgttatacaacaaggaagactcattgaccaacagtctaacaagctggcaaaagaggaaatgttacaaatgatacggcatggagccacccatgtttttgcttctaaagagagtgagttgacagatgaagacattacaactattctggaaagaggggaaaagaagactgcagagatgaatgaacgcctgcaaaaaatgggagagtcttctctaagaaattttagaatggacattgaacaaagtttatacaaatttgagggagaagattatagagaaaaacagaagcttggcatggtggaatggattgaacctcctaaacgagaacgcaaagcaaactacgcagtggatgcctactttagagaggctttgcgtgtcagcgagccaaagattccaaaggctccacggcctccaaaacagccaaatgttcaggattttcaatttttcccaccacgcttatttgagctcctggaaaaggaaattctttattatcggaagacaataggctataaggttccaaggaatcctgatatcccaaatccagctctggctcaaagagaagagcaaaaaaagattgatggagctgaacctcttacaccagaagagactgaagaaaaggaaaaacttctcacacaaggtttcacaaactggactaaacgagattttaaccagtttattaaagctaatgagaaatatggaagagatgacattgataacatagctcgagaggtagagggcaaatcccctgaggaggtcatggagtattcagctgtattttgggaacgttgcaatgaattacaggacattgagaaaattatggctcaaattgaacgtggagaagcaagaattcaacgaaggatcagtatcaagaaagccctggatgccaaaattgcaagatacaaggctccatttcatcagttgcgcattcagtatggaaccagcaaaggaaagaactatactgaggaagaagatagattcttgatttgtatgttacacaaaatgggctttgatagagaaaatgtatatgaagaattaagacagtgtgtacgaaatgctccccagtttagatttgactggtttatcaagtctaggactgccatggaattccagagacgctgtaacactctgatttcattgattgagaaagaaaatatggaaattgaggaaagagagagagcagaaaagaagaaacgggcaactaaaactccaatggtaaaattttcagcattttcctaacttttagatttaacattgttgggccatttaaaatgtgcatattggagcagaacattaaatctgtttccattttagtcacagaaaagaaaagcagagtcagctactgagagctctggaaagaaggatgtcaagaaggtgaaatcctaaagcctagaaataaagttttaaatgggaaactgctattttcttgttcccatcttcaaatgctaattgccagttccagtgtattcatggtactctaagaaaaatctctttggttttgatttcttgcatattttatatattttacaatgctttctacctgaaatgtgtagctttatattttatggcattctagtatttttgtgtactgtattttgtgcatttcatgtcttcatcaaaatcctctcagtccttgttcttttgaagcttgtgctgaggttttagcttttctatgttttatatgccgctgctttgaaagagaacctagattctatagttgtattattgttgtttcatactttaaatttatatggctgtggaaaaacgaattaaaatgttttgaggagaaagactttttcacttctttgttgctttcttttctattgagtctgggcttgtttgtgttactgcatactgtgattagcataataattgtttctttgaggtcatctaaatatttttttcctaaaggaataaagggtgaggaaagaaaaatattaaaaaagctaatatttgatactgtgcttgctgtcagtatgcattacatttaaattattctctattcaagtgggaaaatataataaagaaatgtctataagaaaaaaaaaaa

SEQ ID NO: 295294 - DNA, 4368 bp, Homo sapiens
aaaattcactatgatcaagtgggattcatcctaggaatgtaagactggttccacatatgcaaattaataagcattatagatcacattagcagaaccaagaacaaagaccatatgatcttttcaatagacattgaaaaagtgtttgataaaattcaatattcctttattttaaaaaccctcaaaaactcagtatacatggagtataataataataaaggccataaatttacagcaaacttcatactgaatggagaaaaattgaaagcctttcccctaaaatctggaaaaaaccaagaatgctcactttcaccatttttatgcaacataccctgctccatctagctctttccagtgcagccactgccgccgcccaggagccctcgtcccctgccttgtccccctactcgttcccgctcccacggcatggagcaggacactgccgcagtggcagccaccgtggcagccgcggatgcgaccgccactatcgtggtcatagaggacgagcagcccgggccgtccacctctcaggaggagggagcggccgccgcggccaccgaagccaccgcggccacggagaagggcgagaagaagaaggagaaaaacgtttcttcatttcaactcaaacttgctgctaaagcgcctaaatctgaaaaggaaatggacccagaatatgaagagaaaatgaaagccgaccgagcaaagagatttgaatttttactgaagcagacagaactttttgcacatttcattcagccttcagcacagaaatctccaacatctccactgaacatgaaattgggacgtccccgaataaagaaagatgaaaagcagagcttaatttctgctggagactaccgccataggcgcacagagcaagaagaagatgaagagctactgtctgagagtcggaaaacatctaatgtgtgtattagatttgaggtgtcaccttcatatgtgaaaggggggccactgagagattatcagattcgaggactgaattggttgatctctttatatgaaaatggagtcaatggcattttggctgatgaaatgggccttgggaaaactttacaaacaattgctttgcttggttacctgaaacactaccgaaatattcctggacctcacatggttttagttccaaagtctactttacacaactggatgaatgaatttaaacgatgggtcccatctctccgtgtcatttgttttgtcggagacaaggatgccagagctgcttttattcgtgatgaaatgatgccaggagagtgggatgtttgcgttacttcttatgagatggtaattaaagaaaaatctgtattcaaaaagtttcactggcgatacctggtcattgatgaagctcacagaataaagaatgaaaaatctaagctttcagagattgttcgtgagttcaagtcgactaaccgcttgctcctaactggaacacctttgcagaataacctgcatgaactgtgggccttactcaactttttattgcctgatgtctttaattctgcagatgactttgattcttggtttgacactaaaaattgtcttggtgatcaaaaactcgtggaaagacttcatgcagttttaaaaccatttttgttacgccgtataaaaactgatgtagagaagagtctgccacctaaaaaggaaataaagatttacttggggctgagtaagatgcaacgagaatggtatacaaaaatcctgatgaaagatattgatgttttaaactcttctggcaagatggacaagatgcgactcttaaacattctgatgcagcttcgaaagtgttgtaatcatccatatctgtttgatggtgctgaacctggtccaccttataccactgatgagcatattgtcagcaacagtggtaaaatggtagttctggataaactattggccaaactcaaagaacagggttcaagggttctcattttcagccagatgactcgcttgctggatattttggaagattattgcatgtggcgtggttatgagtattgtcgactggatggacaaaccccgcatgaagaaagagaggataaattcctagaagtggaatttctgggtcaaagggaagcaatagaggcttttaatgctcctaatagtagcaaattcatctttatgctaagtaccagggctggaggtctcggaattaacctggcaagtgctgatgtggttatactatatgattcagactggaacccacaggttgatctacaagctatggatcgagcacatcgtattggtcagaagaaaccagtacgtgtattccgtctcatcactgacaacactgttgaagagaggattgtagaaagagctgagataaaactgagactcgattcaattgttatacaacaaggaagactcattgaccaacagtctaacaagctggcaaaagaggaaatgttacaaatgatacggcatggagccacccatgtttttgcttctaaagagagtgagttgacagatgaagacattacaactattctggaaagaggggaaaagaagactgcagagatgaatgaacgcctgcaaaaaatgggagagtcttctctaagaaattttagaatggacattgaacaaagtttatacaaatttgagggagaagattatagagaaaaacagaagcttggcatggtggaatggattgaacctcctaaacgagaacgcaaagcaaactacgcagtggatgcctactttagagaggctttgcgtgtcagcgagccaaagattccaaaggctccacggcctccaaaacagccaaatgttcaggattttcaatttttcccaccacgcttatttgagctcctggaaaaggaaattctttattatcggaagacaataggctataaggttccaaggaatcctgatatcccaaatccagctctggctcaaagagaagagcaaaaaaagattgatggagctgaacctcttacaccagaagagactgaagaaaaggaaaaacttctcacacaaggtttcacaaactggactaaacgagattttaaccagtttattaaagctaatgagaaatatggaagagatgacattgataacatagctcgagaggtagagggcaaatcccctgaggaggtcatggagtattcagctgtattttgggaacgttgcaatgaattacaggacattgagaaaattatggctcaaattgaacgtggagaagcaagaattcaacgaaggatcagtatcaagaaagccctggatgccaaaattgcaagatacaaggctccatttcatcagttgcgcattcagtatggaaccagcaaaggaaagaactatactgaggaagaagatagattcttgatttgtatgttacacaaaatgggctttgatagagaaaatgtatatgaagaattaagacagtgtgtacgaaatgctccccagtttagatttgactggtttatcaagtctaggactgccatggaattccagagacgctgtaacactctgatttcattgattgagaaagaaaatatggaaattgaggaaagagagagagcagaaaagaagaaacgggcaactaaaactccaatgatttaacattgttgggccatttaaaatgtgcatattggagcagaacattaaatctgtttccattttagtcacagaaaagaaaagcagagtcagctactgagagctctggaaagaaggatgtcaagaaggtgaaatcctaaagcctagaaataaagttttaaatgggaaactgctattttcttgttcccatcttcaaatgctaattgccagttccagtgtattcatggtactctaagaaaaatctctttggttttgatttcttgcatattttatatattttacaatgctttctacctgaaatgtgtagctttatattttatggcattctagtatttttgtgtactgtattttgtgcatttcatgtcttcatcaaaatcctctcagtccttgttcttttgaagcttgtgctgaggttttagcttttctatgttttatatgccgctgctttgaaagagaacctagattctatagttgtattattgttgtttcatactttaaatttatatggctgtggaaaaacgaattaaaatgttttgaggagaaagactttttcacttctttgttgctttcttttctattgagtctgggcttgtttgtgttactgcatactgtgattagcataataattgtttctttgaggtcatctaaatatttttttcctaaaggaataaagggtgaggaaagaaaaatattaaaaaagctaatatttgatactgtgcttgctgtcagtatgcattacatttaaattattctctattcaagtgggaaaatataataaagaaatgtctataagaaaaaaaaaaa

SEQ ID NO: 295295 - DNA, 4061 bp, Homo sapiens
ttaaagaagggggggcctgagcgaaggggttggaagcggagtgattccccacccctgctccatctagctctttccagtgcagccactgccgccgcccaggagccctcgtcccctgccttgtccccctactcgttcccgctcccacggcatggagcaggacactgccgcagtggcagccaccgtggcagccgcggatgcgaccgccactatcgtggtcatagaggacgagcagcccgggccgtccacctctcaggaggagaaaaacgtttcttcatttcaactcaaacttgctgctaaagcgcctaaatctgaaaaggaaatggacccagaatatgaagagaaaatgaaagccgaccgagcaaagagatttgaatttttactgaagcagacagaactttttgcacatttcattcagccttcagcacagaaatctccaacatctccactgaacatgaaattgggacgtccccgaataaagaaagatgaaaagcagagcttaatttctgctggagactaccgccataggcgcacagagcaagaagaagatgaagagctactgtctgagagtcggaaaacatctaatgtgtgtattagatttgaggtgtcaccttcatatgtgaaaggggggccactgagagattatcagattcgaggactgaattggttgatctctttatatgaaaatggagtcaatggcattttggctgatgaaatgggccttgggaaaactttacaaacaattgctttgcttggttacctgaaacactaccgaaatattcctggacctcacatggttttagttccaaagtctactttacacaactggatgaatgaatttaaacgatgggtcccatctctccgtgtcatttgttttgtcggagacaaggatgccagagctgcttttattcgtgatgaaatgatgccaggagagtgggatgtttgcgttacttcttatgagatggtaattaaagaaaaatctgtattcaaaaagtttcactggcgatacctggtcattgatgaagctcacagaataaagaatgaaaaatctaagctttcagagattgttcgtgagttcaagtcgactaaccgcttgctcctaactggaacacctttgcagaataacctgcatgaactgtgggccttactcaactttttattgcctgatgtctttaattctgcagatgactttgattcttggtttgacactaaaaattgtcttggtgatcaaaaactcgtggaaagacttcatgcagttttaaaaccatttttgttacgccgtataaaaactgatgtagagaagagtctgccacctaaaaaggaaataaagatttacttggggctgagtaagatgcaacgagaatggtatacaaaaatcctgatgaaagatattgatgttttaaactcttctggcaagatggacaagatgcgactcttaaacattctgatgcagcttcgaaagtgttgtaatcatccatatctgtttgatggtgctgaacctggtccaccttataccactgatgagcatattgtcagcaacagtggtaaaatggtagttctggataaactattggccaaactcaaagaacagggttcaagggttctcattttcagccagatgactcgcttgctggatattttggaagattattgcatgtggcgtggttatgagtattgtcgactggatggacaaaccccgcatgaagaaagagaggataaattcctagaagtggaatttctgggtcaaagggaagcaatagaggcttttaatgctcctaatagtagcaaattcatctttatgctaagtaccagggctggaggtctcggaattaacctggcaagtgctgatgtggttatactatatgattcagactggaacccacaggttgatctacaagctatggatcgagcacatcgtattggtcagaagaaaccagtacgtgtattccgtctcatcactgacaacactgttgaagagaggattgtagaaagagctgagataaaactgagactcgattcaattgttatacaacaaggaagactcattgaccaacagtctaacaagctggcaaaagaggaaatgttacaaatgatacggcatggagccacccatgtttttgcttctaaagagagtgagttgacagatgaagacattacaactattctggaaagaggggaaaagaagactgcagagatgaatgaacgcctgcaaaaaatgggagagtcttctctaagaaattttagaatggacattgaacaaagtttatacaaatttgagggagaagattatagagaaaaacagaagcttggcatggtggaatggattgaacctcctaaacgagaacgcaaagcaaactacgcagtggatgcctactttagagaggctttgcgtgtcagcgagccaaagattccaaaggctccacggcctccaaaacagccaaatgttcaggattttcaatttttcccaccacgcttatttgagctcctggaaaaggaaattctttattatcggaagacaataggctataaggttccaaggaatcctgatatcccaaatccagctctggctcaaagagaagagcaaaaaaagattgatggagctgaacctcttacaccagaagagactgaagaaaaggaaaaacttctcacacaaggtttcacaaactggactaaacgagattttaaccagtttattaaagctaatgagaaatatggaagagatgacattgataacatagctcgagaggtagagggcaaatcccctgaggaggtcatggagtattcagctgtattttgggaacgttgcaatgaattacaggacattgagaaaattatggctcaaattgaacgtggagaagcaagaattcaacgaaggatcagtatcaagaaagccctggatgccaaaattgcaagatacaaggctccatttcatcagttgcgcattcagtatggaaccagcaaaggaaagaactatactgaggaagaagatagattcttgatttgtatgttacacaaaatgggctttgatagagaaaatgtatatgaagaattaagacagtgtgtacgaaatgctccccagtttagatttgactggtttatcaagtctaggactgccatggaattccagagacgctgtaacactctgatttcattgattgagaaagaaaatatggaaattgaggaaagagagagagcagaaaagaagaaacgggcaactaaaactccaatggtaaaattttcagcattttcctaacttttagatttaacattgttgggccatttaaaatgtgcatattggagcagaacattaaatctgtttccattttagtcacagaaaagaaaagcagagtcagctactgagagctctggaaagaaggatgtcaagaaggtgaaatcctaaagcctagaaataaagttttaaatgggaaactgctattttcttgttcccatcttcaaatgctaattgccagttccagtgtattcatggtactctaagaaaaatctctttggttttgatttcttgcatattttatatattttacaatgctttctacctgaaatgtgtagctttatattttatggcattctagtatttttgtgtactgtattttgtgcatttcatgtcttcatcaaaatcctctcagtccttgttcttttgaagcttgtgctgaggttttagcttttctatgttttatatgccgctgctttgaaagagaacctagattctatagttgtattattgttgtttcatactttaaatttatatggctgtggaaaaacgaattaaaatgttttgaggagaaagactttttcacttctttgttgctttcttttctattgagtctgggcttgtttgtgttactgcatactgtgattagcataataattgtttctttgaggtcatctaaatatttttttcctaaaggaataaagggtgaggaaagaaaaatattaaaaaagctaatatttgatactgtgcttgctgtcagtatgcattacatttaaattattctctattcaagtgggaaaatataataaagaaatgtctataagaaaaaaaaaaa

SEQ ID NO: 295296 - DNA, 4300 bp, Homo sapiens
aaaattcactatgatcaagtgggattcatcctaggaatgtaagactggttccacatatgcaaattaataagcattatagatcacattagcagaaccaagaacaaagaccatatgatcttttcaatagacattgaaaaagtgtttgataaaattcaatattcctttattttaaaaaccctcaaaaactcagtatacatggagtataataataataaaggccataaatttacagcaaacttcatactgaatggagaaaaattgaaagcctttcccctaaaatctggaaaaaaccaagaatgctcactttcaccatttttatgcaacataccctgctccatctagctctttccagtgcagccactgccgccgcccaggagccctcgtcccctgccttgtccccctactcgttcccgctcccacggcatggagcaggacactgccgcagtggcagccaccgtggcagccgcggatgcgaccgccactatcgtggtcatagaggacgagcagcccgggccgtccacctctcaggaggagggagcggccgccgcggccaccgaagccaccgcggccacggagaagggcgagaagaagaaggagaaaaacgtttcttcatttcaactcaaacttgctgctaaagcgcctaaatctgaaaaggaaatggacccagaatatgaagagaaaatgaaagccgaccgagcaaagagatttgaatttttactgaagcagacagaactttttgcacatttcattcagccttcagcacagaaatctccaacatctccactgaacatgaaattgggacgtccccgaataaagaaagatgaaaagcagagcttaatttctgctggagactaccgccataggcgcacagagcaagaagaagatgaagagctactgtctgagagtcggaaaacatctaatgtgtgtattagatttgaggtgtcaccttcatatgtgaaaggggggccactgagagattatcagattcgaggactgaattggttgatctctttatatgaaaatggagtcaatggcattttggctgatgaaatgggccttgggaaaactttacaaacaattgctttgcttggttacctgaaacactaccgaaatattcctggacctcacatggttttagttccaaagtctactttacacaactggatgaatgaatttaaacgatgggtcccatctctccgtgtcatttgttttgtcggagacaaggatgccagagctgcttttattcgtgatgaaatgatgccaggagagtgggatgtttgcgttacttcttatgagatggtaattaaagaaaaatctgtattcaaaaagtttcactggcgatacctggtcattgatgaagctcacagaataaagaatgaaaaatctaagctttcagagattgttcgtgagttcaagtcgactaaccgcttgctcctaactggaacacctttgcagaataacctgcatgaactgtgggccttactcaactttttattgcctgatgtctttaattctgcagatgactttgattcttggtttgacactaaaaattgtcttggtgatcaaaaactcgtggaaagacttcatgcagttttaaaaccatttttgttacgccgtataaaaactgatgtagagaagagtctgccacctaaaaaggaaataaagatttacttggggctgagtaagatgcaacgagaatggtatacaaaaatcctgatgaaagatattgatgttttaaactcttctggcaagatggacaagatgcgactcttaaacattctgatgcagcttcgaaagtgttgtaatcatccatatctgtttgatggtgctgaacctggtccaccttataccactgatgagcatattgtcagcaacagtggtaaaatggtagttctggataaactattggccaaactcaaagaacagggttcaagggttctcattttcagccagatgactcgcttgctggatattttggaagattattgcatgtggcgtggttatgagtattgtcgactggatggacaaaccccgcatgaagaaagagaggataaattcctagaagtggaatttctgggtcaaagggaagcaatagaggcttttaatgctcctaatagtagcaaattcatctttatgctaagtaccagggctggaggtctcggaattaacctggcaagtgctgatgtggttatactatatgattcagactggaacccacaggttgatctacaagctatggatcgagcacatcgtattggtcagaagaaaccagtacgtgtattccgtctcatcactgacaacactgttgaagagaggattgtagaaagagctgagataaaactgagactcgattcaattgttatacaacaaggaagactcattgaccaacagtctaacaagctggcaaaagaggaaatgttacaaatgatacggcatggagccacccatgtttttgcttctaaagagagtgagttgacagatgaagacattacaactattctggaaagaggggaaaagaagactgcagagatgaatgaacgcctgcaaaaaatgggagagtcttctctaagaaattttagaatggacattgaacaaagtttatacaaatttgagggagaagattatagagaaaaacagaagcttggcatggtggaatggattgaacctcctaaacgagaacgcaaagcaaactacgcagtggatgcctactttagagaggctttgcgtgtcagcgagccaaagattccaaaggctccacggcctccaaaacagccaaatgttcaggattttcaatttttcccaccacgcttatttgagctcctggaaaaggaaattctttattatcggaagacaataggctataaggttccaaggaatcctgatatcccaaatccagctctggctcaaagagaagagcaaaaaaagattgatggagctgaacctcttacaccagaagagactgaagaaaaggaaaaacttctcacacaaggtttcacaaactggactaaacgagattttaaccagtttattaaagctaatgagaaatatggaagagatgacattgataacatagctcgagaggtagagggcaaatcccctgaggaggtcatggagtattcagctgtattttgggaacgttgcaatgaattacaggacattgagaaaattatggctcaaattgaacgtggagaagcaagaattcaacgaaggatcagtatcaagaaagccctggatgccaaaattgcaagatacaaggctccatttcatcagttgcgcattcagtatggaaccagcaaaggaaagaactatactgaggaagaagatagattcttgatttgtatgttacacaaaatgggctttgatagagaaaatgtatatgaagaattaagacagtgtgtacgaaatgctccccagtttagatttgactggtttatcaagtctaggactgccatggaattccagagacgctgtaacactctgatttcattgattgagaaagaaaatatggaaattgaggaaagagagagagcagaaaagaagaaacgggcaactaaaactccaatgtcacagaaaagaaaagcagagtcagctactgagagctctggaaagaaggatgtcaagaaggtgaaatcctaaagcctagaaataaagttttaaatgggaaactgctattttcttgttcccatcttcaaatgctaattgccagttccagtgtattcatggtactctaagaaaaatctctttggttttgatttcttgcatattttatatattttacaatgctttctacctgaaatgtgtagctttatattttatggcattctagtatttttgtgtactgtattttgtgcatttcatgtcttcatcaaaatcctctcagtccttgttcttttgaagcttgtgctgaggttttagcttttctatgttttatatgccgctgctttgaaagagaacctagattctatagttgtattattgttgtttcatactttaaatttatatggctgtggaaaaacgaattaaaatgttttgaggagaaagactttttcacttctttgttgctttcttttctattgagtctgggcttgtttgtgttactgcatactgtgattagcataataattgtttctttgaggtcatctaaatatttttttcctaaaggaataaagggtgaggaaagaaaaatattaaaaaagctaatatttgatactgtgcttgctgtcagtatgcattacatttaaattattctctattcaagtgggaaaatataataaagaaatgtctataagaaaaaaaaaaa

SEQ ID NO: 295297 - DNA, 4088 bp, Homo sapiens
ttaaagaagggggggcctgagcgaaggggttggaagcggagtgattccccacccctgctccatctagctctttccagtgcagccactgccgccgcccaggagccctcgtcccctgccttgtccccctactcgttcccgctcccacggcatggagcaggacactgccgcagtggcagccaccgtggcagccgcggatgcgaccgccactatcgtggtcatagaggacgagcagcccgggccgtccacctctcaggaggagggagcggccgccgcggccaccgaagccaccgcggccacggagaagggcgagaagaagaaggagaaaaacgtttcttcatttcaactcaaacttgctgctaaagcgcctaaatctgaaaaggaaatggacccagaatatgaagagaaaatgaaagccgaccgagcaaagagatttgaatttttactgaagcagacagaactttttgcacatttcattcagccttcagcacagaaatctccaacatctccactgaacatgaaattgggacgtccccgaataaagaaagatgaaaagcagagcttaatttctgctggagactaccgccataggcgcacagagcaagaagaagatgaagagctactgtctgagagtcggaaaacatctaatgtgtgtattagatttgaggtgtcaccttcatatgtgaaaggggggccactgagagattatcagattcgaggactgaattggttgatctctttatatgaaaatggagtcaatggcattttggctgatgaaatgggccttgggaaaactttacaaacaattgctttgcttggttacctgaaacactaccgaaatattcctggacctcacatggttttagttccaaagtctactttacacaactggatgaatgaatttaaacgatgggtcccatctctccgtgtcatttgttttgtcggagacaaggatgccagagctgcttttattcgtgatgaaatgatgccaggagagtgggatgtttgcgttacttcttatgagatggtaattaaagaaaaatctgtattcaaaaagtttcactggcgatacctggtcattgatgaagctcacagaataaagaatgaaaaatctaagctttcagagattgttcgtgagttcaagtcgactaaccgcttgctcctaactggaacacctttgcagaataacctgcatgaactgtgggccttactcaactttttattgcctgatgtctttaattctgcagatgactttgattcttggtttgacactaaaaattgtcttggtgatcaaaaactcgtggaaagacttcatgcagttttaaaaccatttttgttacgccgtataaaaactgatgtagagaagagtctgccacctaaaaaggaaataaagatttacttggggctgagtaagatgcaacgagaatggtatacaaaaatcctgatgaaagatattgatgttttaaactcttctggcaagatggacaagatgcgactcttaaacattctgatgcagcttcgaaagtgttgtaatcatccatatctgtttgatggtgctgaacctggtccaccttataccactgatgagcatattgtcagcaacagtggtaaaatggtagttctggataaactattggccaaactcaaagaacagggttcaagggttctcattttcagccagatgactcgcttgctggatattttggaagattattgcatgtggcgtggttatgagtattgtcgactggatggacaaaccccgcatgaagaaagagaggaagcaatagaggcttttaatgctcctaatagtagcaaattcatctttatgctaagtaccagggctggaggtctcggaattaacctggcaagtgctgatgtggttatactatatgattcagactggaacccacaggttgatctacaagctatggatcgagcacatcgtattggtcagaagaaaccagtacgtgtattccgtctcatcactgacaacactgttgaagagaggattgtagaaagagctgagataaaactgagactcgattcaattgttatacaacaaggaagactcattgaccaacagtctaacaagctggcaaaagaggaaatgttacaaatgatacggcatggagccacccatgtttttgcttctaaagagagtgagttgacagatgaagacattacaactattctggaaagaggggaaaagaagactgcagagatgaatgaacgcctgcaaaaaatgggagagtcttctctaagaaattttagaatggacattgaacaaagtttatacaaatttgagggagaagattatagagaaaaacagaagcttggcatggtggaatggattgaacctcctaaacgagaacgcaaagcaaactacgcagtggatgcctactttagagaggctttgcgtgtcagcgagccaaagattccaaaggctccacggcctccaaaacagccaaatgttcaggattttcaatttttcccaccacgcttatttgagctcctggaaaaggaaattctttattatcggaagacaataggctataaggttccaaggaatcctgatatcccaaatccagctctggctcaaagagaagagcaaaaaaagattgatggagctgaacctcttacaccagaagagactgaagaaaaggaaaaacttctcacacaaggtttcacaaactggactaaacgagattttaaccagtttattaaagctaatgagaaatatggaagagatgacattgataacatagctcgagaggtagagggcaaatcccctgaggaggtcatggagtattcagctgtattttgggaacgttgcaatgaattacaggacattgagaaaattatggctcaaattgaacgtggagaagcaagaattcaacgaaggatcagtatcaagaaagccctggatgccaaaattgcaagatacaaggctccatttcatcagttgcgcattcagtatggaaccagcaaaggaaagaactatactgaggaagaagatagattcttgatttgtatgttacacaaaatgggctttgatagagaaaatgtatatgaagaattaagacagtgtgtacgaaatgctccccagtttagatttgactggtttatcaagtctaggactgccatggaattccagagacgctgtaacactctgatttcattgattgagaaagaaaatatggaaattgaggaaagagagagagcagaaaagaagaaacgggcaactaaaactccaatggtaaaattttcagcattttcctaacttttagatttaacattgttgggccatttaaaatgtgcatattggagcagaacattaaatctgtttccattttagtcacagaaaagaaaagcagagtcagctactgagagctctggaaagaaggatgtcaagaaggtgaaatcctaaagcctagaaataaagttttaaatgggaaactgctattttcttgttcccatcttcaaatgctaattgccagttccagtgtattcatggtactctaagaaaaatctctttggttttgatttcttgcatattttatatattttacaatgctttctacctgaaatgtgtagctttatattttatggcattctagtatttttgtgtactgtattttgtgcatttcatgtcttcatcaaaatcctctcagtccttgttcttttgaagcttgtgctgaggttttagcttttctatgttttatatgccgctgctttgaaagagaacctagattctatagttgtattattgttgtttcatactttaaatttatatggctgtggaaaaacgaattaaaatgttttgaggagaaagactttttcacttctttgttgctttcttttctattgagtctgggcttgtttgtgttactgcatactgtgattagcataataattgtttctttgaggtcatctaaatatttttttcctaaaggaataaagggtgaggaaagaaaaatattaaaaaagctaatatttgatactgtgcttgctgtcagtatgcattacatttaaattattctctattcaagtgggaaaatataataaagaaatgtctataagaaaaaaaaaaa

SEQ ID NO: 295298 - DNA, 4137 bp, Homo sapiens
aaaattcactatgatcaagtgggattcatcctaggaatgtaagactggttccacatatgcaaattaataagcattatagatcacattagcagaaccaagaacaaagaccatatgatcttttcaatagacattgaaaaagtgtttgataaaattcaatattcctttattttaaaaaccctcaaaaactcagtatacatggagtataataataataaaggccataaatttacagcaaacttcatactgaatggagaaaaattgaaagcctttcccctaaaatctggaaaaaaccaagaatgctcactttcaccatttttatgcaacataccctgctccatctagctctttccagtgcagccactgccgccgcccaggagccctcgtcccctgccttgtccccctactcgttcccgctcccacggcatggagcaggacactgccgcagtggcagccaccgtggcagccgcggatgcgaccgccactatcgtggtcatagaggacgagcagcccgggccgtccacctctcaggaggagggagcggccgccgcggccaccgaagccaccgcggccacggagaagggcgagaagaagaaggagaaaaacgtttcttcatttcaactcaaacttgctgctaaagcgcctaaatctgaaaaggaaatggacccagaatatgaagagaaaatgaaagccgaccgagcaaagagatttgaatttttactgaagcagacagaactttttgcacatttcattcagccttcagcacagaaatctccaacatctccactgaacatgaaattgggacgtccccgaataaagaaagatgaaaagcagagcttaatttctgctggagactaccgccataggcgcacagagcaagaagaagatgaagagctactgtctgagagtcggaaaacatctaatgtgtgtattagatttgaggtgtcaccttcatatgtgaaaggggggccactgagagattatcagattcgaggactgaattggttgatctctttatatgaaaatggagtcaatggcattttggctgatgaaatgggccttgggaaaactttacaaacaattgctttgcttggttacctgaaacactaccgaaatattcctggacctcacatggttttagttccaaagtctactttacacaactggatgaatgaatttaaacgatgggtcccatctctccgtgtcatttgttttgtcggagacaaggatgccagagctgcttttattcgtgatgaaatgatgccaggagagtgggatgtttgcgttacttcttatgagatggtaattaaagaaaaatctgtattcaaaaagtttcactggcgatacctggtcattgatgaagctcacagaataaagaatgaaaaatctaagctttcagagattgttcgtgagttcaagtcgactaaccgcttgctcctaactggaacacctttgcagaataacctgcatgaactgtgggccttactcaactttttattgcctgatgtctttaattctgcagatgactttgattcttggtttgacactaaaaattgtcttggtgatcaaaaactcgtggaaagacttcatgcagttttaaaaccatttttgttacgccgtataaaaactgatgtagagaagagtctgccacctaaaaaggaaataaagatttacttggggctgagtaagatgcaacgagaatggtatacaaaaatcctgatgaaagatattgatgttttaaactcttctggcaagatggacaagatgcgactcttaaacattctgatgcagcttcgaaagtgttgtaatcatccatatctgtttgatggtgctgaacctggtccaccttataccactgatgagcatattgtcagcaacagtggtaaaatggtagttctggataaactattggccaaactcaaagaacagggttcaagggttctcattttcagccagatgactcgcttgctggatattttggaagattattgcatgtggcgtggttatgagtattgtcgactggatggacaaaccccgcatgaagaaagagaggataaattcctagaagtggaatttctgggtcaaagggaagcaatagaggcttttaatgctcctaatagtagcaaattcatctttatgctaagtaccagggctggaggtctcggaattaacctggcaagtgctgatgtggttatactatatgattcagactggaacccacaggttgatctacaagctatggatcgagcacatcgtattggtcagaagaaaccagtacgtgtattccgtctcatcactgacaacactgttgaagagaggattgtagaaagagctgagataaaactgagactcgattcaattgttatacaacaaggaagactcattgaccaacagtctaacaagctggcaaaagaggaaatgttacaaatgatacggcatggagccacccatgtttttgcttctaaagagagtgagttgacagatgaagacattacaactattctggaaagaggggaaaagaagactgcagagatgaatgaacgcctgcaaaaaatgggagagtcttctctaagaaattttagaatggacattgaacaaagtttatacaaatttgagggagaagattatagagaaaaacagaagcttggcatggtggaatggattgaacctcctaaacgagaacgcaaagcaaactacgcagtggatgcctactttagagaggctttgcgtgtcagcgagccaaagattccaaaggctccacggcctccaaaacagccaaatgttcaggattttcaatttttcccaccacgcttatttgagctcctggaaaaggaaattctttattatcggaagacaataggctataaggttccaaggaatcctgatatcccaaatccagctctggctcaaagagaagagcaaaaaaagattgatggagctgaacctcttacaccagaagagactgaagaaaaggaaaaacttctcacacaaggtttcacaaactggactaaacgagattttaaccagtttattaaagctaatgagaaatatggaagagatgacattgataacatagctcgagaggtagagggcaaatcccctgaggaggtcatggagtattcagctgtattttgggaacgttgcaatgaattacaggacattgagaaaattatggctcaaattgaacgtggagaagcaagaattcaacgaaggatcagtatcaagaaagccctggatgccaaaattgcaagatacaaggctccatttcatcagttgcgcattcagtatggaaccagcaaaggaaagaactatactgaggaagaagatagattcttgatttgtatgttacacaaaatgggctttgatagagaaaatgtatatgaagaattaagacagtgtgtacgaaatgctccccagtttagatttgactggtttatcaagtctaggactgccatggaattccagagacgctgtaacactctgatttcattgattgagaaagaaaatatggaaattgaggaaagagagagagcagaaaagaagaaacgggcaactaaaactccaatggtaaaattttcagcattttcctaacttttagatttaacattgttgggccatttaaaatgtgcatattggagcagaacattaaatctgtttccattttagtcacagaaaagaaaagcagagtcagctactgagagctctggaaagaaggatgtcaagaaggtgaaatcctaaagcctagaaataaagttttaaatgggaaactgctattttcttgttcccatcttcaaatgctaattgccagttccagtgtattcatggtactctaagaaaaatctctttggttttgatttcttgcatattttatatattttacaatgctttctacctgaaatgtgtagctttatattttatggcattctagtatttttgtgtactgtattttgtgcatttcatgtcttcatcaaaatcctctcagtccttgttcttttgaagcttgtgctgaggttttagcttttctatgttttatatgccgctgctttgaaagagaacctagattctatagttgtattattgttgtttcatactttaaatttatatggctgtggaaaaacgaattaaaatgttttgaggaga

SEQ ID NO: 295299 - DNA, 3908 bp, Homo sapiens
ttaaagaagggggggcctgagcgaaggggttggaagcggagtgattccccacccctgctccatctagctctttccagtgcagccactgccgccgcccaggagccctcgtcccctgccttgtccccctactcgttcccgctcccacggcatggagcaggacactgccgcagtggcagccaccgtggcagccgcggatgcgaccgccactatcgtggtcatagaggacgagcagcccgggccgtccacctctcaggaggagggagcggccgccgcggccaccgaagccaccgcggccacggagaagggcgagaagaagaaggagaaaaacgtttcttcatttcaactcaaacttgctgctaaagcgcctaaatctgaaaaggaaatggacccagaatatgaagagaaaatgaaagccgaccgagcaaagagatttgaatttttactgaagcagacagaactttttgcacatttcattcagccttcagcacagaaatctccaacatctccactgaacatgaaattgggacgtccccgaataaagaaagatgaaaagcagagcttaatttctgctggagactaccgccataggcgcacagagcaagaagaagatgaagagctactgtctgagagtcggaaaacatctaatgtgtgtattagatttgaggtgtcaccttcatatgtgaaaggggggccactgagagattatcagattcgaggactgaattggttgatctctttatatgaaaatggagtcaatggcattttggctgatgaaatggctgcttttattcgtgatgaaatgatgccaggagagtgggatgtttgcgttacttcttatgagatggtaattaaagaaaaatctgtattcaaaaagtttcactggcgatacctggtcattgatgaagctcacagaataaagaatgaaaaatctaagctttcagagattgttcgtgagttcaagtcgactaaccgcttgctcctaactggaacacctttgcagaataacctgcatgaactgtgggccttactcaactttttattgcctgatgtctttaattctgcagatgactttgattcttggtttgacactaaaaattgtcttggtgatcaaaaactcgtggaaagacttcatgcagttttaaaaccatttttgttacgccgtataaaaactgatgtagagaagagtctgccacctaaaaaggaaataaagatttacttggggctgagtaagatgcaacgagaatggtatacaaaaatcctgatgaaagatattgatgttttaaactcttctggcaagatggacaagatgcgactcttaaacattctgatgcagcttcgaaagtgttgtaatcatccatatctgtttgatggtgctgaacctggtccaccttataccactgatgagcatattgtcagcaacagtggtaaaatggtagttctggataaactattggccaaactcaaagaacagggttcaagggttctcattttcagccagatgactcgcttgctggatattttggaagattattgcatgtggcgtggttatgagtattgtcgactggatggacaaaccccgcatgaagaaagagaggaagcaatagaggcttttaatgctcctaatagtagcaaattcatctttatgctaagtaccagggctggaggtctcggaattaacctggcaagtgctgatgtggttatactatatgattcagactggaacccacaggttgatctacaagctatggatcgagcacatcgtattggtcagaagaaaccagtacgtgtattccgtctcatcactgacaacactgttgaagagaggattgtagaaagagctgagataaaactgagactcgattcaattgttatacaacaaggaagactcattgaccaacagtctaacaagctggcaaaagaggaaatgttacaaatgatacggcatggagccacccatgtttttgcttctaaagagagtgagttgacagatgaagacattacaactattctggaaagaggggaaaagaagactgcagagatgaatgaacgcctgcaaaaaatgggagagtcttctctaagaaattttagaatggacattgaacaaagtttatacaaatttgagggagaagattatagagaaaaacagaagcttggcatggtggaatggattgaacctcctaaacgagaacgcaaagcaaactacgcagtggatgcctactttagagaggctttgcgtgtcagcgagccaaagattccaaaggctccacggcctccaaaacagccaaatgttcaggattttcaatttttcccaccacgcttatttgagctcctggaaaaggaaattctttattatcggaagacaataggctataaggttccaaggaatcctgatatcccaaatccagctctggctcaaagagaagagcaaaaaaagattgatggagctgaacctcttacaccagaagagactgaagaaaaggaaaaacttctcacacaaggtttcacaaactggactaaacgagattttaaccagtttattaaagctaatgagaaatatggaagagatgacattgataacatagctcgagaggtagagggcaaatcccctgaggaggtcatggagtattcagctgtattttgggaacgttgcaatgaattacaggacattgagaaaattatggctcaaattgaacgtggagaagcaagaattcaacgaaggatcagtatcaagaaagccctggatgccaaaattgcaagatacaaggctccatttcatcagttgcgcattcagtatggaaccagcaaaggaaagaactatactgaggaagaagatagattcttgatttgtatgttacacaaaatgggctttgatagagaaaatgtatatgaagaattaagacagtgtgtacgaaatgctccccagtttagatttgactggtttatcaagtctaggactgccatggaattccagagacgctgtaacactctgatttcattgattgagaaagaaaatatggaaattgaggaaagagagagagcagaaaagaagaaacgggcaactaaaactccaatggtaaaattttcagcattttcctaacttttagatttaacattgttgggccatttaaaatgtgcatattggagcagaacattaaatctgtttccattttagtcacagaaaagaaaagcagagtcagctactgagagctctggaaagaaggatgtcaagaaggtgaaatcctaaagcctagaaataaagttttaaatgggaaactgctattttcttgttcccatcttcaaatgctaattgccagttccagtgtattcatggtactctaagaaaaatctctttggttttgatttcttgcatattttatatattttacaatgctttctacctgaaatgtgtagctttatattttatggcattctagtatttttgtgtactgtattttgtgcatttcatgtcttcatcaaaatcctctcagtccttgttcttttgaagcttgtgctgaggttttagcttttctatgttttatatgccgctgctttgaaagagaacctagattctatagttgtattattgttgtttcatactttaaatttatatggctgtggaaaaacgaattaaaatgttttgaggagaaagactttttcacttctttgttgctttcttttctattgagtctgggcttgtttgtgttactgcatactgtgattagcataataattgtttctttgaggtcatctaaatatttttttcctaaaggaataaagggtgaggaaagaaaaatattaaaaaagctaatatttgatactgtgcttgctgtcagtatgcattacatttaaattattctctattcaagtgggaaaatataataaagaaatgtctataagaaaaaaaaaaa

SEQ ID NO: 295300 - DNA, 4064 bp, Homo sapiens
aaaattcactatgatcaagtgggattcatcctaggaatgtaagactggttccacatatgcaaattaataagcattatagatcacattagcagaaccaagaacaaagaccatatgatcttttcaatagacattgaaaaagtgtttgataaaattcaatattcctttattttaaaaaccctcaaaaactcagtatacatggagtataataataataaaggccataaatttacagcaaacttcatactgaatggagaaaaattgaaagcctttcccctaaaatctggaaaaaaccaagaatgctcactttcaccatttttatgcaacataccctgctccatctagctctttccagtgcagccactgccgccgcccaggagccctcgtcccctgccttgtccccctactcgttcccgctcccacggcatggagcaggacactgccgcagtggcagccaccgtggcagccgcggatgcgaccgccactatcgtggtcatagaggacgagcagcccgggccgtccacctctcaggaggagggagcggccgccgcggccaccgaagccaccgcggccacggagaagggcgagaagaagaaggagaaaaacgtttcttcatttcaactcaaacttgctgctaaagcgcctaaatctgaaaaggaaatggacccagaatatgaagagaaaatgaaagccgaccgagcaaagagatttgaatttttactgaagcagacagaactttttgcacatttcattcagccttcagcacagaaatctccaacatctccactgaacatgaaattgggacgtccccgaataaagaaagatgaaaagcagagcttaatttctgctggagactaccgccataggcgcacagagcaagaagaagatgaagagctactgtctgagagtcggaaaacatctaatgtgtgtattagatttgaggtgtcaccttcatatgtgaaaggggggccactgagagattatcagattcgaggactgaattggttgatctctttatatgaaaatggagtcaatggcattttggctgatgaaatgggccttgggaaaactttacaaacaattgctttgcttggttacctgaaacactaccgaaatattcctggacctcacatggttttagttccaaagtctactttacacaactggatgaatgaatttaaacgatgggtcccatctctccgtgtcatttgttttgtcggagacaaggatgccagagctgcttttattcgtgatgaaatgatgccaggagagtgggatgtttgcgttacttcttatgagatggtaattaaagaaaaatctgtattcaaaaagtttcactggcgatacctggtcattgatgaagctcacagaataaagaatgaaaaatctaagctttcagagattgttcgtgagttcaagtcgactaaccgcttgctcctaactggaacacctttgcagaataacctgcatgaactgtgggccttactcaactttttattgcctgatgtctttaattctgcagatgactttgattcttggtttgacactaaaaattgtcttggtgatcaaaaactcgtggaaagacttcatgcagttttaaaaccatttttgttacgccgtataaaaactgatgtagagaagagtctgccacctaaaaaggaaataaagatttacttggggctgagtaagatgcaacgagaatggtatacaaaaatcctgatgaaagatattgatgttttaaactcttctggcaagatggacaagatgcgactcttaaacattctgatgcagcttcgaaagtgttgtaatcatccatatctgtttgatggtgctgaacctggtccaccttataccactgatgagcatattgtcagcaacagtggtaaaatggtagttctggataaactattggccaaactcaaagaacagggttcaagggttctcattttcagccagatgactcgcttgctggatattttggaagattattgcatgtggcgtggttatgagtattgtcgactggatggacaaaccccgcatgaagaaagagaggataaattcctagaagtggaatttctgggtcaaagggaagcaatagaggcttttaatgctcctaatagtagcaaattcatctttatgctaagtaccagggctggaggtctcggaattaacctggcaagtgctgatgtggttatactatatgattcagactggaacccacaggttgatctacaagctatggatcgagcacatcgtattggtcagaagaaaccagtacgtgtattccgtctcatcactgacaacactgttgaagagaggattgtagaaagagctgagataaaactgagactcgattcaattgttatacaacaaggaagactcattgaccaacagtctaacaagctggcaaaagaggaaatgttacaaatgatacggcatggagccacccatgtttttgcttctaaagagagtgagttgacagatgaagacattacaactattctggaaagaggggaaaagaagactgcagagatgaatgaacgcctgcaaaaaatgggagagtcttctctaagaaattttagaatggacattgaacaaagtttatacaaatttgagggagaagattatagagaaaaacagaagcttggcatggtggaatggattgaacctcctaaacgagaacgcaaagcaaactacgcagtggatgcctactttagagaggctttgcgtgtcagcgagccaaagattccaaaggctccacggcctccaaaacagccaaatgttcaggattttcaatttttcccaccacgcttatttgagctcctggaaaaggaaattctttattatcggaagacaataggctataaggttccaaggaatcctgatatcccaaatccagctctggctcaaagagaagagcaaaaaaagattgatggagctgaacctcttacaccagaagagactgaagaaaaggaaaaacttctcacacaaggtttcacaaactggactaaacgagattttaaccagtttattaaagctaatgagaaatatggaagagatgacattgataacatagctcgagaggtagagggcaaatcccctgaggaggtcatggagtattcagctgtattttgggaacgttgcaatgaattacaggacattgagaaaattatggctcaaattgaacgtggagaagcaagaattcaacgaaggatcagtatcaagaaagccctggatgccaaaattgcaagatacaaggctccatttcatcagttgcgcattcagtatggaaccagcaaaggaaagaactatactgaggaagaagatagattcttgatttgtatgttacacaaaatgggctttgatagagaaaatgtatatgaagaattaagacagtgtgtacgaaatgctccccagtttagatttgactggtttatcaagtctaggactgccatggaattccagagacgctgtaacactctgatttcattgattgagaaagaaaatatggaaattgaggaaagagagagagcagaaaagaagaaacgggcaactaaaactccaatgggaggatgtggagcaagatgcaatagaaagttccactgatcatcttcccacagggacaccaatttaacaactatctacacacaaaaagcgactttgtaagaaccaaaaatgaggtgaacactcatagtacctggtttttacttcatattgcttcatattgctgaaagaggaactgaagaggtagaaaaaaaacagccttgaattgccaacgccacccctcccacatccctctggctgtgatagtgtgttgcagagtgtttctgtgctctggaaagagggagagccagcagttgtgaggtatggaactcagtgttgcccttgctgtaccagaaagcaaaactggaccaaataccactgacacctgcccacagaggatgcattaaaccagccctagccagaggagaatcactgattccagcagttggaaattgagttcttgcaagcattgctaccatgggttaaagtgctctggagccccaaataaacttgaaaggcagtct

SEQ ID NO: 295301 - DNA, 1488 bp, Homo sapiens
taggagttctgatttgatcaagtaagttttctgatgtttgtggaattatgagtacaaatgggaactctgagcagacaacaaagctttgcttggtaataagtgaactgttgaattgataggataacttgattttaatccagtcaggttgctttgtacagctgtaatttaaaatattctttaatagatcgtattatttgagtgtggttaagtaaactgccatatttcatcgaatctaagatgccttccattgtaagacacagcattattttatgtaccactgagggaaaatgctgccaggtgtaatttgtcatcagttgtaagttgcatcctgatttcagagatgctaaaatgtgaaagaaatgtgtatcatagaagatatgaaatatggtatgttaaaacctatcataagttttttaaaaaatatatactcataaacaaaattttgcccagaaaacattaagtagttctttaagataagagtacatttataataccatgtgtaagtagatacttgatgactatttttgatgggtattttatgtcttttcataaaaagaaacatctttgaaggttattttacattgggttatatagtttgttgggctatatagaacattaactgtgaatataacatttaagtgaatattcatgttaaaatttttttttaatgcatttacatcctagatttaacattgttgggccatttaaaatgtgcatattggagcagaacattaaatctgtttccattttagtcacagaaaagaaaagcagagtcagctactgagagctctggaaagaaggatgtcaagaaggtgaaatcctaaagcctagaaataaagttttaaatgggaaactgctattttcttgttcccatcttcaaatgctaattgccagttccagtgtattcatggtactctaagaaaaatctctttggttttgatttcttgcatattttatatattttacaatgctttctacctgaaatgtgtagctttatattttatggcattctagtatttttgtgtactgtattttgtgcatttcatgtcttcatcaaaatcctctcagtccttgttcttttgaagcttgtgctgaggttttagcttttctatgttttatatgccgctgctttgaaagagaacctagattctatagttgtattattgttgtttcatactttaaatttatatggctgtggaaaaacgaattaaaatgttttgaggagaaagactttttcacttctttgttgctttcttttctattgagtctgggcttgtttgtgttactgcatactgtgattagcataataattgtttctttgaggtcatctaaatatttttttcctaaaggaataaagggtgaggaaagaaaaatattaaaaaagctaatatttgatactgtgcttgctgtcagtatgcattacatttaaattattctctattcaagtgggaaaatataataaagaaatgtctataagaaaaaaaaaaa

SEQ ID NO: 295302 - DNA, 691 bp, Homo sapiens
ttaaagaagggggggcctgagcgaaggggttggaagcggagtgattccccacccctgctccatctagctctttccagtgcagccactgccgccgcccaggagccctcgtcccctgccttgtccccctactcgttcccgctcccacggcatggagcaggacactgccgcagtggcagccaccgtggcagccgcggatgcgaccgccactatcgtggtcatagaggacgagcagcccgggccgtccacctctcaggaggagggagcggccgccgcggccaccgaagccaccgcggccacggagaagggcgagaagaagaaggagaaaaacgtttcttcatttcaactcaaacttgctgctaaagcgcctaaatctgaaaaggaaatggacccagaatatgaagagaaaatgaaagccgaccgagcaaagagatttgaatttttactgaagcaatcctcctgagtgatcccatttcttaatcagtgtagccccaagaaggctggggctatttaccagggtagaaaaaggagcttacctcccacctttggtcctaagtccctgccccctccccttcacaccataactaggtaacagtttgataactagggaagaaagcagaacagttaagcagccgccacatcgccgctggctgggggcctcactccaggaaggggctggactggctgtcctttc

SEQ ID NO: 295303 - DNA, 597 bp, Homo sapiens
catgtgtagagttgtgtaacctccaccaccataagactccattgtgctatctctttacagtcacacctaccctctctcctctccctagctcccggcaaccattgatctgttctctctttctataattttgtcatttaaggatgttatataaatggaataatatggtatgtaacctttcgaaattagctttttttttttacttagcataattcccttgaggttcattcagattgttaactgtattaatagttctttcctttttattgctgagtaatattatatgatatggatgtatcatggtttgtttaaccagtcatccataaatgacatttacccccactcctaattctggtggaatctattaataccctgtgtgaatattgtcctgaaaaatagcagttttggaaattctataccacagaaatcatacagttaaatagttgtcagcgttttaaagataatgattgggttgcagaaattaaaaatctttattacttcatttaggaattccagagacgctgtaacactctgatttcattgattgagaaagaaaatatggaaattgaggaaagagagagagcagaaaagaagaaacgg

SEQ ID NO: 295304 - DNA, 365 bp, Homo sapiens
caggtgctttgccctttgtcctggaagtttcccattaatggtacaatataatatttgcagatttctttgttcccagtggtctttagatattctcaatattcatcatgctcttttccaaagtgtcagatctagagaaaaataactaattttatttttagaattttatagcatatgatggctctaaattttatccagaatatccaatatcttacattagaactctttctactaggatcgagcacatcgtattggtcagaagaaaccagtacgtgtattccgtctcatcactgacaacactgttgaagagaggattgtagaaagagctgagataaaactgagactcgattcaattgttatacaacaag

SEQ ID NO: 295305 - DNA, 3088 bp, Homo sapiens
  misc_feature (6)..(6): n is a, c, g, or t
cccacnctccccgctgctcgcgggagccagagggccctgcggtcctcggtggtcttgccagcccctcgtcatcccagggccctccgcgcctgtgaggactccctcaggtcggccacgggacctgacgcaacaggatggacgagtcccctgagcctctgcagcagggcagagggccggtgccggtccgacggcagcgcccagcaccccggggtctgcgtgagatgctgaaggccaggctgtggtgcagctgctcgtgcagtgtgctgtgcgtccgggcgctggtgcaggacctgctccccgccacgcgctggctgcgtcagtaccgcccgcgggagtacctggcaggcgacgtcatgtctgggctggtcatcggcatcatcctggtgccgcaggccatcgcctactcattgctggccgggctgcagcccatctacagcctctatacgtccttcttcgccaacctcatctacttcctcatgggcacctcacggcatgtctccgtgggcatcttcagcctgctttgcctcatggtggggcaggtggtggaccgggagctccagctggccggctttgacccctcccaggacggcctgcagcccggagccaacagcagcaccctcaacggctcggctgccatgctggactgcgggcgtgactgctacgccatccgtgtcgccaccgccctcacgctgatgaccgggctttaccaggtcctcatgggcgtcctccggctgggcttcgtgtccgcctacctctcacagccactgctcgatggctttgccatgggggcctccgtgaccatcctgacctcgcagctcaaacacctgctgggcgtgcggatcccgcggcaccaggggcccggcatggtggtcctcacatggctgagcctgctgcgcggcgccgggcaggccaacgtgtgcgacgtggtcaccagcacggtgtgcctggcggtgctgctagccgcgaaggagctctcagaccgctaccgacaccgcctgagggtgccgctgcccacggagctgctggtcatcgtggtggccacactcgtgtcgcacttcgggcagctccacaagcgctttggctcgagcgtggctggcgacatccccacgggtttcatgccccctcaggtcccagagcccaggctgatgcagcgtgtggctttggatgccgtggccctggccctcgtggctgccgccttctccatctcgctggcggagatgttcgcccgcagtcacggctactctgtgcgtgccaaccaggagctgctggctgtgggctgctgcaacgtgctacccgccttcctccactgcttcgccaccagcgccgccctggccaagagcctggtgaagacagccactggctgccggacacagctgtccagcgtggtcagcgccaccgtggtgctgctggtgctgctggcgctggcaccgctgttccacgacctacagcgaagcgtgctggcctgcgtcatcgtggtcagcctgcggggggccctgcgcaaggtgtggggcttcccgcggctgtggcggatgagcccggctgacgcgctggtctgggcaggcaccgcggccacctgtatgctggtcagcacagaggccgggctgctggctggcgtcatcctctcgctgctcagcctggccggccgcacccaacgcccacgcaccgccctgctggcccgcatcggggacacggccttctacgaggatgccacagagttcgagggcctcgtccctgagcccggcgtgcgggtgttccgctttggggggccgctgtactatgccaacaaggacttcttcctgcagtcactctacagcctcacggggctggacgcagggtgcatggctgccaggaggaaggaggggggctcagagacgggggtcggtgagggaggccctgcccagggcgaggacctgggcccggttagcaccagggctgcgctggtgcccgcagcggccggcttccacacagtggtcatcgactgcgccccgctgctgttcctagacgcagccggtgtgagcacgctgcaggacctgcgccgagactacggggccctgggcatcagcctgctgctagcctgctgcagcccgcctgtgagagacattctgagcagaggaggcttcctcggggagggccccggggacacggctgaggaggagcagctgttcctcagtgtgcacgatgccgtgcagacagcacgagcccgccacagggagctggaggccaccgatgcccatctgtagcagggccaggcctgcccagcagcctctgctccctcctggggacccacagcagacgtctgcaagccactgctgagacccttcccagggaggagccacccaagagctgcactcttgtgccacagctgccctggggaaaccggggaaccccaactgggaaaggaggccctctgatcacacgcaggacccaaacactcagaaatcaagaacctctgcctccgagacaggctggcccacagtgctggctgggccccaatgcaccgtccctcagctcaggagggatgggcctgacctgacgctcagggttgacatcttatttgaacaagggtcccccgccatcatgcagcctccaaggtgccaagaggactccctatgcccaggcctgcccggtgcccaccctgctggtaggagccagcggctctggccaagtgcacgagggtctctgtgtttccagaaggccccacacacccaagtgcccctcacacctcgtgcctccccctcacagggtggccacctgcaccagcgtcagggcccagggtgctgtgaccgatgagacctcagctcagccctcaggtgcagtggccctacccagcctggccagcagacacacacagggatgctcacgggtgcaccaggagccaggtgcggcgcagccaaccctgagcctgcagggagacctgcaggaagcccaccgtgccccatgcaggggctccctccagcacacagccctcaccccagcacagccagcaaggacacgctctccccaacagggtgcttcggcgggaggtgggggaacaaggggtcttccgagcagcccccagccctcccctcccatctgtgcctctgtaagg

SEQ ID NO: 295306 - DNA, 2290 bp, Homo sapiens
  misc_feature (6)..(6): n is a, c, g, or t
  misc_feature (2061)..(2061): n is a, c, g, or t
cccacnctccccgctgctcgcgggagccagagggccctgcggtcctcggtggtcttgccagcccctcgtcatcccagggccctccgcgcctgtgaggactccctcaggtcggccacgggacctgacgcaacaggatggacgagtcccctgagcctctgcagcagggcagagggccggtgccggtccgacggcagcgcccagcaccccggggtctgcgtgagatgctgaaggccaggctgtggtgcagctgctcgtgcagtgtgctgtgcgtccgggcgctggtgcaggacctgctccccgccacgcgctggctgcgtcagtaccgcccgcgggagtacctggcaggcgacgtcatgtctgggctggtcatcggcatcatcctggtgccgcaggccatcgcctactcattgctggccgggctgcagcccatctacagcctctatacgtccttcttcgccaacctcatctacttcctcatgggcacctcacggcatgtctccgtgggcatcttcagcctgctttgcctcatggtggggcaggtggtggaccgggagctccagctggccggctttgacccctcccaggacggcctgcagcccggagccaacagcagcaccctcaacggctcggctgccatgctggactgcgggcgtgactgctacgccatccgtgtcgccaccgccctcacgctgatgaccgggctttaccaggtcctcatgggcgtcctccggctgggcttcgtgtccgcctacctctcacagccactgctcgatggctttgccatgggggcctccgtgaccatcctgacctcgcagctcaaacacctgctgggcgtgcggatcccgcggcaccaggggcccggcatggtggtcctcacatggctgagcctgctgcgcggcgccgggcaggccaacgtgtgcgacgtggtcaccagcacggtgtgcctggcggtgctgctagccgcgaaggagctctcagaccgctaccgacaccgcctgagggtgccgctgcccacggagctgctggtcatcgtggtggccacactcgtgtcgcacttcgggcagctccacaagcgctttggctcgagcgtggctggcgacatccccacgggtttcatgccccctcaggtcccagagcccaggctgatgcagcgtgtggctttggatgccgtggccctggccctcgtggctgccgccttctccatctcgctggcggagatgttcgcccgcagtcacggctactctgtgcgtgccaaccaggagctgctggctgtgggctgctgcaacgtgctacccgccttcctccactgcttcgccaccagcgccgccctggccaagagcctggtgaagacagccactggctgccggacacagctgtccagcgtggtcagcgccaccgtggtgctgctggtgctgctggcgctggcaccgctgttccacgacctacagcgaagcgtgctggcctgcgtcatcgtggtcagcctgcggggggccctgcgcaaggtgtggggcttcccgcggctgtggcggatgagcccggctgacgcgctggtctgggcaggcaccgcggccacctgtatgctggtcagcacagaggccgggctgctggctggcgtcatcctctcgctgctcagcctggccggccgcacccaacgcccacgcaccgccctgctggcccgcatcggggacacggccttctacgaggatgccacagagttcgagggcctcgtccctgagcccggcgtgcgggtgttccgctttggggggccgctgtactatgccaacaaggacttcttcctgcagtcaaaaaaaaaaaaaaaaaaaaaaaaaaaaaaaaaaaaaaaaaaaaaaggggggggccccaaaaaaaaaacccccgggggggcccacatattagcgcgactcacacccggattttttgtgaaaaaaggggggccccctaaaaggaagggcgcgatatataaacacaataggacagagggcgcacgaggttaaaaaaacggtgtgttgaaacggtgaaaacactcgaaagcgggaaaaccttatggaaaagagaagaacncccttactactgcgggggaggggggcgacaaacaacatgggtgggcacaacaactatccccagacaggagaaatataaagaccgcccagagggggaaacaatcgtaaacacttgaaaacgggggataaaaaggtggtgtcacaaacgagggcggatatatatacgcggccgggtgtaaaaaaaaattggcacacgaggagatataaattgaaaagatttttaagcaggc

SEQ ID NO: 295307 - DNA, 1387 bp, Homo sapiens
  misc_feature (6)..(6): n is a, c, g, or t
cccacnctccccgctgctcgcgggagccagagggccctgcggtcctcggtggtcttgccagcccctcgtcatcccagggccctccgcgcctgtgaggactccctcaggtcggccacgggacctgacgcaacaggatggacgagtcccctgagcctctgcagcagggcagagggccggtgccggtccgacggcagcgcccagcaccccggggtctgcgtgagatgctgaaggccaggctgtggtgcagctgctcgtgcagtgtgctgtgcgtccgggcgctggtgcaggacctgctccccgccacgcgctggctgcgtcagtaccgcccgcgggagtacctggcaggcgacgtcatgtctgggctggtcatcggcatcatcctggtgccgcaggccatcgcctactcattgctggccgggctgcagcccatctacagcctctatacgtccttcttcgccaacctcatctacttcctcatgggcacctcacggcatgtctccgtgggcatcttcagcctgctttgcctcatggtggggcaggtggtggaccgggagctccagctggccggctttgacccctcccaggacggcctgcagcccggagccaacagcagcaccctcaacggctcggctgccatgctggactgcgggcgtgactgctacgccatccgtgtcgccaccgccctcacgctgatgaccgggctttaccagacgtcctggggtagaaacagcttccagcaacacccatggcaattaacacagaggagtgactcgcaggaacttctggaagaggaggaaagatcttgctgatttaacaggaaatgccgacatcaacgacatcgagaatgcgggaccctcacaccagcctcacgagaagccggtggatacagcttattccagagggaggcttggatcagcacctggggaaaaaaggcagcccctcaacctggccagcctgcagaggagagaagcctgagcaagcgtcctccaaatttcacaacaggctttaccatgtggatgatgtaaccagtcatcagtacatttctgtaaagcaaagcacacttttaaaaaccagccatgctagtgggcctgaggattacctttcgtcttcctctttcctctgtggaagatgatattgcaaaattgtaaaaagagacaataaaaaagtggatgaaagggtatcctagcaagctgttatgaataaaaaatctcggtattttctggattttgtgctgcttgtgctattagtcaagttttaaaacatgcttaatttattatttcttcttgcatctaattttattttattctttttatttatttatttatttttgagacagagtctcgcactgtcctccaggctggagtgcagtggcacgatcttggctcac

SEQ ID NO: 295308 - DNA, 909 bp, Homo sapiens
  misc_feature (6)..(6): n is a, c, g, or t
cccacnctccccgctgctcgcgggagccagagggccctgcggtcctcggtggtcttgccagcccctcgtcatcccagggccctccgcgcctgtgaggactccctcaggtcggccacgggacctgacgcaacaggatggacgagtcccctgagcctctgcagcagggcagagggccggtgccggtccgacggcagcgcccagcaccccggggtctgcgtgagatgctgaaggccaggctgtggtgcagctgctcgtgcagtgtgctgtgcgtccgggcgctggtgcaggacctgctccccgccacgcgctggctgcgtcagtaccgcccgcgggagtacctggcaggcgacgtcatgtctgggctggtcatcggcatcatcctggtgccgcaggccatcgcctactcattgctggccgggctgcagcccatctacagcctctatacgtccttcttcgccaacctcatctacttcctcatgggcacctcacggcatgtctccgtgggcatcttcagcctgctttgcctcatggtggggcaggtggtggaccgggagctccagctggccggctttgacccctcccaggacggcctgcagcccggagccaacagcagcaccctcaacggctcggctgccatgctggactgcgggcgtgactgctacgccatccgtgtcgccaccgccctcacgctgatgaccgggctttaccaggccttctgtcctaggtggagtgggggatggcctccccacccccgaaggtctcctgccttggcctgtccaccttggcccccgttggctccacatctgcatggggggcagtgggcaccatgtgtaggaagcagcaggaaggggttgccttctgataccagaggtcttaattctgaaataaaacgggctgctgcacgtgaca

SEQ ID NO: 295309 - DNA, 2017 bp, Homo sapiens
  misc_feature (1933)..(1933): n is a, c, g, or t
  misc_feature (1981)..(1981): n is a, c, g, or t
  misc_feature (1991)..(1991): n is a, c, g, or t
  misc_feature (1993)..(1993): n is a, c, g, or t
  misc_feature (1995)..(1995): n is a, c, g, or t
  misc_feature (1997)..(1997): n is a, c, g, or t
cccggaggaggcggagaggttccgccccccggatctccggcttccggcaactgggctggaccgaaaccggcgcggagcaactgaggcccgagccttctcgggacccgggggacgcctaaccccgcgagatgaggaaactgaggccgcgaggagcgcgcacacagcagagaagcagcagaatcgggaatcaaacccagctctgtctgaccccagagcctgtgcctttaaccactggctaggctgaactgcctttgttcttcactgtccccatcacctctttcaaacctcagcctctccttcctcatcgttacatctctaggctgcacctgctctctaaacattcacacaaaccctgcaaattttcttcctcataattgggagaagactcactggccgaatggcagcagtagatgacttgcaatttgaagaatttggcaatgcagccacttctctgacagcaaacccagatgccaccacagtaaacattgaggatcctggtgaaaccccaaaacatcagccaggatccccaagaggctcaggaagagaagaagatgatgagttactgggaaatgatgactctgacaaaactgagttacttgctggacagaagaaaagctcccccttctggacatttgaatactaccaaacattctttgatgtggacacctaccaggtctttgacagaattaaaggatctcttttgccaatacccgggaaaaactttgtgaggttatatatccgcagcaatccagatctctatggccccttttggatatgtgccacgttggtctttgccatagcaattagtgggaatctttccaacttcttgatccatctgggagagaagacgtaccattatgtgcccgaattccgaaaagtgtccatagcagctaccatcatctatgcctatgcctggctggttcctcttgcactctggggtttcctcatgtggagaaacagcaaagttatgaacatcgtctcctattcatttctggagattgtgtgtgtctatggatattccctcttcatttatatccccaccgcaatactgtggattatcccccagaaagctgttcgttggattctagtcatgattgccctgggcatctcaggatctctcttggcaatgacattttggccagctgttcgtgaggataaccgacgcgttgcattggccacaattgtgacaattgtgttgctccatatgctgctttctgtgggctgcttggcatacttttttgatgcaccagagatggaccatctcccaacaactacagctactccaaaccaaacagttgctgcagccaagtccagctaatgaggaaagactcacttgagataccctctccttgctgaagtttttcttgacttctccagttctcttttgttttttggagcatggttctttgggaagtggcatccactgcaggaaagcagaatgagcagagccagcagaactgatggagtggcacaaattcccagtgtctggatggtgccacactggcgcctaatcacccgtttaacaagcagaaattaaatgttgctcagcacatgtgtctttcagctcttccttttcacccatggatgatcattgcgagcatgcgctgattggactgaaatgccggggaataggttaggcatgctcagtgccgtccctttgccaccacagtcaaatgacatgcttcactgtggtaccttaatacctgaaatagaaccatggaaaattctgatgtcctctctctgaattatgtacagactacctgggggatcctcttctctccaaatgttagccatcctgaagtagccgaacagtagaaactttggtggggattaaccgggagcttgaaaatttgtctttggtaacctgatactggacagctgaactgaatggtgcaaaataaatacctcacatgaaaaaaaaaaaatggcctcnttggccctagcggggagctctgcggccttccctttagggaggttaatnaagatcctcncnantnaccccctcgcccccggcatg

SEQ ID NO: 295310 - DNA, 1913 bp, Homo sapiens
cccggaggaggcggagaggttccgccccccggatctccggcttccggcaactgggctggaccgaaaccggcgcggagcaactgaggcccgagccttctcgggacccgggggacgcctaaccccgcgagatgaggaaactgaggccgcgaggagcgcgcacacagcagagaagcagcagaatcgggaatcaaacccagctctgtctgaccccagagcctgtgcctttaaccactggctaggctgaactgcctttgttcttcactgtccccatcacctctttcaaacctcagcctctccttcctcatcgttacatctctaggctgcacctgctctctaaacattcacacaaaccctgcaaattttcttcctcataattgggagaagactcactggccgaatggcagcagtagatgacttgcaatttgaagaatttggcaatgcagccacttctctgacagcaaacccagatgccaccacagtaaacattgaggatcctggtgaaaccccaaaacatcagccaggatccccaagaggctcaggaagagaagaagatgatgagttactgggaaatgatgactctgacaaaactgagttacttgctggacagaagaaaagctcccccttctggacatttgaatactaccaaacattctttgatgtggacacctaccaggtctttgacagaattaaaggatctcttttgccaatacccgggaaaaactttgtgaggttatatatccgcagcaatccagatctctatggccccttttggatatgtgccacgttggtctttgccatagcaattagtgggaatctttccaacttcttgatccatctgggagagaagacgtaccattatgtgcccgaattccgaaaagtgtccatagcagctaccatcatctatgcctatgcctggctggttcctcttgcactctggggtttcctcatgtggagaaacagcaaagttatgaacatcgtctcctattcatttctggagattgtgtgtgtctatggatattccctcttcatttatatccccaccgcaatactgtggattatcccccagaaagctgttcgttggattctagtcatgattgccctgggcatctcaggatctctcttggcaatgacattttggccagctgttcgtgaggataaccgacgcgttgcattggccacaattgtgacaattgtgttgctccatatgctgctttctgtgggctgcttggcatacttttttgatgcaccagagatggaccatctcccaacaactacagctactccaaaccaaacagttgctgcagccaagtccagctaatgaggaaagactcacttgagataccctctccttgctgaagtttttcttgacttctccagttctcttttgttttttggagcatggttctttgggaagtggcatccactgcaggaaagcagaatgagcagagccagcagaactgatggagtggcacaaattcccagtgtctggatggtgccacactggcgcctaatcacccgtttaacaagcagaaattaaatgttgctcagcacatgtgtctttcagctcttccttttcacccatggatgatcattgcgagcatgcgctgattggactgaaatgccggggaataggttaggcatgctcagtgccgtccctttgccaccacagtcaaatgacatgcttcactgtggtaccttaatacctgaaatagaaccatggaaaattctgatgtcctctctctgaattatgtacagactacctgggggatcctcttctctccaaatgttagccatcctgaagtagccgaacagtagaaactttggtggggattaaccgggagcttgaaaatttgtctttggtaacctgatactggacagctgaactgaatggtgcaaaataaatacctcacatg

SEQ ID NO: 295311 - DNA, 1797 bp, Homo sapiens
  misc_feature (1713)..(1713): n is a, c, g, or t
  misc_feature (1761)..(1761): n is a, c, g, or t
  misc_feature (1771)..(1771): n is a, c, g, or t
  misc_feature (1773)..(1773): n is a, c, g, or t
  misc_feature (1775)..(1775): n is a, c, g, or t
  misc_feature (1777)..(1777): n is a, c, g, or t
cccggaggaggcggagaggttccgccccccggatctccggcttccggcaactgggctggaccgaaaccggcgcggagcaactgaggcccgagccttctcgggacccgggggacgcctaaccccgcgagaaccctgcaaattttcttcctcataattgggagaagactcactggccgaatggcagcagtagatgacttgcaatttgaagaatttggcaatgcagccacttctctgacagcaaacccagatgccaccacagtaaacattgaggatcctggtgaaaccccaaaacatcagccaggatccccaagaggctcaggaagagaagaagatgatgagttactgggaaatgatgactctgacaaaactgagttacttgctggacagaagaaaagctcccccttctggacatttgaatactaccaaacattctttgatgtggacacctaccaggtctttgacagaattaaaggatctcttttgccaatacccgggaaaaactttgtgaggttatatatccgcagcaatccagatctctatggccccttttggatatgtgccacgttggtctttgccatagcaattagtgggaatctttccaacttcttgatccatctgggagagaagacgtaccattatgtgcccgaattccgaaaagtgtccatagcagctaccatcatctatgcctatgcctggctggttcctcttgcactctggggtttcctcatgtggagaaacagcaaagttatgaacatcgtctcctattcatttctggagattgtgtgtgtctatggatattccctcttcatttatatccccaccgcaatactgtggattatcccccagaaagctgttcgttggattctagtcatgattgccctgggcatctcaggatctctcttggcaatgacattttggccagctgttcgtgaggataaccgacgcgttgcattggccacaattgtgacaattgtgttgctccatatgctgctttctgtgggctgcttggcatacttttttgatgcaccagagatggaccatctcccaacaactacagctactccaaaccaaacagttgctgcagccaagtccagctaatgaggaaagactcacttgagataccctctccttgctgaagtttttcttgacttctccagttctcttttgttttttggagcatggttctttgggaagtggcatccactgcaggaaagcagaatgagcagagccagcagaactgatggagtggcacaaattcccagtgtctggatggtgccacactggcgcctaatcacccgtttaacaagcagaaattaaatgttgctcagcacatgtgtctttcagctcttccttttcacccatggatgatcattgcgagcatgcgctgattggactgaaatgccggggaataggttaggcatgctcagtgccgtccctttgccaccacagtcaaatgacatgcttcactgtggtaccttaatacctgaaatagaaccatggaaaattctgatgtcctctctctgaattatgtacagactacctgggggatcctcttctctccaaatgttagccatcctgaagtagccgaacagtagaaactttggtggggattaaccgggagcttgaaaatttgtctttggtaacctgatactggacagctgaactgaatggtgcaaaataaatacctcacatgaaaaaaaaaaaatggcctcnttggccctagcggggagctctgcggccttccctttagggaggttaatnaagatcctcncnantnaccccctcgcccccggcatg

SEQ ID NO: 295312 - DNA, 1862 bp, Homo sapiens
cccggaggaggcggagaggttccgccccccggatctccggcttccggcaactgggctggaccgaaaccggcgcggagcaactgaggcccgagccttctcgggacccgggggacgcctaaccccgcgagatgaggaaactgaggccgcgaggagcgcgcacacagcagagaagcagcagaatcgggaatcaaacccagctctgtctgaccccagagcctgtgcctttaaccactggctaggctgaactgcctttgttcttcactgtccccatcacctctttcaaacctcagcctctccttcctcatcgttacatctctaggctgcacctgctctctaaacattcacacaaaccctgcaaattttcttcctcataattgggagaagactcactggccgaatggcagcagtagatgacttgcaatttgaagaatttggcaatgcagccacttctctgacagcaaacccagatgccaccacagtaaacattgaggatcctggtgaaaccccaaaacatcagccaggatccccaagaggctcaggaagagaagaagatgatgagttactgggaaatgatgactctgacaaaactgagttacttgctggacagaagaaaagctcccccttctggacatttgaatactaccaaacattctttgatgtggacacctaccaggtctttgacagaattaaaggatctcttttgccaatacccgggaaaaactttgtgaggttatatatccgcagcaatccagatctctatggccccttttggatatgtgccacgttggtctttgccatagcaattagtgggaatctttccaacttcttgatccatctgggagagaagacgtaccattatgtgcccgaattccgaaaagtgtccatagcagctaccatcatctatgcctatgcctggctggttcctcttgcactctggggtttcctcatgtggagaaacagcaaagttatgaacatcgtctcctattcatttctggagattgtgtgtgtctatggatattccctcttcatttatatccccaccgcaatactgtggattatcccccagaaagctgttcgttggattctagtcatgattgccctgggcatctcaggatctctcttggcaatgacattttggccagctgttcgtgaggataaccgacgcgttgcattggccacaattgtgacaattgtgttgctccatatgctgctttctgtgggctgcttggcatacttttttgatgcaccagagatggaccatctcccaacaactacagctactccaaaccaaacagttgctgcagccaagtccagctaatgaggaaattctcttttgttttttggagcatggttctttgggaagtggcatccactgcaggaaagcagaatgagcagagccagcagaactgatggagtggcacaaattcccagtgtctggatggtgccacactggcgcctaatcacccgtttaacaagcagaaattaaatgttgctcagcacatgtgtctttcagctcttccttttcacccatggatgatcattgcgagcatgcgctgattggactgaaatgccggggaataggttaggcatgctcagtgccgtccctttgccaccacagtcaaatgacatgcttcactgtggtaccttaatacctgaaatagaaccatggaaaattctgatgtcctctctctgaattatgtacagactacctgggggatcctcttctctccaaatgttagccatcctgaagtagccgaacagtagaaactttggtggggattaaccgggagcttgaaaatttgtctttggtaacctgatactggacagctgaactgaatggtgcaaaataaatacctcacatg

SEQ ID NO: 295313 - DNA, 1966 bp, Homo sapiens
  misc_feature (1882)..(1882): n is a, c, g, or t
  misc_feature (1930)..(1930): n is a, c, g, or t
  misc_feature (1940)..(1940): n is a, c, g, or t
  misc_feature (1942)..(1942): n is a, c, g, or t
  misc_feature (1944)..(1944): n is a, c, g, or t
  misc_feature (1946)..(1946): n is a, c, g, or t
cccggaggaggcggagaggttccgccccccggatctccggcttccggcaactgggctggaccgaaaccggcgcggagcaactgaggcccgagccttctcgggacccgggggacgcctaaccccgcgagatgaggaaactgaggccgcgaggagcgcgcacacagcagagaagcagcagaatcgggaatcaaacccagctctgtctgaccccagagcctgtgcctttaaccactggctaggctgaactgcctttgttcttcactgtccccatcacctctttcaaacctcagcctctccttcctcatcgttacatctctaggctgcacctgctctctaaacattcacacaaaccctgcaaattttcttcctcataattgggagaagactcactggccgaatggcagcagtagatgacttgcaatttgaagaatttggcaatgcagccacttctctgacagcaaacccagatgccaccacagtaaacattgaggatcctggtgaaaccccaaaacatcagccaggatccccaagaggctcaggaagagaagaagatgatgagttactgggaaatgatgactctgacaaaactgagttacttgctggacagaagaaaagctcccccttctggacatttgaatactaccaaacattctttgatgtggacacctaccaggtctttgacagaattaaaggatctcttttgccaatacccgggaaaaactttgtgaggttatatatccgcagcaatccagatctctatggccccttttggatatgtgccacgttggtctttgccatagcaattagtgggaatctttccaacttcttgatccatctgggagagaagacgtaccattatgtgcccgaattccgaaaagtgtccatagcagctaccatcatctatgcctatgcctggctggttcctcttgcactctggggtttcctcatgtggagaaacagcaaagttatgaacatcgtctcctattcatttctggagattgtgtgtgtctatggatattccctcttcatttatatccccaccgcaatactgtggattatcccccagaaagctgttcgttggattctagtcatgattgccctgggcatctcaggatctctcttggcaatgacattttggccagctgttcgtgaggataaccgacgcgttgcattggccacaattgtgacaattgtgttgctccatatgctgctttctgtgggctgcttggcatacttttttgatgcaccagagatggaccatctcccaacaactacagctactccaaaccaaacagttgctgcagccaagtccagctaatgaggaaattctcttttgttttttggagcatggttctttgggaagtggcatccactgcaggaaagcagaatgagcagagccagcagaactgatggagtggcacaaattcccagtgtctggatggtgccacactggcgcctaatcacccgtttaacaagcagaaattaaatgttgctcagcacatgtgtctttcagctcttccttttcacccatggatgatcattgcgagcatgcgctgattggactgaaatgccggggaataggttaggcatgctcagtgccgtccctttgccaccacagtcaaatgacatgcttcactgtggtaccttaatacctgaaatagaaccatggaaaattctgatgtcctctctctgaattatgtacagactacctgggggatcctcttctctccaaatgttagccatcctgaagtagccgaacagtagaaactttggtggggattaaccgggagcttgaaaatttgtctttggtaacctgatactggacagctgaactgaatggtgcaaaataaatacctcacatgaaaaaaaaaaaatggcctcnttggccctagcggggagctctgcggccttccctttagggaggttaatnaagatcctcncnantnaccccctcgcccccggcatg

SEQ ID NO: 295314 - DNA, 1549 bp, Homo sapiens
cccggaggaggcggagaggttccgccccccggatctccggcttccggcaactgggctggaccgaaaccggcgcggagcaactgaggcccgagccttctcgggacccgggggacgcctaaccccgcgagatgaggaaactgaggccgcgaggagcgcgcacacagcagagaagcagcagaatcgggaatcaaacccagctctgtctgaccccagagcctgtgcctttaaccactggctaggctgaactgcctttgttcttcactgtccccatcacctctttcaaacctcagcctctccttcctcatcgttacatctctaggctgcacctgctctctaaacattcacacaaaccctgcaaattttcttcctcataattgggagaagactcactggccgaatggcagcagtagatgacttgcaatttgaagaatttggcaatgcagccacttctctgacagcaaacccagatgccaccacagtaaacattgaggatcctggtgaaaccccaaaacatcagccaggatccccaagaggctcaggaagagaagaagatgatgagttactgggaaatgatgactctgacaaaactgagttacttgctggacagaagaaaagctcccccttctggacatttgaatactaccaaacattctttgatgtggacacctaccaggtctttgacagaattaaaggatctcttttgccaatacccgggaaaaactttgtgaggttatatatccgcagcaatccagatctctatggccccttttggatatgtgccacgttggtctttgccatagcaattagtgggaatctttccaacttcttgatccatctgggagagaagacgtaccattatgtgcccgaattccgaaaagtgtccatagcagctaccatcatctatgcctatgcctggctggttcctcttgcactctggggtttcctcatgtggagaaacagcaaagttatgaacatcgtctcctattcatttctggagattgtgtgtgtctatggatattccctcttcatttatatccccaccgcaatactgtggattatcccccagaaagctgttcgttggattctagtcatgattgccctgggcatctcaggatctctcttggcaatgacattttggccagctgttcgtgaggataaccgacgcgttgcattggccacaattgtgacaattgtgttgctccatatgctgctttctgtgggctgcttggcatacttttttgatgcaccagagatggaccatctcccaacaactacagctactccaaaccaaacagttgctgcagccaagtccagctaatgaggaaagactcacttgagataccctctccttgctgaagtttttcttgacttctccagttctcttttgttttttggagcatggttctttgggaagtggcatccactgcaggaaagcagaatgagcagagccagcagaactgatggagtggcacaaattcccagtgtctggatggtgccacactggcgcctaatcacccgtttaacaagcagaaattaaatgttgctcagc

SEQ ID NO: 295315 - DNA, 1562 bp, Homo sapiens
cccggaggaggcggagaggttccgccccccggatctccggcttccggcaactgggctggaccgaaaccggcgcggagcaactgaggcccgagccttctcgggacccgggggacgcctaaccccgcgagaatttggcaatgcagccacttctctgacagcaaacccagatgccaccacagtaaacattgaggatcctggtgaaaccccaaaacatcagccaggatccccaagaggctcaggaagagaagaagatgatgagttactgggaaatgatgactctgacaaaactgagttacttgctggacagaagaaaagctcccccttctggacatttgaatactaccaaacattctttgatgtggacacctaccaggtctttgacagaattaaaggatctcttttgccaatacccgggaaaaactttgtgaggttatatatccgcagcaatccagatctctatggccccttttggatatgtgccacgttggtctttgccatagcaattagtgggaatctttccaacttcttgatccatctgggagagaagacgtaccattatgtgcccgaattccgaaaagtgtccatagcagctaccatcatctatgcctatgcctggctggttcctcttgcactctggggtttcctcatgtggagaaacagcaaagttatgaacatcgtctcctattcatttctggagattgtgtgtgtctatggatattccctcttcatttatatccccaccgcaatactgtggattatcccccagaaagctgttcgttggattctagtcatgattgccctgggcatctcaggatctctcttggcaatgacattttggccagctgttcgtgaggataaccgacgcgttgcattggccacaattgtgacaattgtgttgctccatatgctgctttctgtgggctgcttggcatacttttttgatgcaccagagatggaccatctcccaacaactacagctactccaaaccaaacagttgctgcagccaagtccagctaatgaggaaattctcttttgttttttggagcatggttctttgggaagtggcatccactgcaggaaagcagaatgagcagagccagcagaactgatggagtggcacaaattcccagtgtctggatggtgccacactggcgcctaatcacccgtttaacaagcagaaattaaatgttgctcagcacatgtgtctttcagctcttccttttcacccatggatgatcattgcgagcatgcgctgattggactgaaatgccggggaataggttaggcatgctcagtgccgtccctttgccaccacagtcaaatgacatgcttcactgtggtaccttaatacctgaaatagaaccatggaaaattctgatgtcctctctctgaattatgtacagactacctgggggatcctcttctctccaaatgttagccatcctgaagtagccgaacagtagaaactttggtggggattaaccgggagcttgaaaatttgtctttggtaacctgatactggacagctgaactgaatggtgcaaaataaatacctcacatg

SEQ ID NO: 295316 - DNA, 1853 bp, Homo sapiens
  misc_feature (1769)..(1769): n is a, c, g, or t
  misc_feature (1817)..(1817): n is a, c, g, or t
  misc_feature (1827)..(1827): n is a, c, g, or t
  misc_feature (1829)..(1829): n is a, c, g, or t
  misc_feature (1831)..(1831): n is a, c, g, or t
  misc_feature (1833)..(1833): n is a, c, g, or t
cccggaggaggcggagaggttccgccccccggatctccggcttccggcaactgggctggaccgaaaccggcgcggagcaactgaggcccgagccttctcgggacccgggggacgcctaaccccgcgagatgaggaaactgaggccgcgaggagcgcgcacacagcagagaagcagcagaatcgggaatcaaacccagctctgtctgaccccagagcctgtgcctttaaccactggctaggctgaactgcctttgttcttcactgtccccatcacctctttcaaacctcagcctctccttcctcatcgttacatctctaggctgcacctgctctctaaacattcacacaaaccctgcaaattttcttcctcataattgggagaagactcactggccgaatggcagcagtagatgacttgcaatttgaagttacttgctggacagaagaaaagctcccccttctggacatttgaatactaccaaacattctttgatgtggacacctaccaggtctttgacagaattaaaggatctcttttgccaatacccgggaaaaactttgtgaggttatatatccgcagcaatccagatctctatggccccttttggatatgtgccacgttggtctttgccatagcaattagtgggaatctttccaacttcttgatccatctgggagagaagacgtaccattatgtgcccgaattccgaaaagtgtccatagcagctaccatcatctatgcctatgcctggctggttcctcttgcactctggggtttcctcatgtggagaaacagcaaagttatgaacatcgtctcctattcatttctggagattgtgtgtgtctatggatattccctcttcatttatatccccaccgcaatactgtggattatcccccagaaagctgttcgttggattctagtcatgattgccctgggcatctcaggatctctcttggcaatgacattttggccagctgttcgtgaggataaccgacgcgttgcattggccacaattgtgacaattgtgttgctccatatgctgctttctgtgggctgcttggcatacttttttgatgcaccagagatggaccatctcccaacaactacagctactccaaaccaaacagttgctgcagccaagtccagctaatgaggaaagactcacttgagataccctctccttgctgaagtttttcttgacttctccagttctcttttgttttttggagcatggttctttgggaagtggcatccactgcaggaaagcagaatgagcagagccagcagaactgatggagtggcacaaattcccagtgtctggatggtgccacactggcgcctaatcacccgtttaacaagcagaaattaaatgttgctcagcacatgtgtctttcagctcttccttttcacccatggatgatcattgcgagcatgcgctgattggactgaaatgccggggaataggttaggcatgctcagtgccgtccctttgccaccacagtcaaatgacatgcttcactgtggtaccttaatacctgaaatagaaccatggaaaattctgatgtcctctctctgaattatgtacagactacctgggggatcctcttctctccaaatgttagccatcctgaagtagccgaacagtagaaactttggtggggattaaccgggagcttgaaaatttgtctttggtaacctgatactggacagctgaactgaatggtgcaaaataaatacctcacatgaaaaaaaaaaaatggcctcnttggccctagcggggagctctgcggccttccctttagggaggttaatnaagatcctcncnantnaccccctcgcccccggcatg

SEQ ID NO: 295317 - DNA, 1886 bp, Homo sapiens
  misc_feature (1802)..(1802): n is a, c, g, or t
  misc_feature (1850)..(1850): n is a, c, g, or t
  misc_feature (1860)..(1860): n is a, c, g, or t
  misc_feature (1862)..(1862): n is a, c, g, or t
  misc_feature (1864)..(1864): n is a, c, g, or t
  misc_feature (1866)..(1866): n is a, c, g, or t
cccggaggaggcggagaggttccgccccccggatctccggcttccggcaactgggctggaccgaaaccggcgcggagcaactgaggcccgagccttctcgggacccgggggacgcctaaccccgcgagaaccctgcaaattttcttcctcataattgggagaagactcactggccgaatggcagcagtagatgacttgcaatttgaagaatttggcaatgcagccacttctctgacagcaaacccagatgccaccacagtaaacattgaggatcctggtgaaaccccaaaacatcagccaggatccccaagaggctcaggaagagaagaagatgatgagttactgggaaatgatgactctgacaaaactgaggtacagtgtcaggcaatgacagctcagaggtaaatgacacatggcctcttccttggtgggggaaacaggcaaacagaccattactttccttacttgctggacagaagaaaagctcccccttctggacatttgaatactaccaaacattctttgatgtggacacctaccaggtctttgacagaattaaaggatctcttttgccaatacccgggaaaaactttgtgaggttatatatccgcagcaatccagatctctatggccccttttggatatgtgccacgttggtctttgccatagcaattagtgggaatctttccaacttcttgatccatctgggagagaagacgtaccattatgtgcccgaattccgaaaagtgtccatagcagctaccatcatctatgcctatgcctggctggttcctcttgcactctggggtttcctcatgtggagaaacagcaaagttatgaacatcgtctcctattcatttctggagattgtgtgtgtctatggatattccctcttcatttatatccccaccgcaatactgtggattatcccccagaaagctgttcgttggattctagtcatgattgccctgggcatctcaggatctctcttggcaatgacattttggccagctgttcgtgaggataaccgacgcgttgcattggccacaattgtgacaattgtgttgctccatatgctgctttctgtgggctgcttggcatacttttttgatgcaccagagatggaccatctcccaacaactacagctactccaaaccaaacagttgctgcagccaagtccagctaatgaggaaagactcacttgagataccctctccttgctgaagtttttcttgacttctccagttctcttttgttttttggagcatggttctttgggaagtggcatccactgcaggaaagcagaatgagcagagccagcagaactgatggagtggcacaaattcccagtgtctggatggtgccacactggcgcctaatcacccgtttaacaagcagaaattaaatgttgctcagcacatgtgtctttcagctcttccttttcacccatggatgatcattgcgagcatgcgctgattggactgaaatgccggggaataggttaggcatgctcagtgccgtccctttgccaccacagtcaaatgacatgcttcactgtggtaccttaatacctgaaatagaaccatggaaaattctgatgtcctctctctgaattatgtacagactacctgggggatcctcttctctccaaatgttagccatcctgaagtagccgaacagtagaaactttggtggggattaaccgggagcttgaaaatttgtctttggtaacctgatactggacagctgaactgaatggtgcaaaataaatacctcacatgaaaaaaaaaaaatggcctcnttggccctagcggggagctctgcggccttccctttagggaggttaatnaagatcctcncnantnaccccctcgcccccggcatg

SEQ ID NO: 295318 - DNA, 292 bp, Homo sapiens
cccggaggaggcggagaggttccgccccccggatctccggcttccggcaactgggctggaccgaaaccggcgcggagcaactgaggcccgagccttctcgggacccgggggacgcctaaccccgcgagatgaggaaactgaggccgcgaggagcgcgcacacagcagagaagcagcagaatcgggaatcaaacccagctctgtctgaccccagagcctgtgcctttaaccactggctaggctgaactgcctttgttcttggggagcgggagacgttgtggtggggctggggc

SEQ ID NO: 295319 - DNA, 1498 bp, Homo sapiens
cccggaggaggcggagaggttccgccccccggatctccggcttccggcaactgggctggaccgaaaccggcgcggagcaactgaggcccgagccttctcgggacccgggggacgcctaaccccgcgagatgaggaaactgaggccgcgaggagcgcgcacacagcagagaagcagcagaatcgggaatcaaacccagctctgtctgaccccagagcctgtgcctttaaccactggctaggctgaactgcctttgttcttcactgtccccatcacctctttcaaacctcagcctctccttcctcatcgttacatctctaggctgcacctgctctctaaacattcacacaaaccctgcaaattttcttcctcataattgggagaagactcactggccgaatggcagcagtagatgacttgcaatttgaagaatttggcaatgcagccacttctctgacagcaaacccagatgccaccacagtaaacattgaggatcctggtgaaaccccaaaacatcagccaggatccccaagaggctcaggaagagaagaagatgatgagttactgggaaatgatgactctgacaaaactgagttacttgctggacagaagaaaagctcccccttctggacatttgaatactaccaaacattctttgatgtggacacctaccaggtctttgacagaattaaaggatctcttttgccaatacccgggaaaaactttgtgaggttatatatccgcagcaatccagatctctatggccccttttggatatgtgccacgttggtctttgccatagcaattagtgggaatctttccaacttcttgatccatctgggagagaagacgtaccattatgtgcccgaattccgaaaagtgtccatagcagctaccatcatctatgcctatgcctggctggttcctcttgcactctggggtttcctcatgtggagaaacagcaaagttatgaacatcgtctcctattcatttctggagattgtgtgtgtctatggatattccctcttcatttatatccccaccgcaatactgtggattatcccccagaaagctgttcgttggattctagtcatgattgccctgggcatctcaggatctctcttggcaatgacattttggccagctgttcgtgaggataaccgacgcgttgcattggccacaattgtgacaattgtgttgctccatatgctgctttctgtgggctgcttggcatacttttttgatgcaccagagatggaccatctcccaacaactacagctactccaaaccaaacagttgctgcagccaagtccagctaatgaggaaattctcttttgttttttggagcatggttctttgggaagtggcatccactgcaggaaagcagaatgagcagagccagcagaactgatggagtggcacaaattcccagtgtctggatggtgccacactggcgcctaatcacccgtttaacaagcagaaattaaatgttgctcagc

SEQ ID NO: 295320 - DNA, 2106 bp, Homo sapiens
  misc_feature (2022)..(2022): n is a, c, g, or t
  misc_feature (2070)..(2070): n is a, c, g, or t
  misc_feature (2080)..(2080): n is a, c, g, or t
  misc_feature (2082)..(2082): n is a, c, g, or t
  misc_feature (2084)..(2084): n is a, c, g, or t
  misc_feature (2086)..(2086): n is a, c, g, or t
cccggaggaggcggagaggttccgccccccggatctccggcttccggcaactgggctggaccgaaaccggcgcggagcaactgaggcccgagccttctcgggacccgggggacgcctaaccccgcgagatgaggaaactgaggccgcgaggagcgcgcacacagcagagaagcagcagaatcgggaatcaaacccagctctgtctgaccccagagcctgtgcctttaaccactggctaggctgaactgcctttgttcttcactgtccccatcacctctttcaaacctcagcctctccttcctcatcgttacatctctaggctgcacctgctctctaaacattcacacaaaccctgcaaattttcttcctcataattgggagaagactcactggccgaatggcagcagtagatgacttgcaatttgaagaatttggcaatgcagccacttctctgacagcaaacccagatgccaccacagtaaacattgaggatcctggtgaaaccccaaaacatcagccaggatccccaagaggctcaggaagagaagaagatgatgagttactgggaaatgatgactctgacaaaactgaggtacagtgtcaggcaatgacagctcagaggtaaatgacacatggcctcttccttggtgggggaaacaggcaaacagaccattactttccttacttgctggacagaagaaaagctcccccttctggacatttgaatactaccaaacattctttgatgtggacacctaccaggtctttgacagaattaaaggatctcttttgccaatacccgggaaaaactttgtgaggttatatatccgcagcaatccagatctctatggccccttttggatatgtgccacgttggtctttgccatagcaattagtgggaatctttccaacttcttgatccatctgggagagaagacgtaccattatgtgcccgaattccgaaaagtgtccatagcagctaccatcatctatgcctatgcctggctggttcctcttgcactctggggtttcctcatgtggagaaacagcaaagttatgaacatcgtctcctattcatttctggagattgtgtgtgtctatggatattccctcttcatttatatccccaccgcaatactgtggattatcccccagaaagctgttcgttggattctagtcatgattgccctgggcatctcaggatctctcttggcaatgacattttggccagctgttcgtgaggataaccgacgcgttgcattggccacaattgtgacaattgtgttgctccatatgctgctttctgtgggctgcttggcatacttttttgatgcaccagagatggaccatctcccaacaactacagctactccaaaccaaacagttgctgcagccaagtccagctaatgaggaaagactcacttgagataccctctccttgctgaagtttttcttgacttctccagttctcttttgttttttggagcatggttctttgggaagtggcatccactgcaggaaagcagaatgagcagagccagcagaactgatggagtggcacaaattcccagtgtctggatggtgccacactggcgcctaatcacccgtttaacaagcagaaattaaatgttgctcagcacatgtgtctttcagctcttccttttcacccatggatgatcattgcgagcatgcgctgattggactgaaatgccggggaataggttaggcatgctcagtgccgtccctttgccaccacagtcaaatgacatgcttcactgtggtaccttaatacctgaaatagaaccatggaaaattctgatgtcctctctctgaattatgtacagactacctgggggatcctcttctctccaaatgttagccatcctgaagtagccgaacagtagaaactttggtggggattaaccgggagcttgaaaatttgtctttggtaacctgatactggacagctgaactgaatggtgcaaaataaatacctcacatgaaaaaaaaaaaatggcctcnttggccctagcggggagctctgcggccttccctttagggaggttaatnaagatcctcncnantnaccccctcgcccccggcatg

SEQ ID NO: 295321 - DNA, 1633 bp, Homo sapiens
  misc_feature (1549)..(1549): n is a, c, g, or t
  misc_feature (1597)..(1597): n is a, c, g, or t
  misc_feature (1607)..(1607): n is a, c, g, or t
  misc_feature (1609)..(1609): n is a, c, g, or t
  misc_feature (1611)..(1611): n is a, c, g, or t
  misc_feature (1613)..(1613): n is a, c, g, or t
cccggaggaggcggagaggttccgccccccggatctccggcttccggcaactgggctggaccgaaaccggcgcggagcaactgaggcccgagccttctcgggacccgggggacgcctaaccccgcgagaaccctgcaaattttcttcctcataattgggagaagactcactggccgaatggcagcagtagatgacttgcaatttgaagttacttgctggacagaagaaaagctcccccttctggacatttgaatactaccaaacattctttgatgtggacacctaccaggtctttgacagaattaaaggatctcttttgccaatacccgggaaaaactttgtgaggttatatatccgcagcaatccagatctctatggccccttttggatatgtgccacgttggtctttgccatagcaattagtgggaatctttccaacttcttgatccatctgggagagaagacgtaccattatgtgcccgaattccgaaaagtgtccatagcagctaccatcatctatgcctatgcctggctggttcctcttgcactctggggtttcctcatgtggagaaacagcaaagttatgaacatcgtctcctattcatttctggagattgtgtgtgtctatggatattccctcttcatttatatccccaccgcaatactgtggattatcccccagaaagctgttcgttggattctagtcatgattgccctgggcatctcaggatctctcttggcaatgacattttggccagctgttcgtgaggataaccgacgcgttgcattggccacaattgtgacaattgtgttgctccatatgctgctttctgtgggctgcttggcatacttttttgatgcaccagagatggaccatctcccaacaactacagctactccaaaccaaacagttgctgcagccaagtccagctaatgaggaaagactcacttgagataccctctccttgctgaagtttttcttgacttctccagttctcttttgttttttggagcatggttctttgggaagtggcatccactgcaggaaagcagaatgagcagagccagcagaactgatggagtggcacaaattcccagtgtctggatggtgccacactggcgcctaatcacccgtttaacaagcagaaattaaatgttgctcagcacatgtgtctttcagctcttccttttcacccatggatgatcattgcgagcatgcgctgattggactgaaatgccggggaataggttaggcatgctcagtgccgtccctttgccaccacagtcaaatgacatgcttcactgtggtaccttaatacctgaaatagaaccatggaaaattctgatgtcctctctctgaattatgtacagactacctgggggatcctcttctctccaaatgttagccatcctgaagtagccgaacagtagaaactttggtggggattaaccgggagcttgaaaatttgtctttggtaacctgatactggacagctgaactgaatggtgcaaaataaatacctcacatgaaaaaaaaaaaatggcctcnttggccctagcggggagctctgcggccttccctttagggaggttaatnaagatcctcncnantnaccccctcgcccccggcatg

SEQ ID NO: 295322 - DNA, 981 bp, Homo sapiens
tgggaacacaaacttgctggcgggaagagcccggaaagaaacctgtggatctcccttcgagatcatccaaagagaagaaaggtgacctcacattcgtgccccttagcagcactctgcagaaatgcctcctcagctgcaaaacggcctgaacctctcggccaaagttgtccagggaagcctggacagcctgccccaggcagtgagggagtttctcgagaataacgctgagctgtgtcagcctgatcacatccacatctgtgacggctctgaggaggagaatgggcggcttctgggccagatggaggaagagggcatcctcaggcggctgaagaagtatgacaactgctggttggctctcactgaccccagggatgtggccaggatcgaaagcaagacggttatcgtcacccaagagcaaagagacacagtgcccatccccaaaacaggcctcagccagctcggtcgctggatgtcagaggaggattttgagaaagcgttcaatgccaggttcccagggtgcatgaaaggtcgcaccatgtacgtcatcccattcagcatggggccgctgggctcacctctgtcgaagatcggcatcgagctgacggattcgccctacgtggtggccagcatgcggatcatgacgcggatgggcacgcccgtcctggaagcactgggcgatggggagtttgtcaaatgcctccattctgtggggtgccctctgcctttacaaaagcctttggtcaacaactggccctgcaacccggagctgacgctcatcgcccacctgcctgaccgcagagagatcatctcctttggcagtgggtacggcgggaactcgctgctcgggaagaagtgctttgctctcaggatggccagccggctggccaaggaggaagggtggctggcagagcacatgctgatctgggtataaccaacctgaggttgagagaatgtccggggcgcctagagatcctcgagggc

SEQ ID NO: 295323 - DNA, 393 bp, Homo sapiens
aactttgctcaattgcactgtagagctcagtttggccaatgtgtagttgactgagatgcaagttgggaggcattagatattagataattttgatgtgtgtgtgtgtgtgtgtgtgtgtgtgtgtgcatgtatgtgcacatgtgtctgtgtggtatatttgtgtatgtgtatttgtatgtactgttattgaaaatatatttaatacctttggaaaaatcttgggcaagatgacctactagttttccttgaaaaaaagttgctttgttattaatattgtgcttaaattatttttatacaccattgttccttacctttacataattgcaatatttcccccttactacttcttggaaaaaaattacaaaatgaagttttatagaaaagaaaaaaaag

SEQ ID NO: 295324 - DNA, 364 bp, Homo sapiens
gccccttgttgttagttgggctggcaagggaatttctggtgactgtagttccttagttaggtcttagcaatcaaaccaaattgatgtctcccttgactcttctgtgtatatgtgtctgtgtggtatatttgtgtatgtgtatttgtatgtactgttattgaaaatatatttaatacctttggaaaaatcttgggcaagatgacctactagttttccttgaaaaaaagttgctttgttattaatattgtgcttaaattatttttatacaccattgttccttacctttacataattgcaatatttcccccttactacttcttggaaaaaaattacaaaatgaagttttatagaaaagaaaaaaaag

SEQ ID NO: 295325 - DNA, 2998 bp, Homo sapiens
tgggaacacaaacttgctggcgggaagagcccggaaagaaacctgtggatctcccttcgagatcatccaaagagaagaaaggtgacctcacattcgtgccccttagcagcactctgcagaaatgcctcctcagctgcaaaacggcctgaacctctcggccaaagttgtccagggaagcctggacagcctgccccaggcagtgagggagtttctcgagaataacgctgagctgtgtcagcctgatcacatccacatctgtgacggctctgaggaggagaatgggcggcttctgggccagatggaggaagagggcatcctcaggcggctgaagaagtatgacaactgctggttggctctcactgaccccagggatgtggccaggatcgaaagcaagacggttatcgtcacccaagagcaaagagacacagtgcccatccccaaaacaggcctcagccagctcggtcgctggatgtcagaggaggattttgagaaagcgttcaatgccaggttcccagggtgcatgaaaggtcgcaccatgtacgtcatcccattcagcatggggccgctgggctcacctctgtcgaagatcggcatcgagctgacggattcgccctacgtggtggccagcatgcggatcatgacgcggatgggcacgcccgtcctggaagcactgggcgatggggagtttgtcaaatgcctccattctgtggggtgccctctgcctttacaaaagcctttggtcaacaactggccctgcaacccggagctgacgctcatcgcccacctgcctgaccgcagagagatcatctcctttggcagtgggtacggcgggaactcgctgctcgggaagaagtgctttgctctcaggatggccagccggctggccaaggaggaagggtggctggcagagcacatgctggtgagcctgcaggaagccctgatgtgcagatgagaggcctggggggtggcagaaacaaacagcattacagttcccacccgtcagcacacctctctgagcgtgcaggttcccggacagatcgggaaaccccaccagtaatgattagtttacacatatacatcgcttttgaaggcccccaaacaccaggggaccatagagatcctttggacttcatgattctgggagtgtttgtttgcactgatacctgaagaaatagatcttgagggcctacattccaacctctgggctgaagtaccaacctcggggagaaggaaacaaagatcacaataaagaatcttgtccccaacagattctgggtataaccaaccctgagggtgagaagaagtacctggcggccgcatttcccagcgcctgcgggaagaccaacctggccatgatgaaccccagcctccccgggtggaaggttgagtgcgtcggggatgacattgcctggatgaagtttgacgcacaaggtcatttaagggccatcaacccagaaaatggctttttcggtgtcgctcctgggacttcagtgaagaccaaccccaatgccatcaagaccatccagaagaacacaatctttaccaatgtggccgagaccagcgacgggggcgtttactgggaaggcattgatgagccgctagcttcaggcgtcaccatcacgtcctggaagaataaggagtggagctcagaggatggggaaccttgtgcccaccccaactcgaggttctgcacccctgccagccagtgccccatcattgatgctgcctgggagtctccggaaggtgttcccattgaaggcattatctttggaggccgtagacctgctggtgtccctctagtctatgaagctctcagctggcaacatggagtctttgtgggggcggccatgagatcagaggccacagcggctgcagaacataaaggcaaaatcatcatgcatgacccctttgccatgcggcccttctttggctacaacttcggcaaatacctggcccactggcttagcatggcccagcacccagcagccaaactgcccaagatcttccatgtcaactggttccggaaggacaaggaaggcaaattcctctggccaggctttggagagaactccagggtgctggagtggatgttcaaccggatcgatggaaaagccagcaccaagctcacgcccataggctacatccccaaggaggatgccctgaacctgaaaggcctggggcacatcaacatgatggagcttttcagcatctccaaggaattctgggagaaggaggtggaagacatcgagaagtatctggaggatcaagtcaatgccgacctcccctgtgaaatcgagagagagatccttgccttgaagcaaagaataagccagatgtaatcagggcctgagtgctttacctttaaaatcattccctttcccatccataaggtgcagtaggagcaagagagggcaagtgttcccaaattgacgccaccataataatcatcaccacaccgtgagcagatctgaaaggcacactttgatttttttaaggataagaaccacagaacactgggtagtagctaatgaaattgagaagggaaatcttagcatgcctccaaaaattcacatccaatgcatagtttgttcaaatttaaggttactcaggcattgatcttttcagtgttttttcactttagctatgtggattagctagaatgcacaccaaaaaaatacttgagctgtatatatatatatgtgtgtgtgtgtgtgtgtgtgtgtgtgtgtgcatgtatgtgcacatgtgtctgtgtggtatatttgtgtatgtgtatttgtatgtactgttattgaaaatatatttaatacctttggaaaaatcttgggcaagatgacctactagttttccttgaaaaaaagttgctttgttattaatattgtgcttaaattatttttatacaccattgttccttacctttacataattgcaatatttcccccttactacttcttggaaaaaaattacaaaatgaagttttatagaaaagaaaaaaaag

SEQ ID NO: 295326 - DNA, 2797 bp, Homo sapiens
ggttcgctgcccgtggtgcttggctgaaaggaagcctgtgatttttgcagctggttggctctcactgaccccagggatgtggccaggatcgaaagcaagacggttatcgtcacccaagagcaaagagacacagtgcccatccccaaaacaggcctcagccagctcggtcgctggatgtcagaggaggattttgagaaagcgttcaatgccaggttcccagggtgcatgaaaggtgagcggaacattgatttgattgggtaaaacagcagagagccttttcttatttacatctatcctaatggtaattcaaacaataatggaagctcccaccacctcagatgtctttcagttccatacatgaagttggcaatgtattgaaaatgcacatccctcttctgcttttacagactgtcttatacaaacgtgaaaactagttccatgcatatgggttttaaatagcttggtgggacccaattgcacatttatgaaaactctttaatttcagcaggctgttcactttccagtggcctcttctaacccagggggctggtgaccagcagggtgtggtggtgttagtggaacaccgtgaaaatgggtctacctgggaaaaaaatgctggtcgtgttcgaagtccaaggtcatttctcaccagtgcccacccatcgcaccctgtaggtcgcaccatgtacgtcatcccattcagcatggggccgctgggctcacctctgtcgaagatcggcatcgagctgacggattcgccctacgtggtggccagcatgcggatcatgacgcggatgggcacgcccgtcctggaagcactgggcgatggggagtttgtcaaatgcctccattctgtggggtgccctctgcctttacaaaagcctttggtcaacaactggccctgcaacccggagctgacgctcatcgcccacctgcctgaccgcagagagatcatctcctttggcagtgggtacggcgggaactcgctgctcgggaagaagtgctttgctctcaggatggccagccggctggccaaggaggaagggtggctggcagagcacatgctgattctgggtataaccaaccctgagggtgagaagaagtacctggcggccgcatttcccagcgcctgcgggaagaccaacctggccatgatgaaccccagcctccccgggtggaaggttgagtgcgtcggggatgacattgcctggatgaagtttgacgcacaaggtcatttaagggccatcaacccagaaaatggctttttcggtgtcgctcctgggacttcagtgaagaccaaccccaatgccatcaagaccatccagaagaacacaatctttaccaatgtggccgagaccagcgacgggggcgtttactgggaaggcattgatgagccgctagcttcaggcgtcaccatcacgtcctggaagaataaggagtggagctcagaggatggggaaccttgtgcccaccccaactcgaggttctgcacccctgccagccagtgccccatcattgatgctgcctgggagtctccggaaggtgttcccattgaaggcattatctttggaggccgtagacctgctggtgtccctctagtctatgaagctctcagctggcaacatggagtctttgtgggggcggccatgagatcagaggccacagcggctgcagaacataaaggcaaaatcatcatgcatgacccctttgccatgcggcccttctttggctacaacttcggcaaatacctggcccactggcttagcatggcccagcacccagcagccaaactgcccaagatcttccatgtcaactggttccggaaggacaaggaaggcaaattcctctggccaggctttggagagaactccagggtgctggagtggatgttcaaccggatcgatggaaaagccagcaccaagctcacgcccataggctacatccccaaggaggatgccctgaacctgaaaggcctggggcacatcaacatgatggagcttttcagcatctccaaggaattctgggagaaggaggtggaagacatcgagaagtatctggaggatcaagtcaatgccgacctcccctgtgaaatcgagagagagatccttgccttgaagcaaagaataagccagatgtaatcagggcctgagtgctttacctttaaaatcattccctttcccatccataaggtgcagtaggagcaagagagggcaagtgttcccaaattgacgccaccataataatcatcaccacaccgtgagcagatctgaaaggcacactttgatttttttaaggataagaaccacagaacactgggtagtagctaatgaaattgagaagggaaatcttagcatgcctccaaaaattcacatccaatgcatagtttgttcaaatttaaggttactcaggcattgatcttttcagtgttttttcactttagctatgtggattagctagaatgcacaccaaaaaaatacttgagctgtatatatatatatgtgtgtgtgtgtgtgtgtgtgtgtgtgtgtgcatgtatgtgcacatgtgtctgtgtggtatatttgtgtatgtgtatttgtatgtactgttattgaaaatatatttaatacctttggaaaaatcttgggcaagatgacctactagttttccttgaaaaaaagttgctttgttattaatattgtgcttaaattatttttatacaccattgttccttacctttacataattgcaatatttcccccttactacttcttggaaaaaaattacaaaatgaagttttatagaaaagaaaaaaaag

SEQ ID NO: 295327 - DNA, 2777 bp, Homo sapiens
tgggaacacaaacttgctggcgggaagagcccggaaagaaacctgtggatctcccttcgagatcatccaaagagaagaaaggtgacctcacattcgtgccccttagcagcactctgcagaaatgcctcctcagctgcaaaacggcctgaacctctcggccaaagttgtccagggaagcctggacagcctgccccaggcagtgagggagtttctcgagaataacgctgagctgtgtcagcctgatcacatccacatctgtgacggctctgaggaggagaatgggcggcttctgggccagatggaggaagagggcatcctcaggcggctgaagaagtatgacaactgctggttggctctcactgaccccagggatgtggccaggatcgaaagcaagacggttatcgtcacccaagagcaaagagacacagtgcccatccccaaaacaggcctcagccagctcggtcgctggatgtcagaggaggattttgagaaagcgttcaatgccaggttcccagggtgcatgaaaggtcgcaccatgtacgtcatcccattcagcatggggccgctgggctcacctctgtcgaagatcggcatcgagctgacggattcgccctacgtggtggccagcatgcggatcatgacgcggatgggcacgcccgtcctggaagcactgggcgatggggagtttgtcaaatgcctccattctgtggggtgccctctgcctttacaaagtaagtgtattatttcagaatcaaaagtcaaaataaaaaagaaagctgaacgcaaaccccagtgagtgcctcggggacccccaagcagggccctggcgcactgacttgggagaggtccttgttcacagagcctttggtcaacaactggccctgcaacccggagctgacgctcatcgcccacctgcctgaccgcagagagatcatctcctttggcagtgggtacggcgggaactcgctgctcgggaagaagtgctttgctctcaggatggccagccggctggccaaggaggaagggtggctggcagagcacatgctgattctgggtataaccaaccctgagggtgagaagaagtacctggcggccgcatttcccagcgcctgcgggaagaccaacctggccatgatgaaccccagcctccccgggtggaaggttgagtgcgtcggggatgacattgcctggatgaagtttgacgcacaaggtcatttaagggccatcaacccagaaaatggctttttcggtgtcgctcctgggacttcagtgaagaccaaccccaatgccatcaagaccatccagaagaacacaatctttaccaatgtggccgagaccagcgacgggggcgtttactgggaaggcattgatgagccgctagcttcaggcgtcaccatcacgtcctggaagaataaggagtggagctcagaggatggggaaccttgtgcccaccccaactcgaggttctgcacccctgccagccagtgccccatcattgatgctgcctgggagtctccggaaggtgttcccattgaaggcattatctttggaggccgtagacctgctggtgtccctctagtctatgaagctctcagctggcaacatggagtctttgtgggggcggccatgagatcagaggccacagcggctgcagaacataaaggcaaaatcatcatgcatgacccctttgccatgcggcccttctttggctacaacttcggcaaatacctggcccactggcttagcatggcccagcacccagcagccaaactgcccaagatcttccatgtcaactggttccggaaggacaaggaaggcaaattcctctggccaggctttggagagaactccagggtgctggagtggatgttcaaccggatcgatggaaaagccagcaccaagctcacgcccataggctacatccccaaggaggatgccctgaacctgaaaggcctggggcacatcaacatgatggagcttttcagcatctccaaggaattctgggagaaggaggtggaagacatcgagaagtatctggaggatcaagtcaatgccgacctcccctgtgaaatcgagagagagatccttgccttgaagcaaagaataagccagatgtaatcagggcctgagtgctttacctttaaaatcattccctttcccatccataaggtgcagtaggagcaagagagggcaagtgttcccaaattgacgccaccataataatcatcaccacaccgtgagcagatctgaaaggcacactttgatttttttaaggataagaaccacagaacactgggtagtagctaatgaaattgagaagggaaatcttagcatgcctccaaaaattcacatccaatgcatagtttgttcaaatttaaggttactcaggcattgatcttttcagtgttttttcactttagctatgtggattagctagaatgcacaccaaaaaaatacttgagctgtatatatatatatgtgtgtgtgtgtgtgtgtgtgtgtgtgtgtgcatgtatgtgcacatgtgtctgtgtggtatatttgtgtatgtgtatttgtatgtactgttattgaaaatatatttaatacctttggaaaaatcttgggcaagatgacctactagttttccttgaaaaaaagttgctttgttattaatattgtgcttaaattatttttatacaccattgttccttacctttacataattgcaatatttcccccttactacttcttggaaaaaaattacaaaatgaagttttatagaaaagaaaaaaaag

SEQ ID NO: 295328 - DNA, 2947 bp, Homo sapiens
tgggaacacaaacttgctggcgggaagagcccggaaagaaacctgtggatctcccttcgagatcatccaaagagaagaaaggtgacctcacattcgtgccccttagcagcactctgcagaaatgcctcctcagctgcaaaacggcctgaacctctcggccaaagttgtccagggaagcctggacagcctgccccaggcagtgagggagtttctcgagaataacgctgagctgtgtcagcctgatcacatccacatctgtgacggctctgaggaggagaatgggcggcttctgggccagatggaggaagagggcatcctcaggcggctgaagaagtatgacaactgctggttggctctcactgaccccagggatgtggccaggatcgaaagcaagacggttatcgtcacccaagagcaaagagacacagtgcccatccccaaaacaggcctcagccagctcggtcgctggatgtcagaggaggattttgagaaagcgttcaatgccaggttcccagggtgcatgaaaggtcgcaccatgtacgtcatcccattcagcatggggccgctgggctcacctctgtcgaagatcggcatcgagctgacggattcgccctacgtggtggccagcatgcggatcatgacgcggatgggcacgcccgtcctggaagcactgggcgatggggagtttgtcaaatgcctccattctgtggggtgccctctgcctttacaaaagcctttggtcaacaactggccctgcaacccggagctgacgctcatcgcccacctgcctgaccgcagagagatcatctcctttggcagtgggtacggcgggaactcgctgctcgggaagaagtgctttgctctcaggatggccagccggctggccaaggaggaagggtggctggcagagcacatgctggtgagcctgcaggaagccctgatgtgcagatgagaggcctggggggtggcagaaacaaacagcattacagttcccacccgtcagcacacctctctgagcgtgcaggttcccggacagatcgggaaaccccaccagtaatgattagtttacacatatacatcgcttttgaaggcccccaaacaccaggggaccatagagatcctttggacttcatgattctgggagtgtttgtttgcactgatacctgaagaaatagatcttgagggcctacattccaacctctgggctgaagtaccaacctcggggagaaggaaacaaagatcacaataaagaatcttgtccccaacagattctgggtataaccaaccctgagggtgagaagaagtacctggcggccgcatttcccagcgcctgcgggaagaccaacctggccatgatgaaccccagcctccccgggtggaaggttgagtgcgtcggggatgacattgcctggatgaagtttgacgcacaaggtcatttaagggccatcaacccagaaaatggctttttcggtgtcgctcctgggacttcagtgaagaccaaccccaatgccatcaagaccatccagaagaacacaatctttaccaatgtggccgagaccagcgacgggggcgtttactgggaaggcattgatgagccgctagcttcaggcgtcaccatcacgtcctggaagaataaggagtggagctcagaggatggggaaccttgtgcccaccccaactcgaggttctgcacccctgccagccagtgccccatcattgatgctgcctgggagtctccggaaggtgttcccattgaaggcattatctttggaggccgtagacctgctggtgtccctctagtctatgaagctctcagctggcaacatggagtctttgtgggggcggccatgagatcagaggccacagcggctgcagaacataaaggcaaaatcatcatgcatgacccctttgccatgcggcccttctttggctacaacttcggcaaatacctggcccactggcttagcatggcccagcacccagcagccaaactgcccaagatcttccatgtcaactggttccggaaggacaaggaaggcaaattcctctggccaggctttggagagaactccagggtgctggagtggatgttcaaccggatcgatggaaaagccagcaccaagctcacgcccataggctacatccccaaggaggatgccctgaacctgaaaggcctggggcacatcaacatgatggagcttttcagcatctccaaggaattctgggagaaggaggtggaagacatcgagaagtatctggaggatcaagtcaatgccgacctcccctgtgaaatcgagagagagatccttgccttgaagcaaagaataagccagatgtaatcagggcctgagtgctttacctttaaaatcattccctttcccatccataaggtgcagtaggagcaagagagggcaagtgttcccaaattgacgccaccataataatcatcaccacaccgtgagcagatctgaaaggcacactttgatttttttaaggataagaaccacagaacactgggtagtagctaatgaaattgagaagggaaatcttagcatgcctccaaaaattcacatccaatgcatagtttgttcaaatttaaggttactcaggcattgatcttttcagtgttttttcactttagctatgtggattagctagaatgcacaccaaaaaaatacttgagctgtatatatatatatgtgtgtgtgtgtgtgtgtgtgtgtgtgtgtgcatgtatgtgcacatgtgtctgtgtggtatatttgtgtatgtgtatttgtatgtactgttattgaaaatatatttaatacctttggaaaaatcttgggcaagatgacctactagttttccttgaaaaaaagttgcaattatgtaaaggtaaggaacaatggtgtataaaaataatttaagcacaatattaataacaaagcaacttttttgtcgacgc

SEQ ID NO: 295329 - DNA, 634 bp, Homo sapiens
tgggaacacaaacttgctggcgggaagagcccggaaagaaacctgtggatctcccttcgagatcatccaaagagaagaaaggtgacctcacattcgtgccccttagcagcactctgcagaaatgcctcctcagctgcaaaacggcctgaacctctcggccaaagttgtccagggaagcctggacagcctgccccaggcagtgagggagtttctcgagaataacgctgagctgtgtcagcctgatcacatccacatctgtgacggctctgaggaggagaatgggcggcttctgggccagatggaggaagagggcatcctcaggcggctgaagaagtatgacaactggtaagctcggcccccgctgcctgtcccagcaccctgcaggcagggctcccctgcgtctcctgggagttggtggagaaaggtgaatgaaggccttcgggtagtttcagactcttgagaagatgaatgcaatggtcagaaccatacagacttgaattttgtgacattagtgggccagcccaagctttaaatgaggtgtgtgcacaaaagctctgccaactagattcctgattaaaaaaaaggcagcccctctcctacagaccaggtcctagtggagtaaatgtccacctgg

SEQ ID NO: 295330 - DNA, 2649 bp, Homo sapiens
tgggaacacaaacttgctggcgggaagagcccggaaagaaacctgtggatctcccttcgagatcatccaaagagaagaaaggtgacctcacattcgtgccccttagcagcactctgcagaaatgcctcctcagctgcaaaacggcctgaacctctcggccaaagttgtccagggaagcctggacagcctgccccaggcagtgagggagtttctcgagaataacgctgagctgtgtcagcctgatcacatccacatctgtgacggctctgaggaggagaatgggcggcttctgggccagatggaggaagagggcatcctcaggcggctgaagaagtatgacaactgctggttggctctcactgaccccagggatgtggccaggatcgaaagcaagacggttatcgtcacccaagagcaaagagacacagtgcccatccccaaaacaggcctcagccagctcggtcgctggatgtcagaggaggattttgagaaagcgttcaatgccaggttcccagggtgcatgaaaggtcgcaccatgtacgtcatcccattcagcatggggccgctgggctcacctctgtcgaagatcggcatcgagctgacggattcgccctacgtggtggccagcatgcggatcatgacgcggatgggcacgcccgtcctggaagcactgggcgatggggagtttgtcaaatgcctccattctgtggggtgccctctgcctttacaaaagcctttggtcaacaactggccctgcaacccggagctgacgctcatcgcccacctgcctgaccgcagagagatcatctcctttggcagtgggtacggcgggaactcgctgctcgggaagaagtgctttgctctcaggatggccagccggctggccaaggaggaagggtggctggcagagcacatgctgattctgggtataaccaaccctgagggtgagaagaagtacctggcggccgcatttcccagcgcctgcgggaagaccaacctggccatgatgaaccccagcctccccgggtggaaggttgagtgcgtcggggatgacattgcctggatgaagtttgacgcacaaggtcatttaagggccatcaacccagaaaatggctttttcggtgtcgctcctgggacttcagtgaagaccaaccccaatgccatcaagaccatccagaagaacacaatctttaccaatgtggccgagaccagcgacgggggcgtttactgggaaggcattgatgagccgctagcttcaggcgtcaccatcacgtcctggaagaataaggagtggagctcagaggatggggaaccttgtgcccaccccaactcgaggttctgcacccctgccagccagtgccccatcattgatgctgcctgggagtctccggaaggtgttcccattgaaggcattatctttggaggccgtagacctgctggtgtccctctagtctatgaagctctcagctggcaacatggagtctttgtgggggcggccatgagatcagaggccacagcggctgcagaacataaaggcaaaatcatcatgcatgacccctttgccatgcggcccttctttggctacaacttcggcaaatacctggcccactggcttagcatggcccagcacccagcagccaaactgcccaagatcttccatgtcaactggttccggaaggacaaggaaggcaaattcctctggccaggctttggagagaactccagggtgctggagtggatgttcaaccggatcgatggaaaagccagcaccaagctcacgcccataggctacatccccaaggaggatgccctgaacctgaaaggcctggggcacatcaacatgatggagcttttcagcatctccaaggaattctgggagaaggaggtggaagacatcgagaagtatctggaggatcaagtcaatgccgacctcccctgtgaaatcgagagagagatccttgccttgaagcaaagaataagccagatgtaatcagggcctgagtgctttacctttaaaatcattccctttcccatccataaggtgcagtaggagcaagagagggcaagtgttcccaaattgacgccaccataataatcatcaccacaccgtgagcagatctgaaaggcacactttgatttttttaaggataagaaccacagaacactgggtagtagctaatgaaattgagaagggaaatcttagcatgcctccaaaaattcacatccaatgcatagtttgttcaaatttaaggttactcaggcattgatcttttcagtgttttttcactttagctatgtggattagctagaatgcacaccaaaaaaatacttgagctgtatatatatatatgtgtgtgtgtgtgtgtgtgtgtgtgtgtgtgcatgtatgtgcacatgtgtctgtgtggtatatttgtgtatgtgtatttgtatgtactgttattgaaaatatatttaatacctttggaaaaatcttgggcaagatgacctactagttttccttgaaaaaaagttgctttgttattaatattgtgcttaaattatttttatacaccattgttccttacctttacataattgcaatatttcccccttactacttcttggaaaaaaattacaaaatgaagttttatagaaaagaaaaaaaag

SEQ ID NO: 295331 - DNA, 3212 bp, Homo sapiens
tgggaacacaaacttgctggcgggaagagcccggaaagaaacctgtggatctcccttcgagatcatccaaagagaagaaaggtgacctcacattcgtgccccttagcagcactctgcagaaatgcctcctcagctgcaaaacggcctgaacctctcggccaaagttgtccagggaagcctggacagcctgccccaggcagtgagggagtttctcgagaataacgctgagctgtgtcagcctgatcacatccacatctgtgacggctctgaggaggagaatgggcggcttctgggccagatggaggaagagggcatcctcaggcggctgaagaagtatgacaactgctggttggctctcactgaccccagggatgtggccaggatcgaaagcaagacggttatcgtcacccaagagcaaagagacacagtgcccatccccaaaacaggcctcagccagctcggtcgctggatgtcagaggaggattttgagaaagcgttcaatgccaggttcccagggtgcatgaaaggtcgcaccatgtacgtcatcccattcagcatggggccgctgggctcacctctgtcgaagatcggcatcgagctgacggattcgccctacgtggtggccagcatgcggatcatgacgcggatgggcacgcccgtcctggaagcactgggcgatggggagtttgtcaaatgcctccattctgtggggtgccctctgcctttacaaaagcctttggtcaacaactggccctgcaacccggagctgacgctcatcgcccacctgcctgaccgcagagagatcatctcctttggcagtgggtacggcgggaactcgctgctcgggaagaagtgctttgctctcaggatggccagccggctggccaaggaggaagggtggctggcagagcacatgctggtgagcctgcaggaagccctgatgtgcagatgagaggcctggggggtggcagaaacaaacagcattacagttcccacccgtcagcacacctctctgagcgtgcaggttcccggacagatcgggaaaccccaccagtaatgattagtttacacatatacatcgcttttgaaggcccccaaacaccaggggaccatagagatcctttggacttcatgattctgggagtgtttgtttgcactgatacctgaagaaatagatcttgagggcctacattccaacctctgggctgaagtaccaacctcggggagaaggaaacaaagatcacaataaagaatcttgtccccaacagattctgggtataaccaaccctgagggtgagaagaagtacctggcggccgcatttcccagcgcctgcgggaagaccaacctggccatgatgaaccccagcctccccgggtggaaggttgagtgcgtcggggatgacattgcctggatgaagtttgacgcacaaggtcatttaagggccatcaacccagaaaatggctttttcggtgtcgctcctgggacttcagtgaagaccaaccccaatgccatcaagaccatccagaagaacacaatctttaccaatgtggccgagaccagcgacgggggcgtttactgggaaggcattgatgagccgctagcttcaggcgtcaccatcacgtcctggaagaataaggagtggagctcagaggatggggaaccttgtgcccaccccaactcgaggttctgcacccctgccagccagtgccccatcattgatgctgcctgggagtctccggaaggtgttcccattgaaggcattatctttggaggccgtagacctgctggtgtccctctagtctatgaagctctcagctggcaacatggagtctttgtgggggcggccatgagatcagaggccacagcggctgcagaacataaaggtaaatcaaagtcctgatctgaaaccacagagaagtgggattagagcactcttcgtcactcttatgtctctctccttttctgtgtctgtgtgtggggagagagagagagagaaagagagagaggagaacaaagcatgctaatgtcaacaatcaatggcgtcagtcttgcctaggagagcctcatttactaatgaactccctctctgtttaacaggcaaaatcatcatgcatgacccctttgccatgcggcccttctttggctacaacttcggcaaatacctggcccactggcttagcatggcccagcacccagcagccaaactgcccaagatcttccatgtcaactggttccggaaggacaaggaaggcaaattcctctggccaggctttggagagaactccagggtgctggagtggatgttcaaccggatcgatggaaaagccagcaccaagctcacgcccataggctacatccccaaggaggatgccctgaacctgaaaggcctggggcacatcaacatgatggagcttttcagcatctccaaggaattctgggagaaggaggtggaagacatcgagaagtatctggaggatcaagtcaatgccgacctcccctgtgaaatcgagagagagatccttgccttgaagcaaagaataagccagatgtaatcagggcctgagtgctttacctttaaaatcattccctttcccatccataaggtgcagtaggagcaagagagggcaagtgttcccaaattgacgccaccataataatcatcaccacaccgtgagcagatctgaaaggcacactttgatttttttaaggataagaaccacagaacactgggtagtagctaatgaaattgagaagggaaatcttagcatgcctccaaaaattcacatccaatgcatagtttgttcaaatttaaggttactcaggcattgatcttttcagtgttttttcactttagctatgtggattagctagaatgcacaccaaaaaaatacttgagctgtatatatatatatgtgtgtgtgtgtgtgtgtgtgtgtgtgtgtgcatgtatgtgcacatgtgtctgtgtggtatatttgtgtatgtgtatttgtatgtactgttattgaaaatatatttaatacctttggaaaaatcttgggcaagatgacctactagttttccttgaaaaaaagttgctttgttattaatattgtgcttaaattatttttatacaccattgttccttacctttacataattgcaatatttcccccttactacttcttggaaaaaaattacaaaatgaagttttatagaaaagaaaaaaaag

SEQ ID NO: 295332 - DNA, 2092 bp, Homo sapiens
tgggaacacaaacttgctggcgggaagagcccggaaagaaacctgtggatctcccttcgagatcatccaaagagaagaaaggtgacctcacattcgtgccccttagcagcactctgcagaaatgcctcctcagctgcaaaacggcctgaacctctcggccaaagttgtccagggaagcctggacagcctgccccaggcagtgagggagtttctcgagaataacgctgagctgtgtcagcctgatcacatccacatctgtgacggctctgaggaggagaatgggcggcttctgggccagatggaggaagagggcatcctcaggcggctgaagaagtatgacaactgctggttggctctcactgaccccagggatgtggccaggatcgaaagcaagacggttatcgtcacccaagagcaaagagacacagtgcccatccccaaaacaggcctcagccagctcggtcgccgggtggaaggttgagtgcgtcggggatgacattgcctggatgaagtttgacgcacaaggtcatttaagggccatcaacccagaaaatggctttttcggtgtcgctcctgggacttcagtgaagaccaaccccaatgccatcaagaccatccagaagaacacaatctttaccaatgtggccgagaccagcgacgggggcgtttactgggaaggcattgatgagccgctagcttcaggcgtcaccatcacgtcctggaagaataaggagtggagctcagaggatggggaaccttgtgcccaccccaactcgaggttctgcacccctgccagccagtgccccatcattgatgctgcctgggagtctccggaaggtgttcccattgaaggcattatctttggaggccgtagacctgctggtgtccctctagtctatgaagctctcagctggcaacatggagtctttgtgggggcggccatgagatcagaggccacagcggctgcagaacataaaggcaaaatcatcatgcatgacccctttgccatgcggcccttctttggctacaacttcggcaaatacctggcccactggcttagcatggcccagcacccagcagccaaactgcccaagatcttccatgtcaactggttccggaaggacaaggaaggcaaattcctctggccaggctttggagagaactccagggtgctggagtggatgttcaaccggatcgatggaaaagccagcaccaagctcacgcccataggctacatccccaaggaggatgccctgaacctgaaaggcctggggcacatcaacatgatggagcttttcagcatctccaaggaattctgggagaaggaggtggaagacatcgagaagtatctggaggatcaagtcaatgccgacctcccctgtgaaatcgagagagagatccttgccttgaagcaaagaataagccagatgtaatcagggcctgagtgctttacctttaaaatcattccctttcccatccataaggtgcagtaggagcaagagagggcaagtgttcccaaattgacgccaccataataatcatcaccacaccgtgagcagatctgaaaggcacactttgatttttttaaggataagaaccacagaacactgggtagtagctaatgaaattgagaagggaaatcttagcatgcctccaaaaattcacatccaatgcatagtttgttcaaatttaaggttactcaggcattgatcttttcagtgttttttcactttagctatgtggattagctagaatgcacaccaaaaaaatacttgagctgtatatatatatatgtgtgtgtgtgtgtgtgtgtgtgtgtgtgtgcatgtatgtgcacatgtgtctgtgtggtatatttgtgtatgtgtatttgtatgtactgttattgaaaatatatttaatacctttggaaaaatcttgggcaagatgacctactagttttccttgaaaaaaagttgctttgttattaatattgtgcttaaattatttttatacaccattgttccttacctttacataattgcaatatttcccccttactacttcttggaaaaaaattacaaaatgaagttttatagaaaagaaaaaaaag

SEQ ID NO: 295333 - DNA, 2120 bp, Homo sapiens
tgggaacacaaacttgctggcgggaagagcccggaaagaaacctgtggatctcccttcgagatcatccaaagagaagaaaggtgacctcacattcgtgccccttagcagcactctgcagaaatgcctcctcagctgcaaaacggcctgaacctctcggccaaagttgtccagggaagcctggacagcctgccccaggcagtgagggagtttctcgagaataacgctgagctgtgtcagcctgatcacatccacatctgtgacggctctgaggaggagaatgggcggcttctgggccagatggaggaagagggcatcctcaggcggctgaagaagtatgacaactgctggttggctctcactgaccccagggatgtggccaggatcgaaagcaagacggttatcgtcacccaagagcaaagagacacagtgcccatccccaaaacaggcctcagccagctcggtcgctggatgtcagaggaggattttgagaaagcgttcaatgccaggttcccagggtgcatgaaaggtcgcaccatgtacgtcatcccattcagcatggggccgctgggctcacctctgtcgaagatcggcatcgagctgacggattcgccctacgtggtggccagcatgcggatcatgacgcggatgggcacgcccgtcctggaagcactgggcgatggggagtttgtcaaatgcctccattctgtggggtgccctctgcctttacaaaagcctttggtcaacaactggccctgcaacccggagctgacgctcatcgcccacctgcctgaccgcagagagatcatctcctttggcagtgggtacggcgggaactcgctgctcgggaagaagtgctttgctctcaggatggccagccggctggccaaggaggaagggtggctggcagagcacatgctggtgagcctgcaggaagccctgatgtgcagatgagaggcctggggggtggcagaaacaaacagcattacagttcccacccgtcagcacacctctctgagcgtgcaggttcccggacagatcgggaaaccccaccagtaatgattagtttacacatatacatcgcttttgaaggcccccaaacaccaggggaccatagagatcctttggacttcatgattctgggagtgtttgtttgcactgatacctgaagaaatagatcttgagggcctacattccaacctctgggctgaagtaccaacctcggggagaaggaaacaaagatcacaataaagaatcttgtccccaacagattctgggtataaccaaccctgagggtgagaagaagtacctggcggccgcatttcccagcgcctgcgggaagaccaacctggccatgatgaaccccagcctccccgggtggaaggttgagtgcgtcggggatgacattgcctggatgaagtttgacgcacaaggtcatttaagggccatcaacccagaaaatggctttttcggtgtcgctcctgggacttcagtgaagaccaaccccaatgccatcaagaccatccagaagaacacaatctttaccaatgtggccgagaccataataatcatcaccacaccgtgagcagatctgaaaggcacactttgatttttttaaggataagaaccacagaacactgggtagtagctaatgaaattgagaagggaaatcttagcatgcctccaaaaattcacatccaatgcatagtttgttcaaatttaaggttactcaggcattgatcttttcagtgttttttcactttagctatgtggattagctagaatgcacaccaaaaaaatacttgagctgtatatatatatatgtgtgtgtgtgtgtgtgtgtgtgtgtgtgtgcatgtatgtgcacatgtgtctgtgtggtatatttgtgtatgtgtatttgtatgtactgttattgaaaatatatttaatacctttggaaaaatcttgggcaagatgacctactagttttccttgaaaaaaagttgctttgttattaatattgtgcttaaattatttttatacaccattgttccttacctttacataattgcaatatttcccccttactacttcttggaaaaaaattacaaaatgaagttttatagaaaagaaaaaaaag

SEQ ID NO: 295334 - DNA, 2368 bp, Homo sapiens
cctcgctggctagtaggagagactggtgcttgccccgcccggtggactaactcgcttaattttaaataaaaagtcgaggacacggcggtcgttttcccgaagacatgggccctcccatgggccatttgctccctggaggccctcgcgtcttgctgagcccggggagttaggatgacgcgagcggtgagggagcccggaacgattccttcgcggaacaattgaggcgaggcctttgggagtactttgtgggacggaccctggcgggccctgccagacgcacagggatggcggcggaggcggccgatttggggctgggggccgccgtccccgtggagctgaggcgggagcgacgcatggtgtgcgtggagtacccgggagtggtgcgtgatgtggctaagatgctgccgactctgggcggcgaggaaggcgtctcccggatctacgcagaccccaccaagaggctggagctgtacttccggcccaaggacccatactgccacccagtgtgcgccaaccgcttcagtaccagcagcctgctgctccgcatcaggaagagaacgaggcggcagaaaggggtgctgggcactgaggcccactccgaggtcacatttgacatggagatccttggcatcatctccaccatttacaaatttcaggggatgtctgacttccagtacttggctgtgcatacggaagcaggcggcaagcatacgtcaatgtatgacaaggtgctcatgctccggcccgagaaggaggcctttttccaccaggagctgccgctctacatccccccacccatcttctcccggctggacgccccggtggactacttctaccgaccagagacccagcaccgggaaggctacaacaatccccccatctcaggtgagaatctgattggcctgagcagagcccggcgcccccacaatgccatctttgtcaactttgaggatgaggaggtgcccaagcagccactggaggctgcagcccagacgtggaggagagtctgcactaaccccgtggaccggaaggtggaggaggagctgaggaagctgtttgacatccgtcccatctggtcccgaaatgctgtcaaggccaacatcagcgtccacccagacaagctcaaggtcttgcttcccttcatagcctattacatgataacaggcccctggcgcagcctatgggattcgatttgggtatgacccccgaaaaaacccagatgccaagatttatcaagtcctcgatttccgaatccgttgtggaatgaaacacggttacgcccccagtgacttgccggtcaaagcaaagcgcagcacctacaactacagcctccccatcaccgtcaagaagacatccagccagcttgtcaccatgcatgacctgaagcagggcctgggcccgtcggggacgagtggtgctcggaaaccagcttccagcaagtacaagctcaaggactctgtctacatcttccgggaaggggccttgccaccctatcggcagatgttctaccagttatgcgacttgaatgtggaagagttgcagaagatcattcaccgcaatgacggggcagagaattcctgcacagaacgggatgggtggtgcctccccaagaccagcgacgagctcagggacaccatgtccctcatgatccggcagaccatccgctccaagaggcctgctctcttttccagctcagccaaggctgatggcggaaaagagcagctgacgtacgagtctggggaagacgaggaggatgaggaggaggaggaagaggaggaggaggacttcaagccatccgacggcagtgaaaacgaaatggagacagagattctggactacgtgtgacagggcccaaggctgggcctccctgacccggccagactggtgtctggcctaatgagggagccggggctccccattgccacccacagtgcccggaatggccctaggaggccctctgaggagagctagagtcccagcaaagggtgcagctgaccctagcactggctgtgacatgctgcttggtgctgcctctggtcctgaggggttagggacatccccaaagggtataccctggctctgccacccatgaaccagcccagcatccagccagtgagtgggcacccaatgcctctcaggatgagaccagtaaatgccggaggtggagctgggcagctgtggagccccaggccacaggccagtctcgcttggctctcatgactgtggtggtggagatagtgtggggagcctcgcccatggtctcacgtggcaagaagtgcctttagctctggatcccaaccgtttggcacagctttggccacagccaggcccctctggaattgtccttattaaaccagtttcccgagaa

SEQ ID NO: 295335 - DNA, 2025 bp, Homo sapiens
cctcgctggctagtaggagagactggtgcttgccccgcccggtggactaactcgcttaattttaaataaaaagtcgaggacacggcggtcgttttcccgaagacatgggccctcccatgggccatttgctccctggaggccctcgcgtcttgctgagcccggggagttaggatgacgcgagcggtgagggagcccggaacgattccttcgcggaacaattgaggcgaggcctttgggagtactttgtgggacggaccctggcgggccctgccagacgcacagggatggcggcggaggcggccgatttggggctgggggccgccgtccccgtggagctgaggcgggagcgacgcatggtgtgcgtggagtacccgggagtggtgcgtgatgtggctaagatgctgccgactctgggcggcgaggaaggcgtctcccggatctacgcagaccccaccaagaggctggagctgtacttccggcccaaggacccatactgccacccagtgtgcgccaaccgcttcagtaccagcagcctgctgctccgcatcaggaagagaacgaggcggcagaaaggggtgctgggcactgaggcccactccgaggtcacatttgacatggagatccttggcatcatctccaccatttacaaatttcaggggatgtctgacttccagtacttggctgtgcatacggaagcaggcggcaagcatacgtcaatgtatgacaaggtgctcatgctccggcccgagaaggaggcctttttccaccaggagctgccgctctacatccccccacccatcttctcccggctggacgccccggtggactacttctaccgaccagagacccagcaccgggaaggctacaacaatccccccatctcaggtgagaatctgattggcctgagcagagcccggcgcccccacaatgccatctttgtcaactttgaggatgaggaggtgcccaagcagccactggaggctgcagcccagacgtggaggagagtctgcactaaccccgtggaccggaaggtggaggaggagctgaggaagctgtttgacatccgtcccatctggtcccgaaatgctgtcaaggccaacatcagcgtccacccagacaagctcaaggtcttgcttcccttcatagcctattacatgataacaggcccctggcgcagcctatgggattcgatttgggtatgacccccgaaaaaacccagatgccaagatttatcaagtcctcgatttccgaatccgttgtggaatgaaacacggttacgcccccagtgacttgccggtcaaagcaaagcgcagcacctacaactacagcctccccatcaccgtcaagaagacatccagccagcttgtcaccatgcatgacctgaagcagggcctgggcccgtcggggacgagtggtgctcggaaaccagcttccagcaagtacaagctcaaggactctgtctacatcttccgggaaggggccttgccaccctatcggcagatgttctaccagttatgcgacttgaatgtggaagagttgcagaagatcattcaccgcaatgacggggcagagaattcctgcacagaacgggatgggtggtgcctccccaagaccagcgacgagctcagggacaccatgtccctcatgatccggcagaccatccgctccaagaggcctgctctcttttccagctcagccaaggctgatggcggaaaagagcagctgacgtacgagtctggggaagacgaggaggatgaggaggaggaggaagaggaggaggaggacttcaagccatccgacggcagtgaaaacgaaatggagacagagattctggactacgtgtgacagggcccaaggctgggcctccctgacccggccagactggtgtctggcctaatgagggacctcgcccatggtctcacgtggcaagaagtgcctttagctctggatcccaaccgtttggcacagctttggccacagccaggcccctctggaattgtccttattaaaccagtttcccgagaa

SEQ ID NO: 295336 - DNA, 2010 bp, Homo sapiens
cctcgctggctagtaggagagactggtgcttgccccgcccggtggactaactcgcttaattttaaataaaaagtcgaggacacggcggtcgttttcccgaagacatgggccctcccatgggccatttgctccctggaggccctcgcgtcttgctgagcccggggagttaggatgacgcgagcggtgagggagcccggaacgattccttcgcggaacaattgaggcgaggcctttgggagtactttgtgggacggaccctggcgggccctgccagacgcacagggatggcggcggaggcggccgatttggggctgggggccgccgtccccgtggagctgaggcgggagcgacgcatggtgtgcgtggagtacccgggagtggtgcgtgatgtggctaagatgctgccgactctgggcggcgaggaaggcgtctcccggatctacgcagaccccaccaagaggctggagctgtacttccggcccaaggacccatactgccacccagtgtgcgccaaccgcttcagtaccagcagcctgctgctccgcatcaggaagagaacgaggcggcagaaaggggtgctgggcactgaggcccactccgaggtcacatttgacatggagatccttggcatcatctccaccatttacaaatttcaggggatgtctgacttccagtacttggctgtgcatacggaagcaggcggcaagcatacgtcaatgtatgacaaggtgctcatgctccggcccgagaaggaggcctttttccaccaggagctgccgctctacatccccccacccatcttctcccggctggacgccccggtggactacttctaccgaccagagacccagcaccgggaaggctacaacaatccccccatctcaggtgagaatctgattggcctgagcagagcccggcgcccccacaatgccatctttgtcaactttgaggatgaggaggtgcccaagcagccactggaggctgcagcccagacgtggaggagagtctgcactaaccccgtggaccggaaggtggaggaggagctgaggaagctgtttgacatccgtcccatctggtcccgaaatgctgtcaaggccaacatcagcgtccacccagacaagctcaaggtcttgcttcccttcatagcctattacatgataacaggcccctggcgcagcctatgggattcgatttgggtatgacccccgaaaaaacccagatgccaagatttatcaagtcctcgatttccgaatccgttgtggaatgaaacacggttacgcccccagtgacttgccggtcaaagcaaagcgcagcacctacaactacagcctccccatcaccgtcaagaagacatccagccagcttgtcaccatgcatgacctgaagcagggcctgggcccgtcggggacgagtggtgctcggaaaccagcttccagcaagtacaagctcaagggcgcccctggaggccaggaatggaggggaggacttccctcttggggccgggcaccttgtgggtgacacctggggggctgtgattagggcagctctgcccaccggggcctcggcaccttgcttccttttaggtcagccttcagacactgagggtgagaactcgggtgcaaagccccagggctgtgtgtgttggggacatctggcgaagaggtggtgacaagtctcagggaagtctggcaccagcagctgcatgtggttgtccttctcgagccctttgggagcctgggcccccactgagccacgtgaccactccgggaatgatcggaattgggcacacacaggaggacagagccagagcaggccatgtgggctgcagctgtggcaggagcctcactggctcacgtttccgtcagtgcggttgcccagcgggggttggcggtttccagagctgttcccacattcaggctcccgcaagccgctccacagccctgggggaggccgagaagggggcatcccgcacggtggaatcacctgccgagggagtgggtggcagagatg

SEQ ID NO: 295337 - DNA, 1817 bp, Homo sapiens
cctcgctggctagtaggagagactggtgcttgccccgcccggtggactaactcgcttaattttaaataaaaagtcgaggacacggcggtcgttttcccgaagacatgggccctcccatgggccatttgctccctggaggccctcgcgtcttgctgagcccggggagttaggatgacgcgagcggtgagggagcccggaacgattccttcgcggaacaattgaggcgaggcctttgggagtactttgtgggacggaccctggcgggccctgccagacgcacagggatggcggcggaggcggccgatttggggctgggggccgccgtccccgtggagctgaggcgggagcgacgcatggtgtgcgtggagtacccgggagtggtgcgtgatgtggctaagatgctgccgactctgggcggcgaggaaggcgtctcccggatctacgcagaccccaccaagaggctggagctgtacttccggcccaaggacccatactgccacccagtgtgcgccaaccgcttcagtaccagcagcctgctgctccgcatcaggaagagaacgaggcggcagaaaggggtgctgggcactgaggcccactccgaggtcacatttgacatggagatccttggcatcatctccaccatttacaaatttcaggggatgtctgacttccagtacttggctgtgcatacggaagcaggcggcaagcatacgtcaatgtatgacaaggtgctcatgctccggcccgagaaggaggcctttttccaccaggagctgccgctctacatccccccacccatcttctcccggctggacgccccggtggactacttctaccgaccagagacccagcaccgggaaggctacaacaatccccccatctcaggtgagaatctgattggcctgagcagagcccggcgcccccacaatgccatctttgtcaactttgaggatgaggaggtgcccaagcagccactggaggctgcagcccagacgtggaggagagtctgcactaaccccgtggaccggaaggtggaggaggagctgaggaagctgtttgacatccgtcccatctggtcccgaaatgctgtcaaggccaacatcagcgtccacccagacaagctcaaggtcttgcttcccttcatagcctattacatgataacaggcccctggcgcagcctatgggattcgatttgggtatgacccccgaaaaaacccagatgccaagatttatcaagtcctcgatttccgaatccgttgtggaatgaaacacggttacgcccccagtgacttgccggtcaaagcaaagcgcagcacctacaactacagcctccccatcaccgtcaagaagacatccagccagcttgtcaccatgcatgacctgaagcagggcctgggcccgtcggggacgagtggtgctcggaaaccagcttccagcaagtacaagctcaagggacatctggcgaagaggtggtgacaagtctcagggaagtctggcaccagcagctgcatgtggttgtccttctcgagccctttgggagcctgggcccccactgagccacgtgaccactccgggaatgatcggaattgggcacacacaggaggacagagccagagcaggccatgtgggctgcagctgtggcaggagcctcactggctcacgtttccgtcagtgcggttgcccagcgggggttggcggtttccagagctgttcccacattcaggctcccgcaagccgctccacagccctgggggaggccgagaagggggcatcccgcacggtggaatcacctgccgagggagtgggtggcagagatg

SEQ ID NO: 295338 - DNA, 2901 bp, Homo sapiens
cctcgctggctagtaggagagactggtgcttgccccgcccggtggactaactcgcttaattttaaataaaaagtcgaggacacggcggtcgttttcccgaagacatgggccctcccatgggccatttgctccctggaggccctcgcgtcttgctgagcccggggagttaggatgacgcgagcggtgagggagcccggaacgattccttcgcggaacaattgaggcgaggcctttgggagtactttgtgggacggaccctggcgggccctgccagacgcacagggatggcggcggaggcggccgatttggggctgggggccgccgtccccgtggagctgaggcgggagcgacgcatggtgtgcgtggagtacccgggagtggtgcgtgatgtggctaagatgctgccgactctgggcggcgaggaaggcgtctcccggggatgtctgacttccagtacttggctgtgcatacggaagcaggcggcaagcatacgtcaatgtatgacaaggtgctcatgctccggcccgagaaggaggcctttttccaccaggagctgccgctctacatccccccacccatcttctcccggctggacgccccggtggactacttctaccgaccagagacccagcaccgggaaggctacaacaatccccccatctcaggtgagaatctgattggcctgagcagagcccggcgcccccacaatgccatctttgtcaactttgaggatgaggaggtgcccaagcagccactggaggctgcagcccagacgtggaggagagtctgcactaaccccgtggaccggaaggtggaggaggagctgaggaagctgtttgacatccgtcccatctggtcccgaaatgctgtcaaggccaacatcagcgtccacccagacaagctcaaggtcttgcttcccttcatagcctattacatgataacaggcccctggcgcagcctatgggattcgatttgggtatgacccccgaaaaaacccagatgccaagatttatcaagtcctcgatttccgaatccgttgtggaatgaaacacggttacgcccccagtgacttgccggtcaaagcaaagcgcagcacctacaactacagcctccccatcaccgtcaagaagacatccagccagcttgtcaccatgcatgacctgaagcagggcctgggcccgtcggggacgagtggtgctcggaaaccagcttccagcaagtacaagctcaaggactctgtctacatcttccgggaaggggccttgccaccctatcggcagatgttctaccagttatgcgacttgaatgtggaagagttgcagaagatcattcaccgcaatgacggggcagagaattcctgcacagaacgggatgggtggtgcctccccaagaccagcgacgagctcagggacaccatgtccctcatgatccggcagaccatccgctccaagaggcctgctctcttttccagctcagccaaggctgatggcggaaaagagcagctgacgtacgagtctggggaagacgaggaggatgaggaggaggaggaagaggaggaggaggacttcaagccatccgacggcagtgaaaacgaaatggagacagagattctggactacgtgtgacagggcccaaggctgggcctccctgacccggccagactggtgtctggcctaatgagggagccggggctccccattgccacccacagtgcccggaatggccctaggaggccctctgaggagagctagagtcccagcaaagggtgcagctgaccctagcactggctgtgacatgctgcttggtgctgcctctggtcctgaggggttagggacatccccaaagggtataccctggctctgccacccatgaaccagcccagcatccagccagtgagtgggcacccaatgcctctcaggatgagaccagtaaatgccggaggtggagctgggcagctgtggagccccaggccacaggccagtctcgcttggctctcatgactgtggtggtggagatagtgtggggagcctcgcccatggtctcacgtggcaagaagtgcctttagctctggatcccaaccgtttggcacagctttggccacagccaggcccctctggaattgtccttattaaaccagtttcccgagaaaaaaaaaaaaaaaaaaaaaaaaaaaaaaaaaaaaaaaaaaagggggggggggccaaaaaatattctccccgggggggcccaaaatatagggggatacccggagttttgtggcgtcaccaggggggcgccccaatatggggcggcgcgccgatatataaacccacgcgacgcaggggcccgcgaggttaacaaccacggggtggcgacacgacgcggaaacaacgtgcgacacacgacgcgacactttgggcgagatggacggacccaaaacagacgggggggggcgagccaaaaattgtggggggacacaccatcatctccactaaggaaggcaaatattacaagggctcctcacgaggggaacaaatcataaaaacatcttcacgcgggggtgtaaaataggtggggcttgacaacacatggggggaaattctttgggtaggaatgctggaaaaagtagtgggagcacaacagggtagtagatgttgctgaacaaattttttaacagccggggggcagtggccagatataaacagcgggaccgacagatagagaccacacgacgctgacggatcacgcacacgagcgagcacaaacgaccaggctgcggggggagagcgcaggcaacgtcaagcgcaccacgcgctgacgacacagaagagcgacgagagcgagcgagcagcgcgacagacaagaagaaaaagcaccaaacagcaacgatcagcacaccaagagcaagcagacacagcgaga

SEQ ID NO: 295339 - DNA, 2647 bp, Homo sapiens
cctcgctggctagtaggagagactggtgcttgccccgcccggtggactaactcgcttaattttaaataaaaagtcgaggacacggcggtcgttttcccgaagacatgggccctcccatgggccatttgctccctggaggccctcgcgtcttgctgagcccggggagttaggatgacgcgagcgggatgtctgacttccagtacttggctgtgcatacggaagcaggcggcaagcatacgtcaatgtatgacaaggtgctcatgctccggcccgagaaggaggcctttttccaccaggagctgccgctctacatccccccacccatcttctcccggctggacgccccggtggactacttctaccgaccagagacccagcaccgggaaggctacaacaatccccccatctcaggtgagaatctgattggcctgagcagagcccggcgcccccacaatgccatctttgtcaactttgaggatgaggaggtgcccaagcagccactggaggctgcagcccagacgtggaggagagtctgcactaaccccgtggaccggaaggtggaggaggagctgaggaagctgtttgacatccgtcccatctggtcccgaaatgctgtcaaggccaacatcagcgtccacccagacaagctcaaggtcttgcttcccttcatagcctattacatgataacaggcccctggcgcagcctatgggattcgatttgggtatgacccccgaaaaaacccagatgccaagatttatcaagtcctcgatttccgaatccgttgtggaatgaaacacggttacgcccccagtgacttgccggtcaaagcaaagcgcagcacctacaactacagcctccccatcaccgtcaagaagacatccagccagcttgtcaccatgcatgacctgaagcagggcctgggcccgtcggggacgagtggtgctcggaaaccagcttccagcaagtacaagctcaaggactctgtctacatcttccgggaaggggccttgccaccctatcggcagatgttctaccagttatgcgacttgaatgtggaagagttgcagaagatcattcaccgcaatgacggggcagagaattcctgcacagaacgggatgggtggtgcctccccaagaccagcgacgagctcagggacaccatgtccctcatgatccggcagaccatccgctccaagaggcctgctctcttttccagctcagccaaggctgatggcggaaaagagcagctgacgtacgagtctggggaagacgaggaggatgaggaggaggaggaagaggaggaggaggacttcaagccatccgacggcagtgaaaacgaaatggagacagagattctggactacgtgtgacagggcccaaggctgggcctccctgacccggccagactggtgtctggcctaatgagggagccggggctccccattgccacccacagtgcccggaatggccctaggaggccctctgaggagagctagagtcccagcaaagggtgcagctgaccctagcactggctgtgacatgctgcttggtgctgcctctggtcctgaggggttagggacatccccaaagggtataccctggctctgccacccatgaaccagcccagcatccagccagtgagtgggcacccaatgcctctcaggatgagaccagtaaatgccggaggtggagctgggcagctgtggagccccaggccacaggccagtctcgcttggctctcatgactgtggtggtggagatagtgtggggagcctcgcccatggtctcacgtggcaagaagtgcctttagctctggatcccaaccgtttggcacagctttggccacagccaggcccctctggaattgtccttattaaaccagtttcccgagaaaaaaaaaaaaaaaaaaaaaaaaaaaaaaaaaaaaaaaaaaagggggggggggccaaaaaatattctccccgggggggcccaaaatatagggggatacccggagttttgtggcgtcaccaggggggcgccccaatatggggcggcgcgccgatatataaacccacgcgacgcaggggcccgcgaggttaacaaccacggggtggcgacacgacgcggaaacaacgtgcgacacacgacgcgacactttgggcgagatggacggacccaaaacagacgggggggggcgagccaaaaattgtggggggacacaccatcatctccactaaggaaggcaaatattacaagggctcctcacgaggggaacaaatcataaaaacatcttcacgcgggggtgtaaaataggtggggcttgacaacacatggggggaaattctttgggtaggaatgctggaaaaagtagtgggagcacaacagggtagtagatgttgctgaacaaattttttaacagccggggggcagtggccagatataaacagcgggaccgacagatagagaccacacgacgctgacggatcacgcacacgagcgagcacaaacgaccaggctgcggggggagagcgcaggcaacgtcaagcgcaccacgcgctgacgacacagaagagcgacgagagcgagcgagcagcgcgacagacaagaagaaaaagcaccaaacagcaacgatcagcacaccaagagcaagcagacacagcgaga

SEQ ID NO: 295340 - DNA, 218 bp, Homo sapiens
ttcgatttgggtatgacccccgaaaaaacccagatgccaagatttatcaagtcctcgatttccgaatccgttgtggaatgaaacacggtaaaaattcctgaaagctttgcttcctgcctttctctctctttatctttcagtttctagcattctcttttgtagtaagaatcttttcatttggaaagaataaaaaaaccttttgcccccgttgctgagac

SEQ ID NO: 295341 - DNA, 3121 bp, Homo sapiens
cctcgctggctagtaggagagactggtgcttgccccgcccggtggactaactcgcttaattttaaataaaaagtcgaggacacggcggtcgttttcccgaagacatgggccctcccatgggccatttgctccctggaggccctcgcgtcttgctgagcccggggagttaggatgacgcgagcggtgagggagcccggaacgattccttcgcggaacaattgaggcgaggcctttgggagtactttgtgggacggaccctggcgggccctgccagacgcacagggatggcggcggaggcggccgatttggggctgggggccgccgtccccgtggagctgaggcgggagcgacgcatggtgtgcgtggagtacccgggagtggtgcgtgatgtggctaagatgctgccgactctgggcggcgaggaaggcgtctcccggatctacgcagaccccaccaagaggctggagctgtacttccggcccaaggacccatactgccacccagtgtgcgccaaccgcttcagtaccagcagcctgctgctccgcatcaggaagagaacgaggcggcagaaaggggtgctgggcactgaggcccactccgaggtcacatttgacatggagatccttggcatcatctccaccatttacaaatttcaggggatgtctgacttccagtacttggctgtgcatacggaagcaggcggcaagcatacgtcaatgtatgacaaggtgctcatgctccggcccgagaaggaggcctttttccaccaggagctgccgctctacatccccccacccatcttctcccggctggacgccccggtggactacttctaccgaccagagacccagcaccgggaaggctacaacaatccccccatctcaggtgagaatctgattggcctgagcagagcccggcgcccccacaatgccatctttgtcaactttgaggatgaggaggtgcccaagcagccactggaggctgcagcccagacgtggaggagagtctgcactaaccccgtggaccggaaggtggaggaggagctgaggaagctgtttgacatccgtcccatctggtcccgaaatgctgtcaaggccaacatcagcgtccacccagacaagctcaaggtcttgcttcccttcatagcctattacatgataacaggcccctggcgcagcctatgggattcgatttgggtatgacccccgaaaaaacccagatgccaagatttatcaagtcctcgatttccgaatccgttgtggaatgaaacacggttacgcccccagtgacttgccggtcaaagcaaagcgcagcacctacaactacagcctccccatcaccgtcaagaagacatccagccagcttgtcaccatgcatgacctgaagcagggcctgggcccgtcggggacgagtggtgctcggaaaccagcttccagcaagtacaagctcaaggactctgtctacatcttccgggaaggggccttgccaccctatcggcagatgttctaccagttatgcgacttgaatgtggaagagttgcagaagatcattcaccgcaatgacggggcagagaattcctgcacagaacgggatgggtggtgcctccccaagaccagcgacgagctcagggacaccatgtccctcatgatccggcagaccatccgctccaagaggcctgctctcttttccagctcagccaaggctgatggcggaaaagagcagctgacgtacgagtctggggaagacgaggaggatgaggaggaggaggaagaggaggaggaggacttcaagccatccgacggcagtgaaaacgaaatggagacagagattctggactacgtgtgacagggcccaaggctgggcctccctgacccggccagactggtgtctggcctaatgagggagccggggctccccattgccacccacagtgcccggaatggccctaggaggccctctgaggagagctagagtcccagcaaagggtgcagctgaccctagcactggctgtgacatgctgcttggtgctgcctctggtcctgaggggttagggacatccccaaagggtataccctggctctgccacccatgaaccagcccagcatccagccagtgagtgggcacccaatgcctctcaggatgagaccagtaaatgccggaggtggagctgggcagctgtggagccccaggccacaggccagtctcgcttggctctcatgactgtggtggtggagatagtgtggggagcctcgcccatggtctcacgtggcaagaagtgcctttagctctggatcccaaccgtttggcacagctttggccacagccaggcccctctggaattgtccttattaaaccagtttcccgagaaaaaaaaaaaaaaaaaaaaaaaaaaaaaaaaaaaaaaaaaaagggggggggggccaaaaaatattctccccgggggggcccaaaatatagggggatacccggagttttgtggcgtcaccaggggggcgccccaatatggggcggcgcgccgatatataaacccacgcgacgcaggggcccgcgaggttaacaaccacggggtggcgacacgacgcggaaacaacgtgcgacacacgacgcgacactttgggcgagatggacggacccaaaacagacgggggggggcgagccaaaaattgtggggggacacaccatcatctccactaaggaaggcaaatattacaagggctcctcacgaggggaacaaatcataaaaacatcttcacgcgggggtgtaaaataggtggggcttgacaacacatggggggaaattctttgggtaggaatgctggaaaaagtagtgggagcacaacagggtagtagatgttgctgaacaaattttttaacagccggggggcagtggccagatataaacagcgggaccgacagatagagaccacacgacgctgacggatcacgcacacgagcgagcacaaacgaccaggctgcggggggagagcgcaggcaacgtcaagcgcaccacgcgctgacgacacagaagagcgacgagagcgagcgagcagcgcgacagacaagaagaaaaagcaccaaacagcaacgatcagcacaccaagagcaagcagacacagcgaga

SEQ ID NO: 295342 - DNA, 2177 bp, Homo sapiens
cctcgctggctagtaggagagactggtgcttgccccgcccggtggactaactcgcttaattttaaataaaaagtcgaggacacggcggtcgttttcccgaagacatgggccctcccatgggccatttgctccctggaggccctcgcgtcttgctgagcccggggagttaggatgacgcgagcggtgagggagcccggaacgattccttcgcggaacaattgaggcgaggcctttgggagtactttgtgggacggaccctggcgggccctgccagacgcacagggatggcggcggaggcggccgatttggggctgggggccgccgtccccgtggagctgaggcgggagcgacgcatggtgtgcgtggagtacccgggagtggtgcgtgatgtggctaagatgctgccgactctgggcggcgaggaaggcgtctcccggatctacgcagaccccaccaagaggctggagctgtacttccggcccaaggacccatactgccacccagtgtgcgccaaccgcttcagtaccagcagcctgctgctccgcatcaggaagagaacgaggcggcagaaaggggtgctgggcactgaggcccactccgaggtcacatttgacatggagatccttggcatcatctccaccatttacaaatttcaggggatgtctgacttccagtacttggctgtgcatacggaagcaggcggcaagcatacgtcaatgtatgacaaggtgctcatgctccggcccgagaaggaggcctttttccaccaggagctgccgctctacatccccccacccatcttctcccggctggacgccccggtggactacttctaccgaccagagacccagcaccgggaaggctacaacaatccccccatctcaggtgagaatctgattggcctgagcagagcccggcgcccccacaatgccatctttgtcaactttgaggatgaggaggtgcccaataacaggcccctggcgcagcctatgggattcgatttgggtatgacccccgaaaaaacccagatgccaagatttatcaagtcctcgatttccgaatccgttgtggaatgaaacacggttacgcccccagtgacttgccggtcaaagcaaagcgcagcacctacaactacagcctccccatcaccgtcaagaagacatccagccagcttgtcaccatgcatgacctgaagcagggcctgggcccgtcggggacgagtggtgctcggaaaccagcttccagcaagtacaagctcaaggactctgtctacatcttccgggaaggggccttgccaccctatcggcagatgttctaccagttatgcgacttgaatgtggaagagttgcagaagatcattcaccgcaatgacggggcagagaattcctgcacagaacgggatgggtggtgcctccccaagaccagcgacgagctcagggacaccatgtccctcatgatccggcagaccatccgctccaagaggcctgctctcttttccagctcagccaaggctgatggcggaaaagagcagctgacgtacgagtctggggaagacgaggaggatgaggaggaggaggaagaggaggaggaggacttcaagccatccgacggcagtgaaaacgaaatggagacagagattctggactacgtgtgacagggcccaaggctgggcctccctgacccggccagactggtgtctggcctaatgagggagccggggctccccattgccacccacagtgcccggaatggccctaggaggccctctgaggagagctagagtcccagcaaagggtgcagctgaccctagcactggctgtgacatgctgcttggtgctgcctctggtcctgaggggttagggacatccccaaagggtataccctggctctgccacccatgaaccagcccagcatccagccagtgagtgggcacccaatgcctctcaggatgagaccagtaaatgccggaggtggagctgggcagctgtggagccccaggccacaggccagtctcgcttggctctcatgactgtggtggtggagatagtgtggggagcctcgcccatggtctcacgtggcaagaagtgcctttagctctggatcccaaccgtttggcacagctttggccacagccaggcccctctggaattgtccttattaaaccagtttcccgagaa

SEQ ID NO: 295343 - DNA, 2867 bp, Homo sapiens
cctcgctggctagtaggagagactggtgcttgccccgcccggtggactaactcgcttaattttaaataaaaagtcgaggacacggcggtcgttttcccgaagacatgggccctcccatgggccatttgctccctggaggccctcgcgtcttgctgagcccggggagttaggatgacgcgagcgatctacgcagaccccaccaagaggctggagctgtacttccggcccaaggacccatactgccacccagtgtgcgccaaccgcttcagtaccagcagcctgctgctccgcatcaggaagagaacgaggcggcagaaaggggtgctgggcactgaggcccactccgaggtcacatttgacatggagatccttggcatcatctccaccatttacaaatttcaggggatgtctgacttccagtacttggctgtgcatacggaagcaggcggcaagcatacgtcaatgtatgacaaggtgctcatgctccggcccgagaaggaggcctttttccaccaggagctgccgctctacatccccccacccatcttctcccggctggacgccccggtggactacttctaccgaccagagacccagcaccgggaaggctacaacaatccccccatctcaggtgagaatctgattggcctgagcagagcccggcgcccccacaatgccatctttgtcaactttgaggatgaggaggtgcccaagcagccactggaggctgcagcccagacgtggaggagagtctgcactaaccccgtggaccggaaggtggaggaggagctgaggaagctgtttgacatccgtcccatctggtcccgaaatgctgtcaaggccaacatcagcgtccacccagacaagctcaaggtcttgcttcccttcatagcctattacatgataacaggcccctggcgcagcctatgggattcgatttgggtatgacccccgaaaaaacccagatgccaagatttatcaagtcctcgatttccgaatccgttgtggaatgaaacacggttacgcccccagtgacttgccggtcaaagcaaagcgcagcacctacaactacagcctccccatcaccgtcaagaagacatccagccagcttgtcaccatgcatgacctgaagcagggcctgggcccgtcggggacgagtggtgctcggaaaccagcttccagcaagtacaagctcaaggactctgtctacatcttccgggaaggggccttgccaccctatcggcagatgttctaccagttatgcgacttgaatgtggaagagttgcagaagatcattcaccgcaatgacggggcagagaattcctgcacagaacgggatgggtggtgcctccccaagaccagcgacgagctcagggacaccatgtccctcatgatccggcagaccatccgctccaagaggcctgctctcttttccagctcagccaaggctgatggcggaaaagagcagctgacgtacgagtctggggaagacgaggaggatgaggaggaggaggaagaggaggaggaggacttcaagccatccgacggcagtgaaaacgaaatggagacagagattctggactacgtgtgacagggcccaaggctgggcctccctgacccggccagactggtgtctggcctaatgagggagccggggctccccattgccacccacagtgcccggaatggccctaggaggccctctgaggagagctagagtcccagcaaagggtgcagctgaccctagcactggctgtgacatgctgcttggtgctgcctctggtcctgaggggttagggacatccccaaagggtataccctggctctgccacccatgaaccagcccagcatccagccagtgagtgggcacccaatgcctctcaggatgagaccagtaaatgccggaggtggagctgggcagctgtggagccccaggccacaggccagtctcgcttggctctcatgactgtggtggtggagatagtgtggggagcctcgcccatggtctcacgtggcaagaagtgcctttagctctggatcccaaccgtttggcacagctttggccacagccaggcccctctggaattgtccttattaaaccagtttcccgagaaaaaaaaaaaaaaaaaaaaaaaaaaaaaaaaaaaaaaaaaaagggggggggggccaaaaaatattctccccgggggggcccaaaatatagggggatacccggagttttgtggcgtcaccaggggggcgccccaatatggggcggcgcgccgatatataaacccacgcgacgcaggggcccgcgaggttaacaaccacggggtggcgacacgacgcggaaacaacgtgcgacacacgacgcgacactttgggcgagatggacggacccaaaacagacgggggggggcgagccaaaaattgtggggggacacaccatcatctccactaaggaaggcaaatattacaagggctcctcacgaggggaacaaatcataaaaacatcttcacgcgggggtgtaaaataggtggggcttgacaacacatggggggaaattctttgggtaggaatgctggaaaaagtagtgggagcacaacagggtagtagatgttgctgaacaaattttttaacagccggggggcagtggccagatataaacagcgggaccgacagatagagaccacacgacgctgacggatcacgcacacgagcgagcacaaacgaccaggctgcggggggagagcgcaggcaacgtcaagcgcaccacgcgctgacgacacagaagagcgacgagagcgagcgagcagcgcgacagacaagaagaaaaagcaccaaacagcaacgatcagcacaccaagagcaagcagacacagcgaga

SEQ ID NO: 295344 - DNA, 540 bp, Homo sapiens
ggcccagaatgaaacatgagcctcctggcctttcctggatcaccgtcaggcttttattgagagaggagcagctccccactggctgcttggcttgtcattgcttcactctgtctcctttggccttgccacagatctacgcagaccccaccaagaggctggagctgtacttccggcccaaggacccatactgccacccagtgtgcgccaaccgcttcagtaccagcagcctgctgctccgcatcaggaagagaacgaggcggcagaaaggggtgctgggcactgaggcccactccgaggtcacatttgacatggagatccttggcatcatctccaccatttacaaatttcagggtaactgaaatctgctcttgcaatgtctggttatttcagggctggccatcctagctgcctgcaggagctgtgtgggtcatctgcaccagtggagggggccaggatatgcccaggggctgtggggacacagcagggcacaggccccatccaggaggcagcctttcttccctccagccaacagttccccag

SEQ ID NO: 295345 - DNA, 4698 bp, Homo sapiens
gcgcggcccggctggccgtctgcgcaccctctctcccctcggctctttcctaggaaagctgagcctcatagcttccgggagaaggttttccggaagaaacctccagtctgtgcagtatgtaaggtgaccatcgatgggacaggcgtttcgtgcagagtctgcaaggtggcgacgcacagaaaatgtgaagcaaaggtgacttcagcctgtcaggccttgcctcccgtggagttgcggcgaaacacggccccagtcaggcgcatagagcacctgggatccaccaaatctctgaaccactcaaagcagcgcagcactctgcccaggagcttcagcctggacccgctcatggagcggcgctgggacttagacctcacctacgtgacggagcgcatcttggccgccgccttccccgcgcggcccgatgaacagcggcaccggggccacctgcgcgagctggcccatgtgctgcaatccaagcaccgggacaagtacctgctcttcaacctttcagagaaaaggcatgacctgacccgcttaaaccccaaggttcaagacttcggctggcctgagctgcatgctccacccctggacaagctgtgctccatctgcaaagccatggagacatggctcagtgctgacccacagcacgtggtcgtactatactgcaagggaaacaagggcaagcttggggtcatcgtttctgcctacatgcactacagcaagatctctgcaggggcggaccaggcactggccactcttaccatgcggaaattctgcgaggacaaggtggccacagaactgcagccctcccagcgtcgatatatcagctacttcagtgggctgctatctggctccatcagaatgaacagcagccctctcttcctgcactatgtgctcatccccatgctgccagcctttgaacctggcacaggcttccagcccttccttaaaatctaccagtccatgcagcttgtctacacatctggagtctatcacattgcaggccctggtccccagcagctttgcatcagcctggagccagccctcctcctcaaaggcgatgtcatggtaacatgttatcacaagggtggccggggcacagaccggaccctcgtgttccgagtccagttccacacctgcaccatccacggaccacagctcactttccccaaggaccagcttgacgaggcctggactgatgagaggttccccttccaagcctccgtggagtttgtcttctcctccagccccgagaagatcaaaggcagcactccacggaacgacccctcggtctctgtcgactacaacaccactgagccagccgtgcgctgggactcctatgagaacttcaaccagcaccacgaggacagtgtggatggctccttgacccacacccggggtcccctggatggcagtccttatgcccaggtgcagcggcctccccggcagacccccccggcaccctctccagagcctccaccaccccccatgctctctgtcagcagcgactcaggccattcctccacgctgaccacagagccggctgctgagtcccctggccggccgccccctacagctgctgaacggcaggagctggatcgcctcctaggaggctgcggagtggccagtgggggccggggagctgggcgcgagacggccatcctagatgacgaagagcagcccactgtgggcggaggcccccacctcggagtgtatccaggccataggcctggcctcagccgccactgctcctgccgccagggctaccgggagccctgcggggttcccaatgggggctactaccggccagagggaaccctggagaggaggcgactggcctacgggggctatgagggatccccccagggctacgccgaggcctcgatggagaagaggcgcctctgccgatcgctgtcagaggggctatacccctacccacctgagatggggaaaccagccactggggactttggctaccgcgccccaggctaccgggaggtggtcatcctggaggaccctgggctgcctgccctatacccatgcccagcctgcgaggagaagctggcgctgcctacagcagccttgtatggactgcggctggagagggaggctggagaagggtgggcaagtgaggctggcaagcctctcctgcacccagtgcggcctgggcacccgctgcctctgctcttgcctgcctgtgggcatcaccatgccccgatgcctgactacagctgcctgaagccacccaaggcaggcgaggaagggcacgagggctgctcctacaccatgtgccccgaaggcaggtatgggcatccagggtaccctgccctggtgacatacagctatggaggagcagttcccagttactgcccagcatatggccgtgtgcctcatagctgtggctctccaggagagggcagagggtatcccagccctggtgcccactccccacgggctggctccatttccccgggcagcccgccctatccacaatctaggaagctgagctacgagatccctacggaggagggaggggacaggtacccattgcctgggcacctggcctcagcaggacctttggcatctgcagagtcgctggagccggtgtcctggagggagggccccagtgggcacagcacactgcctcggtctccccgagatgccccatgcagtgcttcgtcagagttgtctggtccctccacgcccctgcacaccagcagtccagtccagggcaaggaaagcacccggcgacaggacaccaggtcccccacctcagcgcccactcagagactgagtcctggcgaggccttgccccctgtttcccaggcaggcaccggaaaggcccctgagctgccgtcgggaagtgggcctgagcctctggcccctagcccagtctctccgaccttccctcccagctcgcccagtgactggcctcaggaaaggagtccagggggccactcagatggcgccagtcctcggagccctgtgcccaccacacttcctggcctccgccacgccccctggcaaggccctcgaggcccccccgacagcccagatgggtctcccctcactcctgtgccttcccagatgccctggcttgtggccagcccagagccgcctcagagctcacctacacctgctttccccctggctgcctcctatgacaccaatggccttagccagcccccacttcctgagaaacgccacctgcccgggccggggcaacagccaggaccctggggcccagagcaggcatcatcgccagccagaggcatcagtcaccatgtcaccttcgcacctctgctctcagataatgtcccccaaaccccagagcctcctacacaagagagccaaagcaatgtcaagtttgtccaggatacatccaagttctggtacaagccacacctgtcccgtgaccaagccattgccctgctgaaggacaaggaccctggggccttcctgatcagggacagtcattcattccaaggagcttatgggctggccctcaaggtggccacaccgccacccagtgcccagccctggaaaggggaccccgtggaacagctggtccgccatttcctcatcgagactgggcccaaaggggtgaagatcaagggctgccccagtgagccctactttggcagcctgtccgccttggtctcccagcactccatctcccccatctccctgccctgctgcctgcgcattcccagcaaagatcctctggaagagaccccagaggctccagtgcccaccaacatgagcacagcggcagacctcctgcgtcagggtgctgcctgcagcgtgctctacttgacctcagtggagacagagtcactgacgggcccccaagctgtggcccgggccagctctgcagctctgagctgtagcccccgcccgacaccagctgttgtccacttcaaggtgtcagcccagggcattacactgacggacaaccaaaggaagctcttctttcgccgccattatccagtgaacagcatcaccttctccagcactgaccctcaagaccggagatggaccaacccagacgggaccacctccaagatctttggtttcgtggccaagaagccgggaagcccctgggagaatgtgtgtcacctctttgcagagcttgacccagatcagcctgctggcgccattgtcaccttcatcaccaaagttctactgggccagagaaaatgaaggaaggccacaagctcagagcccacatcaacactgcccccctcccagcaccccacagccctcacatcccctggcctggacccaggagacccaggagaaagcaccctcccttaggaatgaggagtgggcatcaggcctgggacactgctctccttccccgcccccagcctgctaagttaagtggacaggcccacaagatgaccttgcatgtgagcagatggcagagatgggtgtgtgaggggtgaggaggcatcagcagttgagccccgaaggagatcaggcagccccacctgcaggagaacgtcagccctccaggggatcagcccctgccagttccacccagctgcaggtgccagcacggcagggatgggagaggggtggggagcgagtcactgcctcctctgagcagagattcagagtaggatcacatgaataggggaaaaaagagagtctatttttgtctaataataaagaatttctataaactttagccga

SEQ ID NO: 295346 - DNA, 4687 bp, Homo sapiens
gctgaggaaggagagcagacccaggagagccatgaagcctaggaaagctgagcctcatagcttccgggagaaggttttccggaagaaacctccagtctgtgcagtatgtaaggtgaccatcgatgggacaggcgtttcgtgcagagtctgcaaggtggcgacgcacagaaaatgtgaagcaaaggtgacttcagcctgtcaggccttgcctcccgtggagttgcggcgaaacacggccccagtcaggcgcatagagcacctgggatccaccaaatctctgaaccactcaaagcagcgcagcactctgcccaggagcttcagcctggacccgctcatggagcggcgctgggacttagacctcacctacgtgacggagcgcatcttggccgccgccttccccgcgcggcccgatgaacagcggcaccggggccacctgcgcgagctggcccatgtgctgcaatccaagcaccgggacaagtacctgctcttcaacctttcagagaaaaggcatgacctgacccgcttaaaccccaaggttcaagacttcggctggcctgagctgcatgctccacccctggacaagctgtgctccatctgcaaagccatggagacatggctcagtgctgacccacagcacgtggtcgtactatactgcaagggaaacaagggcaagcttggggtcatcgtttctgcctacatgcactacagcaagatctctgcaggggcggaccaggcactggccactcttaccatgcggaaattctgcgaggacaaggtggccacagaactgcagccctcccagcgtcgatatatcagctacttcagtgggctgctatctggctccatcagaatgaacagcagccctctcttcctgcactatgtgctcatccccatgctgccagcctttgaacctggcacaggcttccagcccttccttaaaatctaccagtccatgcagcttgtctacacatctggagtctatcacattgcaggccctggtccccagcagctttgcatcagcctggagccagccctcctcctcaaaggcgatgtcatggtaacatgttatcacaagggtggccggggcacagaccggaccctcgtgttccgagtccagttccacacctgcaccatccacggaccacagctcactttccccaaggaccagcttgacgaggcctggactgatgagaggttccccttccaagcctccgtggagtttgtcttctcctccagccccgagaagatcaaaggcagcactccacggaacgacccctcggtctctgtcgactacaacaccactgagccagccgtgcgctgggactcctatgagaacttcaaccagcaccacgaggacagtgtggatggctccttgacccacacccggggtcccctggatggcagtccttatgcccaggtgcagcggcctccccggcagacccccccggcaccctctccagagcctccaccaccccccatgctctctgtcagcagcgactcaggccattcctccacgctgaccacagagccggctgctgagtcccctggccggccgccccctacagctgctgaacggcaggagctggatcgcctcctaggaggctgcggagtggccagtgggggccggggagctgggcgcgagacggccatcctagatgacgaagagcagcccactgtgggcggaggcccccacctcggagtgtatccaggccataggcctggcctcagccgccactgctcctgccgccagggctaccgggagccctgcggggttcccaatgggggctactaccggccagagggaaccctggagaggaggcgactggcctacgggggctatgagggatccccccagggctacgccgaggcctcgatggagaagaggcgcctctgccgatcgctgtcagaggggctatacccctacccacctgagatggggaaaccagccactggggactttggctaccgcgccccaggctaccgggaggtggtcatcctggaggaccctgggctgcctgccctatacccatgcccagcctgcgaggagaagctggcgctgcctacagcagccttgtatggactgcggctggagagggaggctggagaagggtgggcaagtgaggctggcaagcctctcctgcacccagtgcggcctgggcacccgctgcctctgctcttgcctgcctgtgggcatcaccatgccccgatgcctgactacagctgcctgaagccacccaaggcaggcgaggaagggcacgagggctgctcctacaccatgtgccccgaaggcaggtatgggcatccagggtaccctgccctggtgacatacagctatggaggagcagttcccagttactgcccagcatatggccgtgtgcctcatagctgtggctctccaggagagggcagagggtatcccagccctggtgcccactccccacgggctggctccatttccccgggcagcccgccctatccacaatctaggaagctgagctacgagatccctacggaggagggaggggacaggtacccattgcctgggcacctggcctcagcaggacctttggcatctgcagagtcgctggagccggtgtcctggagggagggccccagtgggcacagcacactgcctcggtctccccgagatgccccatgcagtgcttcgtcagagttgtctggtccctccacgcccctgcacaccagcagtccagtccagggcaaggaaagcacccggcgacaggacaccaggtcccccacctcagcgcccactcagagactgagtcctggcgaggccttgccccctgtttcccaggcaggcaccggaaaggcccctgagctgccgtcgggaagtgggcctgagcctctggcccctagcccagtctctccgaccttccctcccagctcgcccagtgactggcctcaggaaaggagtccagggggccactcagatggcgccagtcctcggagccctgtgcccaccacacttcctggcctccgccacgccccctggcaaggccctcgaggcccccccgacagcccagatgggtctcccctcactcctgtgccttcccagatgccctggcttgtggccagcccagagccgcctcagagctcacctacacctgctttccccctggctgcctcctatgacaccaatggccttagccagcccccacttcctgagaaacgccacctgcccgggccggggcaacagccaggaccctggggcccagagcaggcatcatcgccagccagaggcatcagtcaccatgtcaccttcgcacctctgctctcagataatgtcccccaaaccccagagcctcctacacaagagagccaaagcaatgtcaagtttgtccaggatacatccaagttctggtacaagccacacctgtcccgtgaccaagccattgccctgctgaaggacaaggaccctggggccttcctgatcagggacagtcattcattccaaggagcttatgggctggccctcaaggtggccacaccgccacccagtgcccagccctggaaaggggaccccgtggaacagctggtccgccatttcctcatcgagactgggcccaaaggggtgaagatcaagggctgccccagtgagccctactttggcagcctgtccgccttggtctcccagcactccatctcccccatctccctgccctgctgcctgcgcattcccagcaaagatcctctggaagagaccccagaggctccagtgcccaccaacatgagcacagcggcagacctcctgcgtcagggtgctgcctgcagcgtgctctacttgacctcagtggagacagagtcactgacgggcccccaagctgtggcccgggccagctctgcagctctgagctgtagcccccgcccgacaccagctgttgtccacttcaaggtgtcagcccagggcattacactgacggacaaccaaaggaagctcttctttcgccgccattatccagtgaacagcatcaccttctccagcactgaccctcaagaccggagatggaccaacccagacgggaccacctccaagatctttggtttcgtggccaagaagccgggaagcccctgggagaatgtgtgtcacctctttgcagagcttgacccagatcagcctgctggcgccattgtcaccttcatcaccaaagttctactgggccagagaaaatgaaggaaggccacaagctcagagcccacatcaacactgcccccctcccagcaccccacagccctcacatcccctggcctggacccaggagacccaggagaaagcaccctcccttaggaatgaggagtgggcatcaggcctgggacactgctctccttccccgcccccagcctgctaagttaagtggacaggcccacaagatgaccttgcatgtgagcagatggcagagatgggtgtgtgaggggtgaggaggcatcagcagttgagccccgaaggagatcaggcagccccacctgcaggagaacgtcagccctccaggggatcagcccctgccagttccacccagctgcaggtgccagcacggcagggatgggagaggggtggggagcgagtcactgcctcctctgagcagagattcagagtaggatcacatgaataggggaaaaaagagagtctatttttgtctaataataaagaatttctataaactttagccga

SEQ ID NO: 295347 - DNA, 4748 bp, Homo sapiens
agcaccccagccagccgaacaccatgaagtccagcggccctgtggagaggctgctcagagccctggggaggagggacagcagccgggccgcaagcaggcctaggaaagctgagcctcatagcttccgggagaaggttttccggaagaaacctccagtctgtgcagtatgtaaggtgaccatcgatgggacaggcgtttcgtgcagagtctgcaaggtggcgacgcacagaaaatgtgaagcaaaggtgacttcagcctgtcaggccttgcctcccgtggagttgcggcgaaacacggccccagtcaggcgcatagagcacctgggatccaccaaatctctgaaccactcaaagcagcgcagcactctgcccaggagcttcagcctggacccgctcatggagcggcgctgggacttagacctcacctacgtgacggagcgcatcttggccgccgccttccccgcgcggcccgatgaacagcggcaccggggccacctgcgcgagctggcccatgtgctgcaatccaagcaccgggacaagtacctgctcttcaacctttcagagaaaaggcatgacctgacccgcttaaaccccaaggttcaagacttcggctggcctgagctgcatgctccacccctggacaagctgtgctccatctgcaaagccatggagacatggctcagtgctgacccacagcacgtggtcgtactatactgcaagggaaacaagggcaagcttggggtcatcgtttctgcctacatgcactacagcaagatctctgcaggggcggaccaggcactggccactcttaccatgcggaaattctgcgaggacaaggtggccacagaactgcagccctcccagcgtcgatatatcagctacttcagtgggctgctatctggctccatcagaatgaacagcagccctctcttcctgcactatgtgctcatccccatgctgccagcctttgaacctggcacaggcttccagcccttccttaaaatctaccagtccatgcagcttgtctacacatctggagtctatcacattgcaggccctggtccccagcagctttgcatcagcctggagccagccctcctcctcaaaggcgatgtcatggtaacatgttatcacaagggtggccggggcacagaccggaccctcgtgttccgagtccagttccacacctgcaccatccacggaccacagctcactttccccaaggaccagcttgacgaggcctggactgatgagaggttccccttccaagcctccgtggagtttgtcttctcctccagccccgagaagatcaaaggcagcactccacggaacgacccctcggtctctgtcgactacaacaccactgagccagccgtgcgctgggactcctatgagaacttcaaccagcaccacgaggacagtgtggatggctccttgacccacacccggggtcccctggatggcagtccttatgcccaggtgcagcggcctccccggcagacccccccggcaccctctccagagcctccaccaccccccatgctctctgtcagcagcgactcaggccattcctccacgctgaccacagagccggctgctgagtcccctggccggccgccccctacagctgctgaacggcaggagctggatcgcctcctaggaggctgcggagtggccagtgggggccggggagctgggcgcgagacggccatcctagatgacgaagagcagcccactgtgggcggaggcccccacctcggagtgtatccaggccataggcctggcctcagccgccactgctcctgccgccagggctaccgggagccctgcggggttcccaatgggggctactaccggccagagggaaccctggagaggaggcgactggcctacgggggctatgagggatccccccagggctacgccgaggcctcgatggagaagaggcgcctctgccgatcgctgtcagaggggctatacccctacccacctgagatggggaaaccagccactggggactttggctaccgcgccccaggctaccgggaggtggtcatcctggaggaccctgggctgcctgccctatacccatgcccagcctgcgaggagaagctggcgctgcctacagcagccttgtatggactgcggctggagagggaggctggagaagggtgggcaagtgaggctggcaagcctctcctgcacccagtgcggcctgggcacccgctgcctctgctcttgcctgcctgtgggcatcaccatgccccgatgcctgactacagctgcctgaagccacccaaggcaggcgaggaagggcacgagggctgctcctacaccatgtgccccgaaggcaggtatgggcatccagggtaccctgccctggtgacatacagctatggaggagcagttcccagttactgcccagcatatggccgtgtgcctcatagctgtggctctccaggagagggcagagggtatcccagccctggtgcccactccccacgggctggctccatttccccgggcagcccgccctatccacaatctaggaagctgagctacgagatccctacggaggagggaggggacaggtacccattgcctgggcacctggcctcagcaggacctttggcatctgcagagtcgctggagccggtgtcctggagggagggccccagtgggcacagcacactgcctcggtctccccgagatgccccatgcagtgcttcgtcagagttgtctggtccctccacgcccctgcacaccagcagtccagtccagggcaaggaaagcacccggcgacaggacaccaggtcccccacctcagcgcccactcagagactgagtcctggcgaggccttgccccctgtttcccaggcaggcaccggaaaggcccctgagctgccgtcgggaagtgggcctgagcctctggcccctagcccagtctctccgaccttccctcccagctcgcccagtgactggcctcaggaaaggagtccagggggccactcagatggcgccagtcctcggagccctgtgcccaccacacttcctggcctccgccacgccccctggcaaggccctcgaggcccccccgacagcccagatgggtctcccctcactcctgtgccttcccagatgccctggcttgtggccagcccagagccgcctcagagctcacctacacctgctttccccctggctgcctcctatgacaccaatggccttagccagcccccacttcctgagaaacgccacctgcccgggccggggcaacagccaggaccctggggcccagagcaggcatcatcgccagccagaggcatcagtcaccatgtcaccttcgcacctctgctctcagataatgtcccccaaaccccagagcctcctacacaagagagccaaagcaatgtcaagtttgtccaggatacatccaagttctggtacaagccacacctgtcccgtgaccaagccattgccctgctgaaggacaaggaccctggggccttcctgatcagggacagtcattcattccaaggagcttatgggctggccctcaaggtggccacaccgccacccagtgcccagccctggaaaggggaccccgtggaacagctggtccgccatttcctcatcgagactgggcccaaaggggtgaagatcaagggctgccccagtgagccctactttggcagcctgtccgccttggtctcccagcactccatctcccccatctccctgccctgctgcctgcgcattcccagcaaagatcctctggaagagaccccagaggctccagtgcccaccaacatgagcacagcggcagacctcctgcgtcagggtgctgcctgcagcgtgctctacttgacctcagtggagacagagtcactgacgggcccccaagctgtggcccgggccagctctgcagctctgagctgtagcccccgcccgacaccagctgttgtccacttcaaggtgtcagcccagggcattacactgacggacaaccaaaggaagctcttctttcgccgccattatccagtgaacagcatcaccttctccagcactgaccctcaagaccggagatggaccaacccagacgggaccacctccaagatctttggtttcgtggccaagaagccgggaagcccctgggagaatgtgtgtcacctctttgcagagcttgacccagatcagcctgctggcgccattgtcaccttcatcaccaaagttctactgggccagagaaaatgaaggaaggccacaagctcagagcccacatcaacactgcccccctcccagcaccccacagccctcacatcccctggcctggacccaggagacccaggagaaagcaccctcccttaggaatgaggagtgggcatcaggcctgggacactgctctccttccccgcccccagcctgctaagttaagtggacaggcccacaagatgaccttgcatgtgagcagatggcagagatgggtgtgtgaggggtgaggaggcatcagcagttgagccccgaaggagatcaggcagccccacctgcaggagaacgtcagccctccaggggatcagcccctgccagttccacccagctgcaggtgccagcacggcagggatgggagaggggtggggagcgagtcactgcctcctctgagcagagattcagagtaggatcacatgaataggggaaaaaagagagtctatttttgtctaataataaagaatttctataaactttagccga

SEQ ID NO: 295348 - DNA, 4598 bp, Homo sapiens
gctgaggaaggagagcagacccaggagagccatgaagcctaggaaagctgagcctcatagcttccgggagaaggttttccggaagaaacctccagtctgtgcagtatgtaaggtgaccatcgatgggacaggcgtttcgtgcagagtctgcaaggtggcgacgcacagaaaatgtgaagcaaaggtgacttcagcctgtcaggccttgcctcccgtggagttgcggcgaaacacggccccagtcaggcgcatagagcacctgggatccaccaaatctctgaaccactcaaagcagcgcagcactctgcccaggagcttcagcctggacccgctcatggagcggcgctgggacttagacctcacctacgtgacggagcgcatcttggccgccgccttccccgcgcggcccgatgaacagcggcaccggggccacctgcgcgagctggcccatgtgctgcaatccaagcaccgggacaagtacctgctcttcaacctttcagagaaaaggcatgacctgacccgcttaaaccccaaggttcaagacttcggctggcctgagctgcatgctccacccctggacaagctgtgctccatctgcaaagccatggagacatggctcagtgctgacccacagcacgtggtcgtactatactgcaagggaaacaagggcaagcttggggtcatcgtttctgcctacatgcactacagcaagatctctgcaggggcggaccaggcactggccactcttaccatgcggaaattctgcgaggacaaggtggccacagaactgcagccctcccagcgtcgatatatcagctacttcagtgggctgctatctggctccatcagaatgaacagcagccctctcttcctgcactatgtgctcatccccatgctgccagcctttgaacctggcacaggcttccagcccttccttaaaatctaccagtccatgcagcttgtctacacatctggagtctatcacattgcaggccctggtccccagcagctttgcatcagcctggagccagccctcctcctcaaaggcgatgtcatggtaacatgttatcacaagggtggccggggcacagaccggaccctcgtgttccgagtccagttccacacctgcaccatccacggaccacagctcactttccccaaggaccagcttgacgaggcctggactgatgagaggttccccttccaagcctccgtggagtttgtcttctcctccagccccgagaagatcaaaggcagcactccacggaacgacccctcggtctctgtcgactacaacaccactgagccagccgtgcgctgggactcctatgagaacttcaaccagcaccacgaggacagtgtggatggctccttgacccacacccggggtcccctggatggcagtccttatgcccaggtgcagcggcctccccggcagacccccccggcaccctctccagagcctccaccaccccccatgctctctgtcagcagcgactcaggccattcctccacgctgaccacagagccggctgctgagtcccctggccggccgccccctacagctgctgaacggcaggagctggatcgcctcctaggaggctgcggagtggccagtgggggccggggagctgggcgcgagacggccatcctagatgacgaagagcagcccactgtgggcggaggcccccacctcggagtgtatccaggccataggcctggcctcagccgccactgctcctgccgccagggctaccgggagccctgcggggttcccaatgggggctactaccggccagagggaaccctggagaggaggcgactggcctacgggggctatgagggatccccccagggctacgccgaggcctcgatggagaagaggcgcctctgccgatcgctgtcagaggggctatacccctacccacctgagatggggaaaccagccactggggactttggctaccgcgccccaggctaccgggaggtggtcatcctggaggaccctgggctgcctgccctatacccatgcccagcctgcgaggagaagctggcgctgcctacagcagccttgtatggactgcggctggagagggaggctggagaagggtgggcaagtgaggctggcaagcctctcctgcacccagtgcggcctgggcacccgctgcctctgctcttgcctgcctgtgggcatcaccatgccccgatgcctgactacagctgcctgaagccacccaaggcaggcgaggaagggcacgagggctgctcctacaccatgtgccccgaaggcaggtatgggcatccagggtaccctgccctggtgacatacagctatggaggagcagttcccagttactgcccagcatatggccgtgtgcctcatagctgtggctctccaggagagggcagagggtatcccagccctggtgcccactccccacgggctggctccatttccccgggcagcccgccctatccacaatctaggaagctgagctacgagatccctacggaggagggaggggacaggtacccattgcctgggcacctggcctcagcaggacctttggcatctgcagagtcgctggagccggtgtcctggagggagggccccagtgggcacagcacactgcctcggtctccccgagatgccccatgcagtgcttcgtcagagttgtctggtccctccacgcccctgcacaccagcagtccagtccagggcaaggaaagcacccggcgacaggacaccaggtcccccacctcagcgcccactcagagactgagtcctggcgaggccttgccccctgtttcccagctcgcccagtgactggcctcaggaaaggagtccagggggccactcagatggcgccagtcctcggagccctgtgcccaccacacttcctggcctccgccacgccccctggcaaggccctcgaggcccccccgacagcccagatgggtctcccctcactcctgtgccttcccagatgccctggcttgtggccagcccagagccgcctcagagctcacctacacctgctttccccctggctgcctcctatgacaccaatggccttagccagcccccacttcctgagaaacgccacctgcccgggccggggcaacagccaggaccctggggcccagagcaggcatcatcgccagccagaggcatcagtcaccatgtcaccttcgcacctctgctctcagataatgtcccccaaaccccagagcctcctacacaagagagccaaagcaatgtcaagtttgtccaggatacatccaagttctggtacaagccacacctgtcccgtgaccaagccattgccctgctgaaggacaaggaccctggggccttcctgatcagggacagtcattcattccaaggagcttatgggctggccctcaaggtggccacaccgccacccagtgcccagccctggaaaggggaccccgtggaacagctggtccgccatttcctcatcgagactgggcccaaaggggtgaagatcaagggctgccccagtgagccctactttggcagcctgtccgccttggtctcccagcactccatctcccccatctccctgccctgctgcctgcgcattcccagcaaagatcctctggaagagaccccagaggctccagtgcccaccaacatgagcacagcggcagacctcctgcgtcagggtgctgcctgcagcgtgctctacttgacctcagtggagacagagtcactgacgggcccccaagctgtggcccgggccagctctgcagctctgagctgtagcccccgcccgacaccagctgttgtccacttcaaggtgtcagcccagggcattacactgacggacaaccaaaggaagctcttctttcgccgccattatccagtgaacagcatcaccttctccagcactgaccctcaagaccggagatggaccaacccagacgggaccacctccaagatctttggtttcgtggccaagaagccgggaagcccctgggagaatgtgtgtcacctctttgcagagcttgacccagatcagcctgctggcgccattgtcaccttcatcaccaaagttctactgggccagagaaaatgaaggaaggccacaagctcagagcccacatcaacactgcccccctcccagcaccccacagccctcacatcccctggcctggacccaggagacccaggagaaagcaccctcccttaggaatgaggagtgggcatcaggcctgggacactgctctccttccccgcccccagcctgctaagttaagtggacaggcccacaagatgaccttgcatgtgagcagatggcagagatgggtgtgtgaggggtgaggaggcatcagcagttgagccccgaaggagatcaggcagccccacctgcaggagaacgtcagccctccaggggatcagcccctgccagttccacccagctgcaggtgccagcacggcagggatgggagaggggtggggagcgagtcactgcctcctctgagcagagattcagagtaggatcacatgaataggggaaaaaagagagtctatttttgtctaataataaagaatttctataaactttagccga

SEQ ID NO: 295349 - DNA, 4802 bp, Homo sapiens
gctgaggaaggagagcagacccaggagagccatgaagcctaggaaagctgagcctcatagcttccgggagaaggttttccggaagaaacctccagtctgtgcagtatgtaaggtgaccatcgatgggacaggcgtttcgtgcagagtctgcaaggtggcgacgcacagaaaatgtgaagcaaaggtgacttcagcctgtcaggccttgcctcccgtggagttgcggcgaaacacggccccagtcaggcgcatagagcacctgggatccaccaaatctctgaaccactcaaagcagcgcagcactctgcccaggagcttcagcctggacccgctcatggagcggcgctgggacttagacctcacctacgtgacggagcgcatcttggccgccgccttccccgcgcggcccgatgaacagcggcaccggggccacctgcgcgagctggcccatgtgctgcaatccaagcaccgggacaagtacctgctcttcaacctttcagagaaaaggcatgacctgacccgcttaaaccccaaggttcaagacttcggctggcctgagctgcatgctccacccctggacaagctgtgctccatctgcaaagccatggagacatggctcagtgctgacccacagcacgtggtcgtactatactgcaagggaaacaagggcaagcttggggtcatcgtttctgcctacatgcactacagcaagatctctgcaggggcggaccaggcactggccactcttaccatgcggaaattctgcgaggacaaggtggccacagaactgcagccctcccagcgtcgatatatcagctacttcagtgggctgctatctggctccatcagaatgaacagcagccctctcttcctgcactatgtgctcatccccatgctgccagcctttgaacctggcacaggcttccagcccttccttaaaatctaccagtccatgcagcttgtctacacatctggagtctatcacattgcaggccctggtccccagcagctttgcatcagcctggagccagccctcctcctcaaaggcgatgtcatggtaacatgttatcacaagggtggccggggcacagaccggaccctcgtgttccgagtccagttccacacctgcaccatccacggaccacagctcactttccccaaggaccagcttgacgaggcctggactgatgagaggttccccttccaagcctccgtggagtttgtcttctcctccagccccgagaagatcaaaggcagcactccacggaacgacccctcggtctctgtcgactacaacaccactgagccagccgtgcgctgggactcctatgagaacttcaaccagcaccacgaggacagtgtggatggctccttgacccacacccggggtcccctggatggcagtccttatgcccaggtgcagcggcctccccggcagacccccccggcaccctctccagagcctccaccaccccccatgctctctgtcagcagcgactcaggccattcctccacgctgaccacagagccggctgctgagtcccctggccggccgccccctacagctgctgaacggcaggagctggatcgcctcctaggaggctgcggagtggccagtgggggccggggagctgggcgcgagacggccatcctagatgacgaagagcagcccactgtgggcggaggcccccacctcggagtgtatccaggccataggcctggcctcagccgccactgctcctgccgccagggctaccgggagccctgcggggttcccaatgggggctactaccggccagagggaaccctggagaggaggcgactggcctacgggggctatgagggatccccccagggctacgccgaggcctcgatggagaagaggcgcctctgccgatcgctgtcagaggggctatacccctacccacctgagatggggaaaccagccactggggactttggctaccgcgccccaggctaccgggaggtggtcatcctggaggaccctgggctgcctgccctatacccatgcccagcctgcgaggagaagctggcgctgcctacagcagccttgtatggactgcggctggagagggaggctggagaagggtgggcaagtgaggctggcaagcctctcctgcacccagtgcggcctgggcacccgctgcctctgctcttgcctgcctgtgggcatcaccatgccccgatgcctgactacagctgcctgaagccacccaaggcaggcgaggaagggcacgagggctgctcctacaccatgtgccccgaaggcaggtatgggcatccagggtaccctgccctggtgacatacagctatggaggagcagttcccagttactgcccagcatatggccgtgtgcctcatagctgtggctctccaggagagggcagagggtatcccagccctggtgcccactccccacgggctggctccatttccccgggcagcccgccctatccacaatctaggaagctgagctacgagatccctacggaggagggaggggacaggtacccattgcctgggcacctggcctcagcaggacctttggcatctgcagagtcgctggagccggtgtcctggagggagggccccagtgggcacagcacactgcctcggtctccccgagatgccccatgcagtgcttcgtcagagttgtctggtccctccacgcccctgcacaccagcagtccagtccagggcaaggaaagcacccggcgacaggacaccaggtcccccacctcagcgcccactcagagactgagtcctggcgaggccttgccccctgtttcccaggcaggcaccggaaaggcccctgagctgccgtcgggaagtgggcctgagcctctggcccctagcccagtctctccgaccttccctcccagctcgcccagtgactggcctcaggaaaggagtccagggggccactcagatggcgccagtcctcggagccctgtgcccaccacacttcctggcctccgccacgccccctggcaaggccctcgaggcccccccgacagcccagatgggtctcccctcactcctgtgccttcccagatgccctggcttgtggccagcccagagccgcctcagagctcacctacacctgctttccccctggctgcctcctatgacaccaatggccttagccagcccccacttcctgagaaacgccacctgcccgggccggggcaacagccaggaccctggggcccagagcaggcatcatcgccagccagaggcatcagtcaccatgtcaccttcgcacctctgctctcagataatgtcccccaaaccccaggtataaaggccttgagggggttggtgccaccttgagagaaccctttctcctgggatgtagcatggatggggacccgggtaccctggggtctgaacctactccctccctgtcctagagcctcctacacaagagagccaaagcaatgtcaagtttgtccaggatacatccaagttctggtacaagccacacctgtcccgtgaccaagccattgccctgctgaaggacaaggaccctggggccttcctgatcagggacagtcattcattccaaggagcttatgggctggccctcaaggtggccacaccgccacccagtgcccagccctggaaaggggaccccgtggaacagctggtccgccatttcctcatcgagactgggcccaaaggggtgaagatcaagggctgccccagtgagccctactttggcagcctgtccgccttggtctcccagcactccatctcccccatctccctgccctgctgcctgcgcattcccagcaaagatcctctggaagagaccccagaggctccagtgcccaccaacatgagcacagcggcagacctcctgcgtcagggtgctgcctgcagcgtgctctacttgacctcagtggagacagagtcactgacgggcccccaagctgtggcccgggccagctctgcagctctgagctgtagcccccgcccgacaccagctgttgtccacttcaaggtgtcagcccagggcattacactgacggacaaccaaaggaagctcttctttcgccgccattatccagtgaacagcatcaccttctccagcactgaccctcaagaccggagatggaccaacccagacgggaccacctccaagatctttggtttcgtggccaagaagccgggaagcccctgggagaatgtgtgtcacctctttgcagagcttgacccagatcagcctgctggcgccattgtcaccttcatcaccaaagttctactgggccagagaaaatgaaggaaggccacaagctcagagcccacatcaacactgcccccctcccagcaccccacagccctcacatcccctggcctggacccaggagacccaggagaaagcaccctcccttaggaatgaggagtgggcatcaggcctgggacactgctctccttccccgcccccagcctgctaagttaagtggacaggcccacaagatgaccttgcatgtgagcagatggcagagatgggtgtgtgaggggtgaggaggcatcagcagttgagccccgaaggagatcaggcagccccacctgcaggagaacgtcagccctccaggggatcagcccctgccagttccacccagctgcaggtgccagcacggcagggatgggagaggggtggggagcgagtcactgcctcctctgagcagagattcagagtaggatcacatgaataggggaaaaaagagagtctatttttgtctaataataaagaatttctataaactttagccga

SEQ ID NO: 295350 - DNA, 6089 bp, Homo sapiens
gctgaggaaggagagcagacccaggagagccatgaagcctaggaaagctgagcctcatagcttccgggagaaggttttccggaagaaacctccagtctgtgcagtatgtaaggtgaccatcgatgggacaggcgtttcgtgcagagtctgcaaggtggcgacgcacagaaaatgtgaagcaaaggtgacttcagcctgtcaggccttgcctcccgtggagttgcggcgaaacacggccccagtcaggcgcatagagcacctgggatccaccaaatctctgaaccactcaaagcagcgcagcactctgcccaggagcttcagcctggacccgctcatggagcggcgctgggacttagacctcacctacgtgacggagcgcatcttggccgccgccttccccgcgcggcccgatgaacagcggcaccggggccacctgcgcgagctggcccatgtgctgcaatccaagcaccgggacaagtacctgctcttcaacctttcagagaaaaggcatgacctgacccgcttaaaccccaaggttcaagacttcggctggcctgagctgcatgctccacccctggacaagctgtgctccatctgcaaagccatggagacatggctcagtgctgacccacagcacgtggtcgtactatactgcaagggaaacaagggcaagcttggggtcatcgtttctgcctacatgcactacagcaagatctctgcaggggcggaccaggcactggccactcttaccatgcggaaattctgcgaggacaaggtggccacagaactgcagccctcccagcgtcgatatatcagctacttcagtgggctgctatctggctccatcagaatgaacagcagccctctcttcctgcactatgtgctcatccccatgctgccagcctttgaacctggcacaggcttccagcccttccttaaaatctaccagtccatgcagcttgtctacacatctggagtctatcacattgcaggccctggtccccagcagctttgcatcagcctggagccagccctcctcctcaaaggcgatgtcatggtaacatgttatcacaagggtggccggggcacagaccggaccctcgtgttccgagtccagttccacacctgcaccatccacggaccacagctcactttccccaaggaccagcttgacgaggcctggactgatgagaggttccccttccaagcctccgtggagtttgtcttctcctccagccccgagaagatcaaaggcagcactccacggaacgacccctcggtctctgtcgactacaacaccactgagccagccgtgcgctgggactcctatgagaacttcaaccagcaccacgaggacagtgtggatggctccttgacccacacccggggtcccctggatggcagtccttatgcccaggtgcagcggcctccccggcagacccccccggcaccctctccagagcctccaccaccccccatgctctctgtcagcagcgactcaggccattcctccacgctgaccacagagccggctgctgagtcccctggccggccgccccctacagctgctgaacggcaggagctggatcgcctcctaggaggctgcggagtggccagtgggggccggggagctgggcgcgagacggccatcctagatgacgaagagcagcccactgtgggcggaggcccccacctcggagtgtatccaggccataggcctggcctcagccgccactgctcctgccgccagggctaccgggagccctgcggggttcccaatgggggctactaccggccagagggaaccctggagaggaggcgactggcctacgggggctatgagggatccccccagggctacgccgaggcctcgatggagaagaggcgcctctgccgatcgctgtcagaggggctatacccctacccacctgagatggggaaaccagccactggggactttggctaccgcgccccaggctaccgggaggtggtcatcctggaggaccctgggctgcctgccctatacccatgcccagcctgcgaggagaagctggcgctgcctacagcagccttgtatggactgcggctggagagggaggctggagaagggtgggcaagtgaggctggcaagcctctcctgcacccagtgcggcctgggcacccgctgcctctgctcttgcctgcctgtgggcatcaccatgccccgatgcctgactacagctgcctgaagccacccaaggcaggcgaggaagggcacgagggctgctcctacaccatgtgccccgaaggcaggtatgggcatccagggtaccctgccctggtgacatacagctatggaggagcagttcccagttactgcccagcatatggccgtgtgcctcatagctgtggctctccaggagagggcagagggtatcccagccctggtgcccactccccacgggctggctccatttccccgggcagcccgccctatccacaatctaggaagctgagctacgagatccctacggaggagggaggggacaggtacccattgcctgggcacctggcctcagcaggacctttggcatctgcagagtcgctggagccggtgtcctggagggagggccccagtgggcacagcacactgcctcggtctccccgagatgccccatgcagtgcttcgtcagagttgtctggtccctccacgcccctgcacaccagcagtccagtccagggcaaggaaagcacccggcgacaggacaccaggtcccccacctcagcgcccactcagagactgagtcctggcgaggccttgccccctgtttcccaggcaggcaccggaaaggcccctgagctgccgtcgggaagtgggcctgagcctctggcccctagcccagtctctccgaccttccctcccagctcgcccagtgactggcctcaggaaaggagtccagggggccactcagatggcgccagtcctcggagccctgtgcccaccacacttcctggcctccgccacgccccctggcaaggccctcgaggcccccccgacagcccagatgggtctcccctcactcctgtgccttcccagatgccctggcttgtggccagcccagagccgcctcagagctcacctacacctgctttccccctggctgcctcctatgacaccaatggccttagccagcccccacttcctgagaaacgccacctgcccgggccggggcaacagccaggaccctggggcccagagcaggcatcatcgccagccagaggcatcagtcaccatgtcaccttcgcacctctgctctcagataatgtcccccaaaccccagagcctcctacacaagagagccaaagcaatgtcaagtttgtccaggatacatccaagttctggtacaagccacacctgtcccgtgaccaagccattgccctgctgaaggacaaggaccctggggccttcctgatcagggacagtcattcattccaaggagcttatgggctggccctcaaggtggccacaccgccacccagtgcccagccctggaaaggggaccccgtggaacagctggtccgccatttcctcatcgagactgggcccaaaggggtgaagatcaagggctgccccagtgagccctactttggcagcctgtccgccttggtctcccagcactccatctcccccatctccctgccctgctgcctgcgcattcccagcaaagatcctctggaagagaccccagaggctccagtgcccaccaacatgagcacagcggcagacctcctgcgtcagggtgctgcctgcagcgtgctctacttgacctcagtggagacagagtcactgacgggcccccaagctgtggcccgggccagctctgcagctctgagctgtagcccccgcccgacaccagctgttgtccacttcaaggtgtcagcccagggcattacactgacggacaaccaaaggaagctcttctttcgccgccattatccagtgaacagcatcaccttctccagcactgaccctcaagaccggagatggaccaacccagacgggaccacctccaagatctttggtttcgtggccaagaagccgggaagcccctgggagaatgtgtgtcacctctttgcagagcttgacccagatcagcctgctggcgccattgtcaccttcatcaccaaagttctactgggccagagaaaatgaaggaaggccacaagctcagagcccacatcaacactgcccccctcccagcaccccacagccctcacatcccctggcctggacccaggagacccaggagaaagcaccctcccttaggaatgaggagtgggcatcaggcctgggacactgctctccttccccgcccccagcctgctaagttaagtggacaggcccacaagatgaccttgcatgtgagcagatggcagagatgggtgtgtgaggggtgaggaggcatcagcagttgagccccgaaggagatcaggcagccccacctgcaggagaacgtcagccctccaggggatcagcccctgccagttccacccagctgcaggtgccagcacggcagggatgggagaggggtggggagcgagtcactgcctcctctgagcagagattcagagtaggatcacatgaataggggaaaaaagagagtctatttttgtctaataataaagaatttctataaactttagccgaaattggagtcaacacttattcacaggaaggtcaaagcctcatctcccaggggacgtatctgtgctcaggcctgtagccaggcccatggaacatatgattcccatccctggcccaacattggtccacatctccccatgagcaagctgccttcggctgcccccatccagcagtcctgttcctagcccagtggactagaaaggctcctggttccggccatactgataaatacggaaactccatctttatcggctgtataaacatctctggtctgtacatacatttcatacatcgtagggtgggaagcgagggccaaagggaggcccagcagcacaacagctcacccgctttccctacagccctacccgctctgtgcaaaccaaggccaacagctcctgctgcctcttcctccctggaaaagtcactgttacggggagggggccaggggttgaaggattagaaggagatagagggcttggtggggaggacacatgtaagtgctagaatcaaacactgaagcgaaacaggcaactggcacaagcagcaagctgaggcatgggacggggcaggaaaaggggagggaggggccacgctgcccctctgggcttgctcagctaaggctctggggtcttgccctcacgctggcagggagacaggccccagagcctcagccccaatacccgggagctagggacatgggtggcactggtaaagaaaggatggaaggggagaaaggagtgaaggccctagtgccctgtcacctcacagcccctctctcttaaacatgcaacaggcacccacccatgtgggtccaggtatggggagccagagacctagatcctctgtggtgcctgagcaggttggggtggggagccagctctcaagggaaagatggagagcctagaggagtcttcctggggcagcagccagtgaaaggacagagatgaccaaagagaggtcccctggccctgccaggggtatgacagcagcaactggttcacacaaccaggaaagaaaacaagaaagaggaattcaaggagaaataccatggtgagtaggggagggggctgtctactctaccctctacaaagcatcatgcccgaatagcagctgagatagggtgctcacgcctctccacccacacagggccggtgagggaaagggggacccagaagcccactgaccaaagcgagtgggaccacccacataccaacaccattctttgggtccattcctgtccaaccagggactcaggcccagggactgacaacagtggcagcaccaggtcagaaacgtgggcacagagaagcgtgacaggggcctgagccagtgggggcagagtgactacacacctccttggtgcctctggcctccttggtgcctctggcctccttggtgcctctgg

SEQ ID NO: 295351 - DNA, 1301 bp, Homo sapiens
tgatcgagatcggtaccaactccgccattgccctgctgaaggacaaggaccctggggccttcctgatcagggacagtcattcattccaaggagcttatgggctggccctcaaggtggccacaccgccacccagtgcccagccctggaaaggggaccccgtggaacagctggtccgccatttcctcatcgagactgggcccaaaggggtgaagatcaagggctgccccagtgagccctactttggcagcctgtccgccttggtctcccagcactccatctcccccatctccctgccctgctgcctgcgcattcccagcaaagatcctctggaagagaccccagaggctccagtgcccaccaacatgagcacagcggcagacctcctgcgtcagggtgctgcctgcagcgtgctctacttgacctcagtggagacagagtcactgacgggcccccaagctgtggcccgggccagctctgcagctctgagctgtagcccccgcccgacaccagctgttgtccacttcaaggtgtcagcccagggcattacactgacggacaaccaaaggaagctcttctttcgccgccattatccagtgaacagcatcaccttctccagcactgaccctcaagaccggagatggaccaacccagacgggaccacctccaagatctttggtttcgtggccaagaagccgggaagcccctgggagaatgtgtgtcacctctttgcagagcttgacccagatcagcctgctggcgccattgtcaccttcatcaccaaagttctactgggccagagaaaatgaaggaaggccacaagctcagagcccacatcaacactgcccccctcccagcaccccacagccctcacatcccctggcctggacccaggagacccaggagaaagcaccctcccttaggaatgaggagtgggcatcaggcctgggacactgctctccttccccgcccccagcctgctaagttaagtggacaggcccacaagatgaccttgcatgtgagcagatggcagagatgggtgtgtgaggggtgaggaggcatcagcagttgagccccgaaggagatcaggcagccccacctgcaggagaacgtcagccctccaggggatcagcccctgccagttccacccagctgcaggtgccagcacggcagggatgggagaggggtggggagcgagtcactgcctcctctgagcagagattcagagtaggatcacatgaataggggaaaaaagagagtctatttttgtctaataataaagaatttctataaactttagccga

SEQ ID NO: 295352 - DNA, 5422 bp, Homo sapiens
gctgaggaaggagagcagacccaggagagccatgaagcctaggaaagctgagcctcatagcttccgggagaaggttttccggaagaaacctccagtctgtgcagtatgtaaggtgaccatcgatgggacaggcgtttcgtgcagagtctgcaaggtggcgacgcacagaaaatgtgaagcaaaggtgacttcagcctgtcaggccttgcctcccgtggagttgcggcgaaacacggccccagtcaggcgcatagagcacctgggatccaccaaatctctgaaccactcaaagcagcgcagcactctgcccaggagcttcagcctggacccgctcatggagcggcgctgggacttagacctcacctacgtgacggagcgcatcttggccgccgccttccccgcgcggcccgatgaacagcggcaccggggccacctgcgcgagctggcccatgtgctgcaatccaagcaccgggacaagtacctgctcttcaacctttcagagaaaaggcatgacctgacccgcttaaaccccaaggttcaagacttcggctggcctgagctgcatgctccacccctggacaagctgtgctccatctgcaaagccatggagacatggctcagtgctgacccacagcacgtggtcgtactatactgcaagggaaacaagggcaagcttggggtcatcgtttctgcctacatgcactacagcaagatctctgcaggggcggaccaggcactggccactcttaccatgcggaaattctgcgaggacaaggtggccacagaactgcagccctcccagcgtcgatatatcagctacttcagtgggctgctatctggctccatcagaatgaacagcagccctctcttcctgcactatgtgctcatccccatgctgccagcctttgaacctggcacaggcttccagcccttccttaaaatctaccagtccatgcagcttgtctacacatctggagtctatcacattgcaggccctggtccccagcagctttgcatcagcctggagccagccctcctcctcaaaggcgatgtcatggtaacatgttatcacaagggtggccggggcacagaccggaccctcgtgttccgagtccagttccacacctgcaccatccacggaccacagctcactttccccaaggaccagcttgacgaggcctggactgatgagaggttccccttccaagcctccgtggagtttgtcttctcctccagccccgagaagatcaaaggcagcactccacggaacgacccctcggtctctgtcgactacaacaccactgagccagccgtgcgctgggactcctatgagaacttcaaccagcaccacgaggacagtgtggatggctccttgacccacacccggggtcccctggatggcagtccttatgcccaggtgcagcggcctccccggcagacccccccggcaccctctccagagcctccaccaccccccatgctctctgtcagcagcgactcaggccattcctccacgctgaccacagagccggctgctgagtcccctggccggccgccccctacagctgctgaacggcaggagctggatcgcctcctaggaggctgcggagtggccagtgggggccggggagctgggcgcgagacggccatcctagatgacgaagagcagcccactgtgggcggaggcccccacctcggagtgtatccaggccataggcctggcctcagccgccactgctcctgccgccagggctaccgggagccctgcggggttcccaatgggggctactaccggccagagggaaccctggagaggaggcgactggcctacgggggctatgagggatccccccagggctacgccgaggcctcgatggagaagaggcgcctctgccgatcgctgtcagaggggctatacccctacccacctgagatggggaaaccagccactggggactttggctaccgcgccccaggctaccgggaggtggtcatcctggaggaccctgggctgcctgccctatacccatgcccagcctgcgaggagaagctggcgctgcctacagcagccttgtatggactgcggctggagagggaggctggagaagggtgggcaagtgaggctggcaagcctctcctgcacccagtgcggcctgggcacccgctgcctctgctcttgcctgcctgtgggcatcaccatgccccgatgcctgactacagctgcctgaagccacccaaggcaggcgaggaagggcacgagggctgctcctacaccatgtgccccgaaggcaggtatgggcatccagggtaccctgccctggtgacatacagctatggaggagcagttcccagttactgcccagcatatggccgtgtgcctcatagctgtggctctccaggagagggcagagggtatcccagccctggtgcccactccccacgggctggctccatttccccgggcagcccgccctatccacaatctaggaagctgagctacgagatccctacggaggagggaggggacaggtacccattgcctgggcacctggcctcagcaggacctttggcatctgcagagtcgctggagccggtgtcctggagggagggccccagtgggcacagcacactgcctcggtctccccgagatgccccatgcagtgcttcgtcagagttgtctggtccctccacgcccctgcacaccagcagtccagtccagggcaaggaaagcacccggcgacaggacaccaggtcccccacctcagcgcccactcagagactgagtcctggcgaggccttgccccctgtttcccaggcaggcaccggaaaggcccctgagctgccgtcgggaagtgggcctgagcctctggcccctagcccagtctctccgaccttccctcccagctcgcccagtgactggcctcaggaaaggagtccagggggccactcagatggcgccagtcctcggagccctgtgcccaccacacttcctggcctccgccacgccccctggcaaggccctcgaggcccccccgacagcccagatgggtctcccctcactcctgtgccttcccagatgccctggcttgtggccagcccagagccgcctcagagctcacctacacctgctttccccctggctgcctcctatgacaccaatggccttagccagcccccacttcctgagaaacgccacctgcccgggccggggcaacagccaggaccctggggcccagagcaggcatcatcgccagccagaggcatcagtcaccatgtcaccttcgcacctctgctctcagataatgtcccccaaaccccagagcctcctacacaagagagccaaagcaatgtcaagtttgtccaggatacatccaagttctggtacaagccacacctgtcccgtgaccaagccattgccctgctgaaggacaaggaccctggggccttcctgatcagggacagtcattcattccaaggagcttatgggctggccctcaaggtggccacaccgccacccagtgcccagccctggaaaggggaccccgtggaacagctggtccgccatttcctcatcgagactgggcccaaaggggtgaagatcaagggctgccccagtgagccctactttggcagcctgtccgccttggtctcccagcactccatctcccccatctccctgccctgctgcctgcgcattcccagcaaagatcctctggaagagaccccagaggctccagtgcccaccaacatgagcacagcggcagacctcctgcgtcagggtgctgcctgcagcgtgctctacttgacctcagtggagacagagtcactgacgggcccccaagctgtggcccgggccagctctgcagctctgagctgtagcccccgcccgacaccagctgttgtccacttcaaggtgtcagcccagggcattacactgacggacaaccaaaggaagctcttctttcgccgccattatccagtgaacagcatcaccttctccagcactgaccctcaagaccggagatggaccaacccagacgggaccacctccaagatctttggtttcgtggccaagaagccgggaagcccctgggagaatgtgtgtcacctctttgcagagcttgacccagatcagcctgctggcgccattgtcaccttcatcaccaaagttctactgggccagagaaaatgaaggaaggccacaagctcagagcccacatcaacactgcccccctcccagcaccccacagccctcacatcccctggcctggacccaggagacccaggagaaagcaccctcccttaggaatgaggagtgggcatcaggcctgggacactgctctccttccccgcccccagcctgctaagttaagtggacaggcccacaagatgaccttgcatgtgagcagatggcagagatgggtgtgtgaggggtgaggaggcatcagcagttgagccccgaaggagatcaggcagccccacctgcaggagaacgtcagccctccaggggatcagcccctgccagttccacccagctgcaggtgccagcacggcagggatgggagaggggtggggagcgagtcactgcctcctctgagcagagattcagagtaggatcacatgaataggggaaaaaagagagtctatttttgtctaataataaagaatttctataaactttagccgaaattggagtcaacacttattcacaggaaggtcaaagcctcatctcccaggggacgtatctgtgctcaggcctgtagccaggcccatggaacatatgattcccatccctggcccaacattggtccacatctccccatgagcaagctgccttcggctgcccccatccagcagtcctgttcctagcccagtggactagaaaggctcctggttccggccatactgataaatacggaaactccatctttatcggctgtataaacatctctggtctgtacatacatttcatacatcgtagggtgggaagcgagggccaaagggaggcccagcagcacaacagctcacccgctttccctacagccctacccgctctgtgcaaaccaaggccaacagctcctgctgcctcttcctccctggaaaagtcactgttacggggagggggccaggggttgaaggattagaaggagatagagggcttggtggggaggacacatgtaagtgctagaatcaaacactgaagcgaaacaggcaactggcacaagcagcaagctgaggcatgggacggggcaggaaaaggggagggaggggccacgctgcccctctgggcttgctcagctaaggctctggggtcttgccctcacgctggcagggagacaggccccagagcctcagccccaatacccgggagctagggacatgggcggacaattttgatctcaattttccctgcagctgtgag

SEQ ID NO: 295353 - DNA, 2730 bp, Homo sapiens
cggacgcgtccgcccacgcgtccggcctgcgcattcccagcaaagatcctctggaagagaccccagaggctccagtgcccaccaacatgagcacagcggcagacctcctgcgtcagggtgctgcctgcagcgtgctctacttgacctcagtggagacagagtcactgacgggcccccaagctgtggcccgggccagctctgcagctctgagctgtagcccccgcccgacaccagctgttgtccacttcaaggtgtcagcccagggcattacactgacggacaaccaaaggaagctcttctttcgccgccattatccagtgaacagcatcaccttctccagcactgaccctcaagaccggagatggaccaacccagacgggaccacctccaagatctttggtttcgtggccaagaagccgggaagcccctgggagaatgtgtgtcacctctttgcagagcttgacccagatcagcctgctggcgccattgtcaccttcatcaccaaagttctactgggccagagaaaatgaaggaaggccacaagctcagagcccacatcaacactgcccccctcccagcaccccacagccctcacatcccctggcctggacccaggagacccaggagaaagcaccctcccttaggaatgaggagtgggcatcaggcctgggacactgctctccttccccgcccccagcctgctaagttaagtggacaggcccacaagatgaccttgcatgtgagcagatggcagagatgggtgtgtgaggggtgaggaggcatcagcagttgagccccgaaggagatcaggcagccccacctgcaggagaacgtcagccctccagggatgggagaggggtggggagcgagtcactgcctcctctgagcagagattcagagtaggatcacatgaataggggaaaaaagagagtctatttttgtctaataataaagaatttctataaactttagccgaaattggagtcaacacttattcacaggaaggtcaaagcctcatctcccaggggacgtatctgtgctcaggcctgtagccaggcccatggaacatatgattcccatccctggcccaacattggtccacatctccccatgagcaagctgccttcggctgcccccatccagcagtcctgttcctagcccagtggactagaaaggctcctggttccggccatactgataaatacggaaactccatctttatcggctgtataaacatctctggtctgtacatacatttcatacatcgtagggtgggaagcgagggccaaagggaggcccagcagcacaacagctcacccgctttccctacagccctacccgctctgtgcaaaccaaggccaacagctcctgctgcctcttcctccctggaaaagtcactgttacggggagggggccaggggttgaaggattagaaggagatagagggcttggtggggaggacacatgtaagtgctagaatcaaacactgaagcgaaacaggcaactggcacaagcagcaagctgaggcatgggacggggcaggaaaaggggagggaggggccacgctgcccctctgggcttgctcagctaaggctctggggtcttgccctcacgctggcagggagacaggccccagagcctcagccccaatacccgggagctagggacatgggtggcactggtaaagaaaggatggaaggggagaaaggagtgaaggccctagtgccctgtcacctcacagcccctctctcttaaacatgcaacaggcacccacccatgtgggtccaggtatggggagccagagacctagatcctctgtggtgcctgagcaggttggggtggggagccagctctcaagggaaagatggagagcctagaggagtcttcctggggcagcagccagtgaaaggacagagatgaccaaagagaggtcccctggccctgccaggggtatgacagcagcaactggttcacacaaccaggaaagaaaacaagaaagaggaattcaaggagaaataccatggtgagtaggggagggggctgtctactctaccctctacaaagcatcatgcccgaatagcagctgagatagggtgctcacgcctctccacccacacagggccggtgagggaaagggggacccagaagcccactgaccaaagcgagtgggaccacccacataccaacaccattctttgggtccattcctgtccaaccagggactcaggcccagggactgacaacagtggcagcaccaggtcagaaacgtgggcacagagaagcgtgacaggggcctgagccagtgggggcagagtgactacacacctccaggggcctgctgggtaaacgaagcctctgggaagtcaggaactgggtgcctggcccagcagagggtgagcagggagaaggagcaggtctggaggggaggccctagccactcaaggggtgcagatctactttgactttctccccgcagctcagcattccaatggtggggaagaagcctccagaaggaacaacagcatccttcttcccaatgatcttgccattccgagtgaagaaaaccaccaccttcctgccctcatgctccggctctatctcttccccatcctcttcctcttcctcttcctcctcttcctcttccccttcctggtgcaggtacatgacattccgcacgttccggacggcccgggcagtcggagacaggatcactgtgtcacaactgtcatc

SEQ ID NO: 295354 - DNA, 5162 bp, Homo sapiens
gctgaggaaggagagcagacccaggagagccatgaagcctaggaaagctgagcctcatagcttccgggagaaggttttccggaagaaacctccagtctgtgcagtatgtaaggtgaccatcgatgggacaggcgtttcgtgcagagtctgcaaggtggcgacgcacagaaaatgtgaagcaaaggtgacttcagcctgtcaggccttgcctcccgtggagttgcggcgaaacacggccccagtcaggcgcatagagcacctgggatccaccaaatctctgaaccactcaaagcagcgcagcactctgcccaggagcttcagcctggacccgctcatggagcggcgctgggacttagacctcacctacgtgacggagcgcatcttggccgccgccttccccgcgcggcccgatgaacagcggcaccggggccacctgcgcgagctggcccatgtgctgcaatccaagcaccgggacaagtacctgctcttcaacctttcagagaaaaggcatgacctgacccgcttaaaccccaaggttcaagacttcggctggcctgagctgcatgctccacccctggacaagctgtgctccatctgcaaagccatggagacatggctcagtgctgacccacagcacgtggtcgtactatactgcaagggaaacaagggcaagcttggggtcatcgtttctgcctacatgcactacagcaagatctctgcaggggcggaccaggcactggccactcttaccatgcggaaattctgcgaggacaaggtggccacagaactgcagccctcccagcgtcgatatatcagctacttcagtgggctgctatctggctccatcagaatgaacagcagccctctcttcctgcactatgtgctcatccccatgctgccagcctttgaacctggcacaggcttccagcccttccttaaaatctaccagtccatgcagcttgtctacacatctggagtctatcacattgcaggccctggtccccagcagctttgcatcagcctggagccagccctcctcctcaaaggcgatgtcatggtaacatgttatcacaagggtggccggggcacagaccggaccctcgtgttccgagtccagttccacacctgcaccatccacggaccacagctcactttccccaaggaccagcttgacgaggcctggactgatgagaggttccccttccaagcctccgtggagtttgtcttctcctccagccccgagaagatcaaaggcagcactccacggaacgacccctcggtctctgtcgactacaacaccactgagccagccgtgcgctgggactcctatgagaacttcaaccagcaccacgaggacagtgtggatggctccttgacccacacccggggtcccctggatggcagtccttatgcccaggtgcagcggcctccccggcagacccccccggcaccctctccagagcctccaccaccccccatgctctctgtcagcagcgactcaggccattcctccacgctgaccacagagccggctgctgagtcccctggccggccgccccctacagctgctgaacggcaggagctggatcgcctcctaggaggctgcggagtggccagtgggggccggggagctgggcgcgagacggccatcctagatgacgaagagcagcccactgtgggcggaggcccccacctcggagtgtatccaggccataggcctggcctcagccgccactgctcctgccgccagggctaccgggagccctgcggggttcccaatgggggctactaccggccagagggaaccctggagaggaggcgactggcctacgggggctatgagggatccccccagggctacgccgaggcctcgatggagaagaggcgcctctgccgatcgctgtcagaggggctatacccctacccacctgagatggggaaaccagccactggggactttggctaccgcgccccaggctaccgggaggtggtcatcctggaggaccctgggctgcctgccctatacccatgcccagcctgcgaggagaagctggcgctgcctacagcagccttgtatggactgcggctggagagggaggctggagaagggtgggcaagtgaggctggcaagcctctcctgcacccagtgcggcctgggcacccgctgcctctgctcttgcctgcctgtgggcatcaccatgccccgatgcctgactacagctgcctgaagccacccaaggcaggcgaggaagggcacgagggctgctcctacaccatgtgccccgaaggcaggtatgggcatccagggtaccctgccctggtgacatacagctatggaggagcagttcccagttactgcccagcatatggccgtgtgcctcatagctgtggctctccaggagagggcagagggtatcccagccctggtgcccactccccacgggctggctccatttccccgggcagcccgccctatccacaatctaggaagctgagctacgagatccctacggaggagggaggggacaggtacccattgcctgggcacctggcctcagcaggacctttggcatctgcagagtcgctggagccggtgtcctggagggagggccccagtgggcacagcacactgcctcggtctccccgagatgccccatgcagtgcttcgtcagagttgtctggtccctccacgcccctgcacaccagcagtccagtccagggcaaggaaagcacccggcgacaggacaccaggtcccccacctcagcgcccactcagagactgagtcctggcgaggccttgccccctgtttcccaggcaggcaccggaaaggcccctgagctgccgtcgggaagtgggcctgagcctctggcccctagcccagtctctccgaccttccctcccagctcgcccagtgactggcctcaggaaaggagtccagggggccactcagatggcgccagtcctcggagccctgtgcccaccacacttcctggcctccgccacgccccctggcaaggccctcgaggcccccccgacagcccagatgggtctcccctcactcctgtgccttcccagatgccctggcttgtggccagcccagagccgcctcagagctcacctacacctgctttccccctggctgcctcctatgacaccaatggccttagccagcccccacttcctgagaaacgccacctgcccgggccggggcaacagccaggaccctggggcccagagcaggcatcatcgccagccagaggcatcagtcaccatgtcaccttcgcacctctgctctcagataatgtcccccaaaccccagagcctcctacacaagagagccaaagcaatgtcaagtttgtccaggatacatccaagttctggtacaagccacacctgtcccgtgaccaagccattgccctgctgaaggacaaggaccctggggccttcctgatcagggacagtcattcattccaaggagcttatgggctggccctcaaggtggccacaccgccacccagtgcccagccctggaaaggggaccccgtggaacagctggtccgccatttcctcatcgagactgggcccaaaggggtgaagatcaagggctgccccagtgagccctactttggcagcctgtccgccttggtctcccagcactccatctcccccatctccctgccctgctgcctgcgcattcccagcaaagatcctctggaagagaccccagaggctccagtgcccaccaacatgagcacagcggcagacctcctgcgtcagggtgctgcctgcagcgtgctctacttgacctcagtggagacagagtcactgacgggcccccaagctgtggcccgggccagctctgcagctctgagctgtagcccccgcccgacaccagctgttgtccacttcaaggtgtcagcccagggcattacactgacggacaaccaaaggaagctcttctttcgccgccattatccagtgaacagcatcaccttctccagcactgaccctcaagaccggagatggaccaacccagacgggaccacctccaagatctttggtttcgtggccaagaagccgggaagcccctgggagaatgtgtgtcacctctttgcagagcttgacccagatcagcctgctggcgccattgtcaccttcatcaccaaagttctactgggccagagaaaatgaaggaaggccacaagctcagagcccacatcaacactgcccccctcccagcaccccacagccctcacatcccctggcctggacccaggagacccaggagaaagcaccctcccttaggaatgaggagtgggcatcaggcctgggacactgctctccttccccgcccccagcctgctaagttaagtggacaggcccacaagatgaccttgcatgtgagcagatggcagagatgggtgtgtgaggggtgaggaggcatcagcagttgagccccgaaggagatcaggcagccccacctgcaggagaacgtcagccctccaggggatcagcccctgccagttccacccagctgcaggtgccagcacggcagggatgggagaggggtggggagcgagtcactgcctcctctgagcagagattcagagtaggatcacatgaataggggaaaaaagagagtctatttttgtctaataataaagaatttctataaactttagccgaaattggagtcaacacttattcacaggaaggtcaaagcctcatctcccaggggacgtatctgtgctcaggcctgtagccaggcccatggaacatatgattcccatccctggcccaacattggtccacatctccccatgagcaagctgccttcggctgcccccatccagcagtcctgttcctagcccagtggactagaaaggctcctggttccggccatactgataaatacggaaactccatctttatcggctgtataaacatctctggtctgtacatacatttcatacatcgtagggtgggaagcgagggccaaagggaggcccagcagcacaacagctcacccgctttccctacagccctacccgctagtcccacagactctgacatcatgtagccggccccattcatcctcgtaactgtccaccatcatgacgctgtcgtcctcacggcccagctcagcgttgaggtgcagccg

SEQ ID NO: 295355 - DNA, 1727 bp, Homo sapiens
gaggagggcgagtgttggtggagtggtgtgcgtttgatgctcggggtggtcgggcgaggttgtgcgtggacgagtggtttggcttattgtgtgttggtttgtcgtgttgtttctttttttccgttgtgtttgtgttttgtttttttttgtgtttttttttttttttttgtttattgttgttgttttttttttttttttttacggaaactccatctttatcggctgtataaacatctctggtctgtacatacatttcatacatcgtagggtgggaagcgagggccaaagggaggcccagcagcacaacagctcacccgctttccctacagccctacccgctctgtgcaaaccaaggccaacagctcctgctgcctcttcctccctggaaaagtcactgttacggggagggggccaggggttgaaggattagaaggagatagagggcttggtggggaggacacatgtaagtgctagaatcaaacactgaagcgaaacaggcaactggcacaagcagcaagctgaggcatgggacggggcaggaaaaggggagggaggggccacgctgcccctctgggcttgctcagctaaggctctggggtcttgccctcacgctggcagggagacaggccccagagcctcagccccaatacccgggagctagggacatgggtggcactggtaaagaaaggatggaaggggagaaaggagtgaaggccctagtgccctgtcacctcacagcccctctctcttaaacatgcaacaggcacccacccatgtgggtccaggtatggggagccagagacctagatcctctgtggtgcctgagcaggttggggtggggagccagctctcaagggaaagatggagagcctagaggagtcttcctggggcagcagccagtgaaaggacagagatgaccaaagagaggtcccctggccctgccaggggtatgacagcagcaactggttcacacaaccaggaaagaaaacaagaaagaggaattcaaggagaaataccatggtgagtaggggagggggctgtctactctaccctctacaaagcatcatgcccgaatagcagctgagatagggtgctcacgcctctccacccacacagggccggtgagggaaagggggacccagaagcccactgaccaaagcgagtgggaccacccacataccaacaccattctttgggtccattcctgtccaaccagggactcaggcccagggactgacaacagtggcagcaccaggtcagaaacgtgggcacagagaagcgtgacaggggcctgagccagtgggggcagagtgactacacacctccaggggcctgctgggtaaacgaagcctctgggaagtcaggaactgggtgcctggcccagcagagggtgagcagggagaaggagcaggtctggaggggaggccctagccactcaaggggtgcagatctactttgactttctccccgcagctcagcattccaatggtggggaagaagcctccagaaggaacaacagcatccttcttcccaatgatcttgccattccgagtgaagaaaaccaccaccttcctgccctcatgctccggctctatctcttccccatcctcttcctcttcctcttcctcctcttcctcttccccttcctggtgcaggtacatgacattccgcacgttccggacggcccgggcagtcggagacaggatcactgtgtcacaactgtcatc

SEQ ID NO: 295356 - DNA, 499 bp, Homo sapiens
gcagggaggcttctctgcctcgcttctgactgtagatccagtagagtcatggaatctgcctttttaacaagtcacctatgtgattgtaaagcatgtgacagcagtagctggggaatgtgcaagagctggtgggggtggctaggggatgggcactccctccctgacccactccctgcccctgtagcctgcagcgtgctctacttgacctcagtggagacagagtcactgacgggcccccaagctgtggcccgggccagctctgcagctctgagctgtagcccccgcccgacaccagctgttgtccacttcaaggtgtcagcccagggcattacactgacggacaaccaaaggaagtatgtatactcagccctgtagaaccccatgcttaaggcccctgggggctcatgtttctgagtgtgaccttcctcaccctcctccttgcaggctcttctttcgccgccattatccagtgaacagcatcaccttctccagcactgac

SEQ ID NO: 295357 - DNA, 406 bp, Homo sapiens
aacaagggcaagcttggggtcatcgtttctgcctacatgcactacagcaagatctctgcagggtgaggctcccagcgcctgagtagctgcttccccagtggccctttctccagctggccccttaggaacccatctcccctggagcccacctcttcgttgagagtcctttgctgtcagcttagcacttccacctcccttttatcactagtactgcaacatagtctgcagcagatggtctgtagagtttcctggggcagccacaaacagggtggtgtaaaacagtggaaatgggccgggtgcgttggctcacgcctgtaataccagcactttgggaggctgaggtgggcaggtcacctgaggtcaggagtttgaaactagcctggccaggtgaaaccccatctctacc

SEQ ID NO: 295358 - DNA, 4492 bp, Homo sapiens
gctgaggaaggagagcagacccaggagagccatgaagcctaggaaagctgagcctcatagcttccgggagaaggttttccggaagaaacctccagtctgtgcagtatgtaaggtgaccatcgatgggacaggcgtttcgtgcagagtctgcaaggtggcgacgcacagaaaatgtgaagcaaaggtgacttcagcctgtcaggccttgcctcccgtggagttgcggcgaaacacggccccagtcaggcgcatagagcacctgggatccaccaaatctctgaaccactcaaagcagcgcagcactctgcccaggagcttcagcctggacccgctcatggagcggcgctgggacttagacctcacctacgtgacggagcgcatcttggccgccgccttccccgcgcggcccgatgaacagcggcaccggggccacctgcgcgagctggcccatgtgctgcaatccaagcaccgggacaagtacctgctcttcaacctttcagagaaaaggcatgacctgacccgcttaaaccccaaggttcaagacttcggctggcctgagctgcatgctccacccctggacaagctgtgctccatctgcaaagccatggagacatggctcagtgctgacccacagcacgtggtcgtactatactgcaagggaaacaagggcaagcttggggtcatcgtttctgcctacatgcactacagcaagatctctgcaggggcggaccaggcactggccactcttaccatgcggaaattctgcgaggacaaggtggccacagaactgcagccctcccagcgtcgatatatcagctacttcagtgggctgctatctggctccatcagaatgaacagcagccctctcttcctgcactatgtgctcatccccatgctgccagcctttgaacctggcacaggcttccagcccttccttaaaatctaccagtccatgcagcttgtctacacatctggagtctatcacattgcaggccctggtccccagcagctttgcatcagcctggagccagccctcctcctcaaaggcgatgtcatggtaacatgttatcacaagggtggccggggcacagaccggaccctcgtgttccgagtccagttccacacctgcaccatccacggaccacagctcactttccccaaggaccagcttgacgaggcctggactgatgagaggttccccttccaagcctccgtggagtttgtcttctcctccagccccgagaagatcaaaggcagcactccacggaacgacccctcggtctctgtcgactacaacaccactgagccagccgtgcgctgggactcctatgagaacttcaaccagcaccacgaggacagtgtggatggctccttgacccacacccggggtcccctggatggcagtccttatgcccaggtgcagcggcctccccggcagacccccccggcaccctctccagagcctccaccaccccccatgctctctgtcagcagcgactcaggccattcctccacgctgaccacagagccggctgctgagtcccctggccggccgccccctacagctgctgaacggcaggagctggatcgcctcctaggaggctgcggagtggccagtgggggccggggagctgggcgcgagacggccatcctagatgacgaagagcagcccactgtgggcggaggcccccacctcggagtgtatccaggccataggcctggcctcagccgccactgctcctgccgccagggctaccgggagccctgcggggttcccaatgggggctactaccggccagagggaaccctggagaggaggcgactggcctacgggggctatgagggatccccccagggctacgccgaggcctcgatggagaagaggcgcctctgccgatcgctgtcagaggggctatacccctacccacctgagatggggaaaccagccactggggactttggctaccgcgccccaggctaccgggaggtggtcatcctggaggaccctgggctgcctgccctatacccatgcccagcctgcgaggagaagctggcgctgcctacagcagccttgtatggactgcggctggagagggaggctggagaagggtgggcaagtgaggctggcaagcctctcctgcacccagtgcggcctgggcacccgctgcctctgctcttgcctgcctgtgggcatcaccatgccccgatgcctgactacagctgcctgaagccacccaaggcaggcgaggaagggcacgagggctgctcctacaccatgtgccccgaaggcaggaagctgagctacgagatccctacggaggagggaggggacaggtacccattgcctgggcacctggcctcagcaggacctttggcatctgcagagtcgctggagccggtgtcctggagggagggccccagtgggcacagcacactgcctcggtctccccgagatgccccatgcagtgcttcgtcagagttgtctggtccctccacgcccctgcacaccagcagtccagtccagggcaaggaaagcacccggcgacaggacaccaggtcccccacctcagcgcccactcagagactgagtcctggcgaggccttgccccctgtttcccaggcaggcaccggaaaggcccctgagctgccgtcgggaagtgggcctgagcctctggcccctagcccagtctctccgaccttccctcccagctcgcccagtgactggcctcaggaaaggagtccagggggccactcagatggcgccagtcctcggagccctgtgcccaccacacttcctggcctccgccacgccccctggcaaggccctcgaggcccccccgacagcccagatgggtctcccctcactcctgtgccttcccagatgccctggcttgtggccagcccagagccgcctcagagctcacctacacctgctttccccctggctgcctcctatgacaccaatggccttagccagcccccacttcctgagaaacgccacctgcccgggccggggcaacagccaggaccctggggcccagagcaggcatcatcgccagccagaggcatcagtcaccatgtcaccttcgcacctctgctctcagataatgtcccccaaaccccagagcctcctacacaagagagccaaagcaatgtcaagtttgtccaggatacatccaagttctggtacaagccacacctgtcccgtgaccaagccattgccctgctgaaggacaaggaccctggggccttcctgatcagggacagtcattcattccaaggagcttatgggctggccctcaaggtggccacaccgccacccagtgcccagccctggaaaggggaccccgtggaacagctggtccgccatttcctcatcgagactgggcccaaaggggtgaagatcaagggctgccccagtgagccctactttggcagcctgtccgccttggtctcccagcactccatctcccccatctccctgccctgctgcctgcgcattcccagcaaagatcctctggaagagaccccagaggctccagtgcccaccaacatgagcacagcggcagacctcctgcgtcagggtgctgcctgcagcgtgctctacttgacctcagtggagacagagtcactgacgggcccccaagctgtggcccgggccagctctgcagctctgagctgtagcccccgcccgacaccagctgttgtccacttcaaggtgtcagcccagggcattacactgacggacaaccaaaggaagctcttctttcgccgccattatccagtgaacagcatcaccttctccagcactgaccctcaagaccggagatggaccaacccagacgggaccacctccaagatctttggtttcgtggccaagaagccgggaagcccctgggagaatgtgtgtcacctctttgcagagcttgacccagatcagcctgctggcgccattgtcaccttcatcaccaaagttctactgggccagagaaaatgaaggaaggccacaagctcagagcccacatcaacactgcccccctcccagcaccccacagccctcacatcccctggcctggacccaggagacccaggagaaagcaccctcccttaggaatgaggagtgggcatcaggcctgggacactgctctccttccccgcccccagcctgctaagttaagtggacaggcccacaagatgaccttgcatgtgagcagatggcagagatgggtgtgtgaggggtgaggaggcatcagcagttgagccccgaaggagatcaggcagccccacctgcaggagaacgtcagccctccaggggatcagcccctgccagttccacccagctgcaggtgccagcacggcagggatgggagaggggtggggagcgagtcactgcctcctctgagcagagattcagagtaggatcacatgaataggggaaaaaagagagtctatttttgtctaataataaagaatttctataaactttagccga

SEQ ID NO: 295359 - DNA, 6441 bp, Homo sapiens
gctgaggaaggagagcagacccaggagagccatgaagcctaggaaagctgagcctcatagcttccgggagaaggttttccggaagaaacctccagtctgtgcagtatgtaaggtgaccatcgatgggacaggcgtttcgtgcagagtctgcaaggtggcgacgcacagaaaatgtgaagcaaaggtgacttcagcctgtcaggccttgcctcccgtggagttgcggcgaaacacggccccagtcaggcgcatagagcacctgggatccaccaaatctctgaaccactcaaagcagcgcagcactctgcccaggagcttcagcctggacccgctcatggagcggcgctgggacttagacctcacctacgtgacggagcgcatcttggccgccgccttccccgcgcggcccgatgaacagcggcaccggggccacctgcgcgagctggcccatgtgctgcaatccaagcaccgggacaagtacctgctcttcaacctttcagagaaaaggcatgacctgacccgcttaaaccccaaggttcaagacttcggctggcctgagctgcatgctccacccctggacaagctgtgctccatctgcaaagccatggagacatggctcagtgctgacccacagcacgtggtcgtactatactgcaagggaaacaagggcaagcttggggtcatcgtttctgcctacatgcactacagcaagatctctgcaggggcggaccaggcactggccactcttaccatgcggaaattctgcgaggacaaggtggccacagaactgcagccctcccagcgtcgatatatcagctacttcagtgggctgctatctggctccatcagaatgaacagcagccctctcttcctgcactatgtgctcatccccatgctgccagcctttgaacctggcacaggcttccagcccttccttaaaatctaccagtccatgcagcttgtctacacatctggagtctatcacattgcaggccctggtccccagcagctttgcatcagcctggagccagccctcctcctcaaaggcgatgtcatggtaacatgttatcacaagggtggccggggcacagaccggaccctcgtgttccgagtccagttccacacctgcaccatccacggaccacagctcactttccccaaggaccagcttgacgaggcctggactgatgagaggttccccttccaagcctccgtggagtttgtcttctcctccagccccgagaagatcaaaggcagcactccacggaacgacccctcggtctctgtcgactacaacaccactgagccagccgtgcgctgggactcctatgagaacttcaaccagcaccacgaggacagtgtggatggctccttgacccacacccggggtcccctggatggcagtccttatgcccaggtgcagcggcctccccggcagacccccccggcaccctctccagagcctccaccaccccccatgctctctgtcagcagcgactcaggccattcctccacgctgaccacagagccggctgctgagtcccctggccggccgccccctacagctgctgaacggcaggagctggatcgcctcctaggaggctgcggagtggccagtgggggccggggagctgggcgcgagacggccatcctagatgacgaagagcagcccactgtgggcggaggcccccacctcggagtgtatccaggccataggcctggcctcagccgccactgctcctgccgccagggctaccgggagccctgcggggttcccaatgggggctactaccggccagagggaaccctggagaggaggcgactggcctacgggggctatgagggatccccccagggctacgccgaggcctcgatggagaagaggcgcctctgccgatcgctgtcagaggggctatacccctacccacctgagatggggaaaccagccactggggactttggctaccgcgccccaggctaccgggaggtggtcatcctggaggaccctgggctgcctgccctatacccatgcccagcctgcgaggagaagctggcgctgcctacagcagccttgtatggactgcggctggagagggaggctggagaagggtgggcaagtgaggctggcaagcctctcctgcacccagtgcggcctgggcacccgctgcctctgctcttgcctgcctgtgggcatcaccatgccccgatgcctgactacagctgcctgaagccacccaaggcaggcgaggaagggcacgagggctgctcctacaccatgtgccccgaaggcaggtatgggcatccagggtaccctgccctggtgacatacagctatggaggagcagttcccagttactgcccagcatatggccgtgtgcctcatagctgtggctctccaggagagggcagagggtatcccagccctggtgcccactccccacgggctggctccatttccccgggcagcccgccctatccacaatctaggaagctgagctacgagatccctacggaggagggaggggacaggtacccattgcctgggcacctggcctcagcaggacctttggcatctgcagagtcgctggagccggtgtcctggagggagggccccagtgggcacagcacactgcctcggtctccccgagatgccccatgcagtgcttcgtcagagttgtctggtccctccacgcccctgcacaccagcagtccagtccagggcaaggaaagcacccggcgacaggacaccaggtcccccacctcagcgcccactcagagactgagtcctggcgaggccttgccccctgtttcccaggcaggcaccggaaaggcccctgagctgccgtcgggaagtgggcctgagcctctggcccctagcccagtctctccgaccttccctcccagctcgcccagtgactggcctcaggaaaggagtccagggggccactcagatggcgccagtcctcggagccctgtgcccaccacacttcctggcctccgccacgccccctggcaaggccctcgaggcccccccgacagcccagatgggtctcccctcactcctgtgccttcccagatgccctggcttgtggccagcccagagccgcctcagagctcacctacacctgctttccccctggctgcctcctatgacaccaatggccttagccagcccccacttcctgagaaacgccacctgcccgggccggggcaacagccaggaccctggggcccagagcaggcatcatcgccagccagaggcatcagtcaccatgtcaccttcgcacctctgctctcagataatgtcccccaaaccccagagcctcctacacaagagagccaaagcaatgtcaagtttgtccaggatacatccaagttctggtacaagccacacctgtcccgtgaccaagccattgccctgctgaaggacaaggaccctggggccttcctgatcagggacagtcattcattccaaggagcttatgggctggccctcaaggtggccacaccgccacccagtgcccagccctggaaaggggaccccgtggaacagctggtccgccatttcctcatcgagactgggcccaaaggggtgaagatcaagggctgccccagtgagccctactttggcagcctgtccgccttggtctcccagcactccatctcccccatctccctgccctgctgcctgcgcattcccagcaaagatcctctggaagagaccccagaggctccagtgcccaccaacatgagcacagcggcagacctcctgcgtcagggtgctgcctgcagcgtgctctacttgacctcagtggagacagagtcactgacgggcccccaagctgtggcccgggccagctctgcagctctgagctgtagcccccgcccgacaccagctgttgtccacttcaaggtgtcagcccagggcattacactgacggacaaccaaaggaagctcttctttcgccgccattatccagtgaacagcatcaccttctccagcactgaccctcaagaccggagatggaccaacccagacgggaccacctccaagatctttggtttcgtggccaagaagccgggaagcccctgggagaatgtgtgtcacctctttgcagagcttgacccagatcagcctgctggcgccattgtcaccttcatcaccaaagttctactgggccagagaaaatgaaggaaggccacaagctcagagcccacatcaacactgcccccctcccagcaccccacagccctcacatcccctggcctggacccaggagacccaggagaaagcaccctcccttaggaatgaggagtgggcatcaggcctgggacactgctctccttccccgcccccagcctgctaagttaagtggacaggcccacaagatgaccttgcatgtgagcagatggcagagatgggtgtgtgaggggtgaggaggcatcagcagttgagccccgaaggagatcaggcagccccacctgcaggagaacgtcagccctccaggggatcagcccctgccagttccacccagctgcaggtgccagcacggcagggatgggagaggggtggggagcgagtcactgcctcctctgagcagagattcagagtaggatcacatgaataggggaaaaaagagagtctatttttgtctaataataaagaatttctataaactttagccgaaattggagtcaacacttattcacaggaaggtcaaagcctcatctcccaggggacgtatctgtgctcaggcctgtagccaggcccatggaacatatgattcccatccctggcccaacattggtccacatctccccatgagcaagctgccttcggctgcccccatccagcagtcctgttcctagcccagtggactagaaaggctcctggttccggccatactgataaatacggaaactccatctttatcggctgtataaacatctctggtctgtacatacatttcatacatcgtagggtgggaagcgagggccaaagggaggcccagcagcacaacagctcacccgctttccctacagccctacccgctctgtgcaaaccaaggccaacagctcctgctgcctcttcctccctggaaaagtcactgttacggggagggggccaggggttgaaggattagaaggagatagagggcttggtggggaggacacatgtaagtgctagaatcaaacactgaagcgaaacaggcaactggcacaagcagcaagctgaggcatgggacggggcaggaaaaggggagggaggggccacgctgcccctctgggcttgctcagctaaggctctggggtcttgccctcacgctggcagggagacaggccccagagcctcagccccaatacccgggagctagggacatgggtggcactggtaaagaaaggatggaaggggagaaaggagtgaaggccctagtgccctgtcacctcacagcccctctctcttaaacatgcaacaggcacccacccatgtgggtccaggtatggggagccagagacctagatcctctgtggtgcctgagcaggttggggtggggagccagctctcaagggaaagatggagagcctagaggagtcttcctggggcagcagccagtgaaaggacagagatgaccaaagagaggtcccctggccctgccaggggtatgacagcagcaactggttcacacaaccaggaaagaaaacaagaaagaggaattcaaggagaaataccatggtgagtaggggagggggctgtctactctaccctctacaaagcatcatgcccgaatagcagctgagatagggtgctcacgcctctccacccacacagggccggtgagggaaagggggacccagaagcccactgaccaaagcgagtgggaccacccacataccaacaccattctttgggtccattcctgtccaaccagggactcaggcccagggactgacaacagtggcagcaccaggtcagaaacgtgggcacagagaagcgtgacaggggcctgagccagtgggggcagagtgactacacacctccaggggcctgctgggtaaacgaagcctctgggaagtcaggaactgggtgcctggcccagcagagggtgagcagggagaaggagcaggtctggaggggaggccctagccactcaaggggtgcagatctactttgactttctccccgcagctcagcattccaatggtggggaagaagcctccagaaggaacaacagcatccttcttcccaatgatcttgccattccgagtgaagaaaaccaccaccttcctgccctcatgctccggctctatctcttccccatcctcttcctcttcctcttcctcctcttcctcttccccttcctggtgcaggtacatgacattccgcacgttccggacggcccgggcagtcggagacaggatcactgtgtcacaactgtcatc

SEQ ID NO: 295360 - DNA, 1544 bp, Homo sapiens
ctcttggctcctcctgtctgagctgtgtttactcttggctgagtgtttaccagcaggtgattctgggctttgggccaaggcggtgagatccaacatggtcaaaacccctgtgaactctagagccctggcctcagactcttaccgccaccacagctgtcagggcagagaccatggagcttggcagcagaggaggggggctgcatggggctcagtccacccctgtgaaaactcctccccactgcccgctacccctcaccctgcagccatccattgccctgctgaaggacaaggaccctggggccttcctgatcagggacagtcattcattccaaggagcttatgggctggccctcaaggtggccacaccgccacccagtgcccagccctggaaaggggaccccgtggaacagctggtccgccatttcctcatcgagactgggcccaaaggggtgaagatcaagggctgccccagtgagccctactttggcagcctgtccgccttggtctcccagcactccatctcccccatctccctgccctgctgcctgcgcattcccagcaaagatcctctggaagagaccccagaggctccagtgcccaccaacatgagcacagcggcagacctcctgcgtcagggtgctgcctgcagcgtgctctacttgacctcagtggagacagagtcactgacgggcccccaagctgtggcccgggccagctctgcagctctgagctgtagcccccgcccgacaccagctgttgtccacttcaaggtgtcagcccagggcattacactgacggacaaccaaaggaagctcttctttcgccgccattatccagtgaacagcatcaccttctccagcactgaccctcaagaccggagatggaccaacccagacgggaccacctccaagatctttggtttcgtggccaagaagccgggaagcccctgggagaatgtgtgtcacctctttgcagagcttgacccagatcagcctgctggcgccattgtcaccttcatcaccaaagttctactgggccagagaaaatgaaggaaggccacaagctcagagcccacatcaacactgcccccctcccagcaccccacagccctcacatcccctggcctggacccaggagacccaggagaaagcaccctcccttaggaatgaggagtgggcatcaggcctgggacactgctctccttccccgcccccagcctgctaagttaagtggacaggcccacaagatgaccttgcatgtgagcagatggcagagatgggtgtgtgaggggtgaggaggcatcagcagttgagccccgaaggagatcaggcagccccacctgcaggagaacgtcagccctccaggggatcagcccctgccagttccacccagctgcaggtgccagcacggcagggatgggagaggggtggggagcgagtcactgcctcctctgagcagagattcagagtaggatcacatgaataggggaaaaaagagagtctatttttgtctaataataaagaatttctataaactttagccga

SEQ ID NO: 295361 - DNA, 1177 bp, Homo sapiens
ggcaggggagccccatactgtcggggatgaggaattgggtcctcagcctaggttctcaaagtctcatgaacaagacgatcatggggtggtagcagggaggcttctctgcctcgcttctgactgtagatccagtagagtcatggaatctgcctttttaacaagtcacctatgtgattgtaaagcatgtgacagcagtagctggggaatgtgcaagagctggtgggggtggctaggggatgggcactccctccctgacccactccctgcccctgtagcctgcagcgtgctctacttgacctcagtggagacagagtcactgacgggcccccaagctgtggcccgggccagctctgcagctctgagctgtagcccccgcccgacaccagctgttgtccacttcaaggtgtcagcccagggcattacactgacggacaaccaaaggaagctcttctttcgccgccattatccagtgaacagcatcaccttctccagcactgaccctcaagaccggagatggaccaacccagacgggaccacctccaagatctttggtttcgtggccaagaagccgggaagcccctgggagaatgtgtgtcacctctttgcagagcttgacccagatcagcctgctggcgccattgtcaccttcatcaccaaagttctactgggccagagaaaatgaaggaaggccacaagctcagagcccacatcaacactgcccccctcccagcaccccacagccctcacatcccctggcctggacccaggagacccaggagaaagcaccctcccttaggaatgaggagtgggcatcaggcctgggacactgctctccttccccgcccccagcctgctaagttaagtggacaggcccacaagatgaccttgcatgtgagcagatggcagagatgggtgtgtgaggggtgaggaggcatcagcagttgagccccgaaggagatcaggcagccccacctgcaggagaacgtcagccctccaggggatcagcccctgccagttccacccagctgcaggtgccagcacggcagggatgggagaggggtggggagcgagtcactgcctcctctgagcagagattcagagtaggatcacatgaataggggaaaaaagagagtctatttttgtctaataataaagaatttctataaactttagccga

SEQ ID NO: 295362 - DNA, 860 bp, Homo sapiens
  misc_feature (16)..(16): n is a, c, g, or t
ctggctctgatcttanggggagagagaggagaaaaggagatcaaacaggagaggggctcctacttatccattcaagtaagcctccccacgaattcagcctcttccttccaagggaccagggcgctgctgtcctctcaatgctggcatttgatttgtctcaccaaggccagctacattcccttgtggaaggaatgttaagccccttccccaccctttatccccctaggatctttggtttcgtggccaagaagccgggaagcccctgggagaatgtgtgtcacctctttgcagagcttgacccagatcagcctgctggcgccattgtcaccttcatcaccaaagttctactgggccagagaaaatgaaggaaggccacaagctcagagcccacatcaacactgcccccctcccagcaccccacagccctcacatcccctggcctggacccaggagacccaggagaaagcaccctcccttaggaatgaggagtgggcatcaggcctgggacactgctctccttccccgcccccagcctgctaagttaagtggacaggcccacaagatgaccttgcatgtgagcagatggcagagatgggtgtgtgaggggtgaggaggcatcagcagttgagccccgaaggagatcaggcagccccacctgcaggagaacgtcagccctccaggggatcagcccctgccagttccacccagctgcaggtgccagcacggcagggatgggagaggggtggggagcgagtcactgcctcctctgagcagagattcagagtaggatcacatgaataggggaaaaaagagagtctatttttgtctaataataaagaatttctataaactttagccga

SEQ ID NO: 295363 - DNA, 4638 bp, Homo sapiens
gctgaggaaggagagcagacccaggagagccatgaagcctaggaaagctgagcctcatagcttccgggagaaggttttccggaagaaacctccagtctgtgcagtatgtaaggtgaccatcgatgggacaggcgtttcgtgcagagtctgcaaggtggcgacgcacagaaaatgtgaagcaaaggtgacttcagcctgtcaggccttgcctcccgtggagttgcggcgaaacacggccccagtcaggcgcatagagcacctgggatccaccaaatctctgaaccactcaaagcagcgcagcactctgcccaggagcttcagcctggacccgctcatggagcggcgctgggacttagacctcacctacgtgacggagcgcatcttggccgccgccttccccgcgcggcccgatgaacagcggcaccggggccacctgcgcgagctggcccatgtgctgcaatccaagcaccgggacaagtacctgctcttcaacctttcagagaaaaggcatgacctgacccgcttaaaccccaaggttcaagacttcggctggcctgagctgcatgctccacccctggacaagctgtgctccatctgcaaagccatggagacatggctcagtgctgacccacagcacgtggtcgtactatactgcaagggaaacaagggcaagcttggggtcatcgtttctgcctacatgcactacagcaagatctctgcaggggcggaccaggcactggccactcttaccatgcggaaattctgcgaggacaaggtggccacagaactgcagccctcccagcgtcgatatatcagctacttcagtgggctgctatctggctccatcagaatgaacagcagccctctcttcctgcactatgtgctcatccccatgctgccagcctttgaacctggcacaggcttccagcccttccttaaaatctaccagtccatgcagcttgtctacacatctggagtctatcacattgcaggccctggtccccagcagctttgcatcagcctggagccagccctcctcctcaaaggcgatgtcatggtaacatgttatcacaagggtggccggggcacagaccggaccctcgtgttccgagtccagttccacacctgcaccatccacggaccacagctcactttccccaaggaccagcttgacgaggcctggactgatgagaggttccccttccaagcctccgtggagtttgtcttctcctccagccccgagaagatcaaaggcagcactccacggaacgacccctcggtctctgtcgactacaacaccactgagccagccgtgcgctgggactcctatgagaacttcaaccagcaccacgaggacagtgtggatggctccttgacccacacccggggtcccctggatggcagtccttatgcccaggtgcagcggcctccccggcagacccccccggcaccctctccagagcctccaccaccccccatgctctctgtcagcagcgactcaggccattcctccacgctgaccacagagccggctgctgagtcccctggccggccgccccctacagctgctgaacggcaggagctggatcgcctcctaggaggctgcggagtggccagtgggggccggggagctgggcgcgagacggccatcctagatgacgaagagcagcccactgtgggcggaggcccccacctcggagtgtatccaggccataggcctggcctcagccgccactgctcctgccgccagggctaccgggagccctgcggggttcccaatgggggctactaccggccagagggaaccctggagaggaggcgactggcctacgggggctatgagggatccccccagggctacgccgaggcctcgatggagaagaggcgcctctgccgatcgctgtcagaggggctatacccctacccacctgagatggggaaaccagccactggggactttggctaccgcgccccaggctaccgggaggtggtcatcctggaggaccctgggctgcctgccctatacccatgcccagcctgcgaggagaagctggcgctgcctacagcagccttgtatggactgcggctggagagggaggctggagaagggtgggcaagtgaggctggcaagcctctcctgcacccagtgcggcctgggcacccgctgcctctgctcttgcctgcctgtgggcatcaccatgccccgatgcctgactacagctgcctgaagccacccaaggcaggcgaggaagggcacgagggctgctcctacaccatgtgccccgaaggcaggtatgggcatccagggtaccctgccctggtgacatacagctatggaggagcagttcccagttactgcccagcatatggccgtgtgcctcatagctgtggctctccaggagagggcagagggtatcccagccctggtgcccactccccacgggctggctccatttccccgggcagcccgccctatccacaatctaggaagctgagctacgagatccctacggaggagggaggggacaggtacccattgcctgggcacctggcctcagcaggacctttggcatctgcagagtcgctggagccggtgtcctggagggagggccccagtgggcacagcacactgcctcggtctccccgagatgccccatgcagtgcttcgtcagagttgtctggtccctccacgcccctgcacaccagcagtccagtccagggcaaggaaagcacccggcgacaggacaccaggtcccccacctcagcgcccactcagagactgagtcctggcgaggccttgccccctgtttcccaggcaggcaccggaaaggcccctgagctgccgtcgggaagtgggcctgagcctctggcccctagcccagtctctccgaccttccctcccagctcgcccagtgactggcctcaggaaaggagtccagggggccactcagatggcgccagtcctcggagccctgtgcccaccacacttcctggcctccgccacgccccctggcaaggccctcgaggcccccccgacagcccagatgggtctcccctcactcctgtgccttcccagatgccctggcttgtggccagcccagagccgcctcagagctcacctacacctgctttccccctggctgcctcctatgacaccaatggccttagccagcccccacttcctgagaaacgccacctgcccgggccggggcaacagccaggaccctggggcccagagcaggcatcatcgccagccagaggcatcagtcaccatgtcaccttcgcacctctgctctcagataatgtcccccaaaccccagagcctcctacacaagagagccaaagcaatgtcaagtttgtccaggatacatccaagttctggtacaagccacacctgtcccgtgaccaagccattgccctgctgaaggacaaggaccctggggccttcctgatcagggacagtcattcattccaaggagcttatgggctggccctcaaggtggccacaccgccacccagtgcccagccctggaaaggggaccccgtggaacagctggtccgccatttcctcatcgagactgggcccaaaggggtgaagatcaagggctgccccagtgagccctactttggcagcctgtccgccttggtctcccagcactccatctcccccatctccctgccctgctgcctgcgcattcccagcaaagatcctctggaagagaccccagaggctccagtgcccaccaacatgagcacagcggcagacctcctgcgtcagggtgctgcctgcagcgtgctctacttgacctcagtggagacagagtcactgacgggcccccaagctgtggcccgggccagctctgcagctctgagctgtagcccccgcccgacaccagctgttgtccacttcaaggtgtcagcccagggcattacactgacggacaaccaaaggaagctcttctttcgccgccattatccagtgaacagcatcaccttctccagcactgaccctcaagaccggagatggaccaacccagacgggaccacctccaagatctttggtttcgtggccaagaagccgggaagcccctgggagaatgtgtgtcacctctttgcagagcttgacccagatcagcctgctggcgccattgtcaccttcatcaccaaagttctactgggccagagaaaatgaaggaaggccacaagctcagagcccacatcaacactgcccccctcccagcaccccacagccctcacatcccctggcctggacccaggagacccaggagaaagcaccctcccttaggaatgaggagtgggcatcaggcctgggacactgctctccttccccgcccccagcctgctaagttaagtggacaggcccacaagatgaccttgcatgtgagcagatggcagagatgggtgtgtgaggggtgaggaggcatcagcagttgagccccgaaggagatcaggcagccccacctgcaggagaacgtcagccctccagggatgggagaggggtggggagcgagtcactgcctcctctgagcagagattcagagtaggatcacatgaataggggaaaaaagagagtctatttttgtctaataataaagaatttctataaactttagccga

SEQ ID NO: 295364 - DNA, 1322 bp, Homo sapiens
gctgaggaaggagagcagacccaggagagccatgaagcctaggaaagctgagcctcatagcttccgggagaaggttttccggaagaaacctccagtctgtgcagtatgtaaggtgaccatcgatgggacaggcgtttcgtgcagagtctgcaaggtggcgacgcacagaaaatgtgaagcaaaggtgacttcagcctgtcaggccttgcctcccgtggagttgcggcgaaacacggccccagtcaggcgcatagagcacctgggatccaccaaatctctgaaccactcaaagcagcgcagcactctgcccaggagcttcagcctggacccgctcatggagcggcgctgggacttagacctcacctacgtgacggagcgcatcttggccgccgccttccccgcgcggcccgatgaacagcggcaccggggccacctgcgcgagctggcccatgtgctgcaatccaagcaccgggacaagtacctgctcttcaacctttcagagaaaaggcatgacctgacccgcttaaaccccaaggttcaagacttcggctggcctgagctgcatgctccacccctggacaagctgtgctccatctgcaaagccatggagacatggctcagtgctgacccacagcacgtggtcgtactatactgcaagggaaacaagggcaagcttggggtcatcgtttctgcctacatgcactacagcaagatctctgcaggggcggaccaggcactggccactcttaccatgcggaaattctgcgaggacaaggtggccacagaactgcagccctcccagcgtcgatatatcagctacttcagtgggctgctatctggctccatcagaatgaacagcagccctctcttcctgcactatgtgctcatccccatgctgccagcctttgaacctggcacaggcttccagcccttccttaaaatctaccagtccatgcagcttgtctacacatctggagtctatcacattgcaggccctggtccccagcagctttgcatcagcctggagccagccctcctcctcaaaggcgatgtcatggtaacatgttatcacaagggtggccggggcacagaccggaccctcgtgttccgagtccagttccacacctgcaccatccacggaccacagctcactttccccaaggaccagcttgacgaggcctggactgatgagaggttccccttccaagcctccgtggagtttgtcttctcctccagccccgagaagatcaaaggcagcactccacggaacgacccctcggtctctgtcgaccacgttgccaaacatcggggatactctagaa

SEQ ID NO: 295365 - DNA, 105 bp, Homo sapiens
acctccagtctgtgcagtatgtaaggtgaccatcgatgggacaggcgtttcgtgcagaggtgaggctctctgtcctgtgactctgagaccctccacccagtacca

SEQ ID NO: 295366 - DNA, 3832 bp, Homo sapiens
  misc_feature (1385)..(1385): n is a, c, g, or t
ggcacgaggccgcatttcaccctgctccaggcagcgtggtctgtatggctccgccctgggcaggaggagaaagaagagggccaggcaccacgtgcctgcactctccctggatgctggaggctgctccgccgtgggcaggaggagaaggaagagaactgggtgccgcctgcctgcactctctccggatgctggaggctggaggcagtgaggcagcaacagcgcgagggcgaggcgactttggagctgcctcatgcagcgacctcgccttccgctgcgcctcctcccagaacccaagaagcctggaacctgtggcgtccagccctgaaaggaggagacggcaacccagccgcgcttttgcctgcactctccctggatgctggaggctggaggcagtgacgcagcaacagcgcgaggcgactttggagcggcctcatatagcgacctcgccttccgctgcgcgtcctcccagagcccaagaagcccggaacctgtggcatccatctctgaaaggagaagacggcaacccagccgaggcactactgggttggggtctccacgaccgagctggtctcatcaagtggcgtccaacaaggggctcaaacccgggttgaggggttgctggagcgacggagaacgtggaactacactggaggacaccagagtactcttaagcaatcccttggccaaaaccagcaactgatttggataccatcaagacacctgaaatcttgtcatgagccagatactgaggaagagattttgggaagaacccaaggaccccccagttgcagccatgtcaagactgacaataaggaagacatcagtcccagcaagcaacattcatcgggcacagccacccatgtggggccagatcaagaagttgacacagatggcggaagaaaatctgaagaaagcggatgaccagctacaatgagtaatctaatggtagctatgatggctgtgctcaccattgccatgagtattcccccagcacctgctgaaacaaaaaacattatacttattgggcatatattccttttccaccagtttcatggccagtgacatggttagaccccccagtggaggtatacactaatgatagcttttggatacctggttctacagatgatagaggcccatctcacccccaaaaggagggaacaattatgaatatttcgttgggatttgagcatttaactacttgcttgggaaaagccaacaggtgcttacctcccagtcatcaatcttggctggcaatagtgcctgaaggtaacatctctgtggcacaattacatatgctttctgaccttagtatttattacaatgattatgcccctgtaaccaaagtttaccgccctcaaaaacctatctgtatagtggattgnacatgttcagaaaaaaatgaagatatttacttgggaagattgtattgcagggcaagcaaaggtgttgtgtaatgattcatatggagtcactattgattggtcccctaaaggggcatttataaggctcacttctcaatctgtaggtaatggtcaccctgcatctaaagaaaatgatcagatggtagacactataaaaaatacaacaaaagttcctattatttggacatatggtgatatggtggaacctcgaccccaaatgatacgacctgctgtaggagctaaacataaggaattgtggaaaatattaatggcactgaaaaagataaaagatttgggaagggaaatatactaagccatcccaatataatcctaattacatgttagaattggctcacaatgattcagtctggatacatagttgtgtctgtcctccctttctgcttgtagtgagtgatttaaaacttgatctccctaatcatcatgtgactgtcaagaatgtagattgttttcttgtgtgaattcttccttgtataatactgatcattctatcttagtggtaagagcccgagaaggagtatggatacctgtaaagctttcccgtccttgagaagcctctccttctgtgcatattattactgaaattcttcaaaagattttgaggcactctcagggtttcattgctactttaatcattatgggattgattgctgtcacagctactgccacggtagctggagttgctttaccaacacagtacaaacagcagattatgtaaataattggcagaaaaattctactttgctgtggaattcccaaactaatatacaccagaaattaaccaatcagattaatgatctccgacaaactatcgtatggttgggagatcatgtagttagtttaaaatatagaatgcagttaacaatgtgattgaaatacttctgatttttgcattactcctcacctgtataatgaaacagagcatgagtgggaaagagttaagagacatttaaaggatcatactggaaatttatctttggatattgcaaaactgaaggaacacatatttcaagcctctgaggcacatctgacattaatgacaggaactaaagtgcttgaaggagctgcagatggattagcagctattcacccatacaagtggatcaagacacttggagactttgtgatttcaatgatgattgtgcctttaatctgtattgtttgtctttgtgtagtctgcagatgtggatcccgaatcctgcgagaagtagcccaccatgacgaagctgcctttgcttttatcgctttgcaaaaacagaaaaggggacatgctgggaacaggccctaagcctgtcataaacaggccttaaactgaccatgaacaggatttctgcacgaatgtgacgtgctcctgatggctatgacgcccactgctagaagttgttagtttactggagcagggtagggaacacctggcccacccggagcggaaaactgctcaaaccacaaacaacagcatgagtggcctgagccttaacaacatgtttttgctgcagataatcggccagagactgtttctctactcctctctaagtatgctttgtttttcgtaaggaatgcttttagctaatctgtaacctatagaaacaatgcttatcactggcttgctgtcaataaacatgtgggtcaaactctgtttgtggctctcagctctcaaggctgttttccccctgattcccactttgcactttatttctgtgtgtttgtcttcattcctctagcaccactgggttggggtctccttgaccaagctggtctcggcacatatgcatgtatgcccaggtcctgaaatcagccttgtggagcctgtgggtaggaaaagtcaaccctctgtgcatgtaggcctggaacctgaccaatactgtattttcctaccacgtttggtttcaaatgtggaaactgcccatacggacctactgcatttgtttttaaaaatcctctgtaagtggacctgcacagttcaggcccagattgttccaggatcaaccctacagtagaaatcaagtatctttttcattgtctcttgggatctgccttttcaccaataaaatatgagggctgttgggagcaggcccccccaaatctggccataaactgtccccaaaactggccataaacaaaatctctgcagcactataacatgttcataatggccataacgcccaagttggaaggttgtggatttacaggaatgagggcaaggaacacctggcctgcccagggtggaaaaccacttaaaggcattcttaagccacaaacaatagcatgagtgatctgtgccttaagaacatgctcctgctgcagttaactagcccaacatattcctttaattcagtccatcccttcgtttcccataagggatacttttagttaatttaatatctatagaa

SEQ ID NO: 295367 - DNA, 3078 bp, Homo sapiens
  misc_feature (1385)..(1385): n is a, c, g, or t
ggcacgaggccgcatttcaccctgctccaggcagcgtggtctgtatggctccgccctgggcaggaggagaaagaagagggccaggcaccacgtgcctgcactctccctggatgctggaggctgctccgccgtgggcaggaggagaaggaagagaactgggtgccgcctgcctgcactctctccggatgctggaggctggaggcagtgaggcagcaacagcgcgagggcgaggcgactttggagctgcctcatgcagcgacctcgccttccgctgcgcctcctcccagaacccaagaagcctggaacctgtggcgtccagccctgaaaggaggagacggcaacccagccgcgcttttgcctgcactctccctggatgctggaggctggaggcagtgacgcagcaacagcgcgaggcgactttggagcggcctcatatagcgacctcgccttccgctgcgcgtcctcccagagcccaagaagcccggaacctgtggcatccatctctgaaaggagaagacggcaacccagccgaggcactactgggttggggtctccacgaccgagctggtctcatcaagtggcgtccaacaaggggctcaaacccgggttgaggggttgctggagcgacggagaacgtggaactacactggaggacaccagagtactcttaagcaatcccttggccaaaaccagcaactgatttggataccatcaagacacctgaaatcttgtcatgagccagatactgaggaagagattttgggaagaacccaaggaccccccagttgcagccatgtcaagactgacaataaggaagacatcagtcccagcaagcaacattcatcgggcacagccacccatgtggggccagatcaagaagttgacacagatggcggaagaaaatctgaagaaagcggatgaccagctacaatgagtaatctaatggtagctatgatggctgtgctcaccattgccatgagtattcccccagcacctgctgaaacaaaaaacattatacttattgggcatatattccttttccaccagtttcatggccagtgacatggttagaccccccagtggaggtatacactaatgatagcttttggatacctggttctacagatgatagaggcccatctcacccccaaaaggagggaacaattatgaatatttcgttgggatttgagcatttaactacttgcttgggaaaagccaacaggtgcttacctcccagtcatcaatcttggctggcaatagtgcctgaaggtaacatctctgtggcacaattacatatgctttctgaccttagtatttattacaatgattatgcccctgtaaccaaagtttaccgccctcaaaaacctatctgtatagtggattgnacatgttcagaaaaaaatgaagatatttacttgggaagattgtattgcagggcaagcaaaggtgttgtgtaatgattcatatggagtcactattgattggtcccctaaaggggcatttataaggctcacttctcaatctgtaggtaatggtcaccctgcatctaaagaaaatgatcagatggtagacactataaaaaatacaacaaaagttcctattatttggacatatggtgatatggtggaacctcgaccccaaatgatacgacctgctgtaggagctaaacataaggaattgtggaaaatattaatggcactgaaaaagataaaagatttgggaagggaaatatactaagccatcccaatataatcctaattacatgttagaattggctcacaatgattcagtctggatacatagttgtgtctgtcctccctttctgcttgtagtgagtgatttaaaacttgatctccctaatcatcatgtgactgtcaagaatgtagattgttttcttgtgtgaattcttccttgtataatactgatcattctatcttagtggtaagagcccgagaaggagtatggatacctgtaaagctttcccgtccttgagaagcctctccttctgtgcatattattactgaaattcttcaaaagattttgaggcactctcagggtttcattgctactttaatcattatgggattgattgctgtcacagctactgccacggtagctggagttgctttaccaacacagtacaaacagcagattatgtaaataattggcagaaaaattctactttgctgtggaattcccaaactaatatacaccagaaattaaccaatcagattaatgatctccgacaaactatcgtatggttgggagatcatgtagttagtttaaaatatagaatgcagttaacaatgtgattgaaatacttctgatttttgcattactcctcacctgtataatgaaacagagcatgagtgggaaagagttaagagacatttaaaggatcatactggaaatttatctttggatattgcaaaactgaaggaacacatatttcaagcctctgaggcacatctgacattaatgacaggaactaaagtgcttgaaggagctgcagatggattagcagctattcacccatacaagtggatcaagacacttggagactttgtgatttcaatgatgattgtgcctttaatctgtattgtttgtctttgtgtagtctgcagatgtggatcccgaatcctgcgagaagtagcccaccatgacgaagctgcctttgcttttatcgctttgcaaaaacagaaaaggggacatgctgggaacaggccctaagcctgtcataaacaggccttaaactgaccatgaacaggatttctgcacgaatgtgacgtgctcctgatggctatgacgcccactgctagaagttgttagtttactggagcagggtagggaacacctggcccacccggagcggaaaactgctcaaaccacaaacaacagcatgagtggcctgagccttaacaacatgtttttgctgcagataatcggccagagactgtttctctactcctctctaagtatgctttgtttttcgtaaggaatgcttttagctaatctgtaacctatagaaacaatgcttatcactggcttgctgtcaataaacatgtgggtcaaactctg

SEQ ID NO: 295368 - DNA, 2160 bp, Homo sapiens
ggcacgaggccgcatttcaccctgctccaggcagcgtggtctgtatggctccgccctgggcaggaggagaaagaagagggccaggcaccacgtgcctgcactctccctggatgctggaggctgctccgccgtgggcaggaggagaaggaagagaactgggtgccgcctgcctgcactctctccggatgctggaggctggaggcagtgaggcagcaacagcgcgagggcgaggcgactttggagctgcctcatgcagcgacctcgccttccgctgcgcctcctcccagaacccaagaagcctggaacctgtggcgtccagccctgaaaggaggagacggcaacccagccgcgcttttgcctgcactctccctggatgctggaggctggaggcagtgacgcagcaacagcgcgaggcgactttggagcggcctcatatagcgacctcgccttccgctgcgcgtcctcccagagcccaagaagcccggaacctgtggcatccatctctgaaaggagaagacggcaacccagccgaggcactactgggttggggtctccacgaccgagctggtctcatcaagtggcgtccaacaaggggctcaaacccgggttgaggggttgctggagcgacggagaacgtggaactacactggaggacaccagagtactcttaagcaatcccttggccaaaaccagcaactgatttggataccatcaagacacctgaaatcttgtcatgagccagatactgaggaagagattttgggaagaacccaaggaccccccagttgcagccatgtcaagactgacaataaggaagacatcagtcccagcaagcaacattcatcgggcacagccacccatgtggggccagatcaagaagttgacacagatggcggaagaaaatctgaagaaagcggatgaccagctacaatgagtaatctaatgtctgcagatgtggatcccgaatcctgcgagaagtagcccaccatgacgaagctgcctttgcttttatcgctttgcaaaaacagaaaaggggacatgctgggaacaggccctaagcctgtcataaacaggccttaaactgaccatgaacaggatttctgcacgaatgtgacgtgctcctgatggctatgacgcccactgctagaagttgttagtttactggagcagggtagggaacacctggcccacccggagcggaaaactgctcaaaccacaaacaacagcatgagtggcctgagccttaacaacatgtttttgctgcagataatcggccagagactgtttctctactcctctctaagtatgctttgtttttcgtaaggaatgcttttagctaatctgtaacctatagaaacaatgcttatcactggcttgctgtcaataaacatgtgggtcaaactctgtttgtggctctcagctctcaaggctgttttccccctgattcccactttgcactttatttctgtgtgtttgtcttcattcctctagcaccactgggttggggtctccttgaccaagctggtctcggcacatatgcatgtatgcccaggtcctgaaatcagccttgtggagcctgtgggtaggaaaagtcaaccctctgtgcatgtaggcctggaacctgaccaatactgtattttcctaccacgtttggtttcaaatgtggaaactgcccatacggacctactgcatttgtttttaaaaatcctctgtaagtggacctgcacagttcaggcccagattgttccaggatcaaccctacagtagaaatcaagtatctttttcattgtctcttgggatctgccttttcaccaataaaatatgagggctgttgggagcaggcccccccaaatctggccataaactgtccccaaaactggccataaacaaaatctctgcagcactataacatgttcataatggccataacgcccaagttggaaggttgtggatttacaggaatgagggcaaggaacacctggcctgcccagggtggaaaaccacttaaaggcattcttaagccacaaacaatagcatgagtgatctgtgccttaagaacatgctcctgctgcagttaactagcccaacatattcctttaattcagtccatcccttcgtttcccataagggatacttttagttaatttaatatctatagaa

SEQ ID NO: 295369 - DNA, 289 bp, Homo sapiens
caagaagcccggaacctgtggcatccatctctgaaaggagaagacggcaacccagccgagggtgagtccgggagtctggggtgccggcagcggaggaaggacaagcaggagtctcggcctcccggggagaatttcacaaaattctctgattatcttgttataatactgttacgtaggctgttgttttgattctgatactggtctcttgtgttctttaatcttttttccttaatcagttttgctagtggtttattaactatgttgtttataaaaacaacttttagccttg

SEQ ID NO: 295370 - DNA, 1143 bp, Homo sapiens
ggcacgaggccgcatttcaccctgctccaggcagcgtggtctgtatggctccgccctgggcaggaggagaaagaagagggccaggcaccacgtgcctgcactctccctggatgctggaggctgctccgccgtgggcaggaggagaaggaagagaactgggtgccgcctgcctgcactctctccggatgctggaggctggaggcagtgaggcagcaacagcgcgagggcgaggcgactttggagctgcctcatgcagcgacctcgccttccgctgcgcctcctcccagaacccaagaagcctggaacctgtggcgtccagccctgaaaggaggagacggcaacccagccgcgcttttgcctgcactctccctggatgctggaggctggaggcagtgacgcagcaacagcgcgaggcgactttggagcggcctcatatagcgacctcgccttccgctgcgcgtcctcccagagcccaagaagcccggaacctgtggcatccatctctgaaaggagaagacggcaacccagccgaggcactactgggttggggtctccacgaccgagctggtctcatcaagtggcgtccaacaaggggctcaaacccgggttgaggggttgctggagcgacggagaacgtggaactacactggaggacaccagagtactcttaagcaatcccttgtctgcagatgtggatcccgaatcctgcgagaagtagcccaccatgacgaagctgcctttgcttttatcgctttgcaaaaacagaaaaggggacatgctgggaacaggccctaagcctgtcataaacaggccttaaactgaccatgaacaggatttctgcacgaatgtgacgtgctcctgatggctatgacgcccactgctagaagttgttagtttactggagcagggtagggaacacctggcccacccggagcggaaaactgctcaaaccacaaacaacagcatgagtggcctgagccttaacaacatgtttttgctgcagataatcggccagagactgtttctctactcctctctaagtatgctttgtttttcgtaaggaatgcttttagctaatctgtaacctatagaaacaatgcttatcactggcttgctgtcaataaacatgtgggtcaaactctg

SEQ ID NO: 295371 - DNA, 1406 bp, Homo sapiens
ggcacgaggccgcatttcaccctgctccaggcagcgtggtctgtatggctccgccctgggcaggaggagaaagaagagggccaggcaccacgtgcctgcactctccctggatgctggaggctgctccgccgtgggcaggaggagaaggaagagaactgggtgccgcctgcctgcactctctccggatgctggaggctggaggcagtgaggcagcaacagcgcgagggcgaggcgactttggagctgcctcatgcagcgacctcgccttccgctgcgcctcctcccagaacccaagaagcctggaacctgtggcgtccagccctgaaaggaggagacggcaacccagccgcgcttttgcctgcactctccctggatgctggaggctggaggcagtgacgcagcaacagcgcgaggcgactttggagcggcctcatatagcgacctcgccttccgctgcgcgtcctcccagagcccaagaagcccggaacctgtggcatccatctctgaaaggagaagacggcaacccagccgaggcactactgggttggggtctccacgaccgagctggtctcatcaagtggcgtccaacaaggggctcaaacccgggttgaggggttgctggagcgacggagaacgtggaactacactggaggacaccagagtactcttaagcaatcccttggccaaaaccagcaactgatttggataccatcaagacacctgaaatcttgtcatgagccagatactgaggaagagattttgggaagaacccaaggaccccccagttgcagccatgtcaagactgacaataaggaagacatcagtcccagcaagcaacattcatcgggcacagccacccatgtggggccagatcaagaagttgacacagatggcggaagaaaatctgaagaaagcggatgaccagctacaatgagtaatctaatgtctgcagatgtggatcccgaatcctgcgagaagtagcccaccatgacgaagctgcctttgcttttatcgctttgcaaaaacagaaaaggggacatgctgggaacaggccctaagcctgtcataaacaggccttaaactgaccatgaacaggatttctgcacgaatgtgacgtgctcctgatggctatgacgcccactgctagaagttgttagtttactggagcagggtagggaacacctggcccacccggagcggaaaactgctcaaaccacaaacaacagcatgagtggcctgagccttaacaacatgtttttgctgcagataatcggccagagactgtttctctactcctctctaagtatgctttgtttttcgtaaggaatgcttttagctaatctgtaacctatagaaacaatgcttatcactggcttgctgtcaataaacatgtgggtcaaactctg

SEQ ID NO: 295372 - DNA, 745 bp, Homo sapiens
gggtggctccagctccgccactgcgcgcgctccagcgccccagaaggcagggggcagcccggggaccggggtcccggagccccgtgggaggcgggcaacacctgtcgggacccgagggcgtgtctgagattgtggcctgaggtgctgcgccttccgatccggggcagcgggcgtcctgtagctgcgccttccgaatccagcccagattctcctaccagctgcttgggtcacgtcggtggaactcctaaagggatgccttcaaaatgtgtgaataagcttcaatcagactgcccttcccaaagaaaataactataaatgctggaaaaactacaaaacagccacctgaaggcactggcgagtgacaaaagcaagcaaattctggagaagagtcaacacttggaagaagggagctgcactgggtacatggggaaggaacagtgtctctgcatgagaatggccaaagaacaagatacatttccccgtggagagcaatcctagagagagggaagcatgggtcagaataaggtgtactggccccagggtaatagcatgtatttctgttgcattggtgtttccaaaataatgcttcggttccaagtttcaggaattggttgggggagcatggggatcatacagtgattcaggagcttccttgcaagtaagtgagtgagccaatcaaataatttatgtttaaatctttcactgtgttaaatgttgaaaaataaagcaagtgaattccaaacta

SEQ ID NO: 295373 - DNA, 1120 bp, Homo sapiens
gggtggctccagctccgccactgcgcgcgctccagcgccccagaaggcagggggcagcccggggaccggggtcccggagccccgtgggaggcgggcaacacctgtcgggacccgagggcgtgtctgagattgtggcctgaggtgctgcgccttccgatccggggcagcgggcgtcctgtagctgcgccttccgaatccagcccagattctcctaccagctgcttgggtcacgtcggtggaactcctaaagggatgccttcaaaatgtgtgaataagcttcaatcagactgcccttcccaaagaaaataactataaatgctggaaaaactacaaaacagccacctgaaggcactggcgagtgacaaaagcaagcaaattctggagaagagtcaacacttggaagaagggagctgcactgggtacatggggaaggaacagtgtctctgcatgagaatggccaaagaacaagatacatttccccgtggagagcaatcctagagagagggaagcatgggtcagaataaggtgtactggccccaggtagagacagggtttcaccatgttggcccggctgacctcgaactcctgacctcaggtgatctgcccaccttggcttctcaaagtgctggtattacaaatgagcccattccttgcttgtggtagacctgcaagaacaaacccattgagatggctacagaatgagaagggaagctaatacatggtgtaagaccgtaagcacacacatgcatcaggacaggaactctgtgggataacggcgcacacgacaaacctacataggagaacatcattggcagtgcaggagcatcagacacaacggctctctggcaacttacgggactccataactatgcctggagacaaacctagaacacaaaactcatcctacatggaccacaatacaatgggctttcgggaaccataaacccacacggggcacaaaaatcctgggtagaaagaatgcgaccacgtagaacacggagactcaaaatttacacggtggacttgcgctcactgccattgaaagggatttacaaactatgagtcatatccatttcggaacttgggataacacttacgggagatggcttattaattcaac

SEQ ID NO: 295374 - DNA, 410 bp, Homo sapiens
aaggaaagaaacccaagtatatctttttctatgcaaaggctactggaataagctttttattattttattgagagatctctcacaataatgtgaggctaatttctctgaacaatggcttgttttaataaatattttgcaaatacagctaatacactgtgtggctgactctggtcctcaactctagctgcacattcaaatcacttatggagttcaagaatatataaaatcttgtgtctaaaacctagagattccgatctgtgagtgtggcctggagtggaggctggaggctgattttttacagagcttcacaggtccttctatggacacccaggattgagaatcagtgatccaactcatacttgttaaagaatttggtgatatcatatgcattacaagagtgattgaatgaa

SEQ ID NO: 295375 - DNA, 1051 bp, Homo sapiens
gccagcctaccggcgactaggatgctttcgctttcgctctcgctttccaatactcgggactggggaaaccgggagaatagaagcaggcaaggaccgccgtgggcacggggtgtccccagcgcagccaatcggcttccgaagtaggtgagttgctgcctgaagagaaaagacaaactccagtatctttcattccattggccagacgcgccattccccaagtgagttctgttctccaaccaaagtgctggattccaagggactggaagggaaagtccctaaaaatcacgagttcaggcgtctgagacttggtgggaacggaccttcctcttagtgcccaagcctgttctaatttttaaaaactgatgtctattaagacccaatgttaactttatgaaaatggttcctaaggagattcacatctctgtgtccgaattctgtgtgcagcaaacatcatctcaagtgcgttttcccaactacgcttctttccaggataaaatactctaagtgacaaatgttgagtacattatcaggtatgttcactattgtgagaactgaagccatctacactcacatagcttgccaactacattaacctgacttcttattccattattttcatcaacatacatttactatttcaagaaacttttgccagggaccggaaagttgcaaatatctttattgcttaatccagtatcttcttcaaagatccaaccactcttcaatggaaaacatcaaagaacagtttacattctaagactttgaacctttacctcaaaatcctagccttgttttatctaccaatcctaaacttttacccgtagctgactcaattctaaccaattcccctcattaaatattagacttacaatgggacttcaaaatctcaatacatatagcccaaacttgctcttccctctctgagacaccacttaaattctgtcaagttattgttctccattacctaagtgagcaagaaacttagctttgtcttatcaacaggttgctttgatattactgggagccaacatttgacattcttggaggctcc

SEQ ID NO: 295376 - DNA, 1028 bp, Homo sapiens
gccagcctaccggcgactaggatgctttcgctttcgctctcgctttccaatactcgggactggggaaaccgggagaatagaagcaggtgtccccagcgcagccaatcggcttccgaagtaggtgagttgctgcctgaagagaaaagacaaactccagtatctttcattccattggccagacgcgccattccccaagtgagttctgttctccaaccaaagtgctggattccaagggactggaagggaaagtccctaaaaatcacgagttcaggcgtctgagacttggtgggaacggaccttcctcttagtgcccaagcctgttctaatttttaaaaactgatgtctattaagacccaatgttaactttatgaaaatggttcctaaggagattcacatctctgtgtccgaattctgtgtgcagcaaacatcatctcaagtgcgttttcccaactacgcttctttccaggataaaatactctaagtgacaaatgttgagtacattatcaggtatgttcactattgtgagaactgaagccatctacactcacatagcttgccaactacattaacctgacttcttattccattattttcatcaacatacatttactatttcaagaaacttttgccagggaccggaaagttgcaaatatctttattgcttaatccagtatcttcttcaaagatccaaccactcttcaatggaaaacatcaaagaacagtttacattctaagactttgaacctttacctcaaaatcctagccttgttttatctaccaatcctaaacttttacccgtagctgactcaattctaaccaattcccctcattaaatattagacttacaatgggacttcaaaatctcaatacatatagcccaaacttgctcttccctctctgagacaccacttaaattctgtcaagttattgttctccattacctaagtgagcaagaaacttagctttgtcttatcaacaggttgctttgatattactgggagccaacatttgacattcttggaggctcc

SEQ ID NO: 295377 - DNA, 1220 bp, Homo sapiens
gccagcctaccggcgactaggatgctttcgctttcgctctcgctttccaatactcgggactggggaaaccgggagaatagaagcaggtgtccccagcgcagccaatcggcttccgaagtaggtgagttgctgcctgaagagaaaagacaaactccagtatctttcattccattggccagacgcgccattccccaagtgagttctgttctccaaccaaagtgctggattccaagggactggaagggaaagtccctaaaaatcacgagttcaggcgtctgagacttggtgggaacggaccttcctcttaggtgagttactctttggttctggggctgacctggagttttgccaggattcattggccgcagcaggatgctggtggggacagggtaaataaaatctgcactcctgcgggcttttattgttgaaaggggcactgacgctctccctggaaacttaaaaagaacagccaagtgaacggatgtgtctttcttttgcagtgcccaagcctgttctaatttttaaaaactgatgtctattaagacccaatgttaactttatgaaaatggttcctaaggagattcacatctctgtgtccgaattctgtgtgcagcaaacatcatctcaagtgcgttttcccaactacgcttctttccaggataaaatactctaagtgacaaatgttgagtacattatcaggtatgttcactattgtgagaactgaagccatctacactcacatagcttgccaactacattaacctgacttcttattccattattttcatcaacatacatttactatttcaagaaacttttgccagggaccggaaagttgcaaatatctttattgcttaatccagtatcttcttcaaagatccaaccactcttcaatggaaaacatcaaagaacagtttacattctaagactttgaacctttacctcaaaatcctagccttgttttatctaccaatcctaaacttttacccgtagctgactcaattctaaccaattcccctcattaaatattagacttacaatgggacttcaaaatctcaatacatatagcccaaacttgctcttccctctctgagacaccacttaaattctgtcaagttattgttctccattacctaagtgagcaagaaacttagctttgtcttatcaacaggttgctttgatattactgggagccaacatttgacattcttggaggctcc

SEQ ID NO: 295378 - DNA, 544 bp, Homo sapiens
tttttttgaaaaagaaaaatatttattttcagcaagaccaaagtcccaagtgggggcaggtgccaaatttgcccccgccaccagagggcctaggcccacaggaagcctgaagccaaattcaggcgtggaaggaggggagccaccagtggggcgggacagtcacttgtactgaggagagagcggggggacaagtggagcagtgcagacactcagcatcttgtcgatgtccacctgggttgacttatccacctcggccttgtggtcactcacccccaagctgggcaagcccccaggctcctctccagcctcctctccgaggggagccagggcatgggtgggggtcactagtggactgggacagggcaaagcgaggcctgggcccagctcacctgccaagggcagcaaggcctgcagttgctccacacctccctcctcgggaaccggggccagctctgcctctgcctccacctcagcctccccgtcccccttccctgcctggttcagctcagggttgcaatagttgacgtactggtacagcggccgc

SEQ ID NO: 295379 - DNA, 1309 bp, Homo sapiens
ggacaagagcactaacacttcttagtttcagggtaaaaacttccaaagttggaaaactcctatgcctaaggctttggaagggaaagtctatgtttctcttctttcctcagccttattcctaaggctttgagagcttttcaggtgccctggaaggcagccttatgctccagccttgggaggtagtatagctgagcacttaagcaagctctggactcagacaattctgggcttcaatctcagatttgtgaccctgggctttacctctgtttttgtatctgtaacgtggaaacagtcttcagaagaacaggaagaactaaatgagataacatgtacagttcttactacacaaaaagctcatagtacttaatagtagcttttttttttttgagatggaatctcactctgttggctaggctggagtgcagtggcacaatctcgactcactgcaacctccacctcctaggttcaagcaattctcagcctcagcctcctgagtagctgggattacaggcacataccaccacatctggctaattttttgtatttttagtagagacgggtttcaccatattggccaggctggtcttaaactcctggcctcatgtgatccgcctgccttggcctcccaaagtgtgattacaggcgtgagccaccacacttggcccaatagtagcttattctaatcccagctctgccactgacttgctatggcactgctgttccttaagtatctctcatctaatgggatcagttatctgtgttcaccaaacagaactaagcgcaagactgaattttaaaattcccatgcaaaggctttgaaagatacagtcctccacttccccatacccaggcctgagagttattcattgagtttcttgtacactgcttctctaccccagctcatatactcataaccttccccctaccctcaggtgtgggttttgctaccaggcaggtggccagcatgaccaagcctaccacaatcatcgaaaagaatggggacattctcaccctaaaaacacacagcaccttcaagaacacagagatcagctttaagttgggggtggagttcgatgagacaacagcagatgacaggaaggtcaaggtaagtcagggaaacaggggtggggaatggagagtgctgagactctaaaagagaataggctggtagtcttggctccctggtattgcaccctgaggggcagactatcatggggaatttaaatgaaacaagattcataaagcctgtgtagtgctggaatgccactgatgctaaatacatgtcagttctgtcctcttgttttcttcc

SEQ ID NO: 295380 - DNA, 692 bp, Homo sapiens
cagtccgttcgtcggagcccttgcacgcctgctctcttgtagcttctctcagcctagcccagcatcactatggtggacgctttcctgggcacctggaagctagtggacagcaagaatttcgatgactacatgaagtcactcgatggaaaaactgcaactcagaaatgtaaagtgagtcgaccaaggctaaagcggcaaaaccactatactttataacacagagtttggcactatttccactttgttctctctcaaagatgaaggctcaggaggagggaagataaaaacaaatcactggagagtcctggcatgctggaacatggactctagctagcaagaagggctcaaggaggtggccttctcctagacctcaactttgatgcaaaagctgttttgcagcctgaacaaagacaatccaatcctccagcaaatggcgtcattttccctacgtgtctagccttgagctacagaacaaaagaacaatcacatccgaagttgtagttcgcctggttgcggtggctcacgcctgtgatcccagcactttgggaggccaaggtgggtggatcacctgaggtcaggaggtcgagactagcctgaccaacatgaagaaaccccatctctactaaaaatacaaaattagctgggcgtggtggcacatgcctgtaatcccagctactcgggaggctgaggca

SEQ ID NO: 295381 - DNA, 450 bp, Homo sapiens
caacgtcacgactgggaaaacttgatggggcttccccaggtttggctattgaactgtcacttcaggcccatcctacactgaaagctcttgggtctggctgttctctgtgaaatgctgtagtctctccctttccagaattcaggttcagggcacagaacccaggcttgtaccatggtggtgggagaaaatgaccactggccaagaggactgctgacctgtgcaccaggctagtacttatgactacaaattcttactgcttctctaatcaactctgagggaagagggcatctgatcattacaaaagggagggcttataagtgatctcccaagaaggcagtgatctgctagtgcctttggctctgtacctctgctgggcatctctccaaggtctaaggtaacatattaaatgtttttgtcagctaatgcaggctcagtgactttaagtctgta

SEQ ID NO: 295382 - DNA, 1377 bp, Homo sapiens
cagtccgttcgtcggagcccttgcacgcctgctctcttgtagcttctctcagcctagcccagcatcactatggtggacgctttcctgggcacctggaagctagtggacagcaagaatttcgatgactacatgaagtcactcggtgtgggttttgctaccaggcaggtggccagcatgaccaagcctaccacaatcatcgaaaagaatggggacattctcaccctaaaaacacacagcaccttcaagaacacagagatcagctttaagttgggggtggagttcgatgagacaacagcagatgacaggaaggtcaagtccattgtgacactggatggagggaaacttgttcacctgcagaaatgggacgggcaagagaccacacttgtgcgggagctaattgatggaaaactcatcctgacactcacccacggcactgcagtttgcactcgcacttatgagaaagaggcatgacctgactgcactgttgctgactactactctgccaatcggctacccctcgactcagcaccacattgcctcatttcttcctctgcattttgtacaaatccacgaattcttctggggtcaggtgccactgaccgggatccagttccagttcccatggtgtatgtggttttttttttttttttttaactgcactcatagggtgctctgaggtcaataaagcagagccaaggccacccagttgcctttttgcctttggtaacataactctgggagtcttggtttatcctgtgtgtcagagagtgggcagaaataacggcctgaaggttactgaggaagaagcactggatgggagactgaaatggacagtctcggagcctgttaatcagctgatcaccttacacatttaataataaaagagctgtacctacacgttgcctttacactgccccccctccatggtcaaatgacctagttcagtcagtgatggggcttccccaggtttggctattgaactgtcacttcaggcccatcctacactgaaagctcttgggtctggctgttctctgtgaaatgctgtagtctctccctttccagaattcaggttcagggcacagaacccaggcttgtaccatggtggtgggagaaaatgaccactggccaagaggactgctgacctgtgcaccaggctagtacttatgactacaaattcttactgcttctctaatcaactctgagggaagagggcatctgatcattacaaaagggagggcttataagtgatctcccaagaaggcagtgatctgctagtgcctttggctctgtacctctgctgggcatctctccaaggtctaaggtaacatattaaatgtttttgtcagctaatgcaggctcagtgactttaagtctgta

SEQ ID NO: 295383 - DNA, 2167 bp, Homo sapiens
ggacaagagcactaacacttcttagtttcagggtaaaaacttccaaagttggaaaactcctatgcctaaggctttggaagggaaagtctatgtttctcttctttcctcagccttattcctaaggctttgagagcttttcaggtgccctggaaggcagccttatgctccagccttgggaggtagtatagctgagcacttaagcaagctctggactcagacaattctgggcttcaatctcagatttgtgaccctgggctttacctctgtttttgtatctgtaacgtggaaacagtcttcagaagaacaggaagaactaaatgagataacatgtacagttcttactacacaaaaagctcatagtacttaatagtagcttttttttttttgagatggaatctcactctgttggctaggctggagtgcagtggcacaatctcgactcactgcaacctccacctcctaggttcaagcaattctcagcctcagcctcctgagtagctgggattacaggcacataccaccacatctggctaattttttgtatttttagtagagacgggtttcaccatattggccaggctggtcttaaactcctggcctcatgtgatccgcctgccttggcctcccaaagtgtgattacaggcgtgagccaccacacttggcccaatagtagcttattctaatcccagctctgccactgacttgctatggcactgctgttccttaagtatctctcatctaatgggatcagttatctgtgttcaccaaacagaactaagcgcaagactgaattttaaaattcccatgcaaaggctttgaaagatacagtcctccacttccccatacccaggcctgagagttattcattgagtttcttgtacactgcttctctaccccagctcatatactcataaccttccccctaccctcaggtgtgggttttgctaccaggcaggtggccagcatgaccaagcctaccacaatcatcgaaaagaatggggacattctcaccctaaaaacacacagcaccttcaagaacacagagatcagctttaagttgggggtggagttcgatgagacaacagcagatgacaggaaggtcaagtccattgtgacactggatggagggaaacttgttcacctgcagaaatgggacgggcaagagaccacacttgtgcgggagctaattgatggaaaactcatcctgacactcacccacggcactgcagtttgcactcgcacttatgagaaagaggcatgacctgactgcactgttgctgactactactctgccaatcggctacccctcgactcagcaccacattgcctcatttcttcctctgcattttgtacaaatccacgaattcttctggggtcaggtgccactgaccgggatccagttccagttcccatggtgtatgtggttttttttttttttttttaactgcactcatagggtgctctgaggtcaataaagcagagccaaggccacccagttgcctttttgcctttggtaacataactctgggagtcttggtttatcctgtgtgtcagagagtgggcagaaataacggcctgaaggttactgaggaagaagcactggatgggagactgaaatggacagtctcggagcctgttaatcagctgatcaccttacacatttaataataaaagagctgtacctacacgttgcctttacactgccccccctccatggtcaaatgacctagttcagtcagtgatggggcttccccaggtttggctattgaactgtcacttcaggcccatcctacactgaaagctcttgggtctggctgttctctgtgaaatgctgtagtctctccctttccagaattcaggttcagggcacagaacccaggcttgtaccatggtggtgggagaaaatgaccactggccaagaggactgctgacctgtgcaccaggctagtacttatgactacaaattcttactgcttctctaatcaactctgagggaagagggcatctgatcattacaaaagggagggcttataagtgatctcccaagaaggcagtgatctgctagtgcctttggctctgtacctctgctgggcatctctccaaggtctaaggtaacatattaaatgtttttgtcagctaatgcaggctcagtgactttaagtctgta

SEQ ID NO: 295384 - DNA, 1397 bp, Homo sapiens
gaaggtcgctagcactagtcgtccggcgcgcgggtccattctctcagtgaacctgcatcatcgactgtggcgtagcgctatcctggtcattgagtagatgtttgtggtctgcaccaataacgatggctccggtgaaagatcagtcggtgctggagtcaagtccaccatggcagttcgtgacggtcatgtacctggactctatcaaaaatggtgtccaaagcagagctgcgactttctcatcctgacccacgaaccggcacttcaagaacacagagatcagctttaagttgggggtggagttcgatgagacaacagcagatgacaggaaggtcaagtccattgtgacactggatggagggaaacttgttcacctgcagaaatgggacgggcaagagaccacacttgtgcgggagctaattgatggaaaactcatcctgacactcacccacggcactgcagtttgcactcgcacttatgagaaagaggcatgacctgactgcactgttgctgactactactctgccaatcggctacccctcgactcagcaccacattgcctcatttcttcctctgcattttgtacaaatccacgaattcttctggggtcaggtgccactgaccgggatccagttccagttcccatggtgtatgtggttttttttttttttttttaactgcactcatagggtgctctgaggtcaataaagcagagccaaggccacccagttgcctttttgcctttggtaacataactctgggagtcttggtttatcctgtgtgtcagagagtgggcagaaataacggcctgaaggttactgaggaagaagcactggatgggagactgaaatggacagtctcggagcctgttaatcagctgatcaccttacacatttaataataaaagagctgtacctacacgttgcctttacactgccccccctccatggtcaaatgacctagttcagtcagtgatggggcttccccaggtttggctattgaactgtcacttcaggcccatcctacactgaaagctcttgggtctggctgttctctgtgaaatgctgtagtctctccctttccagaattcaggttcagggcacagaacccaggcttgtaccatggtggtgggagaaaatgaccactggccaagaggactgctgacctgtgcaccaggctagtacttatgactacaaattcttactgcttctctaatcaactctgagggaagagggcatctgatcattacaaaagggagggcttataagtgatctcccaagaaggcagtgatctgctagtgcctttggctctgtacctctgctgggcatctctccaaggtctaaggtaacatattaaatgtttttgtcagctaatgcaggctcagtgactttaagtctgta

SEQ ID NO: 295385 - DNA, 1109 bp, Homo sapiens
agtggggggtggagggggcgagggacagggagatgacaggaaggtcatccattgtgacactggatggagggaaacttgttcacctgcagaaatgggacgggcaagagaccacacttgtgcgggagctaattgatggaaaactcatcctgacactcacccacggcactgcagtttgcactcgcacttatgagaaagaggcatgacctgactgcactgttgctgactactactctgccaatcggctacccctcgactcagcaccacattgcctcatttcttcctctgcattttgtacaaatccacgaattcttctggggtcaggtgccactgaccgggatccagttccagttcccatggtgtatgtggttttttttttttttttttaactgcactcatagggtgctctgaggtcaataaagcagagccaaggccacccagttgcctttttgcctttggtaacataactctgggagtcttggtttatcctgtgtgtcagagagtgggcagaaataacggcctgaaggttactgaggaagaagcactggatgggagactgaaatggacagtctcggagcctgttaatcagctgatcaccttacacatttaataataaaagagctgtacctacacgttgcctttacactgccccccctccatggtcaaatgacctagttcagtcagtgatggggcttccccaggtttggctattgaactgtcacttcaggcccatcctacactgaaagctcttgggtctggctgttctctgtgaaatgctgtagtctctccctttccagaattcaggttcagggcacagaacccaggcttgtaccatggtggtgggagaaaatgaccactggccaagaggactgctgacctgtgcaccaggctagtacttatgactacaaattcttactgcttctctaatcaactctgagggaagagggcatctgatcattacaaaagggagggcttataagtgatctcccaagaaggcagtgatctgctagtgcctttggctctgtacctctgctgggcatctctccaaggtctaaggtaacatattaaatgtttttgtcagctaatgcaggctcagtgactttaagtctgta

SEQ ID NO: 295386 - DNA, 967 bp, Homo sapiens
cagtccgttcgtcggagcccttgcacgcctgctctcttgtagcttctctcagcctagcccagcatcactatggtggacgctttcctgggcacctggaagctagtggacagcaagaatttcgatgactacatgaagtcactcggtgtgggttttgctaccaggcaggtggccagcatgaccaagcctaccacaatcatcgaaaagaatggggacattctcaccctaaaaacacacagcaccttcaagaacacagagatcagctttaagttgggggtggagttcgatgagacaacagcagatgacaggaaggtcaagtccattgtgacactggatggagggaaacttgttcacctgcagaaatgggacgggcaagagaccacacttgtgcgggagctaattgatggaaaactcatcctgatggaaaaactgcaactcagaaatgtaaagtgagtcgaccaaggctaaagcggcaaaaccactatactttataacacagagtttggcactatttccactttgttctctctcaaagatgaaggctcaggaggagggaagataaaaacaaatcactggagagtcctggcatgctggaacatggactctagctagcaagaagggctcaaggaggtggccttctcctagacctcaactttgatgcaaaagctgttttgcagcctgaacaaagacaatccaatcctccagcaaatggcgtcattttccctacgtgtctagccttgagctacagaacaaaagaacaatcacatccgaagttgtagttcgcctggttgcggtggctcacgcctgtgatcccagcactttgggaggccaaggtgggtggatcacctgaggtcaggaggtcgagactagcctgaccaacatgaagaaaccccatctctactaaaaatacaaaattagctgggcgtggtggcacatgcctgtaatcccagctactcgggaggctgaggca

SEQ ID NO: 295387 - DNA, 230 bp, Homo sapiens
ttcataaagcctgtgtagtgctggaatgccactgatgctaaatacatgtcagttctgtcctcttgttttcttccctcccttcttgggattcatctattgtctgcctcggaatgggcagcacagagccaggatgttcttctgacctcagtatctactccagctccagctgggtgaccctgtgcaaggtatgcagtagctctaggtttctttccccttccatagatggcaga

SEQ ID NO: 295388 - DNA, 1410 bp, Homo sapiens
cagtccgttcgtcggagcccttgcacgcctgctctcttgtagcttctctcagcctagcccagcatcactatggtggacgctttcctgggcacctggaagctagtggacagcaagaatttcgatgactacatgaagtcactcgctcatatactcataaccttccccctaccctcaggtgtgggttttgctaccaggcaggtggccagcatgaccaagcctaccacaatcatcgaaaagaatggggacattctcaccctaaaaacacacagcaccttcaagaacacagagatcagctttaagttgggggtggagttcgatgagacaacagcagatgacaggaaggtcaagtccattgtgacactggatggagggaaacttgttcacctgcagaaatgggacgggcaagagaccacacttgtgcgggagctaattgatggaaaactcatcctgacactcacccacggcactgcagtttgcactcgcacttatgagaaagaggcatgacctgactgcactgttgctgactactactctgccaatcggctacccctcgactcagcaccacattgcctcatttcttcctctgcattttgtacaaatccacgaattcttctggggtcaggtgccactgaccgggatccagttccagttcccatggtgtatgtggttttttttttttttttttaactgcactcatagggtgctctgaggtcaataaagcagagccaaggccacccagttgcctttttgcctttggtaacataactctgggagtcttggtttatcctgtgtgtcagagagtgggcagaaataacggcctgaaggttactgaggaagaagcactggatgggagactgaaatggacagtctcggagcctgttaatcagctgatcaccttacacatttaataataaaagagctgtacctacacgttgcctttacactgccccccctccatggtcaaatgacctagttcagtcagtgatggggcttccccaggtttggctattgaactgtcacttcaggcccatcctacactgaaagctcttgggtctggctgttctctgtgaaatgctgtagtctctccctttccagaattcaggttcagggcacagaacccaggcttgtaccatggtggtgggagaaaatgaccactggccaagaggactgctgacctgtgcaccaggctagtacttatgactacaaattcttactgcttctctaatcaactctgagggaagagggcatctgatcattacaaaagggagggcttataagtgatctcccaagaaggcagtgatctgctagtgcctttggctctgtacctctgctgggcatctctccaaggtctaaggtaacatattaaatgtttttgtcagctaatgcaggctcagtgactttaagtctgta

SEQ ID NO: 295389 - DNA, 1444 bp, Homo sapiens
cagtccgttcgtcggagcccttgcacgcctgctctcttgtagcttctctcagcctagcccagcatcactatggtggacgctttcctgggcacctggaagctagtggacagcaagaatttcgatgactacatgaagtcactcggtgtgggttttgctaccaggcaggtggccagcatgaccaagcctaccacaatcatcgaaaagaatggggacattctcaccctaaaaacacacagcaccttcaagaacacagagatcagctttaagttgggggtggagttcgatgagacaacagcagatgacaggaaggtcaagcacagagccaggatgttcttctgacctcagtatctactccagctccagctgggtgaccctgtgcaagtccattgtgacactggatggagggaaacttgttcacctgcagaaatgggacgggcaagagaccacacttgtgcgggagctaattgatggaaaactcatcctgacactcacccacggcactgcagtttgcactcgcacttatgagaaagaggcatgacctgactgcactgttgctgactactactctgccaatcggctacccctcgactcagcaccacattgcctcatttcttcctctgcattttgtacaaatccacgaattcttctggggtcaggtgccactgaccgggatccagttccagttcccatggtgtatgtggttttttttttttttttttaactgcactcatagggtgctctgaggtcaataaagcagagccaaggccacccagttgcctttttgcctttggtaacataactctgggagtcttggtttatcctgtgtgtcagagagtgggcagaaataacggcctgaaggttactgaggaagaagcactggatgggagactgaaatggacagtctcggagcctgttaatcagctgatcaccttacacatttaataataaaagagctgtacctacacgttgcctttacactgccccccctccatggtcaaatgacctagttcagtcagtgatggggcttccccaggtttggctattgaactgtcacttcaggcccatcctacactgaaagctcttgggtctggctgttctctgtgaaatgctgtagtctctccctttccagaattcaggttcagggcacagaacccaggcttgtaccatggtggtgggagaaaatgaccactggccaagaggactgctgacctgtgcaccaggctagtacttatgactacaaattcttactgcttctctaatcaactctgagggaagagggcatctgatcattacaaaagggagggcttataagtgatctcccaagaaggcagtgatctgctagtgcctttggctctgtacctctgctgggcatctctccaaggtctaaggtaacatattaaatgtttttgtcagctaatgcaggctcagtgactttaagtctgta

SEQ ID NO: 295390 - DNA, 989 bp, Homo sapiens
cgggtcggtggcgtctggcgtggagagtttggggatctacagcagccaaaggcttgtccctgactttatatggctgcgcctggcgagcgactgagtcgtccgtgaggaaaaagaggcgaggcttttccgagatcgtctcagcgatggcgcttcggtcgcagttttgggggttctcggtttgcaggaaccctgggtgcaggttcgcagccctgtcaaccagctccgagccggcagcgaaacctgaagtggaccctgtggaaaatgaagctgtcgccccagaattcaccaaccggaacccccggaacctggagcttttatctgtagccaggaaagagcggggctggcggacggtgtttccctcccgtgagttctggcacaggttgcgagttataaggactcagcatcatgtagaagcacttgtggagcatcagaatggcaaggttgtggtttcggcctccactcgtgagtgggctattaaaaagcacctttatagtaccagaaatgtggtggcttgtgagagtataggacgagtgctggcacagagatgcttagaggcgggaatcaacttcatggtctaccaaccaaccccgtgggaggcagcctcagactcgatgaaacgactacaaagtgccatgacagaaggtggtgtggttctacgggaacctcagagaatctatgaataaatggaagcattaattgttttgaacatgtaaatataaatctgtcagccactacagccatcaaaagagagcatctggaagaacagccagcttggaagttttacagcaataatgttgcagtggaatattatttgtagttaaggtcatcctcctcccctttctgtttttttaaatcaagaactacgttctgcccctctcttgggcttcagaagcatctaagaaaagcagtcatcaattataattaactttcaaagggcaagtcagaagttgtttataaattacaaaataaaggcatattatgaactctta

SEQ ID NO: 295391 - DNA, 818 bp, Homo sapiens
cgggtcggtggcgtctggcgtggagagtttggggatctacagcagccaaaggcttgtccctgactttatatggctgcgcctggcgagcgactgagtcgtccgtgaggaaaaagaggcgaggcttttccgagatcgtctcagcgatggcgcttcggtcgcagttttgggggttctcggtttgcaggaaccctgggtgcaggttcgcagccctgtcaaccagctccgagccggcagcgaaacctgaagtggaccctgtggaaaatgaagctgtcgccccagaattcaccaaccggaacccccggaacctggagcttttatctgtagccaggaaagagcggggctggcggacggtgtttccctcccgtgagttctggcacaggttgcgagttataaggactcagcatcatgtagaagcacttgtggagcatcagaatggcaagatgaaacgactacaaagtgccatgacagaaggtggtgtggttctacgggaacctcagagaatctatgaataaatggaagcattaattgttttgaacatgtaaatataaatctgtcagccactacagccatcaaaagagagcatctggaagaacagccagcttggaagttttacagcaataatgttgcagtggaatattatttgtagttaaggtcatcctcctcccctttctgtttttttaaatcaagaactacgttctgcccctctcttgggcttcagaagcatctaagaaaagcagtcatcaattataattaactttcaaagggcaagtcagaagttgtttataaattacaaaataaaggcatattatgaactctta

SEQ ID NO: 295392 - DNA, 762 bp, Homo sapiens
cctcacatcagtccatagggtagggactagtactctcattctatacagaaataaactgaggcttacttgcccagagtcagtgtatggtggatttcaaacccagggtgactgattctgtagtccatgatgtcagccactgtatttcctgttcatatattgacatcttgtccatataatattttgaaatgctgctgaaccttgacatctctacatttcctttttacttacatcattattaagatcactttctgaaaaaccgttgtaggctgggaagttagcaagaacaaatcaatttatttctgtcttttggaaggtgaaagtattttcagcctactcgtgctgctgacttaatcttttccttttttttctgattttcaaaaccagatgaaacgactacaaagtgccatgacagaaggtggtgtggttctacgggaacctcagagaatctatgaataaatggaagcattaattgttttgaacatgtaaatataaatctgtcagccactacagccatcaaaagagagcatctggaagaacagccagcttggaagttttacagcaataatgttgcagtggaatattatttgtagttaaggtcatcctcctcccctttctgtttttttaaatcaagaactacgttctgcccctctcttgggcttcagaagcatctaagaaaagcagtcatcaattataattaactttcaaagggcaagtcagaagttgtttataaattacaaaataaaggcatattatgaactctta

SEQ ID NO: 295393 - DNA, 685 bp, Homo sapiens
gatggacctactctttttctggtaaatggtcctaaaataaaacctggcgtttaacatggacactcagggggtcgccctgaaacaaaagggggtgcgaggcgtggcccgcacgtgcgagcccgggaggcccgctttcccgcggagggcgcgtttccaacgccgccccggacaccacatccacgcgttgccggtctcaaaaccctgccgcgcgcggcggggctcctcctcgctgtgggaaaagtggggccacagcgccctgccccagagaacggcgggtgggctgggtccggctgcggggccccgaggccctttctgcggaggtaaaggagagaaacgagggcagccggggtccggtcgcggtgggactcggccctccccggccgcaaacccgacccaggcccggcccgcccttaccgttttgggagcggatcgtttccccagtgctgcggtcaccgaacacggacaaaggcccctccatcttgacggcagcgatacacgtcgaattctgcttacaccgcgggcaaccagtatcgcggcccctcggccgaccggcgaccacagcagtggctgcgacggcgtggagcgtacccgagcgatgtcccaggagctactgggtaacacaccaccccacccgcttcccggctgccccggcccggccgcggggcacggcgggaaggaaaaagag

SEQ ID NO: 295394 - DNA, 1004 bp, Homo sapiens
tttttgactactctttcgcctactcctactatgctgcgagaagacgacagaatgggggagctggggtgtaactggaggggcgggcccttctccaagttagagttggggttctgagcgagtcgtgcgttttaggtttagtgtcttttccttgtccctgctcggggagcgtgaggcagatcggccggctttgctccaggcctcaggagtggtgcaggttcgcagccctgtcaaccagctccgagccggcagcgaaacctgaagtggaccctgtggaaaatgaagctgtcgccccagaattcaccaaccggaacccccggaacctggagcttttatctgtagccaggaaagagcggggctggcggacggtgtttccctcccgtgagttctggcacaggttgcgagttataaggactcagcatcatgtagaagcacttgtggagcatcagaatggcaaggttgtggtttcggcctccactcgtgagtgggctattaaaaagcacctttatagtaccagaaatgtggtggcttgtgagagtataggacgagtgctggcacagagatgcttagaggcgggaatcaacttcatggtctaccaaccaaccccgtgggaggcagcctcagactcgatgaaacgactacaaagtgccatgacagaaggtggtgtggttctacgggaacctcagagaatctatgaataaatggaagcattaattgttttgaacatgtaaatataaatctgtcagccactacagccatcaaaagagagcatctggaagaacagccagcttggaagttttacagcaataatgttgcagtggaatattatttgtagttaaggtcatcctcctcccctttctgtttttttaaatcaagaactacgttctgcccctctcttgggcttcagaagcatctaagaaaagcagtcatcaattataattaactttcaaagggcaagtcagaagttgtttataaattacaaaataaaggcatattatgaactctta

SEQ ID NO: 295395 - DNA, 1411 bp, Homo sapiens
gatggacctactctttttctggtaaatggtcctaaaataaaacctggcgtttaacatggacactcagggggtcgccctgaaacaaaagggggtgcgaggcgtggcccgcacgtgcgagcccgggaggcccgctttcccgcggagggcgcgtttccaacgccgccccggacaccacatccacgcgttgccggtctcaaaaccctgccgcgcgcggcggggctcctcctcgctgtgggaaaagtggggccacagcgccctgccccagagaacggcgggtgggctgggtccggctgcggggccccgaggccctttctgcggaggtaaaggagagaaacgagggcagccggggtccggtcgcggtgggactcggccctccccggccgcaaacccgacccaggcccggcccgcccttaccgttttgggagcggatcgtttccccagtgctgcggtcaccgaacacggacaaaggcccctccatcttgacggcagcgatacacgtcgaattctgcttacaccgcgggcaaccagtatcgcggcccctcggccgaccggcgaccacagcagtggctgcgacggcgtggagcgtacccgagcgatgtcccaggagctactggggtgcaggttcgcagccctgtcaaccagctccgagccggcagcgaaacctgaagtggaccctgtggaaaatgaagctgtcgccccagaattcaccaaccggaacccccggaacctggagcttttatctgtagccaggaaagagcggggctggcggacggtgtttccctcccgtgagttctggcacaggttgcgagttataaggactcagcatcatgtagaagcacttgtggagcatcagaatggcaaggttgtggtttcggcctccactcgtgagtgggctattaaaaagcacctttatagtaccagaaatgtggtggcttgtgagagtataggacgagtgctggcacagagatgcttagaggcgggaatcaacttcatggtctaccaaccaaccccgtgggaggcagcctcagactcgatgaaacgactacaaagtgccatgacagaaggtggtgtggttctacgggaacctcagagaatctatgaataaatggaagcattaattgttttgaacatgtaaatataaatctgtcagccactacagccatcaaaagagagcatctggaagaacagccagcttggaagttttacagcaataatgttgcagtggaatattatttgtagttaaggtcatcctcctcccctttctgtttttttaaatcaagaactacgttctgcccctctcttgggcttcagaagcatctaagaaaagcagtcatcaattataattaactttcaaagggcaagtcagaagttgtttataaattacaaaataaaggcatattatgaactctta

SEQ ID NO: 295396 - DNA, 1166 bp, Homo sapiens
gctgggaagaggttgaaccttcgcctcaaacgatgttgcgcagacgcagtgggccattctagtgccttctagaaaaggttgtaagaagggtggagcttggagctggggtgtaactggaggggcgggcccttctccaagttagagttggggttctgagcgagtcgtgcgttttaggtttagtgtcttttccttgtccctgctcggggagcgtgaggcagatcggccggctttgctccaggcctcaggagtgtcactcgcctgggcttgcacagtacattggaacgtgcgggttctattttgtattcgacgtgccggatcgaaatagagctcgcggcactgcgaagaccacagtaggaagttaaggacgggggtgcaggttcgcagccctgtcaaccagctccgagccggcagcgaaacctgaagtggaccctgtggaaaatgaagctgtcgccccagaattcaccaaccggaacccccggaacctggagcttttatctgtagccaggaaagagcggggctggcggacggtgtttccctcccgtgagttctggcacaggttgcgagttataaggactcagcatcatgtagaagcacttgtggagcatcagaatggcaaggttgtggtttcggcctccactcgtgagtgggctattaaaaagcacctttatagtaccagaaatgtggtggcttgtgagagtataggacgagtgctggcacagagatgcttagaggcgggaatcaacttcatggtctaccaaccaaccccgtgggaggcagcctcagactcgatgaaacgactacaaagtgccatgacagaaggtggtgtggttctacgggaacctcagagaatctatgaataaatggaagcattaattgttttgaacatgtaaatataaatctgtcagccactacagccatcaaaagagagcatctggaagaacagccagcttggaagttttacagcaataatgttgcagtggaatattatttgtagttaaggtcatcctcctcccctttctgtttttttaaatcaagaactacgttctgcccctctcttgggcttcagaagcatctaagaaaagcagtcatcaattataattaactttcaaagggcaagtcagaagttgtttataaattacaaaataaaggcatattatgaactctta

SEQ ID NO: 295397 - DNA, 935 bp, Homo sapiens
cgggtcggtggcgtctggcgtggagagtttggggatctacagcagccaaaggcttgtccctgactttatatggctgcgcctggcgagcgactgagtcgtccgtgaggaaaaagaggcgaggcttttccgagatcgtctcagcgatggcgcttcggtcgcagttttgggggttctcggtttgcaggaaccctgggtgcaggttcgcagccctgtcaaccagctccgagccggcagcgaaacctgaagtggaccctgtggttttatctgtagccaggaaagagcggggctggcggacggtgtttccctcccgtgagttctggcacaggttgcgagttataaggactcagcatcatgtagaagcacttgtggagcatcagaatggcaaggttgtggtttcggcctccactcgtgagtgggctattaaaaagcacctttatagtaccagaaatgtggtggcttgtgagagtataggacgagtgctggcacagagatgcttagaggcgggaatcaacttcatggtctaccaaccaaccccgtgggaggcagcctcagactcgatgaaacgactacaaagtgccatgacagaaggtggtgtggttctacgggaacctcagagaatctatgaataaatggaagcattaattgttttgaacatgtaaatataaatctgtcagccactacagccatcaaaagagagcatctggaagaacagccagcttggaagttttacagcaataatgttgcagtggaatattatttgtagttaaggtcatcctcctcccctttctgtttttttaaatcaagaactacgttctgcccctctcttgggcttcagaagcatctaagaaaagcagtcatcaattataattaactttcaaagggcaagtcagaagttgtttataaattacaaaataaaggcatattatgaactctta

SEQ ID NO: 295398 - DNA, 1470 bp, Homo sapiens
cgggtcggtggcgtctggcgtggagagtttggggatctacagcagccaaaggcttgtccctgactttatatggctgcgcctggcgagcgactgagtcgtccgtgaggaaaaagaggcgaggcttttccgagatcgtctcagcgatggcgcttcggtcgcagttttgggggttctcggtttgcaggaaccctgggtgcaggttcgcagccctgtcaaccagctccgagccggcagcgaaacctgaagtggaccctgtggaaaatgaagctgtcgccccagaattcaccaaccggaacccccggaacctggagcttttatctgtagccaggaaagagcggggctggcggacggtgtttccctcccgtgagttctggcacaggttgcgagttataaggactcagcatcatgtagaagcacttgtggagcatcagaatggcaaggttgtggtttcggcctccactcgtgagtgggctattaaaaagcacctttatagtaccagaaatgtggtggcttgtgagagtataggacgagtgctggcacagagatgcttagaggcgggaatcaacttcatggtctaccaaccaaccccgtgggaggcagcctcagactcgatgaaacgactacaaagtgccatgacagaaggtggtgtggttctacgggaacctcagagaatctatgaataaatggaagcattaattgttttgaacatgtaaatataaatctgtcagccactacagccatcaaaagagagcatctggaagaacagccagcttggaagttttacagcaataatgttgcagtggaatattatttgtagttaaggtcatcctcctcccctttctgtttttttaaatcaagaactacgttctgcccctctcttgggcttcagaagcatctaagaaaagcagtcatcaattataattaactttcaaagggcaagtcagaagttgtttataaattacaaaataaaggcatattatgaactcttattttctggttatatgacattgtctgagctcactgtggcagtggagcacatatgaggttgatgtaaagcacttattactgtgtctagttcatggcgagtgatctcagtgaatgacagttgtttgctgctcggagtgtggggtgttttttaaaataggaaatgtcagtatcaatctaatattatagaacagtcagtatgtgaaaatgaaaggaccaaatgccaacctcacttggactcttggttcccaacagtaagagaaacaaatttgaaagaggaaggaggtggcatcaggagctgaaagcagaggtggaaatggttggggttagtgggcgctcaatttgccatgaagtgaacattttattagataggagatgaaacttgaaatgcatgcaagttaatctaaaatttgagcttgggtagatgggaatcatggcagttctctgaaaggagctgattaaggtgttaatttttggctatttgat

SEQ ID NO: 295399 - DNA, 552 bp, Homo sapiens
agttcgacggagactctcacaagctcacagtgggctattaaaaagcacctttatagtaccagaaatgtggtggcttgtgagagtataggacgagtgctggcacagagatgcttagaggcgggaatcaacttcatggtctaccaaccaaccccgtgggaggcagcctcagactcgatgaaacgactacaaagtgccatgacagaaggtggtgtggttctacgggaacctcagagaatctatgaataaatggaagcattaattgttttgaacatgtaaatataaatctgtcagccactacagccatcaaaagagagcatctggaagaacagccagcttggaagttttacagcaataatgttgcagtggaatattatttgtagttaaggtcatcctcctcccctttctgtttttttaaatcaagaactacgttctgcccctctcttgggcttcagaagcatctaagaaaagcagtcatcaattataattaactttcaaagggcaagtcagaagttgtttataaattacaaaataaaggcatattatgaactctta

SEQ ID NO: 295400 - DNA, 923 bp, Homo sapiens
cgggtcggtggcgtctggcgtggagagtttggggatctacagcagccaaaggcttgtccctgactttatatggctgcgcctggcgagcgactgagtcgtccgtgaggaaaaagaggcgaggcttttccgagatcgtctcagcgatggcgcttcggtcgcagttttgggggttctcggtttgcaggaaccctgggtgcaggttcgcagccctgtcaaccagctccgagccggcagcgaaacctgaagtggaccctgtggaaaatgaagctgtcgccccagaattcaccaaccggaacccccggaacctggagcttttatctgtagccaggaaagagcggggctggcggacggtgtttccctcccgtgagttctggcacaggttgcgagttataaggactcagcatcatgtagaagcacttgtggagcatcagaatggcaaggttgtggtttcggcctccactcgtgtgctggcacagagatgcttagaggcgggaatcaacttcatggtctaccaaccaaccccgtgggaggcagcctcagactcgatgaaacgactacaaagtgccatgacagaaggtggtgtggttctacgggaacctcagagaatctatgaataaatggaagcattaattgttttgaacatgtaaatataaatctgtcagccactacagccatcaaaagagagcatctggaagaacagccagcttggaagttttacagcaataatgttgcagtggaatattatttgtagttaaggtcatcctcctcccctttctgtttttttaaatcaagaactacgttctgcccctctcttgggcttcagaagcatctaagaaaagcagtcatcaattataattaactttcaaagggcaagtcagaagttgtttataaattacaaaataaaggcatattatgaactctta

SEQ ID NO: 295401 - DNA, 757 bp, Homo sapiens
cgggtcggtggcgtctggcgtggagagtttggggatctacagcagccaaaggcttgtccctgactttatatggctgcgcctggcgagcgactgagtcgtccgtgaggaaaaagaggcgaggcttttccgagatcgtctcagcgatggcgcttcggtcgcagttttgggggttctcggtttgcaggaaccctgggtgcaggttcgcagccctgtcaaccagctccgagccggcagcgaaacctgaagtggaccctgtggaaaatgaagctgtcgccccagaattcaccaaccggaacccccggaacctggagcttttatctgtagccaggaaagagcggggctggcggacggtgtttccctcccgtgagttctggcacagatgaaacgactacaaagtgccatgacagaaggtggtgtggttctacgggaacctcagagaatctatgaataaatggaagcattaattgttttgaacatgtaaatataaatctgtcagccactacagccatcaaaagagagcatctggaagaacagccagcttggaagttttacagcaataatgttgcagtggaatattatttgtagttaaggtcatcctcctcccctttctgtttttttaaatcaagaactacgttctgcccctctcttgggcttcagaagcatctaagaaaagcagtcatcaattataattaactttcaaagggcaagtcagaagttgtttataaattacaaaataaaggcatattatgaactctta

SEQ ID NO: 295402 - DNA, 858 bp, Homo sapiens
tttttgactactctttcgcctactcctactatgctgcgagaagacgacagaatgggggagctggggtgtaactggaggggcgggcccttctccaagttagagttggggttctgagcgagtcgtgcgttttaggtttagtgtcttttccttgtccctgctcggggagcgtgaggcagatcggccggctttgctccaggcctcaggagtggtgcaggttcgcagccctgtcaaccagctccgagccggcagcgaaacctgaagtggaccctgtggaaaatgaagctgtcgccccagaattcaccaaccggaacccccggaacctggagcttttatctgtagccaggaaagagcggggctggcggacggtgtttccctcccgtgagttctggcacaggttgcgagttataaggactcagcatcatgtagaagcacttgtggagcatcagaatggcaaggttgtggtttcggcctccactcgtgatgaaacgactacaaagtgccatgacagaaggtggtgtggttctacgggaacctcagagaatctatgaataaatggaagcattaattgttttgaacatgtaaatataaatctgtcagccactacagccatcaaaagagagcatctggaagaacagccagcttggaagttttacagcaataatgttgcagtggaatattatttgtagttaaggtcatcctcctcccctttctgtttttttaaatcaagaactacgttctgcccctctcttgggcttcagaagcatctaagaaaagcagtcatcaattataattaactttcaaagggcaagtcagaagttgtttataaattacaaaataaaggcatattatgaactctta

SEQ ID NO: 295403 - DNA, 833 bp, Homo sapiens
tttttgactactctttcgcctactcctactatgctgcgagaagacgacagaatgggggagctggggtgtaactggaggggcgggcccttctccaagttagagttggggttctgagcgagtcgtgcgttttaggtttagtgtcttttccttgtccctgctcggggagcgtgaggcagatcggccggctttgctccaggcctcaggagtggtgcaggttcgcagccctgtcaaccagctccgagccggcagcgaaacctgaagtggaccctgtggaaaatgaagctgtcgccccagaattcaccaaccggaacccccggaacctggagcttttatctgtagccaggaaagagcggggctggcggacggtgtttccctcccgtgagttctggcacaggttgcgagttataaggactcagcatcatgtagaagcacttgtggagcatcagaatggcaagatgaaacgactacaaagtgccatgacagaaggtggtgtggttctacgggaacctcagagaatctatgaataaatggaagcattaattgttttgaacatgtaaatataaatctgtcagccactacagccatcaaaagagagcatctggaagaacagccagcttggaagttttacagcaataatgttgcagtggaatattatttgtagttaaggtcatcctcctcccctttctgtttttttaaatcaagaactacgttctgcccctctcttgggcttcagaagcatctaagaaaagcagtcatcaattataattaactttcaaagggcaagtcagaagttgtttataaattacaaaataaaggcatattatgaactctta

SEQ ID NO: 295404 - DNA, 843 bp, Homo sapiens
cgggtcggtggcgtctggcgtggagagtttggggatctacagcagccaaaggcttgtccctgactttatatggctgcgcctggcgagcgactgagtcgtccgtgaggaaaaagaggcgaggcttttccgagatcgtctcagcgatggcgcttcggtcgcagttttgggggttctcggtttgcaggaaccctgggtgcaggttcgcagccctgtcaaccagctccgagccggcagcgaaacctgaagtggaccctgtggaaaatgaagctgtcgccccagaattcaccaaccggaacccccggaacctggagcttttatctgtagccaggaaagagcggggctggcggacggtgtttccctcccgtgagttctggcacaggttgcgagttataaggactcagcatcatgtagaagcacttgtggagcatcagaatggcaaggttgtggtttcggcctccactcgtgatgaaacgactacaaagtgccatgacagaaggtggtgtggttctacgggaacctcagagaatctatgaataaatggaagcattaattgttttgaacatgtaaatataaatctgtcagccactacagccatcaaaagagagcatctggaagaacagccagcttggaagttttacagcaataatgttgcagtggaatattatttgtagttaaggtcatcctcctcccctttctgtttttttaaatcaagaactacgttctgcccctctcttgggcttcagaagcatctaagaaaagcagtcatcaattataattaactttcaaagggcaagtcagaagttgtttataaattacaaaataaaggcatattatgaactctta

SEQ ID NO: 295405 - DNA, 874 bp, Homo sapiens
gctgggaagaggttgaaccttcgcctcaaacgatgttgcgcagacgcagtgggccattctagtgccttctagaaaagggtgcaggttcgcagccctgtcaaccagctccgagccggcagcgaaacctgaagtggaccctgtggaaaatgaagctgtcgccccagaattcaccaaccggaacccccggaacctggagcttttatctgtagccaggaaagagcggggctggcggacggtgtttccctcccgtgagttctggcacaggttgcgagttataaggactcagcatcatgtagaagcacttgtggagcatcagaatggcaaggttgtggtttcggcctccactcgtgagtgggctattaaaaagcacctttatagtaccagaaatgtggtggcttgtgagagtataggacgagtgctggcacagagatgcttagaggcgggaatcaacttcatggtctaccaaccaaccccgtgggaggcagcctcagactcgatgaaacgactacaaagtgccatgacagaaggtggtgtggttctacgggaacctcagagaatctatgaataaatggaagcattaattgttttgaacatgtaaatataaatctgtcagccactacagccatcaaaagagagcatctggaagaacagccagcttggaagttttacagcaataatgttgcagtggaatattatttgtagttaaggtcatcctcctcccctttctgtttttttaaatcaagaactacgttctgcccctctcttgggcttcagaagcatctaagaaaagcagtcatcaattataattaactttcaaagggcaagtcagaagttgtttataaattacaaaataaaggcatattatgaactctta

SEQ ID NO: 295406 - DNA, 1055 bp, Homo sapiens
cgggtcggtggcgtctggcgtggagagtttggggatctacagcagccaaaggcttgtccctgactttatatggctgcgcctggcgagcgactgagtcgtccgtgaggaaaaagaggcgaggcttttccgagatcgtctcagcgatggcgcttcggtcgcagttttgggggttctcggtttgcaggaaccctgggtgcaggttcgcagccctgtcaaccagctccgagccggcagcgaaacctgaagtggaccctgtggaaaatgaagctgtcgccccagaattcaccaaccggaacccccggaacctggagcttttatctgtagccaggaaagagcggggctggcggacggtgtttccctcccgtgagttctggcacaggttgcgagttataaggactcagcatcatgtagaagcacttgtggagcatcagaatggcaaggttgtggtttcggcctccactcgtgagtgggctattaaaaagcacctttatagtaccagaaatgtggtggcttgtgagagtataggacgagtgctggcacagagatgcttagaggcgggaatcaacttcatggtctaccaaccaaccccgtgggaggcagcctcagactcgatgaaacgactacaaagtgccatgacagaaggtggtgtggttctacgggaacctcagagaatctatgaataaatggaagcattaattgttttgaacatgtaaatataaatctgtcagccactacagccatcaaaagagagcatctggaagaacagccagcttggaagttttacagcaataatgttgcagtggaatattatttgtagttaaggtcatcctcctcccctttctgtttttttaaatcaagaactacgttctgcccctctcttgggcttcagaagcatctaagaaaagcagtcatcaattataattaactttcaaagggcaagtcagaagttgtttataaattacaaaataaaggcatattatgaactcttaaaaaaaaaaagaaaaaggaaataaaaattgtttgggggcatgcgcctggagaaagttattaaaagt

SEQ ID NO: 295407 - DNA, 1501 bp, Homo sapiens
cgggtcggtggcgtctggcgtggagagtttggggatctacagcagccaaaggcttgtccctgactttatatggctgcgcctggcgagcgactgagtcgtccgtgaggaaaaagaggcgaggcttttccgagatcgtctcagcgatggcgcttcggtcgcagttttgggggttctcggtttgcaggaaccctgggtgcaggttcgcagccctgtcaaccagctccgagccggcagcgaaacctgaagtggaccctgtggaaaatgaagctgtcgccccagaattcaccaaccggaacccccggaacctggagcttttatctgtagccaggaaagagcggggctggcggacggtgtttccctcccgtgagttctggcacaggttgcgagttataaggactcagcatcatgtagaagcacttgtggagcatcagaatggcaaggttgtggtttcggcctccactcgtgagtgggctattaaaaagcacctttatagtaccagaaatgtggtggcttgtgagagtataggacgagtgctggcacagagatgcttagaggcgggaatcaacttcatggtctaccaaccaaccccgtgggaggcagcctcagactcggtatttttgttttcatgtacttattgaaaagatgaaacgactacaaagtgccatgacagaaggtggtgtggttctacgggaacctcagagaatctatgaataaatggaagcattaattgttttgaacatgtaaatataaatctgtcagccactacagccatcaaaagagagcatctggaagaacagccagcttggaagttttacagcaataatgttgcagtggaatattatttgtagttaaggtcatcctcctcccctttctgtttttttaaatcaagaactacgttctgcccctctcttgggcttcagaagcatctaagaaaagcagtcatcaattataattaactttcaaagggcaagtcagaagttgtttataaattacaaaataaaggcatattatgaactcttattttctggttatatgacattgtctgagctcactgtggcagtggagcacatatgaggttgatgtaaagcacttattactgtgtctagttcatggcgagtgatctcagtgaatgacagttgtttgctgctcggagtgtggggtgttttttaaaataggaaatgtcagtatcaatctaatattatagaacagtcagtatgtgaaaatgaaaggaccaaatgccaacctcacttggactcttggttcccaacagtaagagaaacaaatttgaaagaggaaggaggtggcatcaggagctgaaagcagaggtggaaatggttggggttagtgggcgctcaatttgccatgaagtgaacattttattagataggagatgaaacttgaaatgcatgcaagttaatctaaaatttgagcttgggtagatgggaatcatggcagttctctgaaaggagctgattaaggtgttaatttttggctatttgat

SEQ ID NO: 295408 - DNA, 5171 bp, Homo sapiens
agaccttctgtccaccagctgagaaggacaagggcggaaggcagctgcacagagcagggccacggccttgcacacagtccagggagcttttgtgcaggagccaggcctccccctgggtccccatgatgagagaatgggttctgctcatgtccgtgctgctctgtggcctggctggccccacacacctgttccagccaagcctggtgctggacatggccaaggtcctcttggataactactgcttcccggagaacctgctgggcatgcaggaagccatccagcaggccatcaagagccatgagattctgagcatctcagacccgcagacgctggccagtgtgctgacagccggggtgcagagctccctgaacgatcctcgcctggtcatctcctatgagcccagcacccccgagcctcccccacaagtcccagcactcaccagcctctcagaagaggaactgcttgcctggctgcaaaggggcctccgccatgaggttctggagggtaatgtgggctacctgcgggtggacagcgtcccgggccaggaggtgctgagcatgatgggggagttcctggtggcccacgtgtgggggaatctcatgggcacctccgccttagtgctggatctccggcactgcacaggaggccaggtctctggcattccctacatcatctcctacctgcacccagggaacaccatcctgcacgtggacactatctacaaccgcccctccaacaccaccacggagatctggaccttgccccaggtcctgggagaaaggtacggtgccgacaaggatgtggtggtcctcaccagcagccagaccaggggcgtggccgaggacatcgcgcacatccttaagcagatgcgcagggccatcgtggtgggcgagcggactgggggaggggccctggacctccggaagctgaggataggcgagtctgacttcttcttcacggtgcccgtgtccaggtccctggggccccttggtggaggcagccagacgtgggagggcagcggggtgctgccctgtgtggggactccggccgagcaggccctggagaaagccctggccatcctcactctgcgcagcgcccttccaggggtagtccactgcctccaggaggtcctgaaggactactacacgctggtggaccgtgtgcccaccctgctgcagcacttggccagcatggacttctccacggtggtctccgaggaagatctggtcaccaagctcaatgccggcctgcaggctgcgtctgaggatcccaggctcctggtgcgagccatcgggcccacagaaactccttcttggcccgcgcccgacgctgcagccgaagactcaccaggggtggccccagagttgcctgaggacgaggctatccggcaagcactggtggactctgtgttccaggtgtcggtgctgccaggcaatgtgggctacctgcgcttcgatagttttgctgacgcctccgtcctgggtgtgttggccccatatgtcctgcgccaggtgtgggagccgctacaggacacggagcacctcatcatggacctgcgccacaaccctggagggccatcctctgctgtgcccctgctcctgtcctacttccagggccctgaggccggccccgtgcacctcttcaccacctatgatcgccgcaccaacatcacgcaggagcacttcagccacatggagctcccgggcccacgctacagcacccaacgtggggtgtatctgctcaccagccaccgcaccgccacggccgcggaggagttcgccttccttatgcagtcgctgggctgggccacactggtaggtgagatcaccgcgggcaacctgctgcacacccgcacggtgccgctgctggacacacccgaaggcagcctcgcgctcaccgtgccggtcctcaccttcatcgacaatcacggcgaggcctggctgggtggtggagtggtgcccgatgccatcgtgctggccgaggaggccctggacaaagcccaggaagtgctggagttccaccaaagcctgggggccttggtggagggcacagggcacctgctggaggcccactatgctcggccagaggtcgtggggcagaccagtgccctcctgcgggccaagctggcccagggcgcctaccgcacagctgtggacttggagtctctggcctctcagctcacagcagacctccaggaggtgtctggggaccaccgcttgctagtgttccacagccctggcgagctggtggtagaggaagcacccccaccaccccctgctgtcccctctccagaggagctcacctaccttattgaggccctgttcaagacagaggtgctgcccggccagctgggctacctgcgttttgacgccatggctgaactggagacagtgaaggccgtggggccacagctggtgcggctggtatggcaacagctggtggacacggctgcgctggtgatcgacctgcgctacaaccctggcagctactccacggccatcccgctgctctgctcctacttctttgaggcagagccccgccagcacctgtattctgtctttgacagggccacctcaaaagtcacggaggtgtggaccttgccccaggtcgccggccagcgctacggctcacacaaggacctctacatcctgatgagccacaccagtggctctgcggccgaggcctttgcacacaccatgcaggacctgcagcgggccacggtcattggggagcccacggccggaggcgcactctctgtgggcatctaccaggtgggcagcagccccttatatgcatccatgcccacccagatggccatgagtgccaccacaggcaaggcctgggacctggctggtgtggagcccgacatcactgtgcccatgagcgaagccctttccatagcccaggacatagtggctctgcgtgccaaggtgcccacggtgctgcagacggccgggaagctggtggctgataactatgcctctgccgagctgggggccaagatggccaccaaactgagcggtctgcagagccgctactccagggtgacctcagaagtggccctagccgagatcctgggggctgacctgcagatgctctccggagacccacacctgaaggcagcccatatccctgagaatgccaaggaccgcattcctggaattgtgcccatgcagatcccttcccctgaagtatttgaagagctgatcaagttttccttccacactaacgtgcttgaggacaacattggctacttgaggtttgacatgtttggggacggtgagctgctcacccaggtctccaggctgctggtggagcacatctggaagaagatcatgcacacggatgccatgatcatcgacatgaggttcaacatcggtggccccacatcctccattcccatcttgtgctcctacttctttgatgaaggccctccagttctgctggacaagatctacagccggcctgatgactctgtcagtgaactctggacacacgcccaggttgtaggtgaacgctatggctccaagaagagcatggtcattctgaccagcagtgtgacggccggcaccgcggaggagttcacctatatcatgaagaggctgggccgggccctggtcattggggaggtgaccagtgggggctgccagccaccacagacctaccacgtggatgacaccaacctctacctcactatccccacggcccgttctgtgggggcctcggatggcagctcctgggaaggggtgggggtgacaccccatgtggttgtccctgcagaagaggctctcgccagggccaaggagatgctccagcacaaccagctgagggtgaagcggagcccaggcctgcaggaccacctgtagggaagggccccataggcagagccccagggcagacagaacctctgggacacacaccaagggcactcctgcaggtggcccggcctgaggttcccaggagcagcaaaggggcctgctgagctctggttaggttacagctggaggtgtgtatatatacacacacacacatgtatatacacatatatatgtgtatgtatatatatgtatatatatatggctttccaataaccacctaaattttaacaaaggttccttctaagtggtagaacttggggtggtatttttaccttccttcttcatactttgctctttttcttaaatactcattaatgtgcatatatcattattttcagatgcagctatcattattccaaaatacaaaataaagaagataaaataaattatatacccgagccattaaccacaatttagtgatcactagtggttgttaaatctcttcttttcatgagttctccattcacattatttagatcttctggatctgccctgctgacctctatggacagctgattttatttaagatgtggtgcaagatgctgtggggtcagcaggtggcaaagatcttgtggatcttaaatagggaaagggctggtgcggcccttctgctggtgatgtacatacactggctgtgtctcttctgagcctcatgccggctgcatagctggccactctcatcttctacccaggagccagctgagacacagacaaactccgcagctcacccaaggtcacacatccagcatggtggacctgtgtcctcctttgggccacccagcatttgcagcacctttggatgatcagagaatcactgcccataggaatcagtaggaaacagtgatgtcagccttgcctgggtgggaaaccagcccagccacttccccagctgagtggttctgggcaatttgtttcacttctttgggcctcagtttgttcacctgttcaatgggagaaataatactacacttggagttgtgagaatgaagtgagttaatctagtgtccagccaatgttagctgtcataatttctccaccacaaagctgaacactctggaagccccacttttccagcccttctggcagtagggcatgggcatgtgatcctgccttggtcaaccagaagctcctgtgcaagatgtttaatctggagcaagtggccagggagcctgggcagcggccatctgccagaagcctagtgtacagggacagcacagccatgccctgtgcttagcagggacagcagcagcaccctcaacaggtgcttcctcgacttcctggtgtgactttggc

SEQ ID NO: 295409 - DNA, 728 bp, Homo sapiens
aatagggccagaaaagcacaagccaaatggcatgtcacaatgtgatctgtaaagagtgtctcacttagaggggttttagtgcgtgcactgctctatcccgtgttgcgggtgcatggcattggtggaacgcatcatgggtcttccgtgttttttccttggagtttgttttcttagttcagaccatggtaaattgtaaaagaaaatctgtgataaagtataatgattgtaccatattggcccagataacattttctgtgttttcattagcttcaaattttaggaactgtatttagccgtactgactttgggaacatagtagaagattctgttttttttttttaacctcttattattacttggaatgtttttccttaacttttttcacatttttattagtttggcacaaactatgaagaccctaaggctaagaaagaacactgtgaaattttcattatatagacattttaaaaatactctgatctttgctgtgctgggtaagctatttaatttttcttacagtaaattatcttagtattgttatattccttcaaaggtgactttttgtgtgtttcagcttctatagtgtttatggggtggacaactaagacatttagaattgcaaaatgccaatcagtaagtataacctacctatttcacaatcgcccctgggagtcattgtggctggttgggcctatgggcctgcaggctgtgtttgatgtggtgacgca

SEQ ID NO: 295410 - DNA, 752 bp, Homo sapiens
tagtcccggtggggaccgatctgtcagtatgtgtcctagatggagttctggagagtactgtatacgaggtagtctataatataggagctctgatagcgagactctgatatcaaattcatctgaccacatcctgtagaaaataccaccttttccccttgtattacagtacaatgtttacattactatactgtcaagctgaaagtataaaaaatgtacatatacattttgagttatgtatcctttttttaaaaaaaagttcgagtctgttgcactaggctgtacatgactaaagttgacagatgctatgctagatttataatcactagttctggtacttgtgtctttgtatgatcaaagcatgcaataagcaatacaaaataccaagccttatacttaaaagaagtttaacatattggttaatatactggttaatatactggttaaacatattgaatgtatataagtggcaaaactagatttttaaggaagtgtacattataatattggagctcagtactgcatgaagagacttcattaaaactaagaaaacatttatttggggagaaattttaggcatttaagaacttgtatttttctattttaaaaagttaaattattccgtaatttggaagaagtttcgttgaatgtaggacataaccgtttgaagggttttcatttgaaaaattgatgtattttgtgccttaatattttgttcttttaataaaaatgctctgaatttgaaaaaaaaaatc

SEQ ID NO: 295411 - DNA, 595 bp, Homo sapiens
gggaaatgaacttacatttaaagatttaagactgactgttaattaactctctcttcttctctatcctagtttctctttctatgattgggcctcatggatatatctctgcatcagattggcccctaatgattgtgagtatttctcatcattttttcctttttaaaaaatgaattttataccctaagagctttgtggtagtaattcctcagtagttaatgctttgacatatcctgtatttctggttccagagtgactggaaaatgaagggttggatacttgaatgtagaagtgccaactttcaaatgaccaaaaggcttaactgactaaaattgcttctcttcctacagttttacatggtgatgtgtattgtttatatattatatggcatactctggctgacgtggtctgcctgttattggaaagatatattaagaatccagttctggattgcagctgttatttttttgggaatgcttgaaaaagcagttttttatagtgaataccaaaacatcagcaacactggactgtcaagtaagttttgactgtctctgtaaatatagtatgatctaagagttccccagtatttatgagcaga

SEQ ID NO: 295412 - DNA, 5203 bp, Homo sapiens
agccctcccttgcacgttccggctcctcctctatcttcacgcccacgctaggccctgagcccacctctacgtctcgccgccaactccacatcctggctcctatctctgccttccaggcatctcccagctgcacgctcgggcccggctcagagccctaagccctgcctcccggtcctggccgggtttcccagaactgcacggcgcctctccgcccaggcccaagcgcgagcccctcctccacacccgagtcccagccccgcgtcccggattcggacccgcctgcctggggcggtgctgcaccaggtgcgggtgtggcaggcgtctcggagcgccaggtgcagcttcctgatcaagatggtcgccgcctgccgctcggtagccgggctcctgccacgccgccgccgctgctttcccgcccgggccccgctgctgcgcgtcgccctctgcctcctgtgctggaccccggcggctgtgcgcgcggtccctgagctcgggctctggttagagacagtcaacgacaaatcaggacctttgatatttaggaaaactatgtttaactctacagatatcaagttatctgttaagtcattccattgttctgggcctgtgaagtttaccatagtgtggcatttgaagtatcatacctgtcacaatgagcattctaatctggaagagctgttccaaaaacataaacttagtgttgatgaagacttttgtcattatttgaagaatgacaactgttggacaacaaaaaatgaaaacttagattgcaacagtgattcacaggtgtttccctctttgaataataaagaactaataaatatcagaaatgtttcaaaccaggaaagatcaatggatgttgtagccagaacacaaaaagatgggtttcatatctttattgtttctattaaaacggagaatacagatgcaagctggaatttgaatgtttctctttctatgattgggcctcatggatatatctctgcatcagattggcccctaatgattttttacatggtgatgtgtattgtttatatattatatggcatactctggctgacgtggtctgcctgttattggaaagatatattaagaatccagttctggattgcagctgttatttttttgggaatgcttgaaaaagcagttttttatagtgaataccaaaacatcagcaacactggactgtcaacccaaggcttattgatatttgcggagttgatttctgcgattaagaggacgttggctcgccttctcgtgatcattgtgagcctgggctatggcattgtgaagcctcgtttaggaacagtcatgcaccgggtgatcggactggggcttctatacttaatctttgcagctgttgaaggcgtgatgagagtcattgggggttctaaccatttagctgttgttcttgatgacattattttagcagttattgactccatttttgtgtggttcatttttattagtttggcacaaactatgaagaccctaaggctaagaaagaacactgtgaaattttcattatatagacattttaaaaatactctgatctttgctgtgctggcttctatagtgtttatggggtggacaactaagacatttagaattgcaaaatgccaatcagattggatggaacgctgggttgacgatgcattttggagcttccttttttcgcttatccttattgtaatcatgtttttgtggagaccatcagcaaacaatcagagatatgccttcatgcccttaatagatgattctgatgatgaaattgaggaattcatggtaacttctgaaaatttaaccgaaggaataaaattaagagcctcaaaatcagtttccaatggaacagctaagcctgccacttctgagaactttgatgaagatttgaagtgggtagaagaaaatattccctcttcattcacagatgtagctcttccagtgttagtggattcagatgaggaaatcatgaccagatctgaaatggctgaaaaaatgttctcttcagaaaagataatgtgattggaacccgtataagaaatgtagttaagcctgaaggactatccttcatcaagactgaaagtgagctttgatttgatattgcctaaaaatttttattgtgttatcttggaagtctgtgtatcaaaatgaagaattcagatggtaggaggttctatagtccttttaaagctgactcttgagtgtcagttgaatatccattaaattggatttggaaataacctgaggaaagtattatgataaagatctgcacagatgcctcttagctgataggtggcaggcctgtgggtttgggttctccctcttttctctggaacatatgacaattccagattaaagaaaaatgttttttaataaatacccttggtctttcttctagtcacctttgaggtagatattgtgattttctggagtatagtatatccgtgtctctgtgtcttaggtttactagatgcaataatacttctctttgacatttgtactgaagtgatttgatattaagtaaaacagttaatgtttgaatataggcatatttataggttttttccgctcccccccaacccaccctttttaaaaaatctatacaaagcccttgtttgagtctcatcatgcacatcaaatcatggagttaggtcttctctgagctcaggggaacacaagtgcacagagagagatgtcttgagggtcactaccaaagaattaccctcattgtccctcactcaggccatgtgtacatgcgatgctgctgagtgtgctggggtgggtggtggccacgtggctcccccagagcacttcctaactggcaagctgggagacccattactggtgaactttgtggaaattagaactgtatcttttacataatcttggcatattacatttcataataaaaacatacatttagttgcatgctacatcactattgattttataattaatttcttaagcttcaaccatgttttataccttatttcgttacatcatatatttgtaatgtgtaatatgaaatcttttgctttaatgtctttttttaaaatgtagaatgttctaaacttgaaaggcaattgaatgtagtatgatgaaaatgtgaatgttttgctgctttcatgaccaaagatacagggctagtggacatttagaataataattaaagctagagtcttgtatgtcttttctttgaaggagttctaaccttgtaaattgagaatgacttcagagaattttgattaagaaaacattaaaatcttaaccggcacaaacactccaatttttttcactgtgaagccgcaagcaattttttttctttttctttcaaaagcctgccttctgaatttatttcttgtttactcatttcagagagggtagtaaagaagatctatttctggtagtcatatcgcttgaaaggtattggtaaatgtgttttcagtcgtgaccatgtggaaagtgaacagtgttggcaaacattaccgagaaaatcatgcttttcaagatgcccttgctttgggatatccttcctagggagaaaaaaaaaaagtagtttaacaattgtgaattccatttcttatttcagtttctgctgcagtaatgggttcccacccactataattcccagcatttatgttctgttgtattctccccttagcccagtaacatttttatctaataccccattccccaagttttgagacagattgaccccctactcattatgtggctctagttgaattttaaaatgtggaatattgggcttgcaggcagtaggagctgcaaatctggtagagtgggagtgtggagttaatggtgagtatgttaataaagggaaactgtctctgacagaatctcagtaatgtttaccaaaacatgtctttctacagctggtaggataaatgatgctaccctgtagctcagctacaggctgcagtgcaaacttttcttccatccagagaaagcagaattccctcctagtaacctcattacaaatactgttactagaagggcatgtgctgtctgtcaccttcagtaatatttgtgccatctcttgatgactgatgacctggatcgagtatttctatgaagggtcttcttaggccccttacatacgcaagaggggtgctctagtgccatagctgtagttcacaggaaggacaccaggagaagttatacctagggctactgagcagctcatcatccctgtttctgcacagtttcctgaaactggccatcagggcctctgaggcactcaaatcagtttacttttagcatgcccccatcagggtgggtctcactgttagtgaggatacgggtctggtttgatgtttttctaggcaaaatgcttaagtgttctggttatgccattcattcatacgatgtgtgaaatttgcttaaaagggaattttcatgatttgatttagattagtatttaaatatctgctttagatagcaattaattttattgtaaaaataaggaaaaatatgtgaatatgtgaattttttaagcctgagagatgatagaatgttcccatatttttcttgtaaagaaaataatattttaacttacacatcctgtagaaaataccaccttttccccttgtattacagtacaatgtttacattactatactgtcaagctgaaagtataaaaaatgtacatatacattttgagttatgtatcctttttttaaaaaaaagttcgagtctgttgcactaggctgtacatgactaaagttgacagatgctatgctagatttataatcactagttctggtacttgtgtctttgtatgatcaaagcatgcaataagcaatacaaaataccaagccttatacttaaaagaagtttaacatattggttaatatactggttaatatactggttaaacatattgaatgtatataagtggcaaaactagatttttaaggaagtgtacattataatattggagctcagtactgcatgaagagacttcattaaaactaagaaaacatttatttggggagaaattttaggcatttaagaacttgtatttttctattttaaaaagttaaattattccgtaatttggaagaagtttcgttgaatgtaggacataaccgtttgaagggttttcatttgaaaaattgatgtattttgtgccttaatattttgttcttttaataaaaatgctctgaatttgaaaaaaaaaatc

SEQ ID NO: 295413 - DNA, 2586 bp, Homo sapiens
aaatttctttactatctacactattctaccctaagatgccaatgtctactgagactctccaaaacaggcacagattatccagcatttccccagcttagatggtcatttttttgtgggatgcctgttaacatctcccctggatgttaatgttctgaggagcatggtttgggaaaggacctcgtgggacttacaggaagtagaaagatgtcacccattaaaggccaccacggtaagaacattcctctccttttagcagttgcttaagctgcacaagttggagtaagatgtcaccctttttatccaggtcattgggttagctgacagggagccaagattgaaatctaagatctttgccctgcaggattcagggctaatggacatcctgagatgggaggaaggagctttcattacagccttgtgggtcttgactcaccagtccctgcaggagccagtggagttcctgccatggtgtccctgaggaggtgtagcttctcacctaccctgccgccaagcccctcagtctgggtcttcttttcccatgcagcctccagcccaggctgcatactatggctgtggcccagtgacacccacccagcctgcccccaggtggacatcccagccacctagaccttcctgtgagtgacccagccccttccactctcagactggcctattggtgtgggccccgtgaggcagtcataacacagggatgaaacctggctctgccacttcccaaggtgggtgacttcacttctctgagcctcagtttcctcttctgagcatgggcctgaatgagacgtgtgtaaagtaccaagcacagtggtgagccaatggaagacacgcagctagccaccagcagtcatcaccaaagatgcctctgatttgtgactctgaaaattcttgcaaagctgagaaggtgaaattcctctggctatattgttgaccaaaggccctcctctgtaagagtgaattgcacgctcacttgaaactatcttgagggactaaggtgtacaatcctggtgcttatgcagtttggggctctaggtagacacgagctggctttgaaattgtagattcctacactccccctttctggagttctgggtctaagtgaattgactcctatttctgttgtgaatgttgtagtttcccttcccattctcttggtggccctggaagcttctaggcacagtgtgccaccctgattattcccaccactccatccaacttttctctctctgtggtgtctgcaccacaagctgcctaccctccaggtgcctcaatggtccggccaccagttgtgcctcggcgccccccggcccacatcagcagtgtcaggcaggcctccacccaggtgccacgcacggtgcctcatacccagagagtagccaacattggtactcagaccacaggacccagtggggtaggatgctgtacaccaggccggccgctcctgccgtgcaaatgttcctcagcagcacatagcacctatcgggtccaggagccggctgtgcacatcccaggacaggagcccctgaccgcgtccatgctggctgcggcgcccctgcatgagcaaaagcagatgattggggagcgtctctacccccttatccatgatgtccacacccagctggctggcaagatcacgggcatgctgctggagattgacaactcagagctgttgctcatgctggagtctccagaatccctccatgccaagatttcagcttaaaatgccacccagagaccaagttcattctgtcaactgatctccagcacctggcccagagacggaaagtacaaagactagtaaaatacatccttgcccttaaggagctaagtacccaaaacctgtaatccatcttgagtcaccagagtacggttgctcagaaacagcagtggtgcggtggaaagggcatcaaccctgcgatccggacaagtcactccatccctctgatcatgcgtgcccacctaccacatgaggatatcacttcatagacttgctggaagggttcattgtgttagcctgttccctgagctctcttcgtgatcaagaagactgatcagataaatcaagagacttgcccaaaattacctaggaaatctgtagcagcagcagaaccaaactccggtccttgctaaatctagataccaggctagcttttctatggacccagaattaacccatacaaatgtacaagcttttccagaccagctggggtgagatgaatgaaaatggcagcaacatcaatacctcagcttcttcagcaacttcatcaagtaaggctgccatgaggaagtgggcctaaaggagagttttctagaacaaagaagggggcaaaggagtggcttgaaactgcaaaaagtgcagacaaaaaaaaaaaaaaaaagaatgaaatctggagaggatgtgaggagaggtctagcaaaatgattaaaaatttggacttagcatcaaagtcaaacagatccatattcaaatcgtggctcttccatgtcttcactatgtaaccccgagggagccaatttaactctcttggactcctcctttctaagcattttatccacagggccataataaagatc

SEQ ID NO: 295414 - DNA, 1788 bp, Homo sapiens
  misc_feature (1249)..(1249): n is a, c, g, or t
cttacaggcacatgccaccatgaccagctaagttttgtatttttattagagatggggtttcaccatgttggccaggctggtttcaaactcctgatctcaggtgatccacccacctcagcctcccaaagtactgtgattacaggtgtgagccaccatgcctggcctcacccagaaacattttgaatgagcttaatggaagtagaagtctttgttagtagttctctgtaaacattttcactttcttcatgggacgatcctttccgcccccacttaaggcacccagtcctggctgggccctggacacattgctgagatgggctgaccaccaataccaggcccagtcattaaaagtacctgatgttagaagatcaagtgttaaatgtcatagcctagaaggagcagttctgggagaagaacccagatgtcctcagtgctccactccatacgagccctgggatgctggggtgtgagctaggccgtgcacaagccattagaaggtgttccacacgggagcgtctctacccccttatccatgatgtccacacccagctggctggcaagatcacgggcatgctgctggagattgacaactcagagctgttgctcatgctggagtctccagaatccctccatgccaaggtaagcaggagcccgggcagcagggagcccgagggggcaggaggagagctaacgacaagggctctcctagtggagccagtggatagctgtttggccagataaagtgtttcttcttgctaatacctgaaggcctgctgaatcttaagagtggaaggggccttaggtaagggtttgctacttcagcccttccgtagactaattctgtgttgttctgtaggtaggtcttttggtacaaggaagtgtgttgtgactcagtgtaagggttaagatttttccagctgtccagcaatgtacctctgtgtcaaaggtgacagacagggccatgggatcttgcaagcagtggtggatgggagggttccacagaaaccctgtggatggaggaggatcctgtatccaggatggtgagcgagggggagatcaaggctcttctgtgacctgctaagatagctgcactaagcccccccgccactcatgtctcacagatagacgaggcagtggccgtgctgcaggcacaccaggctatggagcagccgaaggcgtacatgcactgaaaccaggtgggtggaatggtgacagaagcagctgagcccgggagaagctgtaaggaaanaggcagggactgactttcacaaacactgagaattgcgccgtgttcctggctttctctgaagcaccaaagagtttggaggaagttgtgagaatcagaggagatgattaactgtgatcggaatggggggtggtggagggtgaaggaggtgccctcttgccagctgccctgcctggcttcatgcagaatagtttgggctttcccagggccctgcctggctccattctgcctgcctgaaggcctggccaggatgtaaccaccttctttattgaagactgggtgtctgccatactttaaaaacacttatttttacctttttgtcctcagaaaaggaaatcctcgcttccatggctgccaaaaggacagtgtttctggctctcagccctaaggccctgcaaactctaacttatttcccaattagtctgtatctatacttgggctctgtatgtgaatgaaggttggtcacccatccagcctattaccttttgctttgtgtattaaaagtgctgcaaaatctgcgtggggtcccaggaggccctttt

SEQ ID NO: 295415 - DNA, 854 bp, Homo sapiens
cttacaggcacatgccaccatgaccagctaagttttgtatttttattagagatggggtttcaccatgttggccaggctggtttcaaactcctgatctcaggtgatccacccacctcagcctcccaaagtactgtgattacaggtgtgagccaccatgcctggcctcacccagaaacattttgaatgagcttaatggaagtagaagtctttgttagtagttctctgtaaacattttcactttcttcatgggacgatcctttccgcccccacttaaggcacccagtcctggctgggccctggacacattgctgagatgggctgaccaccaataccaggcccagtcattaaaagtacctgatgttagaagatcaagtgttaaatgtcatagcctagaaggagcagttctgggagaagaacccagatgtcctcagtgctccactccatacgagccctgggatgctggggtgtgagctaggccgtgcacaagccattagaaggtgttccacacgggagcgtctctacccccttatccatgatgtccacacccagctggctggcaagatcacgggcatgctgctggagattgacaactcagagctgttgctcatgctggagtctccagaatccctccatgccaagaaaaggaaatcctcgcttccatggctgccaaaaggacagtgtttctggctctcagccctaaggccctgcaaactctaacttatttcccaattagtctgtatctatacttgggctctgtatgtgaatgaaggttggtcacccatccagcctattaccttttgctttgtgtattaaaagtgctgcaaaatctgcgtggggtcccaggaggccctttt

SEQ ID NO: 295416 - DNA, 710 bp, Homo sapiens
gaacgcttaccggaatagctatacaggaagcagctatatagggaacagcatctacgagcaaatggtataagcacgtagatacaccaatgccggccgatccatgctcagttgaccagtgattccatcagttagacacagtaacacctatctgagtccaggagccggctgtgcacatcccaggacaggagcccctgaccgcgtccatgctggctgcggcgcccctgcatgagcaaaagcagatgattggggagcgtctctacccccttatccatgatgtccacacccagctggctggcaagatcacgggcatgctgctggagattgacaactcagagctgttgctcatgctggagtctccagaatccctccatgccaagatagacgaggcagtggccgtgctgcaggcacaccaggctatggagcagccgaaggcgtacatgcactgaaaccagaaaaggaaatcctcgcttccatggctgccaaaaggacagtgtttctggctctcagccctaaggccctgcaaactctaacttatttcccaattagtctgtatctatacttgggctctgtatggactttcggcgtgtgcatgcacacgccgaataacaaactgccacgccgagcctccatgtacttctgaagagatctgatggagaagttgttgccacgcgagaatcaaatgaaaagcagatacagatcgagagtgtggg

SEQ ID NO: 295417 - DNA, 2010 bp, Homo sapiens
aaatttctttactatctacactattctaccctaagatgccaatgtctactgagactctccaaaacaggcacagattatccagcatttccccagcttagatggtcatttttttgtgggatgcctgttaacatctcccctggatgttaatgttctgaggagcatggtttgggaaaggacctcgtgggacttacaggaagtagaaagatgtcacccattaaaggccaccacggtaagaacattcctctccttttagcagttgcttaagctgcacaagttggagtaagatgtcaccctttttatccaggtcattgggttagctgacagggagccaagattgaaatctaagatctttgccctgcaggattcagggctaatggacatcctgagatgggaggaaggagctttcattacagccttgtgggtcttgactcaccagtccctgcaggagccagtggagttcctgccatggtgtccctgaggaggtgtagcttctcacctaccctgccgccaagcccctcagtctgggtcttcttttcccatgcagcctccagcccaggctgcatactatggctgtggcccagtgacacccacccagcctgcccccaggtggacatcccagccacctagaccttcctgtgagtgacccagccccttccactctcagactggcctattggtgtgggccccgtgaggcagtcataacacagggatgaaacctggctctgccacttcccaaggtgggtgacttcacttctctgagcctcagtttcctcttctgagcatgggcctgaatgagacgtgtgtaaagtaccaagcacagtggtgagccaatggaagacacgcagctagccaccagcagtcatcaccaaagatgcctctgatttgtgactctgaaaattcttgcaaagctgagaaggtgaaattcctctggctatattgttgaccaaaggccctcctctgtaagagtgaattgcacgctcacttgaaactatcttgagggactaaggtgtacaatcctggtgcttatgcagtttggggctctaggtagacacgagctggctttgaaattgtagattcctacactccccctttctggagttctgggtctaagtgaattgactcctatttctgttgtgaatgttgtagtttcccttcccattctcttggtggccctggaagcttctaggcacagtgtgccaccctgattattcccaccactccatccaacttttctctctctgtggtgtctgcaccacaagctgcctaccctccaggtgcctcaatggtccggccaccagttgtgcctcggcgccccccggcccacatcagcagtgtcaggcaggcctccacccaggtgccacgcacggtgcctcatacccagagagtagccaacattggtactcagaccacaggacccagtggggtaggatgctgtacaccaggccggccgctcctgccgtgcaaatgttcctcagcagcacatagcacctatcgggtccaggagccggctgtgcacatcccaggacaggagcccctgaccgcgtccatgctggctgcggcgcccctgcatgagcaaaagcagatgattggggagcgtctctacccccttatccatgatgtccacacccagctggctggcaagatcacgggcatgctgctggagattgacaactcagagctgttgctcatgctggagtctccagaatccctccatgccaagatagacgaggcagtggccgtgctgcaggcacaccaggctatggagcagccgaaggcgtacatgcactgaaaccagaaaaggaaatcctcgcttccatggctgccaaaaggacagtgtttctggctctcagccctaaggccctgcaaactctaacttatttcccaattagtctgtatctatacttgggctctgtatgtgaatgaaggttggtcacccatccagcctattaccttttgctttgtgtattaaaagtgctgcaaaatctgcgtggggtcccaggaggccctttt

SEQ ID NO: 295418 - DNA, 1224 bp, Homo sapiens
ttaacacctattatgccatgaattcatagggaataggttccagcagctcaggctccttcccattggttctcacaaagtgtgcttctctgggtggagcaggctggcgctttagttgaacccaggtacctttctctttggcttctttctttttctgatcattttccttcacacgtttcaggaagctatctcggctcacttgaaactatcttgagggactaaggtgtacaatcctggtgcttatgcagtttggggctctaggtagacacgagctggctttgaaattgtagattcctacactccccctttctggagttctgggtctaagtgaattgactcctatttctgttgtgaatgttgtagtttcccttcccattctcttggtggccctggaagcttctaggcacagtgtgccaccctgattattcccaccactccatccaacttttctctctctgtggtgtctgcaccacaagctgcctaccctccaggtgcctcaatggtccggccaccagttgtgcctcggcgccccccggcccacatcagcagtgtcaggcaggcctccacccaggtgccacgcacggtgcctcatacccagagagtagccaacattggtactcagaccacaggacccagtggggtaggatgctgtacaccaggccggccgctcctgccgtgcaaatgttcctcagcagcacatagcacctatcgggtccaggagccggctgtgcacatcccaggacaggagcccctgaccgcgtccatgctggctgcggcgcccctgcatgagcaaaagcagatgattggggagcgtctctacccccttatccatgatgtccacacccagctggctggcaagatcacgggcatgctgctggagattgacaactcagagctgttgctcatgctggagtctccagaatccctccatgccaagatagacgaggcagtggccgtgctgcaggcacaccaggctatggagcagccgaaggcgtacatgcactgaaaccagaaaaggaaatcctcgcttccatggctgccaaaaggacagtgtttctggctctcagccctaaggccctgcaaactctaacttatttcccaattagtctgtatctatacttgggctctgtatgtgaatgaaggttggtcacccatccagcctattaccttttgctttgtgtattaaaagtgctgcaaaatctgcgtggggtcccaggaggccctttt

SEQ ID NO: 295419 - DNA, 2093 bp, Homo sapiens
aaatttctttactatctacactattctaccctaagatgccaatgtctactgagactctccaaaacaggcacagattatccagcatttccccagcttagatggtcatttttttgtgggatgcctgttaacatctcccctggatgttaatgttctgaggagcatggtttgggaaaggacctcgtgggacttacaggaagtagaaagatgtcacccattaaaggccaccacggtaagaacattcctctccttttagcagttgcttaagctgcacaagttggagtaagatgtcaccctttttatccaggtcattgggttagctgacagggagccaagattgaaatctaagatctttgccctgcaggattcagggctaatggacatcctgagatgggaggaaggagctttcattacagccttgtgggtcttgactcaccagtccctgcaggagccagtggagttcctgccatggtgtccctgaggaggtgtagcttctcacctaccctgccgccaagcccctcagtctgggtcttcttttcccatgcagcctccagcccaggctgcatactatggctgtggcccagtgacacccacccagcctgcccccaggtggacatcccagccacctagaccttcctgtgagtgacccagccccttccactctcagactggcctattggtgtgggccccgtgaggcagtcataacacagggatgaaacctggctctgccacttcccaaggtgggtgacttcacttctctgagcctcagtttcctcttctgagcatgggcctgaatgagacgtgtgtaaagtaccaagcacagtggtgagccaatggaagacacgcagctagccaccagcagtcatcaccaaagatgcctctgatttgtgactctgaaaattcttgcaaagctgagaaggtgaaattcctctggctatattgttgaccaaaggccctcctctgtaagagtgaattgcacgctcacttgaaactatcttgagggactaaggtgtacaatcctggtgcttatgcagtttggggctctaggtagacacgagctggctttgaaattgtagattcctacactccccctttctggagttctgggtctaagtgaattgactcctatttctgttgtgaatgttgtagtttcccttcccattctcttggtggccctggaagcttctaggcacagtgtgccaccctgattattcccaccactccatccaacttttctctctctgtggtgtctgcaccacaagctgcctaccctccaggtgcctcaatggtccggccaccagttgtgcctcggcgccccccggcccacatcagcagtgtcaggcaggcctccacccaggtgccacgcacggtgcctcatacccagagagtagccaacattggtactcagaccacaggacccagtggggtaggatgctgtacaccaggccggccgctcctgccgtgcaaatgttcctcagcagcacatagcacctatcgggtccaggagccggctgtgcacatcccaggacaggagcccctgaccgcgtccatgctggctgcggcgcccctgcatgagcaaaagcagatgattggcacctgttatcttgtcttaaaacgctggtcagactggatggtcctgagctttcttccactgctgctgtcctgtgactttgaggggagcgtctctacccccttatccatgatgtccacacccagctggctggcaagatcacgggcatgctgctggagattgacaactcagagctgttgctcatgctggagtctccagaatccctccatgccaagatagacgaggcagtggccgtgctgcaggcacaccaggctatggagcagccgaaggcgtacatgcactgaaaccagaaaaggaaatcctcgcttccatggctgccaaaaggacagtgtttctggctctcagccctaaggccctgcaaactctaacttatttcccaattagtctgtatctatacttgggctctgtatgtgaatgaaggttggtcacccatccagcctattaccttttgctttgtgtattaaaagtgctgcaaaatctgcgtggggtcccaggaggccctttt

SEQ ID NO: 295420 - DNA, 1598 bp, Homo sapiens
aaatttctttactatctacactattctaccctaagatgccaatgtctactgagactctccaaaacaggcacagattatccagcatttccccagcttagatggtcatttttttgtgggatgcctgttaacatctcccctggatgttaatgttctgaggagcatggtttgggaaaggacctcgtgggacttacaggaagtagaaagatgtcacccattaaaggccaccacggtaagaacattcctctccttttagcagttgcttaagctgcacaagttggagtaagatgtcaccctttttatccaggtcattgggttagctgacagggagccaagattgaaatctaagatctttgccctgcaggattcagggctaatggacatcctgagatgggaggaaggagctttcattacagccttgtgggtcttgactcaccagtccctgcaggagccagtggagttcctgccatggtgtccctgaggaggtgtagcttctcacctaccctgccgccaagcccctcagtctgggtcttcttttcccatgcagcctccagcccaggctgcatactatggctgtggcccagtgacacccacccagcctgcccccaggtggacatcccagccacctagaccttcctgtgagtgacccagccccttccactctcagactggcctattggtgtgggccccgtgaggcagtcataacacagggatgaaacctggctctgccacttcccaaggtgggtgacttcacttctctgagcctcagtttcctcttctgagcatgggcctgaatgagacgtgtgtaaagtaccaagcacagtggtgagccaatggaagacacgcagctagccaccagcagtcatcaccaaagatgcctctgatttgtgactctgtcggcgccccccggcccacatcagcagtgtcaggcaggcctccacccaggtgccacgcacggtgcctcatacccagagagtagccaacattggtactcagaccacaggacccagtggggtaggatgctgtacaccaggccggccgctcctgccgtgcaaatgttcctcagcagcacatagcacctatcgggtccaggagccggctgtgcacatcccaggacaggagcccctgaccgcgtccatgctggctgcggcgcccctgcatgagcaaaagcagatgattggggagcgtctctacccccttatccatgatgtccacacccagctggctggcaagatcacgggcatgctgctggagattgacaactcagagctgttgctcatgctggagtctccagaatccctccatgccaagatagacgaggcagtggccgtgctgcaggcacaccaggctatggagcagccgaaggcgtacatgcactgaaaccagaaaaggaaatcctcgcttccatggctgccaaaaggacagtgtttctggctctcagccctaaggccctgcaaactctaacttatttcccaattagtctgtatctatacttgggctctgtatgtgaatgaaggttggtcacccatccagcctattaccttttgctttgtgtattaaaagtgctgcaaaatctgcgtggggtcccaggaggccctttt

SEQ ID NO: 295421 - DNA, 2258 bp, Homo sapiens
aaatttctttactatctacactattctaccctaagatgccaatgtctactgagactctccaaaacaggcacagattatccagcatttccccagcttagatggtcatttttttgtgggatgcctgttaacatctcccctggatgttaatgttctgaggagcatggtttgggaaaggacctcgtgggacttacaggaagtagaaagatgtcacccattaaaggccaccacggtaagaacattcctctccttttagcagttgcttaagctgcacaagttggagtaagatgtcaccctttttatccaggtcattgggttagctgacagggagccaagattgaaatctaagatctttgccctgcaggattcagggctaatggacatcctgagatgggaggaaggagctttcattacagccttgtgggtcttgactcaccagtccctgcaggagccagtggagttcctgccatggtgtccctgaggaggtgtagcttctcacctaccctgccgccaagcccctcagtctgggtcttcttttcccatgcagcctccagcccaggctgcatactatggctgtggcccagtgacacccacccagcctgcccccaggtggacatcccagccacctagaccttcctgtgagtgacccagccccttccactctcagactggcctattggtgtgggccccgtgaggcagtcataacacagggatgaaacctggctctgccacttcccaaggtgggtgacttcacttctctgagcctcagtttcctcttctgagcatgggcctgaatgagacgtgtgtaaagtaccaagcacagtggtgagccaatggaagacacgcagctagccaccagcagtcatcaccaaagatgcctctgatttgtgactctgaaaattcttgcaaagctgagaaggtgaaattcctctggctatattgttgaccaaaggccctcctctgtaagagtgaattgcacgctcacttgaaactatcttgagggactaaggtgtacaatcctggtgcttatgcagtttggggctctaggtagacacgagctggctttgaaattgtagattcctacactccccctttctggagttctgggtctaagtgaattgactcctatttctgttgtgaatgttgtagtttcccttcccattctcttggtggccctggaagcttctaggcacagtgtgccaccctgattattcccaccactccatccaacttttctctctctgtggtgtctgcaccacaagctgcctaccctccaggtgcctcaatggtccggccaccagttgtgcctcggcgccccccggcccacatcagcagtgtcaggcaggcctccacccaggtgccacgcacggtgcctcatacccagagagtagccaacattggtactcagaccacaggacccagtggggtaggatgctgtacaccaggccggccgctcctgccgtgcaaatgttcctcagcagcacatagcacctatcgggtccaggagccggctgtgcacatcccaggacaggagcccctgaccgcgtccatgctggctgcggcgcccctgcatgagcaaaagcagatgattgtggtgagtggctggttctcctactgtggagcaagaagaggagggctgcgagctggctagcctgctgggaaacacctcacctggtggtccaacgtgaggtcaaattccagctttgtcaccgacccccctactgggtgaccgtggccaagctggctctattctctaggcacctgttatcttgtcttaaaacgctggtcagactggatggtcctgagctttcttccactgctgctgtcctgtgactttgaggggagcgtctctacccccttatccatgatgtccacacccagctggctggcaagatcacgggcatgctgctggagattgacaactcagagctgttgctcatgctggagtctccagaatccctccatgccaagatagacgaggcagtggccgtgctgcaggcacaccaggctatggagcagccgaaggcgtacatgcactgaaaccagaaaaggaaatcctcgcttccatggctgccaaaaggacagtgtttctggctctcagccctaaggccctgcaaactctaacttatttcccaattagtctgtatctatacttgggctctgtatgtgaatgaaggttggtcacccatccagcctattaccttttgctttgtgtattaaaagtgctgcaaaatctgcgtggggtcccaggaggccctttt

SEQ ID NO: 295422 - DNA, 2393 bp, Homo sapiens
aaatttctttactatctacactattctaccctaagatgccaatgtctactgagactctccaaaacaggcacagattatccagcatttccccagcttagatggtcatttttttgtgggatgcctgttaacatctcccctggatgttaatgttctgaggagcatggtttgggaaaggacctcgtgggacttacaggaagtagaaagatgtcacccattaaaggccaccacggtaagaacattcctctccttttagcagttgcttaagctgcacaagttggagtaagatgtcaccctttttatccaggtcattgggttagctgacagggagccaagattgaaatctaagatctttgccctgcaggattcagggctaatggacatcctgagatgggaggaaggagctttcattacagccttgtgggtcttgactcaccagtccctgcaggagccagtggagttcctgccatggtgtccctgaggaggtgtagcttctcacctaccctgccgccaagcccctcagtctgggtcttcttttcccatgcagcctccagcccaggctgcatactatggctgtggcccagtgacacccacccagcctgcccccaggtggacatcccagccacctagaccttcctgtgagtgacccagccccttccactctcagactggcctattggtgtgggccccgtgaggcagtcataacacagggatgaaacctggctctgccacttcccaaggtgggtgacttcacttctctgagcctcagtttcctcttctgagcatgggcctgaatgagacgtgtgtaaagtaccaagcacagtggtgagccaatggaagacacgcagctagccaccagcagtcatcaccaaagatgcctctgatttgtgactctgaaaattcttgcaaagctgagaaggtgaaattcctctggctatattgttgaccaaaggccctcctctgtaagagtgaattgcacgctcacttgaaactatcttgagggactaaggtgtacaatcctggtgcttatgcagtttggggctctaggtagacacgagctggctttgaaattgtagattcctacactccccctttctggagttctgggtctaagtgaattgactcctatttctgttgtgaatgttgtagtttcccttcccattctcttggtggccctggaagcttctaggcacagtgtgccaccctgattattcccaccactccatccaacttttctctctctgtggtgtctgcaccacaagctgcctaccctccaggtgcctcaatggtccggccaccagttgtgcctcggcgccccccggcccacatcagcagtgtcaggcaggcctccacccaggtgccacgcacggtgcctcatacccagagagtagccaacattggtactcagaccacaggacccagtggggtaggatgctgtacaccaggccggccgctcctgccgtgcaaatgttcctcagcagcacatagcacctatcgggtccaggagccggctgtgcacatcccaggacaggagcccctgaccgcgtccatgctggctgcggcgcccctgcatgagcaaaagcagatgattggcccagagacggaaagtacaaagactagtaaaatacatccttgcccttaaggagctaagtacccaaaacctgtaatccatcttgagtcaccagagtacggttgctcagaaacagcagtggtgcggtggaaagggcatcaaccctgcgatccggacaagtcactccatccctctgatcatgcgtgcccacctaccacatgaggatatcacttcatagacttgctggaagggttcattgtgttagcctgttccctgagctctcttcgtgatcaagaagactgatcagataaatcaagagacttgcccaaaattacctaggaaatctgtagcagcagcagaaccaaactccggtccttgctaaatctagataccaggctagcttttctatggacccagaattaacccatacaaatgtacaagcttttccagaccagctggggtgagatgaatgaaaatggcagcaacatcaatacctcagcttcttcagcaacttcatcaagtaaggctgccatgaggaagtgggcctaaaggagagttttctagaacaaagaagggggcaaaggagtggcttgaaactgcaaaaagtgcagacaaaaaaaaaaaaaaaaagaatgaaatctggagaggatgtgaggagaggtctagcaaaatgattaaaaatttggacttagcatcaaagtcaaacagatccatattcaaatcgtggctcttccatgtcttcactatgtaaccccgagggagccaatttaactctcttggactcctcctttctaagcattttatccacagggccataataaagatc

SEQ ID NO: 295423 - DNA, 2018 bp, Homo sapiens
aaatttctttactatctacactattctaccctaagatgccaatgtctactgagactctccaaaacaggcacagattatccagcatttccccagcttagatggtcatttttttgtgggatgcctgttaacatctcccctggatgttaatgttctgaggagcatggtttgggaaaggacctcgtgggacttacaggaagtagaaagatgtcacccattaaaggccaccacggtaagaacattcctctccttttagcagttgcttaagctgcacaagttggagtaagatgtcaccctttttatccaggtcattgggttagctgacagggagccaagattgaaatctaagatctttgccctgcaggattcagggctaatggacatcctgagatgggaggaaggagctttcattacagccttgtgggtcttgactcaccagtccctgcaggagccagtggagttcctgccatggtgtccctgaggaggtgtagcttctcacctaccctgccgccaagcccctcagtctgggtcttcttttcccatgcagcctccagcccaggctgcatactatggctgtggcccagtgacacccacccagcctgcccccaggtggacatcccagccacctagaccttcctgtgagtgacccagccccttccactctcagactggcctattggtgtgggccccgtgaggcagtcataacacagggatgaaacctggctctgccacttcccaaggtgggtgacttcacttctctgagcctcagtttcctcttctgagcatgggcctgaatgagacgtgtgtaaagtaccaagcacagtggtgagccaatggaagacacgcagctagccaccagcagtcatcaccaaagatgcctctgatttgtgactctgaaaattcttgcaaagctgagaaggtgaaattcctctggctatattgttgaccaaaggccctcctctgtaagagtgaattgcacgctcacttgaaactatcttgagggactaaggtgtacaatcctggtgcttatgcagtttggggctctaggtagacacgagctggctttgaaattgtagattcctacactccccctttctggagttctgggtctaagtgaattgactcctatttctgttgtgaatgttgtagtttcccttcccattctcttggtggccctggaagcttctaggcacagtgtgccaccctgattattcccaccactccatccaacttttctctctctgtggtgtctgcaccacaagctgcctaccctccaggtgcctcaatggtccggccaccagttgtgcctcggcgccccccggcccacatcagcagtgtcaggcaggcctccacccaggtgccacgcacggtgcctcatacccagagagtagccaacattggtactcagaccacaggacccagtggggtaggatgctgtacaccaggccggccgctcctgccgtgcaaatgttcctcagcagcacatagcacctatcgggtccaggagccggctgtgcacatcccaggacaggagcccctgaccgcgtccatgctggctgcggcgcccctgcatgagcaaaagcagatgattggcacctgttatcttgtcttaaaacgctggtcagactggatggtcctgagctttcttccactgctgctgtcctgtgactttgaggggagcgtctctacccccttatccatgatgtccacacccagctggctggcaagatcacgggcatgctgctggagattgacaactcagagctgttgctcatgctggagtctccagaatccctccatgccaagaaaaggaaatcctcgcttccatggctgccaaaaggacagtgtttctggctctcagccctaaggccctgcaaactctaacttatttcccaattagtctgtatctatacttgggctctgtatgtgaatgaaggttggtcacccatccagcctattaccttttgctttgtgtattaaaagtgctgcaaaatctgcgtggggtcccaggaggccctttt

SEQ ID NO: 295424 - DNA, 1935 bp, Homo sapiens
aaatttctttactatctacactattctaccctaagatgccaatgtctactgagactctccaaaacaggcacagattatccagcatttccccagcttagatggtcatttttttgtgggatgcctgttaacatctcccctggatgttaatgttctgaggagcatggtttgggaaaggacctcgtgggacttacaggaagtagaaagatgtcacccattaaaggccaccacggtaagaacattcctctccttttagcagttgcttaagctgcacaagttggagtaagatgtcaccctttttatccaggtcattgggttagctgacagggagccaagattgaaatctaagatctttgccctgcaggattcagggctaatggacatcctgagatgggaggaaggagctttcattacagccttgtgggtcttgactcaccagtccctgcaggagccagtggagttcctgccatggtgtccctgaggaggtgtagcttctcacctaccctgccgccaagcccctcagtctgggtcttcttttcccatgcagcctccagcccaggctgcatactatggctgtggcccagtgacacccacccagcctgcccccaggtggacatcccagccacctagaccttcctgtgagtgacccagccccttccactctcagactggcctattggtgtgggccccgtgaggcagtcataacacagggatgaaacctggctctgccacttcccaaggtgggtgacttcacttctctgagcctcagtttcctcttctgagcatgggcctgaatgagacgtgtgtaaagtaccaagcacagtggtgagccaatggaagacacgcagctagccaccagcagtcatcaccaaagatgcctctgatttgtgactctgaaaattcttgcaaagctgagaaggtgaaattcctctggctatattgttgaccaaaggccctcctctgtaagagtgaattgcacgctcacttgaaactatcttgagggactaaggtgtacaatcctggtgcttatgcagtttggggctctaggtagacacgagctggctttgaaattgtagattcctacactccccctttctggagttctgggtctaagtgaattgactcctatttctgttgtgaatgttgtagtttcccttcccattctcttggtggccctggaagcttctaggcacagtgtgccaccctgattattcccaccactccatccaacttttctctctctgtggtgtctgcaccacaagctgcctaccctccaggtgcctcaatggtccggccaccagttgtgcctcggcgccccccggcccacatcagcagtgtcaggcaggcctccacccaggtgccacgcacggtgcctcatacccagagagtagccaacattggtactcagaccacaggacccagtggggtaggatgctgtacaccaggccggccgctcctgccgtgcaaatgttcctcagcagcacatagcacctatcgggtccaggagccggctgtgcacatcccaggacaggagcccctgaccgcgtccatgctggctgcggcgcccctgcatgagcaaaagcagatgattggggagcgtctctacccccttatccatgatgtccacacccagctggctggcaagatcacgggcatgctgctggagattgacaactcagagctgttgctcatgctggagtctccagaatccctccatgccaagaaaaggaaatcctcgcttccatggctgccaaaaggacagtgtttctggctctcagccctaaggccctgcaaactctaacttatttcccaattagtctgtatctatacttgggctctgtatgtgaatgaaggttggtcacccatccagcctattaccttttgctttgtgtattaaaagtgctgcaaaatctgcgtggggtcccaggaggccctttt

SEQ ID NO: 295425 - DNA, 2210 bp, Homo sapiens
aaatttctttactatctacactattctaccctaagatgccaatgtctactgagactctccaaaacaggcacagattatccagcatttccccagcttagatggtcatttttttgtgggatgcctgttaacatctcccctggatgttaatgttctgaggagcatggtttgggaaaggacctcgtgggacttacaggaagtagaaagatgtcacccattaaaggccaccacggtaagaacattcctctccttttagcagttgcttaagctgcacaagttggagtaagatgtcaccctttttatccaggtcattgggttagctgacagggagccaagattgaaatctaagatctttgccctgcaggattcagggctaatggacatcctgagatgggaggaaggagctttcattacagccttgtgggtcttgactcaccagtccctgcaggagccagtggagttcctgccatggtgtccctgaggaggtgtagcttctcacctaccctgccgccaagcccctcagtctgggtcttcttttcccatgcagcctccagcccaggctgcatactatggctgtggcccagtgacacccacccagcctgcccccaggtggacatcccagccacctagaccttcctgtgagtgacccagccccttccactctcagactggcctattggtgtgggccccgtgaggcagtcataacacagggatgaaacctggctctgccacttcccaaggtgggtgacttcacttctctgagcctcagtttcctcttctgagcatgggcctgaatgagacgtgtgtaaagtaccaagcacagtggtgagccaatggaagacacgcagctagccaccagcagtcatcaccaaagatgcctctgatttgtgactctgaaaattcttgcaaagctgagaaggtgaaattcctctggctatattgttgaccaaaggccctcctctgtaagagtgaattgcacgctcacttgaaactatcttgagggactaaggtgtacaatcctggtgcttatgcagtttggggctctaggtagacacgagctggctttgaaattgtagattcctacactccccctttctggagttctgggtctaagtgaattgactcctatttctgttgtgaatgttgtagtttcccttcccattctcttggtggccctggaagcttctaggcacagtgtgccaccctgattattcccaccactccatccaacttttctctctctgtggtgtctgcaccacaagctgcctaccctccaggtgcctcaatggtccggccaccagttgtgcctcggcgccccccggcccacatcagcagtgtcaggcaggcctccacccaggtgccacgcacggtgcctcatacccagagagtagccaacattggtactcagaccacaggacccagtggggtaggatgctgtacaccaggccggccgctcctgccgtgcaaatgttcctcagcagcacatagcacctatcgggtccaggagccggctgtgcacatcccaggacaggagcccctgaccgcgtccatgctggctgcggcgcccctgcatgagcaaaagcagatgattgtggtgagtggctggttctcctactgtggagcaagaagaggagggctgcgagctggctagcctgctgggaaacacctcacctggtggtccaacgtgaggtcaaattccagctttgtcaccgacccccctactgggtgaccgtggccaagctggctctattctctaggcacctgttatcttgtcttaaaacgctggtcagactggatggtcctgagctttcttccactgctgctgtcctgtgactttgaggttgggagacagtccagatgtggggagatcaggggacaaagggaggagtaggggtatggtcttgggtttctgctgagaaatggcttgtaggtggggggttaaagttcctcacacctctcctgaacgggaggaagctgctgttcaccagtttccagtgctcaatgcgggcaggtggggcatctgtgcgtttggtaaatacatgatgtttcccatagattctggattccttgtgcaattcatcttcacccctagtgtccatggcaggccctgataaaaatgccactaagtgaacacaagcttgttcctggttggcaggttctttactgcatggcccccgagacctccagaccctttactgaaggcccccattacc

SEQ ID NO: 295426 - DNA, 2952 bp, Homo sapiens
  misc_feature (2413)..(2413): n is a, c, g, or t
aaatttctttactatctacactattctaccctaagatgccaatgtctactgagactctccaaaacaggcacagattatccagcatttccccagcttagatggtcatttttttgtgggatgcctgttaacatctcccctggatgttaatgttctgaggagcatggtttgggaaaggacctcgtgggacttacaggaagtagaaagatgtcacccattaaaggccaccacggtaagaacattcctctccttttagcagttgcttaagctgcacaagttggagtaagatgtcaccctttttatccaggtcattgggttagctgacagggagccaagattgaaatctaagatctttgccctgcaggattcagggctaatggacatcctgagatgggaggaaggagctttcattacagccttgtgggtcttgactcaccagtccctgcaggagccagtggagttcctgccatggtgtccctgaggaggtgtagcttctcacctaccctgccgccaagcccctcagtctgggtcttcttttcccatgcagcctccagcccaggctgcatactatggctgtggcccagtgacacccacccagcctgcccccaggtggacatcccagccacctagaccttcctgtgagtgacccagccccttccactctcagactggcctattggtgtgggccccgtgaggcagtcataacacagggatgaaacctggctctgccacttcccaaggtgggtgacttcacttctctgagcctcagtttcctcttctgagcatgggcctgaatgagacgtgtgtaaagtaccaagcacagtggtgagccaatggaagacacgcagctagccaccagcagtcatcaccaaagatgcctctgatttgtgactctgaaaattcttgcaaagctgagaaggtgaaattcctctggctatattgttgaccaaaggccctcctctgtaagagtgaattgcacgctcacttgaaactatcttgagggactaaggtgtacaatcctggtgcttatgcagtttggggctctaggtagacacgagctggctttgaaattgtagattcctacactccccctttctggagttctgggtctaagtgaattgactcctatttctgttgtgaatgttgtagtttcccttcccattctcttggtggccctggaagcttctaggcacagtgtgccaccctgattattcccaccactccatccaacttttctctctctgtggtgtctgcaccacaagctgcctaccctccaggtgcctcaatggtccggccaccagttgtgcctcggcgccccccggcccacatcagcagtgtcaggcaggcctccacccaggtgccacgcacggtgcctcatacccagagagtagccaacattggtactcagaccacaggacccagtggggtaggatgctgtacaccaggccggccgctcctgccgtgcaaatgttcctcagcagcacatagcacctatcgggtccaggagccggctgtgcacatcccaggacaggagcccctgaccgcgtccatgctggctgcggcgcccctgcatgagcaaaagcagatgattggcacctgttatcttgtcttaaaacgctggtcagactggatggtcctgagctttcttccactgctgctgtcctgtgactttgaggggagcgtctctacccccttatccatgatgtccacacccagctggctggcaagatcacgggcatgctgctggagattgacaactcagagctgttgctcatgctggagtctccagaatccctccatgccaaggtaagcaggagcccgggcagcagggagcccgagggggcaggaggagagctaacgacaagggctctcctagtggagccagtggatagctgtttggccagataaagtgtttcttcttgctaatacctgaaggcctgctgaatcttaagagtggaaggggccttaggtaagggtttgctacttcagcccttccgtagactaattctgtgttgttctgtaggtaggtcttttggtacaaggaagtgtgttgtgactcagtgtaagggttaagatttttccagctgtccagcaatgtacctctgtgtcaaaggtgacagacagggccatgggatcttgcaagcagtggtggatgggagggttccacagaaaccctgtggatggaggaggatcctgtatccaggatggtgagcgagggggagatcaaggctcttctgtgacctgctaagatagctgcactaagcccccccgccactcatgtctcacagatagacgaggcagtggccgtgctgcaggcacaccaggctatggagcagccgaaggcgtacatgcactgaaaccaggtgggtggaatggtgacagaagcagctgagcccgggagaagctgtaaggaaanaggcagggactgactttcacaaacactgagaattgcgccgtgttcctggctttctctgaagcaccaaagagtttggaggaagttgtgagaatcagaggagatgattaactgtgatcggaatggggggtggtggagggtgaaggaggtgccctcttgccagctgccctgcctggcttcatgcagaatagtttgggctttcccagggccctgcctggctccattctgcctgcctgaaggcctggccaggatgtaaccaccttctttattgaagactgggtgtctgccatactttaaaaacacttatttttacctttttgtcctcagaaaaggaaatcctcgcttccatggctgccaaaaggacagtgtttctggctctcagccctaaggccctgcaaactctaacttatttcccaattagtctgtatctatacttgggctctgtatgtgaatgaaggttggtcacccatccagcctattaccttttgctttgtgtattaaaagtgctgcaaaatctgcgtggggtcccaggaggccctttt

SEQ ID NO: 295427 - DNA, 1919 bp, Homo sapiens
aaatttctttactatctacactattctaccctaagatgccaatgtctactgagactctccaaaacaggcacagattatccagcatttccccagcttagatggtcatttttttgtgggatgcctgttaacatctcccctggatgttaatgttctgaggagcatggtttgggaaaggacctcgtgggacttacaggaagtagaaagatgtcacccattaaaggccaccacggtaagaacattcctctccttttagcagttgcttaagctgcacaagttggagtaagatgtcaccctttttatccaggtcattgggttagctgacagggagccaagattgaaatctaagatctttgccctgcaggattcagggctaatggacatcctgagatgggaggaaggagctttcattacagccttgtgggtcttgactcaccagtccctgcaggagccagtggagttcctgccatggtgtccctgaggaggtgtagcttctcacctaccctgccgccaagcccctcagtctgggtcttcttttcccatgcagcctccagcccaggctgcatactatggctgtggcccagtgacacccacccagcctgcccccaggtggacatcccagccacctagaccttcctgtgagtgacccagccccttccactctcagactggcctattggtgtgggccccgtgaggcagtcataacacagggatgaaacctggctctgccacttcccaaggtgggtgacttcacttctctgagcctcagtttcctcttctgagcatgggcctgaatgagacgtgtgtaaagtaccaagcacagtggtgagccaatggaagacacgcagctagccaccagcagtcatcaccaaagatgcctctgatttgtgactctgaaaattcttgcaaagctgagaaggtgaaattcctctggctatattgttgaccaaaggccctcctctgtaagagtgaattgcacgctcacttgaaactatcttgagggactaaggtgtacaatcctggtgcttatgcagtttggggctctaggtagacacgagctggctttgaaattgtagattcctacactccccctttctggagttctgggtctaagtgaattgactcctatttctgttgtgaatgttgtagtttcccttcccattctcttggtggccctggaagcttctaggcacagtgtgccaccctgattattcccaccactccatccaacttttctctctctgtggtgtctgcaccacaagctgcctaccctccaggtgcctcaatggtccggccaccagttgtgcctcggcgccccccggcccacatcagcagtgtcaggcaggcctccacccaggtgccacgcacggtgcctcatacccagagagtagccaacattggtactcagaccacaggacccagtggggtaggatgctgtacaccaggccggccgctcctgccgtgcaaatgttcctcagcagcacatagcacctatcgggtccaggagccggctgtgcacatcccaggacaggagcccctgaccgcgtccatgctggctgcggcgcccctgcatgagcaaaagcagatgattggggagcgtctctacccccttatccatgatgtccacacccagctggctggcaagatcacgggcatgctgctggagattgacaactcagagctgttgctcatgctggagtctccagaatccctccatgccaagatttcagcttaaaatgccacccagagaccaagttcattctgtcaactgatctccagcacctggtatgtcacctagcaaccaccaaggcccaatcagttatgtgttgaatgagtgaataatgctaactgtatactttttctgctcctacaaccatgtttcctatattacaagaataaaaaccacagactgtatcactaca

SEQ ID NO: 295428 - DNA, 929 bp, Homo sapiens
cttacaggcacatgccaccatgaccagctaagttttgtatttttattagagatggggtttcaccatgttggccaggctggtttcaaactcctgatctcaggtgatccacccacctcagcctcccaaagtactgtgattacaggtgtgagccaccatgcctggcctcacccagaaacattttgaatgagcttaatggaagtagaagtctttgttagtagttctctgtaaacattttcactttcttcatgggacgatcctttccgcccccacttaaggcacccagtcctggctgggccctggacacattgctgagatgggctgaccaccaataccaggcccagtcattaaaagtacctgatgttagaagatcaagtgttaaatgtcatagcctagaaggagcagttctgggagaagaacccagatgtcctcagtgctccactccatacgagccctgggatgctggggtgtgagctaggccgtgcacaagccattagaaggtgttccacacgggagcgtctctacccccttatccatgatgtccacacccagctggctggcaagatcacgggcatgctgctggagattgacaactcagagctgttgctcatgctggagtctccagaatccctccatgccaagatagacgaggcagtggccgtgctgcaggcacaccaggctatggagcagccgaaggcgtacatgcactgaaaccagaaaaggaaatcctcgcttccatggctgccaaaaggacagtgtttctggctctcagccctaaggccctgcaaactctaacttatttcccaattagtctgtatctatacttgggctctgtatgtgaatgaaggttggtcacccatccagcctattaccttttgctttgtgtattaaaagtgctgcaaaatctgcgtggggtcccaggaggccctttt

SEQ ID NO: 295429 - DNA, 1499 bp, Homo sapiens
  misc_feature (1482)..(1482): n is a, c, g, or t
aaatttctttactatctacactattctaccctaagatgccaatgtctactgagactctccaaaacaggcacagattatccagcatttccccagcttagatggtcatttttttgtgggatgcctgttaacatctcccctggatgttaatgttctgaggagcatggtttgggaaaggacctcgtgggacttacaggaagtagaaagatgtcacccattaaaggccaccacggtaagaacattcctctccttttagcagttgcttaagctgcacaagttggagtaagatgtcaccctttttatccaggtcattgggttagctgacagggagccaagattgaaatctaagatctttgccctgcaggattcagggctaatggacatcctgagatgggaggaaggagctttcattacagccttgtgggtcttgactcaccagtccctgcaggagccagtggagttcctgccatggtgtccctgaggaggtgtagcttctcacctaccctgccgccaagcccctcagtctgggtcttcttttcccatgcagcctccagcccaggctgcatactatggctgtggcccagtgacacccacccagcctgcccccaggtggacatcccagccacctagaccttcctgtgagtgacccagccccttccactctcagactggcctattggtgtgggccccgtgaggcagtcataacacagggatgaaacctggctctgccacttcccaaggtgggtgacttcacttctctgagcctcagtttcctcttctgagcatgggcctgaatgagacgtgtgtaaagtaccaagcacagtggtgagccaatggaagacacgcagctagccaccagcagtcatcaccaaagatgcctctgatttgtgactctgaaaattcttgcaaagctgagaaggtgaaattcctctggctatattgttgaccaaaggccctcctctgtaagagtgaattgcacgctcacttgaaactatcttgagggactaaggtgtacaatcctggtgcttatgcagtttggggctctaggtagacacgagctggctttgaaattgtagattcctacactccccctttctggagttctgggtctaagtgaattgactcctatttctgttgtgaatgttgtagtttcccttcccattctcttggtggccctggaagcttctaggcacagtgtgccaccctgattattcccaccactccatccaacttttctctctctgtggtgtctgcaccacaagctgcctaccctccaggtgcctcaatggtccggccaccagttgtgcctcggcgccccccggcccacatcagcagtgtcaggcaggcctccacccaggtgccacgcacggtgcctcatacccagagagtagccaacattggtactcagaccacaggacccagtggggtaggatgctgtacaccaaatcggcaaagtgcaggaattggcgagcttcacaaaccttnattaacttcaccatgag

SEQ ID NO: 295430 - DNA, 2907 bp, Homo sapiens
ggcagagctcggcactgcgccggggcgcacggctcgggggacccaggcccagctaccttccctccgcccccgggctctgttctcactttccagcagtggaaggacgggaagcgggagccatgcagtccgaatcggggatcgtgccggatttcgaagtcggggaggagtttcatgaagagcccaaaacctattacgaactcaaaagtcaaccgctgaagagcagcagttccgccgagcatcctggggcctccaagcctccgataagctcctccagtatgacatcacgcatcttgctacgccagcaactcatgcgtgagcagatgcaggagcaggagcgcagggagcagcagcagaagctgcaggcggcccagttcatgcaacagagagtgcccgtgagtcagacaccagccataaacgtcagtgtgcccaccacccttccctctgccacgcaggtgccgatggaagtccttaaggtgcagacccacctcgaaaaccccaccaagtaccacatacagcaagcccaacggcagcaggtaaagcagtacctttctaccactttagcaaataaacatgccaaccaagtcctgagcttgccatgtccaaaccagcctggcgatcatgtcatgccaccggtgccggggagcagcgcacccaacagccccatggctatgcttacgcttaactccaactgtgaaaaagagggattttataagtttgaagagcaaaacagggcagagagcgagtgcccaggcatgaacacacattcacgagcgtcctgtatgcagatggatgatgtaatcgatgacatcattagcctagaatcaagttataatgaggaaatcttgggcttgatggatcctgctttgcaaatggcaaatacgttgcctgtctcgggaaacttgattgatctttatggaaaccaaggtctgcccccaccaggcctcaccatcagcaactcctgtccagccaaccttcccaacataaaaagggagctcacagagtctgaagcaagagcactggccaaagagaggcagaaaaaggacaatcacaacctgattgaacgaagaagaagatttaacataaatgaccgcattaaagaactaggtactttgattcccaagtcaaatgatccagacatgcgctggaacaagggaaccatcttaaaagcatccgtggactatatccgaaagttgcaacgagaacagcaacgcgcaaaagaacttgaaaaccgacagaagaaactggagcacgccaaccggcatttgttgctcagaatacaggaacttgaaatgcaggctcgagctcatggactttcccttattccatccacgggtctctgctctccagatttggtgaatcggatcatcaagcaagaacccgttcttgagaactgcagccaagacctccttcagcatcatgcagacctaacctgtacaacaactctcgatctcacggatggcaccatcaccttcaacaacaacctcggaactgggactgaggccaaccaagcctatagtgtccccacaaaaatgggatccaaactggaagacatcctgatggacgacaccctttctcccgtcggtgtcactgatccactcctttcctcagtgtcccccggagcttccaaaacaagcagccggaggagcagtatgagcatggaagagacggagcacacttgttagcgaatcctccctgcactgcattcgcacaaactgcttcctttcttgattcgtagatttaataacttacctgaaggggttttcttgataattttcctttaatatgaaattttttttcatgctttatcaatagcccaggatatattttatttttagaattttgtgaaacagacttgtatattctattttacaactacaaatgcctccaaagtattgtacaaataagtgtgcagtatctgtgaactgaattcaccacagactttagctttctgagcaagaggattttgcgtcagagaaatgtctgtccatttttattcaggggaaacttgatttgagatttttatgcctgtgacttccttggaaatcaaatgtaaagtttaattgaaagaatgtaaagcaaccaaaaagaaaaaaaaaaagaaagaaagaggaaaagaaatccatactaacccttttccattttataaatgtattgattcattggtactgccttaaagatacagtacccctctagctttgtttagtctttatactgcaaactatttaaagaaatatgtattctgtaaaagaaaaaaaaaatgcggccttttcatgaggatcgtctggttagaaaacataactgataccaaccgaaactgaagggagttagaccaaggctctgaaatataaagtctaatcttgctctcttttattctgtgctgttacagttttcttcatcaatgagtgtgatccagtttttcataagatattttattttgaaatggaaattaatgtcctctcaaagtaaaatattgaggagcactgaaagtatgttttacttttttttaatttattttggcttttgataagaaaaccgaactgggcatatttctaattgggctttactatttttatttttaaattatgttttactgttcatttgatttgtacagattctttattatcattgttcttttcaatatatttgtattaatttgtaagaatatgcatcttaaaatggcaagttttccatatttttacaactcactggtggttttccgcattctttgtacacccatgaaagaaaacttttatgcaaggtcttgcatttaaaagacagctttgcgaatattttgtaaattacagtctcactcagaactgtttttggacacatttaaggtgtagtattaataggttaaaaccaggctttctagaaagaataaacttacatatttatttttaggacatg

SEQ ID NO: 295431 - DNA, 2605 bp, Homo sapiens
gggataccttgtttatagtaccttctctttgccagtccatcttcaaattggaattatagaaagtagagggagggatagtctaccgtctctcactggattggtgccacctaaaacattgttatgctggaaatgctagaatataatcactatcaggtgcagacccacctcgaaaaccccaccaagtaccacatacagcaagcccaacggcagcaggtaaagcagtacctttctaccactttagcaaataaacatgccaaccaagtcctgagcttgccatgtccaaaccagcctggcgatcatgtcatgccaccggtgccggggagcagcgcacccaacagccccatggctatgcttacgcttaactccaactgtgaaaaagagggattttataagtttgaagagcaaaacagggcagagagcgagtgcccaggcatgaacacacattcacgagcgtcctgtatgcagatggatgatgtaatcgatgacatcattagcctagaatcaagttataatgaggaaatcttgggcttgatggatcctgctttgcaaatggcaaatacgttgcctgtctcgggaaacttgattgatctttatggaaaccaaggtctgcccccaccaggcctcaccatcagcaactcctgtccagccaaccttcccaacataaaaagggagctcacagcgtgtatttttcccacagagtctgaagcaagagcactggccaaagagaggcagaaaaaggacaatcacaacctgattgaacgaagaagaagatttaacataaatgaccgcattaaagaactaggtactttgattcccaagtcaaatgatccagacatgcgctggaacaagggaaccatcttaaaagcatccgtggactatatccgaaagttgcaacgagaacagcaacgcgcaaaagaacttgaaaaccgacagaagaaactggagcacgccaaccggcatttgttgctcagaatacaggaacttgaaatgcaggctcgagctcatggactttcccttattccatccacgggtctctgctctccagatttggtgaatcggatcatcaagcaagaacccgttcttgagaactgcagccaagacctccttcagcatcatgcagacctaacctgtacaacaactctcgatctcacggatggcaccatcaccttcaacaacaacctcggaactgggactgaggccaaccaagcctatagtgtccccacaaaaatgggatccaaactggaagacatcctgatggacgacaccctttctcccgtcggtgtcactgatccactcctttcctcagtgtcccccggagcttccaaaacaagcagccggaggagcagtatgagcatggaagagacggagcacacttgttagcgaatcctccctgcactgcattcgcacaaactgcttcctttcttgattcgtagatttaataacttacctgaaggggttttcttgataattttcctttaatatgaaattttttttcatgctttatcaatagcccaggatatattttatttttagaattttgtgaaacagacttgtatattctattttacaactacaaatgcctccaaagtattgtacaaataagtgtgcagtatctgtgaactgaattcaccacagactttagctttctgagcaagaggattttgcgtcagagaaatgtctgtccatttttattcaggggaaacttgatttgagatttttatgcctgtgacttccttggaaatcaaatgtaaagtttaattgaaagaatgtaaagcaaccaaaaagaaaaaaaaaaagaaagaaagaggaaaagaaatccatactaacccttttccattttataaatgtattgattcattggtactgccttaaagatacagtacccctctagctttgtttagtctttatactgcaaactatttaaagaaatatgtattctgtaaaagaaaaaaaaaatgcggccttttcatgaggatcgtctggttagaaaacataactgataccaaccgaaactgaagggagttagaccaaggctctgaaatataaagtctaatcttgctctcttttattctgtgctgttacagttttcttcatcaatgagtgtgatccagtttttcataagatattttattttgaaatggaaattaatgtcctctcaaagtaaaatattgaggagcactgaaagtatgttttacttttttttaatttattttggcttttgataagaaaaccgaactgggcatatttctaattgggctttactatttttatttttaaattatgttttactgttcatttgatttgtacagattctttattatcattgttcttttcaatatatttgtattaatttgtaagaatatgcatcttaaaatggcaagttttccatatttttacaactcactggtggttttccgcattctttgtacacccatgaaagaaaacttttatgcaaggtcttgcatttaaaagacagctttgcgaatattttgtaaattacagtctcactcagaactgtttttggacacatttaaggtgtagtattaataggttaaaaccaggctttctagaaagaataaacttacatatttatttttaggacatg

SEQ ID NO: 295432 - DNA, 2853 bp, Homo sapiens
ggcagagctcggcactgcgccggggcgcacggctcgggggacccaggcccagctaccttccctccgcccccgggctctgttctcactttccagcagtggaaggacgggaagcgggagccatgcagtccgaatcggggatcgtgccggatttcgaagtcggggaggagtttcatgaagagcccaaaacctattacgaactcaaaagtcaaccgctgaagagcagcagttccgccgagcatcctggggcctccaagcctccgataagctcctccagtatgacatcacgcatcttgctacgccagcaactcatgcgtgagcagatgcaggagcaggagcgcagggagcagcagcagaagctgcaggcggcccagttcatgcaacagagagtgcccgtgagtcagacaccagccataaacgtcagtgtgcccaccacccttccctctgccacgcaggtgccgatggaagtccttaaggtgcagacccacctcgaaaaccccaccaagtaccacatacagcaagcccaacggcagcaggtaaagcagtacctttctaccactttagcaaataaacatgccaaccaagtcctgagcttgccatgtccaaaccagcctggcgatcatgtcatgccaccggtgccggggagcagcgcacccaacagccccatggctatgcttacgcttaactccaactgtgaaaaagagggattttataagtttgaagagcaaaacagggcagagagcgagtgcccaggcatgaacacacattcacgagcgtcctgtatgcagatggatgatgtaatcgatgacatcattagcctagaatcaagttataatgaggaaatcttgggcttgatggatcctgctttgcaaatggcaaatacgttgcctgtctcgggaaacttgattgatctttatggaaaccaaggtctgcccccaccaggcctcaccatcagcaactcctgtccagccaaccttcccaacataaaaagggagctcacagagtctgaagcaagagcactggccaaagagaggcagaaaaaggacaatcacaacctgattgaacgaagaagaagatttaacataaatgaccgcattaaagaactaggtactttgattcccaagtcaaatgatccagacatgcgctggaacaagggaaccatcttaaaagcatccgtggactatatccgaaagttgcaacgagaacagcaacgcgcaaaagaacttgaaaaccgacagaagaaactggagcacgccaaccggcatttgttgctcagaatacaggaacttgaaatgcaggctcgagctcatggactttcccttattccatccacgggtctctgctctccagatttggtgaatcggatcatcaagcaagaacccgttcttgagaactgcagccaagacctccttcagcatcatgcagacctaacctgtacaacaactctcgatctcacggatggcaccatcaccttcaacaacaacctcggaactgggactgaggccaaccaagcctatagtgtccccacaaaaatgggatccaaactggaagacatcctgatggacgacaccctttctcccgtcggtgtcactgatccactcctttcctcagtgtcccccggagcttcctagcgaatcctccctgcactgcattcgcacaaactgcttcctttcttgattcgtagatttaataacttacctgaaggggttttcttgataattttcctttaatatgaaattttttttcatgctttatcaatagcccaggatatattttatttttagaattttgtgaaacagacttgtatattctattttacaactacaaatgcctccaaagtattgtacaaataagtgtgcagtatctgtgaactgaattcaccacagactttagctttctgagcaagaggattttgcgtcagagaaatgtctgtccatttttattcaggggaaacttgatttgagatttttatgcctgtgacttccttggaaatcaaatgtaaagtttaattgaaagaatgtaaagcaaccaaaaagaaaaaaaaaaagaaagaaagaggaaaagaaatccatactaacccttttccattttataaatgtattgattcattggtactgccttaaagatacagtacccctctagctttgtttagtctttatactgcaaactatttaaagaaatatgtattctgtaaaagaaaaaaaaaatgcggccttttcatgaggatcgtctggttagaaaacataactgataccaaccgaaactgaagggagttagaccaaggctctgaaatataaagtctaatcttgctctcttttattctgtgctgttacagttttcttcatcaatgagtgtgatccagtttttcataagatattttattttgaaatggaaattaatgtcctctcaaagtaaaatattgaggagcactgaaagtatgttttacttttttttaatttattttggcttttgataagaaaaccgaactgggcatatttctaattgggctttactatttttatttttaaattatgttttactgttcatttgatttgtacagattctttattatcattgttcttttcaatatatttgtattaatttgtaagaatatgcatcttaaaatggcaagttttccatatttttacaactcactggtggttttccgcattctttgtacacccatgaaagaaaacttttatgcaaggtcttgcatttaaaagacagctttgcgaatattttgtaaattacagtctcactcagaactgtttttggacacatttaaggtgtagtattaataggttaaaaccaggctttctagaaagaataaacttacatatttatttttaggacatg

SEQ ID NO: 295433 - DNA, 799 bp, Homo sapiens
gacgcgcatctaccattatagtatcatatagagtggtttcacaggcttaaaagtcctctgtgctctgcctatttcagtgttttatctttactcttattataggaacttgaaatgcaggctcgagctcatggactttcccttattccatccacgggtctctgctctccagatttggtgaatcggatcatcaagcaagaacccgttcttgagaactgcagccaagacctccttcagcatcatgcagacctaacctgtacaacaactctcgatctcacggatggcaccatcaccttcaacaacaacctcggaactgggactgaggccaaccaagcctatagtgtccccacaaaaatgggatccaaactggaagacatcctgatggacgacaccctttctcccgtcggtgtcactgatccactcctttcctcagtgtcccccggagcttccaaaacaagcagccggaggagcagtatgagcatggaagagacggagcacacttgttagcgaatcctccctgcactgcattcgcacaaactgcttcctttcttgattcgtagatttaataacttacctgaaggggttttcttgataattttcctttaatatgaaattttttttcatgctttatcaatagcccaggatatattttatttttagaattttgtgaaacagacttgtatattctattttacaactacaaatgcctccaaagtattgtacaaataagtgtgcagtatctgtgaactgaattcaccacagactttagctttctgagcaagaggattttgcgtcagagaaa

SEQ ID NO: 295434 - DNA, 2090 bp, Homo sapiens
gtgctgcggcgagctccgtccaaaagaaaatggggtttggtgtaaatctgggggtgtaatgttatcatatatcactctacctcgtaaaaccgacactgaaagctgccggacaacaaatcacaggtcaaaattatgagttcttcgtattatgtgaacgcgctttttagcaaatatacggcggggacttctctgttccaaaatgccgagccgacttcttgctcctttgcgcccaactcacagagaagcggctacggggcgggcgccggcgccttcgcctcgaccgttccgggcttatacaatgtcaacagccccctttatcagagcccctttgcgtccggctacggcctgggcgccgacgcctacggcaacctgccctgcgcctcctacgaccaaaacatccccgggctctgcagtgacctcgccaaaggcgcctgcgacaagacggacgagggcgcgctgcatggcgcggctgaggccaatttccgcatctacccctggatgcggtcttcaggacctgacaggaagcggggccgccagacctacacgcgctaccagacgctggagctggagaaggagttccacttcaaccgctacctgacgcggcgccgccgcattgaaatcgcccacgcgctctgcctcaccgagcgccagattaagatctggttccagaaccgccgcatgaagtggaagaaagagcataaggacgaaggtccgactgccgccgcagctcccgagggcgccgtgccctctgccgccgccactgctgccgcggacaaggccgacgaggaggacgatgatgaagaagaggaagacgaggaggaatgaggggccgatccggggccctctctgcaccggacagtcggaaaagcgtctttaagagactcactggttttacttacaaaaatgggaaaaataaaagaaaaagaaggaagggctggtcatggtggaggtgcgcaaggagaaacagttccagaaagtgatcacagaatacctgaatgcccaagagtcagcctggcgctcttggctgacctccaacattttaatctaagtggccgggacaaaattgaccaaaactagggggaggaggggaccagtagtactaatgacttactacaggtcattatgaaataagctaacaatactgaatctttggcgagaaaattttgctgctaagggcactgcactgtaatttgttagtaaaggctaatatagtagagattaaagctccgttgaggacaggtgccttgtctttaacacgttgtattcatcacatttaacataggagtaattgctgagggatgacttgattgtactacggtgagatgaagggttaagatttcttccccatcaccagtagcctccctagctggtgtccctgtctccatactctcctgaatccaccttccactattgtccgctggccctttccagcctgtaaactggacagttttcattcctctgcctaacatccagtcgtagcagcccatcccatctctttaaggataaaacccaaattcttggtatagtaaagctaaaccaagcgctctccctggaagggctcctgtgtttcaccaaagctgacttacgtactttccccatcttcccaggcatcttgtacgtcgttacatttatcatattggaaggtaataaatgatcttgttttcctcttttcctgggctccttattaagagcagggaacctaatttatatcctcagggcagaacaggtattcagaaaagaataatgcaagaggaaaaaagtttaatataaactagggagatcgtaacattggctaatcacgagcaaatatttatagaagacccactgtgtgctaaatggctcctaatatatacttaagatattctcccagcttggaaattctgctcacttcttgctcttgcttgcttctctggtgggcttccatccaaatttggccatgacatcagatcatatggttaatattaacaaatattgtataaattgttttcatacttaatatccaacaggttgtcaatttacgtactactggtgccttatctgtttttactgtcccatacactgcccatctggaataagcttagtgttaaaaa

SEQ ID NO: 295435 - DNA, 1591 bp, Homo sapiens
gtaaaaaaacaaaaactaaaacaaaaaagcaacccagtccccaacctgcactctacccacccccatcacctactccagctcccaacttttgtggactgaacggccgcagagactgggtcgccttggattccctctgcctcaccgagcgccagattaagatctggttccagaaccgccgcatgaagtggaagaaagagcataaggacgaaggtccgactgccgccgcagctcccgagggcgccgtgccctctgccgccgccactgctgccgcggacaaggccgacgaggaggacgatgatgaagaagaggaagacgaggaggaatgaggggccgatccggggccctctctgcaccggacagtcggaaaagcgtctttaagagactcactggttttacttacaaaaatgggaaaaataaaagaaaaagaaggaagggctggtcatggtggaggtgcgcaaggagaaacagttccagaaagtgatcacagaatacctgaatgcccaagagtcagcctggcgctcttggctgacctccaacattttaatctaagtggccgggacaaaattgaccaaaactagggggaggaggggaccagtagtactaatgacttactacaggtcattatgaaataagctaacaatactgaatctttggcgagaaaattttgctgctaagggcactgcactgtaatttgttagtaaaggctaatatagtagagattaaagctccgttgaggacaggtgccttgtctttaacacgttgtattcatcacatttaacataggagtaattgctgagggatgacttgattgtactacggtgagatgaagggttaagatttcttccccatcaccagtagcctccctagctggtgtccctgtctccatactctcctgaatccaccttccactattgtccgctggccctttccagcctgtaaactggacagttttcattcctctgcctaacatccagtcgtagcagcccatcccatctctttaaggataaaacccaaattcttggtatagtaaagctaaaccaagcgctctccctggaagggctcctgtgtttcaccaaagctgacttacgtactttccccatcttcccaggcatcttgtacgtcgttacatttatcatattggaaggtaataaatgatcttgttttcctcttttcctgggctccttattaagagcagggaacctaatttatatcctcagggcagaacaggtattcagaaaagaataatgcaagaggaaaaaagtttaatataaactagggagatcgtaacattggctaatcacgagcaaatatttatagaagacccactgtgtgctaaatggctcctaatatatacttaagatattctcccagcttggaaattctgctcacttcttgctcttgcttgcttctctggtgggcttccatccaaatttggccatgacatcagatcatatggttaatattaacaaatattgtataaattgttttcatacttaatatccaacaggttgtcaatttacgtactactggtgccttatctgtttttactgtcccatacactgcccatctggaataagcttagtgttaaaaa

SEQ ID NO: 295436 - DNA, 134 bp, Homo sapiens
gacgaggaggaatgaggggccgatccggggccctctctgcaccggacagtcggaaaagcgtctttaagagactcactggttttacttacaaaaatgggaaaaataaaagaaaatgtaaaaaacaaaaacaaaaa

SEQ ID NO: 295437 - DNA, 1582 bp, Homo sapiens
ctccttcctggggcagtggagcagccacagccccagttcatctcgcgtttcctggagggccagtcgggtgtgaccatcaagcacgtggcctgtggggacttcttcactgcctgcctgactgacagaggcatcatcatgacattcggcagcggcagcaatgggtgcctaggccatggcagcctcactgacatcagccagcccaccattgtggaggctttgctgggctatgaaatggtgcaggtggcctgtggggcctctcacgtgctggccctgtccactgagcgagaactatttgcctggggccgtggagacagcggcagactggggctaggcaccagggagtcccacagctgcccccagcaggtgcccatgcccccaggacaggaagctcagcgagttgtatgtggtatcgattcctccatgatcctcactgtgcctggccaagccctagcctgtgggagcaacaggttcaacaagctgggcctggaccacctctccctgggggaggagcctgtcccccaccagcaagtggaggaggccctgagcttcacactactaggctctgcacccctggaccaggagcctctgctgagtatagacctgggcactgctcactcagctgctgtgactgcctcgggtgattgctacacttttggcagcaatcagcacggacagttgggcaccaatactcgccgaggcagtcgggcaccctgtaaggtccaaggccttgagggcatcaagatggcaatggtagcctgtggggatgccttcactgtagctattggggcagagagcgaagtgtactcttggggcaaaggggcgcgaggtcgattgggaaggagggatgaggatgccggactccctcggccagtgcagttggatgagacacacccttacacggtgacttccgtgtcctgttgccatggaaacaccctcctggctgttcgatcggtcacagatgagccggtccccccctgaggcacccggattcacctctggaccaccctgatattgcttctcctctgaatgctctgaaaagtgcaggtgcccaaggcatgacttgcagctgtctcctggattgtgtcatcatggggtatcagggctggcaaaacccctgctctgcttttggccttggatatggaaacctcaaccactttgttctcctaccacctctttgcccttcctaccccttcctcccttcagtcagtgtccccagggtccagcctggctagagttagaaggcagacctagcctttggaagcagggtggcctccagagccttgccataaaaaggctgaaggcagccgggcgcagtggctcacgcctgtaatcccagcactttgggaggctgaggcgggcggatcacgaggtcaggagatcgagaccatcctggctaacgtggtgaaaccccatctctactaaaaatacaaaaattaaccaggcatggtgacgggcgcctgtaatcccagctactctggaggctaaggcaagagaatcccttgaacccgggaggtgaagtttgcagtgagccgagatcgcaccactgcactccagcctggatgacagagcaagtctccctctc

SEQ ID NO: 295438 - DNA, 1757 bp, Homo sapiens
ctccttcctggggcagtggagcagccacagccccagttcatctcgcgtttcctggagggccagtcgggtgtgaccatcaagcacgtggcctgtggggacttcttcactgcctgcctgactgacagaggcatcatcatgacattcggcagcggcagcaatgggtgcctaggccatggcagcctcactgacatcagccagcccaccattgtggaggctttgctgggctatgaaatggtgcaggtggcctgtggggcctctcacgtgctggccctgtccactgagcgagaactatttgcctggggccgtggagacagcggcagactggggctaggcaccagggagtcccacagctgcccccagcaggtgcccatgcccccaggacaggaagctcagcgagttgtatgtggtatcgattcctccatgatcctcactgtgcctggccaagccctagcctgtgggagcaacaggttcaacaagctgggcctggaccacctctccctgggggaggagcctgtcccccaccagcaagtggaggaggccctgagcttcacactactaggctctgcacccctggaccaggagcctctgctgagtatagacctgggcactgctcactcagctgctgtgactgcctcgggtgattgctacacttttggcagcaatcagcacggacagttgggcaccaatactcgccgaggcagtcgggcaccctgtaaggtccaaggccttgagggcatcaagatggcaatggtagcctgtggggatgccttcactgtagctattggggcagagagcgaagtgtactcttggggcaaaggggcgcgaggtcgattgggaaggagggatgaggatgccggactccctcggccagtgcagttggatgagacacacccttacacggtgacttccgtgtcctgttgccatggaaacaccctcctggctgttcgatcggtcacagatgagccggtccccccctgaggcacccggattcacctctggaccaccctgatattgcttctcctctgaatgctctgaaaagtgcaggtgcccaaggcatgacttgcagctgtctcctggattgtgtcatcatggggtatcagggctggcaaaacccctgctctgcttttggccttggatatggaaacctcaaccactttgttctcctaccacctctttgcccttcctaccccttcctcccttcagtcagtgtccccagggtccagcctggctagagttagaaggcagacctagcctttggaagcagggtggcctccagagccttgccataaaaaggctgaaggcagccgggcgcagtggctcacgcctgtaatcccagcactttgggaggctgaggcgggcggatcacgaggtcaggagatcgagaccatcctggctaacgtggtgaaaccccatctctactaaaaatacaaaaaaattagctgggcgtggtggcacgcgcctgtagtcccagctgctcaggaggctgaggcaggagaatggcgtaaacccctccagcctgggcgacagaaccagactccgtctcaaaaaaaaaaaaaaaacaaaaaaggctgaaggcagcctgtagctccacacagaccctaccctttcccctagcccagttagaaaataagtctgggccggcggcggtggctcacacctgcataggcagtgctttggccaggaggatcccttgatcccttgtggccaggagttgggagaccagcctggggaccatagcgagaccgctgtctccacca

SEQ ID NO: 295439 - DNA, 950 bp, Homo sapiens
ctccttcctggggcagtggagcagccacagccccagttcatctcgcgtttcctggagggccagtcgggtgtgaccatcaagcacgtggcctgtggggacttcttcactgcctgcctgactgacagaggcatcatcatgacattcggcagcggcagcaatgggtgcctaggccatggcagcctcactgacatcagccagcccaccattgtggaggctttgctgggctatgaaatggtgcaggtggcctgtggggcctctcacgtgctggccctgtccactgagcgagaactatttgcctggggccgtggagacagcggcagactggggctaggcaccagggagtcccacagctgcccccagcaggtgcccatgcccccaggacaggaagctcagcgagttgtatgtggtatcgattcctccatgatcctcactgtgcctggccaagccctagcctgtgggagcaacaggttcaacaagctgggcctggaccacctctccctgggggaggagcctgtcccccaccagcaagtggaggaggccctgagcttcacactactaggctctgcacccctggaccaggagcctctgctgagtatagacctgggcactgctcactcagctgctgtgactgcctcgggtgattgctacacttttggcagcaatcagcacggacagttgggcaccaatactcgccgaggcagtcgggcaccctgtaaggtccaaggccttgagggcatcaagatggcaatggtagcctgtggggatgccttcactgtagctccacacagaccctaccctttcccctagcccagttagaaaataagtctgggccggcggcggtggctcacacctgcataggcagtgctttggccaggaggatcccttgatcccttgtggccaggagttgggagaccagcctggggaccatagcgagaccgctgtctccacca

SEQ ID NO: 295440 - DNA, 2005 bp, Homo sapiens
tgaggacgtggggcttccgtgaatgcgcagtgggtgcgtcggccacgaccttttggccaggttagggagggggcgacgctgagatgggggcggcggcggcggaagcggatcgcactctctttgtgggcaaccttgaaacgaaagtgaccgaggagctccttttcgagcttttccaccaggctgggccagtaataaaggtgaaaattccaaaagataaggatggtaaaccaaagcagtttgcgtttgtgaatttcaaacatgaagtgtctgttccttatgcaatgaatctacttaatggaatcaaactttatggaaggcctatcaaaattcaatttagatcaggaagtagtcatgccccacaagatgtcagtttgtcatatccccaacatcatgttggaaattcaagccctacctccacatctcctagcagcaggtacgaaaggactatggataacatgacttcatcagcacagataattcagagatctttctcttctccagaaaattttcagagacaagcagtgatgaacagtgctttgagacaaatgtcatatggtggaaaatttggttcttcacctctggatcaatcaggattttcaccatcagttcaatcacacagtcatagtttcaatcagtcttcaagctcccagtggcgccaaggtacaccatcatcacagcgtaaagtcagaatgaattcttatccctacctagcagatagacattatagccgggaacagcgttacactgatcatgggtctgaccatcattacagaggaaagagagatgatttcttctatgaagacaggaatcatgatgactggagccatgactatgataacagaagagacagtagtagagatggaaaatggcgctcatctcgacactaacacatgttaaaaggacattgtttttatagggtcattttaggccctttgactaagttgatatggaaatattttgttgaaaaactgtacagagcagctttacaagttgtcacatttctttataaatttttttaaagctacagtttaatacaaaatgaattgcggttttattacattaataacctttcacctcagggttttatgaagaggaaagggttttatgcaaaagaaagtgctacaattcctaatcattttagacactttaggagggggtgaagttgtatgataaagcagatattttaattatttgttatctttttgtattgcaagaaatttcttgctagtgaatcaagaaaacatccagattgacagtctaaaatggctactggtattttagttaattcaaaaatgaaacttttcagtgattcactttactaacattctatttgagaaggcttattggtaaagtttggggataaaggcattgcttaacttcttatataatttaggtataaattctgtgacatgctcttgagctttaccctagttgaacatacatgtgtagatttacacatactgtttcattctaaaatttagaaattgttcattaaatcccatttgaggtataagtcactcaggaagttaaaatatctctacacgtatatttttacattaaaaatacagtgttagcataaatccccttttcaggaagaacaaaaatgtcagtgcatagttagataaaatggtaaaatgttttactgaaagcatacttttttggaaaatagattcatgaagcctttaagtgctgcttctgtcagtcaaacgttaaaaactttaacattttcaaagtgcccagactgtgtacaaagacacatgtaatggagattgtacaggttgtttttttgtttgaacctttgaaagagtttaatcttaacgttttctaattttaaaattttaaaatcttgtttaacaaaagcttgtattaagatactgttttcatttcattacagaattgtttataaaagttcatttgttgaaaaataaggatcctttttaataccacagcatttgtactgttcctttttaatatactgaaaatataaaaggaagggtgtgtgtta

SEQ ID NO: 295441 - DNA, 822 bp, Homo sapiens
tgaggacgtggggcttccgtgaatgcgcagtgggtgcgtcggccacgaccttttggccaggttagggagggggcgacgctgagatgggggcggcggcggcggaagcggatcgcactctctttgtgggcaaccttgaaacgaaagtgaccgaggagctccttttcgagcttttccaccaggctgggccagtaataaaggtgaaaattccaaaagataaggatggtaaaccaaagcagtttgcgtttgtgaatttcaaacatgaagtgtctgttccttatgcaatgaatctacttaatggaatcaaactttatggaaggcctatcaaaattcaatttagatcaggaagtagtcatgccccacaagatgtcagtttgtcatatccccaacatcatgttggaaattcaagccctacctccacatctcctagcagcaggtacgaaaggactatggataacatgacttcatcagcacagataattcagagatctttctcttctccagaaaattttcagagacaagcagtgattactctagtttgatgtcataatttctcatggagttaaaactggactcttcaaaatgatagagttgtctgaatttggctgcaatgcgaactactaatcgattcaagcttgttatcaagacacctagagatcaccagatgacaggattggacattgagaaggaccagattattgagatggcctgtctgataactgactctgatctcaacattttggctgaaggtcctaacctgattataaaacaaccagatgagttgctggacagcatgtcagattggtgtaaggagcatcacgggaa

SEQ ID NO: 295442 - DNA, 304 bp, Homo sapiens
gcggccgcctactactactactgctcgaattcaagcttctaacgatgtacggggacatgtaatggagattgtacaggttgtttttttgtttgaacctttgaaagagtttaatcttaacgttttctaattttaaaattttaaaatcttgtttaacaaaagcttgtattaagatactgttttcatttcattacagaattgtttataaaagttcatttgttgaaaaataaggatcctttttaataccacagcatttgtactgttcctttttaatatactgaaaatataaaaggaagggtgtgtgtta

SEQ ID NO: 295443 - DNA, 3609 bp, Homo sapiens
tgaggacgtggggcttccgtgaatgcgcagtgggtgcgtcggccacgaccttttggccaggttagggagggggcgacgctgagatgggggcggcggcggcggaagcggatcgcactctctttgtgggcaaccttgaaacgaaagtgaccgaggagctccttttcgagcttttccaccaggctgggccagtaataaaggtgaaaattccaaaagataaggatggtaaaccaaagcagtttgcgtttgtgaatttcaaacatgaagtgtctgttccttatgcaatgaatctacttaatggaatcaaactttatggaaggcctatcaaaattcaatttagatcaggaagtagtcatgccccacaagatgtcagtttgtcatatccccaacatcatgttggaaattcaagccctacctccacatctcctagcagcaggtacgaaaggactatggataacatgacttcatcagcacagataattcagagatctttctcttctccagaaaattttcagagacaagcagtgatgaacagtgctttgagacaaatgtcatatggtggaaaatttggttcttcacctctggatcaatcaggattttcaccatcagttcaatcacacagtcatagtttcaatcagtcttcaagctcccagtggcgccaaggtacaccatcatcacagcgtaaagtcagaatgaattcttatccctacctagcagatagacattatagccgggaacagcgttacactgatcatgggtctgaccatcattacagaggaaagagagatgatttcttctatgaagacaggaatcatgatgactggagccatgactatgataacagaagagacagtagtagagatggaaaatggcgctcatctcgacactaacacatgttaaaaggacattgtttttatagggtcattttaggccctttgactaagttgatatggaaatattttgttgaaaaactgtacagagcagctttacaagttgtcacatttctttataaatttttttaaagctacagtttaatacaaaatgaattgcggttttattacattaataacctttcacctcagggttttatgaagaggaaagggttttatgcaaaagaaagtgctacaattcctaatcattttagacactttaggagggggtgaagttgtatgataaagcagatattttaattatttgttatctttttgtattgcaagaaatttcttgctagtgaatcaagaaaacatccagattgacagtctaaaatggctactggtattttagttaattcaaaaatgaaacttttcagtgattcactttactaacattctatttgagaaggcttattggtaaagtttggggataaaggcattgcttaacttcttatataatttaggtataaattctgtgacatgctcttgagctttaccctagttgaacatacatgtgtagatttacacatactgtttcattctaaaatttagaaattgttcattaaatcccatttgaggtataagtcactcaggaagttaaaatatctctacacgtatatttttacattaaaaatacagtgttagcataaatccccttttcaggaagaacaaaaatgtcagtgcatagttagataaaatggtaaaatgttttactgaaagcatacttttttggaaaatagattcatgaagcctttaagtgctgcttctgtcagtcaaacgttaaaaactttaacattttcaaagtgcccagactgtgtacaaagacacatgtaatggagattgtacaggttgtttttttgtttgaacctttgaaagagtttaatcttaacgttttctaattttaaaattttaaaatcttgtttaacaaaagcttgtattaagatactgttttcatttcattacagaattgtttataaaagttcatttgttgaaaaataaggatcctttttaataccacagcatttgtactgttcctttttaatatactgaaaatataaaaggaagggtgtgtgttaaaacaaaaaaacaaaaaaaaaacaaaacaaaaaaaaaagagagagagagagagagagacacacagagagaaaataaaaaaaaaagaggacacacaaaagaaaacaaaagaaacacacaaacacacaacgagagaaaccaaaagaagagagaacaagaaaagaacagagaaacagagagtgacgtggagaggcgagacaagaaaacaggtgagcacgcacgcagacaacgacaacgacgtgctcagaacacacgggacacagcagagaggacacagaccaggacagacaaacgctagcgcacagaggaaaaacaacagaatagacacacatagcgagagaggagatgacgaagacacacaccagatacaccgctgcgagagaaacatacacactcaacacacaccacacacacaggagcagaagaaaatctcgggaacacagacgccaccacgacagagcggcgagacaccaacacactacgaacaccaacgaaactacgtgatgacaaggcaggagacgcaaaaacataacctggaggaagctcaactaaacagcgacgatcagaaacgaaagcaaggatcaacaaaagattgaagagatagtacagctagacgtcgatagtaagctaacacacagcagctataataggaagcagactaataaacaagtacgcgaatataggacactcatcgatgacaataataaaagactaaacaaaaaggctaatagaatgaataacacaagaagtggaagagacagacgagtagcactgaattataatacccaaaccacacagaagagatacaaacacaaagatacgcataacagagatacgcatacgaagagcatgaaagacgacgatacactaaacgaaaaagaagaagaaaaaatctacggatgcaacgacagagaacgagcaaaagagaagagagagaggagtgagagcaaaagaaaaagataaggaaaaagatgaggagagagagaagagaaaggcggagcaaaagaaacacaagaagaagaaacacgaagagacagcaaagagagagagagagaagaaacgacgagcaagagaaaggatcacacaggataaagaaacaagaaagcagagcaagagagacaggaaagcagaaagaagaaagcagaaagaaaagagaagagggaaagaaggaaggagaaagaggacgaggaaaacaaggaagagaaagagagagaagaaacggagagcgaacgagcaaagaagaagaaagcacggagacagaaacaaggagagtgaggcggaagcaagaacgagacagcggaggagcggagaggaggcaaagaaggatagtagatgaactaagaaatagagggagagagaaagaagaaagaggataggatgcgggagggggcaaaccgatgtacagatgaagagagaggagagcagagaggtagagagaagtgagattgagtgatgaggtgagcaacttagctgtagcagcaggacgttcgacacatagaacagtaggatagtgatcagagagattgatgacgaagcaggaagaaggagaggatgacagagacgtgaaagaacgagagtggatatgagattgcgatgagaatgaaag

SEQ ID NO: 295444 - DNA, 1989 bp, Homo sapiens
tgaggacgtggggcttccgtgaatgcgcagtgggtgcgtcggccacgaccttttggccaggttagggagggggcgacgctgagatgggggcggcggcggcggaagcggatcgcactctctttgtgggcaaccttgaaacgaaagtgaccgaggagctccttttcgagcttttccaccaggctgggccagtaataaaggtgaaaattccaaaagataaggatggtaaaccaaagcagtttgcgtttgtgaatttcaaacatgaagtgtctgttccttatgcaatgaatctacttaatggaatcaaactttatggaaggcctatcaaaattcaatttagatcaggaagtagtcatgccccacaagatgtcagtttgtcatatccccaacatcatgttggaaattcaagccctacctccacatctcctagcagcaggtacgaaaggactatggataacatgacttcatcagcacagataattcagagatctttctcttctccagaaaattttcagagacaagcagtgatgaacagtgctttgagacaaatgtcatatggtggaaaatttggttcttcacctctggatcaatcaggattttcaccatcagttcaatcacacagtcatagtttcaatcagtcttcaagctcccagtggcgccaaggtacaccatcatcacagcgtaaagtcagaatgaattcttatccctacctagcagatagacattatagccgggaacagcgttacactgatcatgggtctgaccatcattacagaggaaagagagatgatttcttctatgaagacaggaatcatgatgactggagccatgactatgataacagaagagacagtagtagagatggaaaatggcgctcatctcgacactaacacatgttaaaaggacattgtttttatagggtcattttaggccctttgactaagttgatatggaaatattttgttgaaaaactgtacagagcagctttacaagttgtcacatttctttataaatttttttaaagctacagtttaatacaaaatgaattgcggttttattacattaataacctttcacctcagggttttatgaagaggaaagggttttatgcaaaagaaagtgctacaattcctaatcattttagacactttaggagggggtgaagttgtatgataaagcagatattttaattatttgttatctttttgtattgcaagaaatttcttgctagtgaatcaagaaaacatccagattgacagtctaaaatggctactggtattttagttaattcaaaaatgaaacttttcagtgattcactttactaacattctatttgagaaggcttattggtaaagtttggggataaaggcattgcttaacttcttatataatttaggtataaattctgtgacatgctcttgagctttaccctagttgaacatacatgtgtagatttacacatactgtttcattctaaaatttagaaattgttcattaaatcccatttgaggtataagtcactcaggaagttaaaatatctctacacgtatatttttacattaaaaatacagtgttagcataaatccccttttcaggaagaacaaaaatgtcagtgcatagttagataaaatggtaaaatgttttactgaaagcatacttttttggaaaatagattcatgaagcctttaagtgctgcttctgtcagtcaaacgttaaaaactttaacattttcaaagtgcccagactgtgtacaaagacacatgtaatggagattgtacaggttgtttttttgtttgaacctttgaaagagtttaatcttaacgttttctaattttaaaattttaaaatcttgtttaacaaaagcttgtattaagatactgttttcatttcattacagaattgtttataaaagttcatttgttgaaaaataaggatcctttttaataccacagcatacgccgtgcttttaatatatgccccccccccctctct

SEQ ID NO: 295445 - DNA, 1685 bp, Homo sapiens
ccaggctgggccagtaataaaggaagtagtcatgccccacaagatgtcagtttgtcatatccccaacatcatgttggaaattcaagccctacctccacatctcctagcagcaggtacgaaaggactatggataacatgacttcatcagcacagataattcagagatctttctcttctccagaaaattttcagagacaagcagtgatgaacagtgctttgagacaaatgtcatatggtggaaaatttggttcttcacctctggatcaatcaggattttcaccatcagttcaatcacacagtcatagtttcaatcagtcttcaagctcccagtggcgccaaggtacaccatcatcacagcgtaaagtcagaatgaattcttatccctacctagcagatagacattatagccgggaacagcgttacactgatcatgggtctgaccatcattacagaggaaagagagatgatttcttctatgaagacaggaatcatgatgactggagccatgactatgataacagaagagacagtagtagagatggaaaatggcgctcatctcgacactaacacatgttaaaaggacattgtttttatagggtcattttaggccctttgactaagttgatatggaaatattttgttgaaaaactgtacagagcagctttacaagttgtcacatttctttataaatttttttaaagctacagtttaatacaaaatgaattgcggttttattacattaataacctttcacctcagggttttatgaagaggaaagggttttatgcaaaagaaagtgctacaattcctaatcattttagacactttaggagggggtgaagttgtatgataaagcagatattttaattatttgttatctttttgtattgcaagaaatttcttgctagtgaatcaagaaaacatccagattgacagtctaaaatggctactggtattttagttaattcaaaaatgaaacttttcagtgattcactttactaacattctatttgagaaggcttattggtaaagtttggggataaaggcattgcttaacttcttatataatttaggtataaattctgtgacatgctcttgagctttaccctagttgaacatacatgtgtagatttacacatactgtttcattctaaaatttagaaattgttcattaaatcccatttgaggtataagtcactcaggaagttaaaatatctctacacgtatatttttacattaaaaatacagtgttagcataaatccccttttcaggaagaacaaaaatgtcagtgcatagttagataaaatggtaaaatgttttactgaaagcatacttttttggaaaatagattcatgaagcctttaagtgctgcttctgtcagtcaaacgttaaaaactttaacattttcaaagtgcccagactgtgtacaaagacacatgtaatggagattgtacaggttgtttttttgtttgaacctttgaaagagtttaatcttaacgttttctaattttaaaattttaaaatcttgtttaacaaaagcttgtattaagatactgttttcatttcattacagaattgtttataaaagttcatttgttgaaaaataaggatcctttttaataccacagcatttgtactgttcctttttaatatactgaaaatataaaaggaagggtgtgtgtta

SEQ ID NO: 295446 - DNA, 1196 bp, Homo sapiens
gcccattaacctgcccccaagattcggcaccagagagacagtagtagagatggaaaatggcgctcatctcgacactaacacatgttaaaaggacattgtttttatagggtcattttaggccctttgactaagttgatatggaaatattttgttgaaaaactgtacagagcagctttacaagttgtcacatttctttataaatttttttaaagctacagtttaatacaaaatgaattgcggttttattacattaataacctttcacctcagggttttatgaagaggaaagggttttatgcaaaagaaagtgctacaattcctaatcattttagacactttaggagggggtgaagttgtatgataaagcagatattttaattatttgttatctttttgtattgcaagaaatttcttgctagtgaatcaagaaaacatccagattgacagtctaaaatggctactggtattttagttaattcaaaaatgaaacttttcagtgattcactttactaacattctatttgagaaggcttattggtaaagtttggggataaaggcattgcttaacttcttatataatttaggtataaattctgtgacatgctcttgagctttaccctagttgaacatacatgtgtagatttacacatactgtttcattctaaaatttagaaattgttcattaaatcccatttgaggtataagtcactcaggaagttaaaatatctctacacgtatatttttacattaaaaatacagtgttagcataaatccccttttcaggaagaacaaaaatgtcagtgcatagttagataaaatggtaaaatgttttactgaaagcatacttttttggaaaatagattcatgaagcctttaagtgctgcttctgtcagtcaaacgttaaaaactttaacattttcaaagtgcccagactgtgtacaaagacacatgtaatggagattgtacaggttgtttttttgtttgaacctttgaaagagtttaatcttaacgttttctaattttaaaattttaaaatcttgtttaacaaaagcttgtattaagatactgttttcatttcattacagaattgtttataaaagttcatttgttgaaaaataaggatcctttttaataccacagcatttgtactgttcctttttaatatactgaaaatataaaaggaagggtgtgtgtta

SEQ ID NO: 295447 - DNA, 1139 bp, Homo sapiens
aacgcgtcgaccacgcgtcgcccacgcgctcgggacactgtctcactacgggtcattttaggccctttgactaagttgatatggaaatattttgttgaaaaactgtacagagcagctttacaagttgtcacatttctttataaatttttttaaagctacagtttaatacaaaatgaattgcggttttattacattaataacctttcacctcagggttttatgaagaggaaagggttttatgcaaaagaaagtgctacaattcctaatcattttagacactttaggagggggtgaagttgtatgataaagcagatattttaattatttgttatctttttgtattgcaagaaatttcttgctagtgaatcaagaaaacatccagattgacagtctaaaatggctactggtattttagttaattcaaaaatgaaacttttcagtgattcactttactaacattctatttgagaaggcttattggtaaagtttggggataaaggcattgcttaacttcttatataatttaggtataaattctgtgacatgctcttgagctttaccctagttgaacatacatgtgtagatttacacatactgtttcattctaaaatttagaaattgttcattaaatcccatttgaggtataagtcactcaggaagttaaaatatctctacacgtatatttttacattaaaaatacagtgttagcataaatccccttttcaggaagaacaaaaatgtcagtgcatagttagataaaatggtaaaatgttttactgaaagcatacttttttggaaaatagattcatgaagcctttaagtgctgcttctgtcagtcaaacgttaaaaactttaacattttcaaagtgcccagactgtgtacaaagacacatgtaatggagattgtacaggttgtttttttgtttgaacctttgaaagagtttaatcttaacgttttctaattttaaaattttaaaatcttgtttaacaaaagcttgtattaagatactgttttcatttcattacagaattgtttataaaagttcatttgttgaaaaataaggatcctttttaataccacagcatttgtactgttcctttttaatatactgaaaatataaaaggaagggtgtgtgtta

SEQ ID NO: 295448 - DNA, 890 bp, Homo sapiens
tgaggacgtggggcttccgtgaatgcgcagtgggtgcgtcggccacgaccttttggccaggttagggagggggcgacgctgagatgggggcggcggcggcggaagcggatcgcactctctttgtgggcaaccttgaaacgaaagtgaccgaggagctccttttcgagcttttccaccaggctgggccagtaataaaggtgaaaattccaaaagataaggatggtaaaccaaagcagtttgcgtttgtgaatttcaaacatgaagtgtctgttccttatgcaatgaatctacttaatggaatcaaactttatggaaggcctatcaaaattcaatttagatcaggaagtagtcatgccccacaagatgtcagtttgtcatatccccaacatcatgttggaaattcaagccctacctccacatctcctagcagcaggtacgaaaggactatggataacatgacttcatcagcacagataattcagagatctttctcttctccagaaaattttcagagacaagcagtgatgaacagtgctttgagacaaatgtcatatggtggaaaatttggttcttcacctctggatcaatcaggattttcaccatcagttcaatcacacagtcatagtttcaatcagtcttcaagctcccagtggcgccaaggtacaccatcatcacagcgtaaagtcagaatgaattcttatccctacctagcagatagacattatagccgggaacagcgttacactgatcatgggtctgaccatcattacagaggaaagagagatgatttcttctatgaagacaggaatcatgatgactggagccatgactatgataacagatcaagtacctggattaggatgcgctcgtagagggatactctaattcag

SEQ ID NO: 295449 - DNA, 550 bp, Homo sapiens
ctatcgcttcgcagaacctactcaggcagccagctgagaagagttgagggaaagtgctgctgctgggtctgcagacgcgatggataacgtgcagccgaaaataaaacatcgccccttctgcttcagtgtgaaaggccacgtgaagatgctgcggctggatcttaccaacagtatcattacagctgtgttcctttcagtagttgccatcttggccatgcaagaaaagaaaagaaggcatttactctatgtcggggggcggtaatcgtgtgttgcatcgatgcgtttgtggtcaccacgaagatgaggaccaacttgaaaagattcctgggagtcgaagttgaaaggaagctttcccccgccaaggacgcctaccccgaaaccggccccgacgccccgcagaggcccgcctgaagccagcccggcgccctagcagatgcacgtgtctgtcgaatcgctgcctccgagcccacccccgagctcgcatgctgtcacccattccagcctaaatgtgaccataaaattagggctgctgcttttatcgagaaaaaaa

SEQ ID NO: 295450 - DNA, 1055 bp, Homo sapiens
acgctggttcccaggggagagccagccgctgccgcggcactggttcagacggccaggccctagggacccaccatggatcctgaacacgccaaacctgagtcatccgaggcaccttcagggaacttgaaacaaccggagactgccgcagccctggcaagtagcggcagcgtagtgagttctgtacccaaggcacagcgcaacatctcagcgaagaccgcaccccggaagcaccccgcagtctcaattcgcagtgcgcagtccgcagccgccgcacgtccccaaggcagtgagggcaccgcaccctcaaggaaagccaccacacgcccaccgcaaagcccacactcccaccccccacgccctctgcacacactgaatccaaactcttaaatgagatggcgatcaaagagcgcgtggagggccgagccaaagtcccgtacaaattcagggacagcctcaaacgtttctccttctcgcccactggaatgttgaagatcctgagactgagtcttatcttaggagcattagcttgtttcatcatcacccaagccaatgagtcatttataacaatcacaagtctggaaatctgcattgtcgttttttttattctaatatatgtgctaacccttcaccacttgctgacctatttacattggcccttacttgatcttaccaacagtatcattacagctgtgttcctttcagtagttgccatcttggccatgcaagaaaagaaaagaaggcatttactctatgtcggggggcggtaatcgtgtgttgcatcgatgcgtttgtggtcaccacgaagatgaggaccaacttgaaaagattcctgggagtcgaagttgaaaggaagctttcccccgccaaggacgcctaccccgaaaccggccccgacgccccgcagaggcccgcctgaagccagcccggcgccctagcagatgcacgtgtctgtcgaatcgctgcctccgagcccacccccgagctcgcatgctgtcacccattccagcctaaatgtgaccataaaattagggctgctgcttttatcgagaaaaaaa

SEQ ID NO: 295451 - DNA, 588 bp, Homo sapiens
cattgtcttcaaatctgtgagagattttctcaaaggctgctgagctctctctgtcccacagaatgccgagtacaggaagcagacaaagcaaatatgagcaactttaattgaacatgtggaagacccttttagttatggagaggtttctcaggggaaactcaaatctctgtccgtggaaattttcaagaagggaaggatcttaccaacagtatcattacagctgtgttcctttcagtagttgccatcttggccatgcaagaaaagaaaagaaggcatttactctatgtcggggggcggtaatcgtgtgttgcatcgatgcgtttgtggtcaccacgaagatgaggaccaacttgaaaagattcctgggagtcgaagttgaaaggaagctttcccccgccaaggacgcctaccccgaaaccggccccgacgccccgcagaggcccgcctgaagccagcccggcgccctagcagatgcacgtgtctgtcgaatcgctgcctccgagcccacccccgagctcgcatgctgtcacccattccagcctaaatgtgaccataaaattagggctgctgcttttatcgagaaaaaaa

SEQ ID NO: 295452 - DNA, 483 bp, Homo sapiens
atcaactcactggtaacaacagtattcatgctcatcgtatctgtgttggcactgataccagaaaccacaacattgacagttggtggaggggatcttaccaacagtatcattacagctgtgttcctttcagtagttgccatcttggccatgcaagaaaagaaaagaaggcatttactctatgtcggggggcggtaatcgtgtgttgcatcgatgcgtttgtggtcaccacgaagatgaggaccaacttgaaaagattcctgggagtcgaagttgaaaggaagctttcccccgccaaggacgcctaccccgaaaccggccccgacgccccgcagaggcccgcctgaagccagcccggcgccctagcagatgcacgtgtctgtcgaatcgctgcctccgagcccacccccgagctcgcatgctgtcacccattccagcctaaatgtgaccataaaattagggctgctgcttttatcgagaaaaaaa

SEQ ID NO: 295453 - DNA, 765 bp, Homo sapiens
acgctggttcccaggggagagccagccgctgccgcggcactggttcagacggccaggccctagggacccaccatggatcctgaacacgccaaacctgagtcatccgaggcaccttcagggaacttgaaacaaccggagactgccgcagccctggcaagtagcggcagcgtagtgagttctgtacccaaggcacagcgcaacatctcagcgaagaccgcaccccggaagcaccccgcagtctcaattcgcagtgcgcagtccgcagccgccgcacgtccccaaggcagtgagggcaccgcaccctcaaggaaagccaccacacgcccaccgcaaagcccacactcccaccccccacgccctctgcacacactgaatccaaactcttaaatgagatggcgatcaaagagcgcgtggagggccgagccaaagtcccgtacaaattcagggacagcctcaaacgtttctccttctcgcccactggaatgttgaagatcctgagactggtgagcggagagctggtgagacctagctgggcggatgtggccggcagtggcctcggggaaatgcccacggggtgccagctccagaaaccttccataattcactttgccactcacctttgttttgcctcaccatcctcaccctgaacaaccttccgctctgcccagcacctatagagcagggatcacgacgcggggtgagtgacgcagtgtcgcagtctcgcctggccttctgataatagtcgtgaatggcgtagcggatgac

SEQ ID NO: 295454 - DNA, 909 bp, Homo sapiens
acgctggttcccaggggagagccagccgctgccgcggcactggttcagacggccaggccctagggacccaccatggatcctgaacacgccaaacctgagtcatccgaggcaccttcagggaacttgaaacaaccggagactgccgcagccctggcaagtagcggcagcgtagtgagttctgtacccaaggcacagcgcaacatctcagcgaagaccgcaccccggaagcaccccgcagtctcaattcgcagtgcgcagtccgcagccgccgcacgtccccaaggcagtgagggcaccgcaccctcaaggaaagccaccacacgcccaccgcaaagcccacactcccaccccccacgccctctgcacacactgaatccaaactcttaaatgagatggcgatcaaagagcgcgtggagggccgagccaaagtcccgtacaaattcagggacagcctcaaacgtttctccttctcgcccactggaatgttgaagatcctgagactgagtcttatcttaggagcattagcttgtttcatcatcacccaagccaatgagtcatttataacaatcacaagtctggaaatctgcattgtcgttttttttattctaatatatgtgctaacccttcaccacttgctgacctatttacattggcccttacttgtaagtgttcatttttacaattcttcaaatccaagctttgccctcagccccagagtaagggctctccttaagtgaaaacaacggagctatctctctagacaaggacatagctgagctgtgacagttagggtgttgccctggtccagaaggattccttgaacccttgtgcctgcaggacagccaacacaccgctgctccagccctgagtgtaaaacccctcattatggcactagacacatggtacttt

SEQ ID NO: 295455 - DNA, 148 bp, Homo sapiens
acccctggacaaaggtggggcagggctaggggctcagggcagtatggctgagagctggtcccccttggaggtcaactgttctgtggacctagcctcagaatcacggcttgggaggatttgaagagttatccagggatcaataacatcc

SEQ ID NO: 295456 - DNA, 2307 bp, Homo sapiens
gatggttagtactataattatcccaaggattcattcactcatagaacatttgttgagcaattactacctgccagtcacttccaagtggtaagtgagatagaaatggttctttgtggcactcacaatttattggagaatggaaacacaattacaaaaaaaaagtgtgataagttctgggagaagggtggtacaggatcctgtggggtagtggtggctccatataggagggacattgggatactgatcaggaaggagtgggggacagggctagaagctgcattagtataaagttatgtcagactgccaaaacaaaacaaacacaaaaaatcagtagtctgtggtaaagaattgctataggaacagccagtaggggcagttaagctggtcttggtgaatcaggggaagcgtcctagaggaacagatgtccatgctgaggccaaatgctggacaggagttagccagacagggaaattgcattctgggcagaggagacagcaaaggtcaagaaacatgacaactttggaagactgtaacttgttcagaggcagagggtgcaaaggagaaatgaggaaaggtgaagctggagaggtgggcttggtccagctcttgctgggccttttcagccgtgttaaagatttagactgtatccagagggatgttgaactttaagcctaagactgaaaaggtgagaattgtgccttagatcactatggttgcagtgtggagactggtttggaaaggggagaaatcagaggcttttacagccatcccagggagagagaatgaacaccagaattagggtaatggaagatggaaagaagagaaatcgttttatgggttgctcaggagatagaattgacatgtcttgggattgttttgctgtgtaggggagagagacaagtcaagagtatacatcctgtttctgacttggcaactgggtgggtcatgggtctgtttcctgagacagttgtctacagccataccaccgtaagcgccctaaatctcatcagagacagtttatgcaaatggagcttggggaaagagaggtcgtggctggagacagagatttgggcatcatcaacatataggtgtggggagcagagaaggctgaggaagaaagcaggaaacatataaaaaggagagcagggaaaggagccagtgagacaggaaaaacctagtaacgtggtgtgatgaagctaggggaggaaggaaggaaggaagggcggcgtggaacgctgctgatgggtggtggcggggaaaatgaacgagtatccaccagcaacgagaggggcctccatggtcttggtgggagcatttctttggagaggtggaatcagaagccccagatgtcagagggttaaggaataatttggaggaaaagcgtaaaggcagtggaggtgaggagagaattttcaaaatgtttggcagtgattgcaatgaaagaaaaaaatggagggagcagagtatatgcagttgaggaacttttttagtttggagtgtgttaacacgatgttaggaagaaggatcaagtgaaggagaaaggtgaaaatgctggaaggtggggcttagtgatgaaacaaaccttggggacaggtgggcgtggtactgagagtcccagtgaggggagtgccctcaggcaggcgccggtggcttctgtcacaggagggaacagcgctgacattcagctggttcgcactgatacggctcaaccagtttgttaaaacatgtctgttccagtgtcagtaatatacgagtaactgcaatatgcagtaaaaattataaattctaatacaaactcagttcaagctaattaagagatcgcaacagccgttggtaaatggacttcccgctgcatttgagaagctttgcagcgccatctgccggtgtcgtagcatcactgcaggctgagaggctgctttgcgccttcatcttgaagcactctgaaattgcctgtttaaattaccttggaatcatggagttgctactgcttctgaatagtttagcttctactttgattttattgttagtgcattgtcgttcttgtgtcagtagcaagtttcagtgttttaatatttacaaatacaaaaatttttaataaaatattaaagccaaacttgaatgaagagacaacaaagtttggatatgtttctttatgtgccttttgacatatcataaatgagaatcttttgattcctcaggagaacaaagaagaaatattaatgagctgcagccaggaatgttttctgttactgtgtaaaaatcagaataatatggaaatcatttgcaactttttattttgaaaaattt

SEQ ID NO: 295457 - DNA, 384 bp, Homo sapiens
ctagaggatccccatggcaatccacgcatggccagaccatccaggtagaccatcagcaggctgaagtcttcatcgtggagcagactgtccacgcggaggagggcatccccatgtcctgccagtactacctgctctccgatgggcacctggccaagagaatacaggtgggctccccagggtgctgcatcatcaccaagatgcctatcttgagggaagaggatgagattgagccacgcccagtgtttgagaagaagccctggtatgggaggaggatatggagctctattcgaagttcctggaccggaaggaggagctccggctcggccacgccagctatctgcggcagcaccccgaagcccacgcgctcatctccgacttcctgct

SEQ ID NO: 295458 - DNA, 420 bp, Homo sapiens
gacggtggcgacgcgtgcaccggggatgtgtcctgccaccagaggaggtgtgcgtggcggggagcagaggggctttgtttcccaggtgaaggtgcggcttcttcactcttagaggtgcgtgtgtgggtgggggtgcttgctgttgaggtttatgcctgtgactgacagctgtcccccaagccatgctggcagtgtgtaggtgtcgtgccggccaccgcagaggaatcctctgggcttctgtggttcaagtggggcccagcgcagagctccatgagttgctgagcagccagccctgcagcatctcctggttttggcagcaggaggcgtcccctgtgcattcaggggccgtggggctggggcactcgcagcaggaaggagccctgctcaggcctgcgtgctccctttctgcagagggagacg

SEQ ID NO: 295459 - DNA, 769 bp, Homo sapiens
ccgcgacccgcacggcccggacacgcccgccctcaggaaacgccggacgcttgtgggggcaaccacggaccgcaggacagagacccgcgggcggcgggttctctcggtggcgccgtatccagagcagcgcccgcgtccccaggcggtgatgtcgccgcggccgaggatcctctgtgccagctccggccgcgcagcccggggaggtgcaaagagaaatccttggaactccttgagctctgagaattgggagcaacctcagggaaccaggtgctccagctgctgatagacacaggttgattccaaattggttattgtgaacagtgctgcaatgaacataggagtgcagctaagccttcaacgtattgatttcctttattttggaatccaccctgaaacagcaaactgtaactagatggaaggataaaaataaacatggcaaagcatccacccatcttgaaaacttctgctcagaggtggcatccatcactatgcctgacgtcagtggaacggaaaagtgggaccctcatgtcttggaaatgcagcacttattgactaactctcctgctggaaaagaaacaaaaaatgagcaagctgaacaaatattataagaaaatattttgaaccgacactgaaccaggcaagcggtgatgatatgagaggtcatgacccagagacgaaggaaggagcagagatatgcctgcaaactcaaaagctgcttttcccaaggaaggattttgtttacccaaaagccgtgcaaggaagactagaa

SEQ ID NO: 295460 - DNA, 5644 bp, Homo sapiens
aattaaatacctagcttttatctacttacgtagtggattcctttgccatgcatttgacctaaggctgaaagagcaggagagttccatgcagtgtgacacaggaactttagaaattttggtatgacagagttgcctgggctacaaacagaatatagtaagtaaaaaatatcaacagtagctctagaggagtgctgtcccatagaaatatgatatgagccatatatgtaatttaaatttttctagtagcagcttgatttaaaaaaataaaaagaggtgaaattaattgtaacaatatatttaccccagtatgtccaaaatattataatttcaaccagtaatgtttttacatacctatttttttgtttgtattatctttgaaatcctgtgtatattttacagttatagcacatctcaatttacactagccacatttcagatgctcagtagccacatgtggttgctagaggctactatattgaacaacacagtctattatcatcttgatattcttgttgtatagaactctgtattgggaaaaagttcacacaaatttcttgtcctttctatgcttgaaaatcaaagtcaatggatatgtactttcattacactgcacatggtcagttttgtaaataacaatataaatttgcaaatataaaatagctgtagttttaatcttcaataatttttaaaatatagttttttgaagtattatttggaaagtcagtgtttaggataattttccaattcatatacctcataaattacaactccaatttaggttgactttcttcagcaagctaataaagacctggagaagcgtatacgagagcttatggaaaccaaggaaacagtgacatctgaagtcgttaatttaagtaacaaaaatgaaaaactctgccaagaattaactgaaatagatcagttagcacagcagttggaaagacataaagaagaagtgcttgagactgctgataaagagcttggggaagcaaagaaagagattaaaagaaagctctctgaaatgcaggatcttgaagaaacaatggcaaaacttcagctggaattgaacttatgccagaaagaaaaggagagactgagtgatgaactccttgtaaaatcagacctagaaactgttgttcatcagcttgaacaagaaaagcaaagacttagcaaaaaagttgaaagttttgcagttacagaacgacaacttactctggaggttgagaggatgagactagaacatggaataaaacgtcgagacaggtcaccttctcgtttagatacatttctgaaaggtatagaagaagaacgagattattataagaaagagctagagagactccaacatataatacagcgaagatcttgctctacaagttatagcgcacgtgaaaaaagttcaatatttagaacaccagaaaagggtgattacaattcagaaattcatcagatcacaagagaaagagatgaacttcagcgtatgctagaaagatttgaaaaatatatggaagatatacagtccaatgttaaattattgacagcagaaagagataaactaagtgtcttatataatgaagctcaggaagaattatctgccctaagaaaggaatccacccaaaccacagcaccccataatattgttagtcttatggaaaaggaaaaagaacttgcgttatctgacttaagaagaattatggcagaaaaggaagctttaagagaaaaattagagcatattgaagaagtgagtctttttggaaaatcagaattagagaaaactattgaacatttgacatgtgttaatcatcagcttgaaagcgaaaaatatgaattaaagtctaaagtgttaataatgaaagaaacaatagagtcgttagagaacaaattaaaagtccaagctcaaaaatttagccatgtggctggtgactcatctcatcagaaaacagaggtgaactcacttaggatagtgaatgagcagctacagcggtcagttgatgactatcagcaccgactttccataaaaagaggtgaacttgaatcagcccaagcacaaattaaaatactggaggaaaagatagatgaactaaaccttaagatgacttcacaggatgaggaggctcatgtaatgaaaaagaccattggtgttattgataaagaaaaagactttctccaggagactgtagatgagaagacagaaaagattgcaaatttgcaagaaaacctagctaataaagaaaaagctgttgctcaaatgaagataatgatctcagagtgtgaatcatctgtgaaccagctgaaagaaacattggttaatcgagatcgtgagataaacagcctccggcgccagcttgatgcagctcacaaagaactcgatgaagtaggaagatctagagaaatcgcttttaaggaaaacagaagactgcaagatgacctggctacaatggcaagagaaaatcaagaaatctcattggaattggaagcagcagtgcaagaaaaagaagaaatgaagagcagagttcataaatacataacagaggtgtcacgatgggagagcttaatggctgccaaggaaaaagaaaatcaagatttgttagatagatttcagatgcttcataaccgtgctgaagactgggaggtcaaagcccatcaagctgagggagaaagcagctcagttcgactggaacttctttctattgacactgagaggagacatcttcgagaaagagtggagctattagaaaaagaaattcaagagcacataaatgcccatcatgcttatgaatctcagatctcatcaatggcaaaagccatgtctcgattagaagaagagctgagacatcaagaagatgagaaagcaacagtattaaatgacttgtcatctcttagagaactttgcattaaacttgattcaggcaaagatattatgacccagcaattgaattcgaaaaaccttgagtttgagagggttgtggtggaattagaaaatgtaaagtcagagtcagacctactgaaaaaacaactttcaaatgagagacatacagttaaaaacctcgaatcattgttggctacaaacagagataaagaatttcattctcacttaacctcccacgagaaggatacagaaatccagctacttaaggagaagttaaccctttctgaaagcaaattaactagtcaaagccgggaaaacaccatgcttcgagctaaagtggcacagttacaaacagattatgatgctctgaaaaggcagatctcaactgaaagatacgaacgagaacgagcaatccaagagatgcgtcgacatggtcttgctacaccaccccttagttccactctgaggtctccttcacattctcctgaacatagaaatgtgtaattatcagaaagaataatggctttcaatgagttcctatgtggatttttaaaagaacagaacagtaatgaaatatttgaagtacttgttgctgaaaatcatgaacatggacacaaattctacctctgtcaacttttatttaaatcagtgaatatgttaaaaagtttggtttaaaagaactatatctatatgtatattttcatatatatgacagaacaagaatatgtattaatagtgcctaatgtatctatatttttattattcatgaattaaattactaaaagtatgtttatactgtgaattaatataatgtattcacattattctttaataatctgtttattaataagccatgatatgtgtatgtaaatattcttacagtacttgtttttagttgtcatgcctatgtttagaccatatcttaatgtattcacaaagaattatcaactttgatgctatgctgtcatgcttaactttttcttcttaaaattattcatagatctactgtctgttgtcaaggggaatatattcaggtctagtcttcttataatagcagaggtcttggtaaaataactaccatatataacgtgttattgccatctagaagaactatgatgagaaagatacatttatatattatgtaaaatgttaactatcatcatatggactctatgtaacacaaattcaaaagcaaactaaaagctatatgcagagttttgtataaaacaatagaacagaaatttgggacatttttctaggaaataaaattcctcggtgtattaatctaaggtttcaaagtataaaagtatatggggtaggccgggtgcagtggctcacgcctgtaatcccagcactttgggaggccgaggcgagtggatttcctaaggtcaggagtttgagaccagcctgagcaatgtggtgaaaccccatctctactaaaaatacaaaaattatctgggcttggtggcgggcacctgtaatcccagccacttgggaggctgaggcaggagaattgcttgaacccgggaggtggaggctgcggtgagccaagatcatgccattgcactccagcctgggtgacagagtaacactctgtctcagaaaaaaaaaaaagaaaaatatatggggtaaatacagtaaaacgttttgttaaattccaatatacattcagtgataccactctttttcttctaagcctgtgtgttataatttaccagttccccaaaatgccatttttaacgccgaactgtgtaatatacatggaaaacagctttttacaattaattttcaaagttgtaattttaaagaatttgggtgtatacctatgttaatgaaacaacagaagtacaaaaaagaatatcagatacaaaaatcaatcgtgaagaaaatctgttcttaatatatttcattatgattgaaaaacataaaaactaacataggaaagtgaatgatcagttacttatgatatattttgtttcctcttgtggtttaataaagtgaagtgtgtgtgtgtgtgtgtgtgtgtgtgtgtgtgtatacctgggggtgggcagtgctctttttctaaaactaatatggcttatatatctgaattatgccctttttagtgtgtattaggatgtgggctggtttgcttttctaccacctttgtaattttatgtatcccatctcctttgtgtgaattcatatattatagcaaaatacaagagacatgggactgtttgcaataccatatggaaatcttttaataaatatatgtaaataaaataaaaaatatttgtctccaccttttccccaaaagcaacagcaagacatattttgttagatattttatttttaatgttttctataatttaaaaatgtatagcctgccaaatgttgttttcataaccatgatattgttttgaaaaaattttatcttaaaatactgaatgttctgaccttttatagatgtttttgattttgttttaaataattttaaattatggagcttgacctagatttgccaataaactttctagcctatttattttctctttcttacaaataaggtttttataattttatattagggatactcttaattctaaaattaagtaaagtttattcaaatcaaactttatcatggtgggatatggacaaatccctgaacataggtgccaggcacctttcttaactgacttttatttccatttagttcaaaataataagaaatgaagccaaagtttatttttgttatctgtccacaaaatggttaaacgtgtgtgtgacggg

SEQ ID NO: 295461 - DNA, 2100 bp, Homo sapiens
aatcgtccgccgctcccgttaccggggcaaccgcggcgcctcctccgtgtcggccccgatcgtccctccgcgccattttcaaactgctctagcgccggagcccgtgcctggacggaaggagctagtgggggactcgaggcctgagggcaatgcggctggaggcggaggcaacggcggctggagctgccggactttaatttttggaagtgaataaaacttgttttagaagacgagatgactacagctgtagagagaaagtatattaatattaggaaaaggctggatcagctgggataccgccagactctgacagtggagtgtttacctttggtagaaaaacttttcagcgacttagttcatacaactgagagccttcggcaatcaaaattatctgctgtgaaagctgaaaaagaaagtgccaattttgattttgttttggaaccctataaacttgaaaatgcaagattgagtagagaaaataatgaattatacctagagttaatgaaactgagagaacattcagaccaacacgttaaagagttgaaaacttcattgaagaaatgtgcacgtgaaacagctgatctgaaatttctgaataaccaatatgctcataaactcaaactgttggagaaagagagcaaagctaagaatgaaagaattcaacaacttcaagaaaagaatttgcatgctgtagtacaaactccaggtggcaagaaaagaagtattgctttcaggcgccagcgtatgcaaattgatgaaccggttcctccctctgaagtcagttcatatccagttcctcaaccagatgacccttacattgcagacctccttcaagtggctgataacaggattcaagaacttcaacaggaagtccaccagctacaagaaaagttagcaatgatggaaagtggggtgagagactatagcaagcaggtaggatttttatttacttgcatagtagggattgagataggtatgctgtgattgtaaatagaattgggttatatttgaaattgctgatactgagtttttatacagctttcctctttttcatcaggtttgttaatagagttaatagctggaatggcttaggtggctttacttacttagcctgtctcttcaaaaaatttaaaaattagccaagtgtggtggcatgtgcctatggtcccaggtacttgggaggctgaggtgggaggattaatggattgaagagcacttatttactcgattctcttcactattcattgaggtgaatagtagttttttgtttggtttttcttttagctgaatcatctatctccccaaatataattttataaccatattaccgttttcatctcaggagacattttattaagtgtgctatgttttataattgtatttttgtgatttttctactcttattatatattttgtcatattgaacaccagtctcttagaaagttactcttttgtgttgctaatttttttgtttgttttctctataagcacaagtcctcatacaacagttttctgaagaatcaggagaattagtagatgcagagttatattataaccatagcaagctttgtcttttcataatttctattgatgtcttggctaaattttgatttgggtaattataggcttgttttcttaatatgcttcttgaaggttaaattgggtaacatgtttttcattttctgcattgactgcattttttttgagtgatctgcacacacaaatatagatgtaacttaggtgttggtataactaaatctttaaagtgttttgaagattagttggataaaaatggagttaaagaaaattgaccaggcgtggtggctcatgcctgtaatcgcagcactttgggaggccgaggcgggtggatcacttgagatcagaagtttgagaccatcctggccaacatggtgaaacctcatctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaa

SEQ ID NO: 295462 - DNA, 5928 bp, Homo sapiens
aatcgtccgccgctcccgttaccggggcaaccgcggcgcctcctccgtgtcggccccgatcgtccctccgcgccattttcaaactgctctagcgccggagcccgtgcctggacggaaggagctagtgggggactcgaggcctgagggcaatgcggctggaggcggaggcaacggcggctggagctgccggactttaatttttggaagtgaataaaacttgttttagaagacgagatgactacagctgtagagagaaagtatattaatattaggaaaaggctggatcagctgggataccgccagactctgacagtggagtgtttacctttggtagaaaaacttttcagcgacttagttcatacaactgagagccttcggcaatcaaaattatctgctgtgaaagctgaaaaagaaagtgccaattttgattttgttttggaaccctataaacttgaaaatgcaagattgagtagagaaaataatgaattatacctagagttaatgaaactgagagaacattcagaccaacacgttaaagagttgaaaacttcattgaagaaatgtgcacgtgaaacagctgatctgaaatttctgaataaccaatatgctcataaactcaaactgttggagaaagagagcaaagctaagaatgaaagaattcaacaacttcaagaaaagaatttgcatgctgtagtacaaactccaggtggcaagaaaagaagtattgctttcaggcgccagcgtatgcaaattgatgaaccggttcctccctctgaagtcagttcatatccagttcctcaaccagatgacccttacattgcagacctccttcaagtggctgataacaggattcaagaacttcaacaggaagtccaccagctacaagaaaagttagcaatgatggaaagtggggtgagagactatagcaagcagattgagctaagagaacgagagatagaacgactgtcagttgctttggatggtggtcggtcccctgatgtcctttctctggagtctagaaataaaaccaatgaaaagcttattgctcatttaaatattcaggttgactttcttcagcaagctaataaagacctggagaagcgtatacgagagcttatggaaaccaaggaaacagtgacatctgaagtcgttaatttaagtaacaaaaatgaaaaactctgccaagaattaactgaaatagatcagttagcacagcagttggaaagacataaagaagaagtgcttgagactgctgataaagagcttggggaagcaaagaaagagattaaaagaaagctctctgaaatgcaggatcttgaagaaacaatggcaaaacttcagctggaattgaacttatgccagaaagaaaaggagagactgagtgatgaactccttgtaaaatcagacctagaaactgttgttcatcagcttgaacaagaaaagcaaagacttagcaaaaaagttgaaagttttgcagttacagaacgacaacttactctggaggttgagaggatgagactagaacatggaataaaacgtcgagacaggtcaccttctcgtttagatacatttctgaaaggtatagaagaagaacgagattattataagaaagagctagagagactccaacatataatacagcgaagatcttgctctacaagttatagcgcacgtgaaaaaagttcaatatttagaacaccagaaaagggtgattacaattcagaaattcatcagatcacaagagaaagagatgaacttcagcgtatgctagaaagatttgaaaaatatatggaagatatacagtccaatgttaaattattgacagcagaaagagataaactaagtgtcttatataatgaagctcaggaagaattatctgccctaagaaaggaatccacccaaaccacagcaccccataatattgttagtcttatggaaaaggaaaaagaacttgcgttatctgacttaagaagaattatggcagaaaaggaagctttaagagaaaaattagagcatattgaagaagtgagtctttttggaaaatcagaattagagaaaactattgaacatttgacatgtgttaatcatcagcttgaaagcgaaaaatatgaattaaagtctaaagtgttaataatgaaagaaacaatagagtcgttagagaacaaattaaaagtccaagctcaaaaatttagccatgtggctggtgactcatctcatcagaaaacagaggtgaactcacttaggatagtgaatgagcagctacagcggtcagttgatgactatcagcaccgactttccataaaaagaggtgaacttgaatcagcccaagcacaaattaaaatactggaggaaaagatagatgaactaaaccttaagatgacttcacaggatgaggaggctcatgtaatgaaaaagaccattggtgttattgataaagaaaaagactttctccaggagactgtagatgagaagacagaaaagattgcaaatttgcaagaaaacctagctaataaagaaaaagctgttgctcaaatgaagataatgatctcagagtgtgaatcatctgtgaaccagctgaaagaaacattggttaatcgagatcgtgagataaacagcctccggcgccagcttgatgcagctcacaaagaactcgatgaagtaggaagatctagagaaatcgcttttaaggaaaacagaagactgcaagatgacctggctacaatggcaagagaaaatcaagaaatctcattggaattggaagcagcagtgcaagaaaaagaagaaatgaagagcagagttcataaatacataacagaggtgtcacgatgggagagcttaatggctgccaaggaaaaagaaaatcaagatttgttagatagatttcagatgcttcataaccgtgctgaagactgggaggtcaaagcccatcaagctgagggagaaagcagctcagttcgactggaacttctttctattgacactgagaggagacatcttcgagaaagagtggagctattagaaaaagaaattcaagagcacataaatgcccatcatgcttatgaatctcagatctcatcaatggcaaaagccatgtctcgattagaagaagagctgagacatcaagaagatgagaaagcaacagtattaaatgacttgtcatctcttagagaactttgcattaaacttgattcaggcaaagatattatgacccagcaattgaattcgaaaaaccttgagtttgagagggttgtggtggaattagaaaatgtaaagtcagagtcagacctactgaaaaaacaactttcaaatgagagacatacagttaaaaacctcgaatcattgttggctacaaacagagataaagaatttcattctcacttaacctcccacgagaaggatacagaaatccagctacttaaggagaagttaaccctttctgaaagcaaattaactagtcaaagccgggaaaacaccatgcttcgagctaaagtggcacagttacaaacagattatgatgctctgaaaaggcagatctcaactgaaagatacgaacgagaacgagcaatccaagagatgcgtcgacatggtcttgctacaccaccccttagttccactctgaggtctccttcacattctcctgaacatagaaatgtgtaattatcagaaagaataatggctttcaatgagttcctatgtggatttttaaaagaacagaacagtaatgaaatatttgaagtacttgttgctgaaaatcatgaacatggacacaaattctacctctgtcaacttttatttaaatcagtgaatatgttaaaaagtttggtttaaaagaactatatctatatgtatattttcatatatatgacagaacaagaatatgtattaatagtgcctaatgtatctatatttttattattcatgaattaaattactaaaagtatgtttatactgtgaattaatataatgtattcacattattctttaataatctgtttattaataagccatgatatgtgtatgtaaatattcttacagtacttgtttttagttgtcatgcctatgtttagaccatatcttaatgtattcacaaagaattatcaactttgatgctatgctgtcatgcttaactttttcttcttaaaattattcatagatctactgtctgttgtcaaggggaatatattcaggtctagtcttcttataatagcagaggtcttggtaaaataactaccatatataacgtgttattgccatctagaagaactatgatgagaaagatacatttatatattatgtaaaatgttaactatcatcatatggactctatgtaacacaaattcaaaagcaaactaaaagctatatgcagagttttgtataaaacaatagaacagaaatttgggacatttttctaggaaataaaattcctcggtgtattaatctaaggtttcaaagtataaaagtatatggggtaggccgggtgcagtggctcacgcctgtaatcccagcactttgggaggccgaggcgagtggatttcctaaggtcaggagtttgagaccagcctgagcaatgtggtgaaaccccatctctactaaaaatacaaaaattatctgggcttggtggcgggcacctgtaatcccagccacttgggaggctgaggcaggagaattgcttgaacccgggaggtggaggctgcggtgagccaagatcatgccattgcactccagcctgggtgacagagtaacactctgtctcagaaaaaaaaaaaagaaaaatatatggggtaaatacagtaaaacgttttgttaaattccaatatacattcagtgataccactctttttcttctaagcctgtgtgttataatttaccagttccccaaaatgccatttttaacgccgaactgtgtaatatacatggaaaacagctttttacaattaattttcaaagttgtaattttaaagaatttgggtgtatacctatgttaatgaaacaacagaagtacaaaaaagaatatcagatacaaaaatcaatcgtgaagaaaatctgttcttaatatatttcattatgattgaaaaacataaaaactaacataggaaagtgaatgatcagttacttatgatatattttgtttcctcttgtggtttaataaagtgaagtgtgtgtgtgtgtgtgtgtgtgtgtgtgtgtgtatacctgggggtgggcagtgctctttttctaaaactaatatggcttatatatctgaattatgccctttttagtgtgtattaggatgtgggctggtttgcttttctaccacctttgtaattttatgtatcccatctcctttgtgtgaattcatatattatagcaaaatacaagagacatgggactgtttgcaataccatatggaaatcttttaataaatatatgtaaataaaataaaaaatatttgtctccaccttttccccaaaagcaacagcaagacatattttgttagatattttatttttaatgttttctataatttaaaaatgtatagcctgccaaatgttgttttcataaccatgatattgttttgaaaaaattttatcttaaaatactgaatgttctgaccttttatagatgtttttgattttgttttaaataattttaaattatggagcttgacctagatttgccaataaactttctagcctatttattttctctttcttacaaataaggtttttataattttatattagggatactcttaattctaaaattaagtaaagtttattcaaatcaaactttatcatggtgggatatggacaaatccctgaacataggtgccaggcacctttcttaactgacttttatttccatttagttcaaaataataagaaatgaagccaaagtttatttttgttatctgtccacaaaatggttaaacgtgtgtgtgacggg

SEQ ID NO: 295463 - DNA, 4687 bp, Homo sapiens
aatcgtccgccgctcccgttaccggggcaaccgcggcgcctcctccgtgtcggccccgatcgtccctccgcgccattttcaaactgctctagcgccggagcccgtgcctggacggaaggagctagtgggggactcgaggcctgagggcaatgcggctggaggcggaggcaacggcggctggagctgccggactttaatttttggaagtgaataaaacttgttttagaagacgagatgactacagctgtagagagaaagtatattaatattaggaaaaggctggatcagctgggataccgccagactctgacagtggagtgtttacctttggtagaaaaacttttcagcgacttagttcatacaactgagagccttcggcaatcaaaattatctgctgtgaaagctgaaaaagaaagtgccaattttgattttgttttggaaccctataaacttgaaaatgcaagattgagtagagaaaataatgaattatacctagagttaatgaaactgagagaacattcagaccaacacgttaaagagttgaaaacttcattgaagaaatgtgcacgtgaaacagctgatctgaaatttctgaataaccaatatgctcataaactcaaactgttggagaaagagagcaaagctaagaatgaaagaattcaacaacttcaagaaaagaatttgcatgctgtagtacaaactccaggtggcaagaaaagaagtattgctttcaggcgccagcgtatgcaaattgatgaaccggttcctccctctgaagtcagttcatatccagttcctcaaccagatgacccttacattgcagacctccttcaagtggctgataacaggattcaagaacttcaacaggaagtccaccagctacaagaaaagttagcaatgatggaaagtggggtgagagactatagcaagcagattgagctaagagaacgagagatagaacgactgtcagttgctttggatggtggtcggtcccctgatgtcctttctctggagtctagaaataaaaccaatgaaaagcttattgctcatttaaatattcaggttgactttcttcagcaagctaataaagacctggagaagcgtatacgagagcttatggaaaccaaggaaacagtgacatctgaagtcgttaatttaagtaacaaaaatgaaaaactctgccaagaattaactgaaatagatcagttagcacagcagttggaaagacataaagaagaagtgcttgagactgctgataaagagcttggggaagcaaagaaagagattaaaagaaagctctctgaaatgcaggatcttgaagaaacaatggcaaaacttcagctggaattgaacttatgccagaaagaaaaggagagactgagtgatgaactccttgtaaaatcagacctagaaactgttgttcatcagcttgaacaagaaaagcaaagacttagcaaaaaagttgaaagttttgcagttacagaacgacaacttactctggaggttgagaggatgagactagaacatggaataaaacgtcgagacaggtcaccttctcgtttagatacatttctgaaaggtatagaagaagaacgagattattataagaaagagctagagagactccaacatataatacagcgaagatcttgctctacaagttatagcgcacgtgaaaaaagttcaatatttagaacaccagaaaagggtgattacaattcagaaattcatcagatcacaagagaaagagatgaacttcagcgtatgctagaaagatttgaaaaatatatggaagatatacagtccaatgttaaattattgacagcagaaagagataaactaagtgtcttatataatgaagctcaggaagaattatctgccctaagaaaggaatccacccaaaccacagcaccccataatattgttagtcttatggaaaaggaaaaagaacttgcgttatctgacttaagaagaattatggcagaaaaggaagctttaagagaaaaattagagcatattgaagaagtgagtctttttggaaaatcagaattagagaaaactattgaacatttgacatgtgttaatcatcagcttgaaagcgaaaaatatgaattaaagtctaaagtgttaataatgaaagaaacaatagagtcgttagagaacaaattaaaagtccaagctcaaaaatttagccatgtggctggtgactcatctcatcagaaaacagaggtgaactcacttaggatagtgaatgagcagctacagcggtcagttgatgactatcagcaccgactttccataaaaagaggtgaacttgaatcagcccaagcacaaattaaaatactggaggaaaagatagatgaactaaaccttaagatgacttcacaggatgaggaggctcatgtaatgaaaaagaccattggtgttattgataaagaaaaagactttctccaggagactgtagatgagaagacagaaaagattgcaaatttgcaagaaaacctagctaataaagaaaaagctgttgctcaaatgaagataatgatctcagagtgtgaatcatctgtgaaccagctgaaagaaacattggttaatcgagatcgtgagataaacagcctccggcgccagcttgatgcagctcacaaagaactcgatgaagtaggaagatctagagaaatcgcttttaaggaaaacagaagactgcaagatgacctggctacaatggcaagagaaaatcaagaaatctcattggaattggaagcagcagtgcaagaaaaagaagaaatgaagagcagagttcataaatacataacagaggtgtcacgatgggagagcttaatggctgccaaggaaaaagaaaatcaagatttgttagatagatttcagatgcttcataaccgtgctgaagactgggaggtcaaagcccatcaagctgagggagaaagcagctcagttcgactggaacttctttctattgacactgagaggagacatcttcgagaaagagtggagctattagaaaaagaaattcaagagcacataaatgcccatcatgcttatgaatctcagatctcatcaatggcaaaagccatgtctcgattagaagaagagctgagacatcaagaagatgagaaagcaacagtattaaatgacttgtcatctcttagagaactttgcattaaacttgattcaggcaaagatattatgacccagcaattgaattcgaaaaaccttgagtttgagagggttgtggtggaattagaaaatgtaaagtcagagtcagacctactgaaaaaacaactttcaaatgagagacatacagttaaaaacctcgaatcattgttggctacaaacagagataaagaatttcattctcacttaacctcccacgagaaggatacagaaatccagctacttaaggagaattgcttgaacccgggaggtggaggctgcggtgagccaagatcatgccattgcactccagcctgggtgacagagtaacactctgtctcagaaaaaaaaaaaagaaaaatatatggggtaaatacagtaaaacgttttgttaaattccaatatacattcagtgataccactctttttcttctaagcctgtgtgttataatttaccagttccccaaaatgccatttttaacgccgaactgtgtaatatacatggaaaacagctttttacaattaattttcaaagttgtaattttaaagaatttgggtgtatacctatgttaatgaaacaacagaagtacaaaaaagaatatcagatacaaaaatcaatcgtgaagaaaatctgttcttaatatatttcattatgattgaaaaacataaaaactaacataggaaagtgaatgatcagttacttatgatatattttgtttcctcttgtggtttaataaagtgaagtgtgtgtgtgtgtgtgtgtgtgtgtgtgtgtgtatacctgggggtgggcagtgctctttttctaaaactaatatggcttatatatctgaattatgccctttttagtgtgtattaggatgtgggctggtttgcttttctaccacctttgtaattttatgtatcccatctcctttgtgtgaattcatatattatagcaaaatacaagagacatgggactgtttgcaataccatatggaaatcttttaataaatatatgtaaataaaataaaaaatatttgtctccaccttttccccaaaagcaacagcaagacatattttgttagatattttatttttaatgttttctataatttaaaaatgtatagcctgccaaatgttgttttcataaccatgatattgttttgaaaaaattttatcttaaaatactgaatgttctgaccttttatagatgtttttgattttgttttaaataattttaaattatggagcttgacctagatttgccaataaactttctagcctatttattttctctttcttacaaataaggtttttataattttatattagggatactcttaattctaaaattaagtaaagtttattcaaatcaaactttatcatggtgggatatggacaaatccctgaacataggtgccaggcacctttcttaactgacttttatttccatttagttcaaaataataagaaatgaagccaaagtttatttttgttatctgtccacaaaatggttaaacgtgtgtgtgacggg

SEQ ID NO: 295464 - DNA, 424 bp, Homo sapiens
tttcttatttcacttactaagtctgtgaattgtggagtaaacctcagttttctaaacctaagaattggcagcagtacctcaaagaattttcctggggatcaaaatgcaatagtgaggtgtttcttgcacagtgtatctgagtttcaaattatttactactcagttttaaatcttgttacaaaccaactctccatgatgttgtactatattttatattgatttggggaccctttggcacagtacgtcctacctgtttgagaagctgaaagtatagaatttatgaaataacacatctagcttcgtttcttattttgtatttcttaacaaaagtgtattggcattaatttaaagtgcttttcaggattcaagaacttcaacaggaagtccaccagctacaagaaaagttagcaatgatggaaagtgg

SEQ ID NO: 295465 - DNA, 360 bp, Homo sapiens
atacagttaaaaacctcgaatcattgttggctacaaacagagataaagaatttcattctcacttaacctcccacgagaaggatacagaaatccagctacttaaggagaagttaaccctttctgaaagcaaattgtaagtgtcttaagtcaacttatgcaaagacaattgcttgtgaaggatagttttttaatttttttgaagtggaggaaaggttaagagtatgaaagataggccaggtgcagtggctcacacctgtaatcccagcactttgggaggccaaggcgggtagattgcctgagctcaggagtttgagactagcctgggcaagatggcgaaaccccgtctatactaaaaataca

SEQ ID NO: 295466 - DNA, 194 bp, Homo sapiens
aatttagaaacaattttattgtgattaaaccaggaaaaagaaaatcaagatttgttagatagatttcagatgcttcataaccgtgctgaagactgggaggtcaaagcccatcaagctgagggagaaagcagctcagttcgactggaacttctttctattgacactgagaggagacatcttcgagaaagagtgga

SEQ ID NO: 295467 - DNA, 560 bp, Homo sapiens
gcccagggtcccaaggcttttgtgagtatcattgtaggtattgaagcaacgatgttgagaaggatgctgaacatgctctttagtgggatgacgtactctgaaggctcctgacccccagatgagcatccttgtgtccgttaacttctgtgtttatgaacaggtgaggccagagacaggcagacagcagatgtattgcagggagctggatgacatggcccttggaacctgtgcacatgcctgcctttctgatgcacgtccatgttttctctgcacctccccggtggtgttggtataaaaagcaggcttacatcagcaagggatgattgtcgtctcatgcgatcctgggagatggcagaagtcccgggacacatggagtgtgggctctttcggaggctgttggatccctcctgaatgtgttgtggccatggaagtaaggccagtggctacgagggacagtcttcatcttgggagatccctagagagggcagggagccccttgacatgtggaatgtgatctctgttggtgccgatgatagcgagggatcctctagacagcccac

SEQ ID NO: 295468 - DNA, 1622 bp, Homo sapiens
tgaggcccctggacacatgtggtgtgggctcctttggaggctgttgtatcccttctgaatgtggcgtgggcatagaaggaaggccagtggccacgagggacaatcttggtcttgggagatcctggaaatgatagggagtcccttgatatgtgtggcatgggctccttcaggtgctagtggattccttaggatggtggtgttggcatgaaaggcaggcttgtatcatgaggaatgattgtcatcttgtctgattcttggagatggcaggaagcccctggaaacacatggtgtggactccttcacaggctgttgaaaccctcctgaatgtaagtgatttcattccaaagcaccctgagtttcctcatttgcagggatgaaacctgtgtgtggatcgatgatgacttccatatatacattccttggaaagctgaacaaaatgagtgaaaactctatactgtcatcctcgtcgaactgaggtccagcacattactccaacaggggctagacagagaaggccaacatccgtttgttgacatgggttatatcaaggcgtctgttcaggcttagaatgtggtctcttatgggtgatgggggtcacaggagagtggtggctcccatgtataggaaatttcttgtttgaaggactgtcagtgagggtgggtaacacatgcattgtctgcaggactaggtgaatgtccatgtggcctagcaagagttagctggtagcccgcctctggttgccaatttgttcttgagtccttgttctgggttctcaggtcccacggaggaaaacagatctgtgtggttgagaggtgggtacaaggccgcatctttgtcatttgttggctaactttgtccttggttgaggacattagagttttggtcaccaggcatagcctatgtgcctttgtgcccgtgttgtatcccacgtgttttgaggacatgtattttgcacgtaaaggtgagctcctgctccaagctggttctgataccaaaggagtccctggcttatcctaaactcatggtaggttaaagccttcctccttaggggttcagggccgcaaggcttttgtgagtggcattgcaggcgttgaagcagtgatgttgagagggatggtcaatgtcagtgctctttagcaggatggtgtactgcaggggcccccagccccgagacgagcatccctgcatccatgcatttctgcctccatgaacaggggaggccagagacaggcagatagtagataaattgcaggggactggatgacatggccctcgtgacctgtgcacctgtctgtctttctgaagcacgcctgtgttaactctgcacctcccaggtagcactggcatggagggcaggcacatgttggtgagggacaattgttaccttgtgtgagctgcggagataccaggaagcccctggacacaaatggcaaaggctccttcggaagttgttggatcccttctgaatgtaagcacttctttcccagagcactctgagtttcctcatttgcagggacaaatactgtgcgtggatcgatgatgacttccacatatacattccttggaaagctgaacaaaatgagtgaaaactctataccgtcatcctcgtcgaactgaggtcc

SEQ ID NO: 295469 - DNA, 951 bp, Homo sapiens
tgaggcccctggacacatgtggtgtgggctcctttggaggctgttgtatcccttctgaatgtggcgtgggcatagaaggaaggccagtggccacgagggacaatcttggtcttgggagatcctggaaatgatagggagtcccttgatatgtgtggcatgggctccttcaggtgctagtggattccttaggatggtggtgttggcatgaaaggcaggcttgtatcatgaggaatgattgtcatcttgtctgattcttggagatggcaggaagcccctggaaacacatggtgtggactccttcacaggctgttgaaaccctcctgaatgtaagtgatttcattccaaagcaccctgagtttcctcatttgcagggatgaaacctgtgtgtggatcgatgatgacttccatatatacattccttggaaagctgaacaaaatgagtgaaaactctatactgtcatcctcgtcgaactgaggtccagcacattgctccaacagtgggtagatagagagggaaaacttccatttgttgacgcaggttccattgaggggtttgtccaggcttaggatggggtcccctttgggcaaagggagtcacaggggagtgcggcctcctgtgcacaggagattccttgtgtgaaggatttacctctgtgagagcagggtagcacacataactatgcaggagcaggtgaatgtgcaggtggcacaggaagagttagatggcagcctgtctctgcacagcgaggtttgacttgtcctagctctgcattccctcatcccttagaggaagttggtttcttcagaagacttaaatttgtggaattcagtagaatattatccacataatgttcccagtgaatgctaggcatatcacccaagatggccaggcctctggccataaaccatagtaaataatttttaacctttacgccaatgaagatctgaggc

SEQ ID NO: 295470 - DNA, 1163 bp, Homo sapiens
tgaggcccctggacacatgtggtgtgggctcctttggaggctgttgtatcccttctgaatgtggcgtgggcatagaaggaaggccagtggccacgagggacaatcttggtcttgggagatcctggaaatgatagggagtcccttgatatgtgtggcatgggctccttcaggtgctagtggattccttaggatggtggtgttggcatgaaaggcaggcttgtatcatgaggaatgattgtcatcttgtctgattcttggagatggcaggaagcccctggaaacacatggtgtggactccttcacaggctgttgaaaccctcctgaatgtgaggccagagacaggcagacagcagatgtattgcagggagctggatgacatggcccttggaacctgtgcacatgcctgcctttctgatgcacgtccatgttttctctgcacctccccggtggtgttggtataaaaagcaggcttacatcagcaagggatgattgtcgtctcatgcgatcctgggagatggcagaagtcccgggacacatggagtgtgggctctttcggaggctgttggatccctcctgaatgtgttgtggccatggaagtaaggccagtggctacgagggacagtcttcatcttgggagatccctagagagggcagggagccccttgacatgtggaatgtgatctctgttgggtgctggtggatcccacaggtggtctggcatggaagaaggccagaggctgcgatggatcatctttgtcttgggagattcctggagatggtggggagcccctgggcacgtgcagcatatgtggcgtgggcttcttcaggtgctggtggatccctcaggatgctttccaaggtttcctatgagtcctggtcacagagtctggacatgggcgttggaagaatgcttcgattccaggatgtgggttccagagggcgggtctttggggccggccagatttctacgaagttttctttaacccaaagggcgagggggttctggcaagtttgtctcactcacatgttgtgggcggggaacccgggttttgcacccggggtttgtgtttccatcccgggggagaccccctttgggctccacggtgtgtgtcatctccgcgagaaagattatgccccccggcacaggtgcgactacggcggct

SEQ ID NO: 295471 - DNA, 616 bp, Homo sapiens
actgcatccaacgccgcatgactgcatccaacgccgcatgactgcatccaaagccgcatgactgcatccaacgccgcgtctcatgcgatcctgggagatggcagaagtcccgggacacatggagtgtgggctctttcggaggctgttggatccctcctgaatgtggtctggcatggaagaaggccagaggctgcgatggatcatctttgtcttgggagattcctggagatggtggggagcccctgggcacgtgcagcatatgtggcgtgggcttcttcaggtgctggtggatccctcaggatgctttccaaggtttcctatgagtcctggtcacagagtctggacatgggcgttggaagaatgcttcgattccaggatgtgggttccagagggcgggtctttggggccggccagatttctacgaagttttctttaacccaaagggcgagggggttctggcaagtttgtctcactcacatgttgtgggcggggaacccgggttttgcacccggggtttgtgtttccatcccgggggagaccccctttgggctccacggtgtgtgtcatctccgcgagaaagattatgccccccggcacaggtgcgactacggcggct

SEQ ID NO: 295472 - DNA, 1279 bp, Homo sapiens
ggacgcggaacccggcgcggcggcggcacgatggtcatggcgtatttcgtcgagaatttttggggggaaaaaaatagtggctttgatgtcctctaccataatatgaaacatggacagatatcaacaaaagaactagcagattttgtaagggaacgagctaccatagaggaggcatactccaggtcaatgacaaaactagcaaaatctgcaagcaattattcacaacttggaacatttgcaccagtatgggatgtattcaaaacatctacagagaaattagcaaattgtcacttggatcttgttagaaaattacaagaattaataaaggaagttcagaagtatggagaagaacaagtaaagtctcataaaaagactaaagaagaagttgcaggaactctggaagctgtccaaaccattcagagcataactcaggccctccagaaatccaaggaaaattacaatgccaagtgtgtagaacaggagcgtttgaaaaaggaaggagctacacaaagagaaatagaaaaggcagctgttaaatctaagaaagctacagatacctataaactctatgtggaaaaatatgcattagcaaaagctgatttcgaacagaaaatgacagaaacagctcagaaatttcaagatattgaagaaactcatctcattcacataaaggaaattataggatccttgtcaaatgctataaaggaaattcatttgcagataggccaggtccatgaagaatttataaataacatggctaatactacagttgaaagtttgatacaaaaatttgctgagtcaaaaggcactgggaaggaaagacctggcctcattgaatttgaagaatgtgacactgctagtgcagttgaaggtataaaaccaaggaaaagaaagacctttgctttgccaggaatcattaaaaaggaaaaagatgcagaatctgtatggagtttcactgttgttgcccaggttggaatgcaatggcgcgatcttggcttactgcattctccacctcccaggttcaagcgattctcctcctacctcagcctcccaagtagctggaattacggcgcccaccaccacatctggctaattttttgtatttttagtagagacagggtttcaccatattggccaggctggtcgcgaactcctgacctcaggtgaaccacccgcctcagcttcccaaagtgctgggattacaggcctgagccacgcgcccggcctgatttaccttcttttaaaaataaaaaattaatatacaaagaatatgtaataa

SEQ ID NO: 295473 - DNA, 590 bp, Homo sapiens
ggacgcggaacccggcgcggcggcggcacgatggtcatggcgtatttcgtcgagaatttttggggggaaaaaaatagtggctttgatgtcctctaccataatatgaaacatggacagatatcaacaaaagaactagcagattttgtaagggaacgagctaccatagaggaggcatactccaggtcaatgacaaaactagcaaaatctgcaagcaattattcacaacttggaacatttgcaccagtatgggatgtattcaaaacatctacagagaaattagcaaattgtcacttggatcttgttagaaaattacaagaattaataaaggaagttcagaagtatggagaagaacaagtaaagtctcataaaaagactaaagaagaagttgcaggaactctggaagctgtccaaaccattcagagcataactcaggccctccagaaatccaaggaaaattacaatgccaagtgtgtagaacaggagcgtttgaaaaaggaaggagctacacaaagagaaatagaaaaggcagctgttaaatctaagaaagctacagatacctataaactctatgtggaaaaatatgcattagc

SEQ ID NO: 295474 - DNA, 1126 bp, Homo sapiens
ggacgcggaacccggcgcggcggcggcacgatggtcatggcgtatttcgtcgagaatttttggggggaaaaaaatagtggctttgatgtcctctaccataatatgaaacatggacagatatcaacaaaagaactagcagattttgtaagggaacgagctaccatagaggaggcatactccaggtcaatgacaaaactagcaaaatctgcaagcaattattcacaacttggaacatttgcaccagtatgggatgtattcaaaacatctacagagaaattagcaaattgtcacttggatcttgttagaaaattacaagaattaataaaggaagttcagaagtatggagaagaacaagtaaagtctcataaaaagactaaagaagaagttgcaggaactctggaagctgtccaaaccattcagagcataactcaggccctccagaaatccaaggaaaattacaatgccaagtgtgtagaacaggagcgtttgaaaaaggaaggagctacacaaagagaaatagaaaaggcagctgttaaatctaagaaagctacagatacctataaactctatgtggaaaaatatgcattagcaaaagctgatttcgaacagaaaatgacagaaacagctcagaaatttcaagatattgaagaaactcatctcattcacataaaggaaattataggatccttgtcaaatgctataaaggaaattcatttgcagataggccaggtccatgaagaatttataaataacatggctaatactacagttgaaagtttgatacaaaaatttgctgagtcaaaaggcactgggaaggaaagacctggcctcattgaatttgaagaatgtgacactgctagtgcagttgaaggtataaaaccaaggaaaagaaagacctttgctttgccaggaatcattaaaaaggaaaaagatgcagaatctgtggaatgtcctgatgcagattcattgatgcatttttggatttacattgccagatgctttcctattaaatagaaagtatttctaaccacctttgaagagtggacattttacttttaaaattggagtggtgccatatcattctgtttttttcttgggaaacatgccagaaatcaaatctgtatac

SEQ ID NO: 295475 - DNA, 1509 bp, Homo sapiens
ggacgcggaacccggcgcggcggcggcacgatggtcatggcgtatttcgtcgagaatttttggggggaaaaaaatagtggctttgatgtcctctaccataatatgaaacatggacagatatcaacaaaagaactagcagattttgtaagggaacgagctaccatagaggaggcatactccaggtcaatgacaaaactagcaaaatctgcaagcaattattcacaacttggaacatttgcaccagtatgggatgtattcaaaacatctacagagaaattagcaaattgtcacttggatcttgttagaaaattacaagaattaataaaggaagttcagaagtatggagaagaacaagtaaagtctcataaaaagactaaagaagaagttgcaggaactctggaagctgtccaaaccattcagagcataactcaggccctccagaaatccaaggaaaattacaatgccaagtgtgtagaacaggagcgtttgaaaaaggaaggagctacacaaagagaaatagaaaaggcagctgttaaatctaagaaagctacagatacctataaactctatgtggaaaaatatgcattagcaaaagctgatttcgaacagaaaatgacagaaacagctcagaaatttcaagatattgaagaaactcatctcattcacataaaggaaattataggatccttgtcaaatgctataaaggaaattcatttgcagataggccaggtccatgaagaatttataaataacatggctaatactacagttgaaagtttgatacaaaaatttgctgagtcaaaaggcactgggaaggaaagacctggcctcattgaatttgaagaatgtgacactgctagtgcagttgaaggtataaaaccaaggaaaagaaagacctttgctttgccaggaatcattaaaaaggaaaaagatgcagaatctgtatggagtttcactgttgttgcccaggttggaatgcaatggcgcgatcttggcttactgcattctccacctcccaggttcaagcgattctcctcctacctcagcctcccaagtagctggaattacggcgcccaccaccacatctggctaattttttgtatttttagtagagacagggtttcaccatattggccaggctggtcgcgaactcctgacctcaggtgaaccacccgcctcagcttcccaaagtgctgggattacaggcctgagccacgcgcccggcctgatttaccttcttttaaaaataaaaaattaatatacaaagaatatgtaataaacatgtaagaaattgagtttagattagctaactaaagtttttgtttgtttgtttgttttttactttggctacacattagaactacctgggaaattaaaataaatacacctatgccaggtcccacctcagatcaattaaatcagattctctaagcatgaaacctcaacataggttttgctcttttttgttttaagcagcccctttgattcctaatgtatacctggggttaa

SEQ ID NO: 295476 - DNA, 872 bp, Homo sapiens
ttatttgatttttaaaatttattgctgatattttaattattaggtaacaactagaaccatttcagaacaattaaaaagatgcgttgtcaattaaaagtagaataaaaaatttaaaatgtaaaaaaaaagttttaaaatttacctaatagtttttttctactagaagtttttcaatttctttttttccaggcctcattgaatttgaagaatgtgacactgctagtgcagttgaaggtataaaaccaaggaaaagaaagacctttgctttgccaggaatcattaaaaaggaaaaagatgcagaatctgtatggagtttcactgttgttgcccaggttggaatgcaatggcgcgatcttggcttactgcattctccacctcccaggttcaagcgattctcctcctacctcagcctcccaagtagctggaattacggcgcccaccaccacatctggctaattttttgtatttttagtagagacagggtttcaccatattggccaggctggtcgcgaactcctgacctcaggtgaaccacccgcctcagcttcccaaagtgctgggattacaggcctgagccacgcgcccggcctgatttaccttcttttaaaaataaaaaattaatatacaaagaatatgtaataaacatgtaagaaattgagtttagattagctaactaaagtttttgtttgtttgtttgttttttactttggctacacattagaactacctgggaaattaaaataaatacacctatgccaggtcccacctcagatcaattaaatcagattctctaagcatgaaacctcaacataggttttgctcttttttgttttaagcagcccctttgattcctaatgtatacctggggttaa

SEQ ID NO: 295477 - DNA, 289 bp, Homo sapiens
tgcaccagtatgggatgtattcaaaacatctacagagaaattagcaaattgtcacttggatcttgttagaaaattacaagaattaataaaggaagttcagaagtatggagaagaacaagtaaagtctcataaaaaggtatcagtttttttcttgttaaataattgattggtcagatattgaatactttatagttcagtcattttgatggatcatttcatactaaacagactaaagaagaagttgcaggaactctggaagctgtccaaaccattcagagcataactcagg

SEQ ID NO: 295478 - DNA, 1325 bp, Homo sapiens
cgcggctctggagagcgctcctccgccccgcgcgccgtccctgcgccccgctccgcccgcgcctctctcccagcgccgcgcctcgggcgtaaagagcgcgcccctcgcaccgcagccagtgccgaccgcagcagcccagccccagccttcctccgcctccgcctctctctcctcctcctcctccgccgccggacacgcagccgcaggccgggaccgggacgcagctggggagtcagggacgcgcgcagccagcccttccccctccggctcccgcaccgccggccgcctcccctcgccctcctactctcccctccctgctccttcgctttttcctcctcctcctctcccggccccggctgccagcaccatgtccgcagggggagattttgggaatccactgagaaaattcaagttggtgttcttgggggagcagagcgtcgggaagacgtctctgattacgaggttcatgtacgacagcttcgacaacacataccaggcaaccattgggattgacttcttgtcaaaaaccatgtacttggaggaccgcacggtgcgactgcagctctgggacacagctggtcaggagaggttccgcagcctgatccccagctacatccgggactccacggtggctgtggtggtgtacgacatcacaaatctcaactccttccaacagacctctaagtggatcgacgacgtcaggacagagaggggcagtgatgttatcatcatgctggtgggcaacaagacggacctggctgataagaggcagataaccatcgaggagggggagcagcgcgccaaagaactgagcgtcatgttcattgagaccagtgcgaagactggctacaacgtgaagcagctttttcgacgtgtggcgtcggctctacccggaatggagaatgtccaggagaaaagcaaagaagggatgatcgacatcaagctggacaaaccccaggagcccccggccagcgagggcggctgctcctgctaatgcagagccgacctgtggcttcccatgacactccttgcttgttgtgttgcttcctattggctagcttcctaaggggggagggaaccgagttatcaagatgggaggatttttcttttctctctgtctttaggagtagggtgggatggggagggaggctgggcatcagggatcacatcactcttaacggctgttacttaaacaactattttttggtttggttgtaatatattgtactttattaagattgccaaaaactgttaaaatttaaaaaaaatttaaatcatgtgtatacaattttttgccagataaaaatgtagtcatttttatttga

SEQ ID NO: 295479 - DNA, 2778 bp, Homo sapiens
cgcggctctggagagcgctcctccgccccgcgcgccgtccctgcgccccgctccgcccgcgcctctctcccagcgccgcgcctcgggcgtaaagagcgcgcccctcgcaccgcagccagtgccgaccgcagcagcccagccccagccttcctccgcctccgcctctctctcctcctcctcctccgccgccggacacgcagccgcaggccgggaccgggacgcagctggggagtcagggacgcgcgcagccagcccttccccctccggctcccgcaccgccggccgcctcccctcgccctcctactctcccctccctgctccttcgctttttcctcctcctcctctcccggccccggctgccagcaccatgtccgcagggggagattttgggaatccactgagaaaattcaagttggtgttcttgggggagcagagcgtcgggaagacgtctctgattacgaggttcatgtacgacagcttcgacaacacataccaggcaaccattgggattgacttcttgtcaaaaaccatgtacttggaggaccgcacggtgcgactgcagctctgggacacagctggtcaggagaggttccgcagcctgatccccagctacatccgggactccacggtggctgtggtggtgtacgacatcacaaatctcaactccttccaacagacctctaagtggatcgacgacgtcaggacagagaggggcagtgatgttatcatcatgctggtgggcaacaagacggacctggctgataagaggcagataaccatcgaggagggggagcagcgcgccaaagaactgagcgtcatgttcattgagaccagtgcgaagactggctacaacgtgaagcagctttttcgacgtgtggcgtcggctctacccggaatggagaatgtccaggagaaaagcaaagaagggatgatcgacatcaagctggacaaaccccaggagcccccggccagcgagggcggctgctcctgctaatgcagagccgacctgtggcttcccatgacactccttgcttgttgtgttgcttcctattggctagcttcctaaggggggagggaaccgagttatcaagatgggaggatttttcttttctctctgtctttaggagtagggtgggatggggagggaggctgggcatcagggatcacatcactcttaacggctgttacttaaacaactattttttggtttggttgtaatatattgtactttattaagattgccaaaaactgttaaaatttaaaaaaaatttaaatcatgtgtatacaattttttgccagataaaaatgtagtcatttttatttgaaagatgtgctttttgtttttgtatatttgtaaacttatagagaaccttttccacacacctcctccttcctgttctctttgaaccattcatcacctctgccttcctcctatccccagcccaataaattaaaacaattaactgagcaaattaattaggcttcagtctggggccatctggccccactctctaggccctactccagttaaatcaaacattggttgaacacatcagcctctgaaaaggtagctctgactcttgtctttccatggccagagtgggtcgtcaacctcgtgtggagctgagaccaaggtctgtgggctctaggcagcccggcagcagcccccagaggaactgctcccacctctccttctctttccctgaaaagccttgaagggggttgagggtacaggcaaccttgtgttctctgtgccctcagggactggcagagcaagaggccatcagaaggacgaggtgctgttggcaattgcagctgcgtggtgcgtggtttatagactggggtgccatgtgtacttctgaaaatattttaaccagcccacccagcagtcagtacacatgcctgggccaagtctaagaaactcagtgtgtgatgttgggcagtgtgccatcctgaagccttcctcctggatgtcagggaagctggaccacctggagttgatcctctgtgatggggaggcggggggggggggggtgttgtctgcagaaccaccaccttgaaagatccatgttcttagagcctcagctgctaatattgttgagtgctttctggaaaagctgatttgttgctatgttttcaccccagtggcatggcgcagttgaagtctttgtggacatatctttgtggctactgtggctgcgctgtggtcacctgaggatgtggttcaggtggggtctccagaaggctgcttgcccccagagagccatctcttccatttttgattcattcctgagaatggcttagtcctgagaatctgcaaagtctctgaagagaactctctcttcccactaagtgatataacctacttggccagcattccaaatagactcagactcactgccctgagcctgcacagagccaggtgcaatgggcagtgagtctggccaaaatgtaaaccccaccctccctgctgtcattggctctccctccaggctgctgctgggcatgtcatagatgggatgaatgaccatctggggtatggtgggctgaactccacaaggtcgttggaatgaattttgaaacttctcagaaattaatctgaaatggcaggcagtaagtgcagcagaatctggcaggactgatatttgtgcagtgggcctgccacacaccctctgcctaggaggctgtatgccagagctcatctctagcaaggaatttatcttcaggtgaagaagagaggaagcaggatcccactgagcacctcttgcagaaggcaag

SEQ ID NO: 295480 - DNA, 203 bp, Homo sapiens
ttcgcactggctgtcccctcactgccgtccagtcttccctcaaatgtcatctcctcactggcccccagcactcatcttccaactccttacaggactctgccttctaggctcatcttcaaatctcctatactactcactcgtctgtctcttttacaagaacaaatctccttgagagaagaacagtgcctggaacatggcaggca

SEQ ID NO: 295481 - DNA, 384 bp, Homo sapiens
gcggccgccctggacgtgggcatgaggtgcacggtctgggtatgccccgggcagggagttggtgcatcccaggcctcgggagggggcctgtccggcggtgaccatgacccatgtgttggggaccacagcggtggccgaagtgagcgggcatctggggaaaagtttgatcaagttctgctctggagacttggggcccgagggcatcttgccggacacccacctcctggacccgctgctgaaggaggcctctactgcccccttggcacagatccccagcaagggcatggacggtgagtcaagggtgggacccctgctctatcaactggtttcctacccgcccaggccccgcccccaacttccaggccccaccccccaacctcaggc

SEQ ID NO: 295482 - DNA, 2480 bp, Homo sapiens
  misc_feature (1406)..(1406): n is a, c, g, or t
tcagctctctctgcttccccaggatgcgggctccgggtgcgggcgcggcctcggtggtctcgctggcgctgttgtggctgctggggctgccgtggacctggagcgcggcagcggcgctcggcgtgtacgtgggcagcggcggctggcgcttcctgcgcatcgtctgcaagaccgcgaggcgagacctcttcggtctctctgtgctgatccgcgtgcgcctggagctgcggcggcaccagcgtgccggccacaccatcccgcgcatctttcaggcggtagtgcagcgacagcccgagcgcctggcgctggtggatgccgggaccggcgagtgctggacctttgcgcagctggacgcctactccaatgcggtagccaacctcttccgccagctgggcttcgcgccgggcgacgtggtggccatcttcctggagggccggccggagttcgtggggctgtggctgggcctggccaaggcgggcatggaggccgcgctgctcaacgtgaacctgcggcgcgagcccctggccttctgcctgggcacctcgggcgctaaggccctgatctttggaggagaaatggtggcggcggtggccgaagtgagcgggcatctggggaaaagtttgatcaagttctgctctggagacttggggcccgagggcatcttgccggacacccacctcctggacccgctgctgaaggaggcctctactgcccccttggcacagatccccagcaagggcatggacgatcgtcttttctacatctacacgtcggggaccaccgggctgcccaaggctgccattgtcgtgcacagcaggtactaccgcatggcagccttcggccaccacgcctaccgcatgcaggcggctgacgtgctctatgactgcctgcccctgtaccactcggcaggaaacatcatcggcgtggggcagtgtctcatctatgggctgacagtcgtcctccgcaagaaattctcggccagccgcttctgggacgactgcatcaagtacaactgcacgctgtacctggcacggcccatcctggactgagaaactggaacctcagaggaacccgtgcctctctgctgccttggtgcccctgtgtctgcctcctctccctgcttttcagcctctgtctccttccatccctgtccctgtctggccttaactcttccctctttttcttttctttctttctttcttttttttttaagatagagtctcactctgctgcccgggctagagtgcagtggtgggatctcggctcactgcaacctctgcctcctggggttcaagtgatcctcccacctcagcctcctgagtagctgggattacaggcacccgccaccacgtccagctaatttttatatttttagtagagacggggtttcaccatgttggtcaggntggtcttgaactcctgacctcaggtgatccgctggcctcggcctcccagagtgctgggattataggcgtgagcctctggcccggcctttcctttttcctctcctctcctgccgagagtggaacacgcgtgtcctgggagctgcatcttgtgtagggtccagctgcttttggggactgcaggaatcatctcccctgggccctggactcggactggggcctccccacctccctctcggctgtgccttacggagccccaatccaggcctcctgtggctgttgggttccagatgctgcagctccatgtgacttccaagcaggccctccgccctccctgctgaatggaggagccgggggtcccccaggccaactggaaaatctcccaggctaggccaattgccttttgcacttccccgttcctgtcacatttccccagccccaccttcccctcctgatgccctgaaagcttccggaattgactgtgaccacttggatgtcaccactgtcagcccctgccttgatgtccccatttagccatctccatggagctcctgctggagggccctgaaccctgcactgcgtggctgcccagccagctgcctcctgtcctgggaggaggcctcctgggtgtcctcatctggtgtgtctactggagggtcccacaggagaggcagcagaggggtcaggggaggtctcctgccgggggttggcctctcaagcctcaggggttctagcctgttgaatataccccacctggtggtggcccctccgatgtccccactgatggctctgacaccgtgttggtggcgatgtcccagacaatcccaccaggacggcccagacatccctactggcttcgctggtggctcatctcgaacatccacgccagcctttctggggccggccacccaggccgcctgtccgtctgtcctccctccagcagcaccccctggcccctggagtggtggggccatggcaagagacaccgtggcgtctcatgtgaactttcctgggcactgtggttttatttcctaattgatttaagaaataaacctgaagaccgtctggtgcaagctg

SEQ ID NO: 295483 - DNA, 3385 bp, Homo sapiens
  misc_feature (2311)..(2311): n is a, c, g, or t
tcagctctctctgcttccccaggatgcgggctccgggtgcgggcgcggcctcggtggtctcgctggcgctgttgtggctgctggggctgccgtggacctggagcgcggcagcggcgctcggcgtgtacgtgggcagcggcggctggcgcttcctgcgcatcgtctgcaagaccgcgaggcgagacctcttcggtctctctgtgctgatccgcgtgcgcctggagctgcggcggcaccagcgtgccggccacaccatcccgcgcatctttcaggcggtagtgcagcgacagcccgagcgcctggcgctggtggatgccgggaccggcgagtgctggacctttgcgcagctggacgcctactccaatgcggtagccaacctcttccgccagctgggcttcgcgccgggcgacgtggtggccatcttcctggagggccggccggagttcgtggggctgtggctgggcctggccaaggcgggcatggaggccgcgctgctcaacgtgaacctgcggcgcgagcccctggccttctgcctgggcacctcgggcgctaaggccctgatctttggaggagaaatggtggcggcggtggccgaagtgagcgggcatctggggaaaagtttgatcaagttctgctctggagacttggggcccgagggcatcttgccggacacccacctcctggacccgctgctgaaggaggcctctactgcccccttggcacagatccccagcaagggcatggacgatcgtcttttctacatctacacgtcggggaccaccgggctgcccaaggctgccattgtcgtgcacagcaggtactaccgcatggcagccttcggccaccacgcctaccgcatgcaggcggctgacgtgctctatgactgcctgcccctgtaccactcggcaggaaacatcatcggcgtggggcagtgtctcatctatgggctgacagtcgtcctccgcaagaaattctcggccagccgcttctgggacgactgcatcaagtacaactgcacggtggttcagtacatcggggagatctgccgctacctgctgaagcagccggtgcgcgaggcggagaggcgacaccgcgtgcgcctggcggtggggaacgggctgcgtcctgccatctgggaggagttcacggagcgcttcggcgtacgccaaatcggggagttctacggcgccaccgagtgcaactgcagcattgccaacatggacggcaaggtcggctcctgtggtttcaacagccgcatcctgccccacgtgtaccccatccggctggtgaaggtcaatgaggacacaatggagctgctgcgggatgcccagggcctctgcatcccctgccaggccggggagcctggcctccttgtgggtcagatcaaccaacaggacccgctgcgccgcttcgatggctatgtcagcgagagcgccaccagcaagaagatcgcccacagcgtcttcagcaagggcgacagcgcctacctctcaggtgacgtgctagtgatggatgagctgggctacatgtacttccgggaccgtagcggggacaccttccgctggcgaggggagaacgtctccaccaccgaggtggagggcgtgctgagccgcctgctgggccagacagacgtggccgtctatggggtggctgttccaggcaccttcaagatccagaagacgaggctgcagcgagagggctttgacccacgccagacctcagaccggctcttcttcctggacctgaagcagggccactacctgcccttaaatgaggcagtctacactcgcatctgctcgggcgccttcgccctctgaagctgttcctctactggccacaaactctgggcctggtgggagaggccagcttgagccagacagcgctgcccaggggtggccgcctagtacacacccacctggccgagctgtacctggcacggcccatcctggactgagaaactggaacctcagaggaacccgtgcctctctgctgccttggtgcccctgtgtctgcctcctctccctgcttttcagcctctgtctccttccatccctgtccctgtctggccttaactcttccctctttttcttttctttctttctttcttttttttttaagatagagtctcactctgctgcccgggctagagtgcagtggtgggatctcggctcactgcaacctctgcctcctggggttcaagtgatcctcccacctcagcctcctgagtagctgggattacaggcacccgccaccacgtccagctaatttttatatttttagtagagacggggtttcaccatgttggtcaggntggtcttgaactcctgacctcaggtgatccgctggcctcggcctcccagagtgctgggattataggcgtgagcctctggcccggcctttcctttttcctctcctctcctgccgagagtggaacacgcgtgtcctgggagctgcatcttgtgtagggtccagctgcttttggggactgcaggaatcatctcccctgggccctggactcggactggggcctccccacctccctctcggctgtgccttacggagccccaatccaggcctcctgtggctgttgggttccagatgctgcagctccatgtgacttccaagcaggccctccgccctccctgctgaatggaggagccgggggtcccccaggccaactggaaaatctcccaggctaggccaattgccttttgcacttccccgttcctgtcacatttccccagccccaccttcccctcctgatgccctgaaagcttccggaattgactgtgaccacttggatgtcaccactgtcagcccctgccttgatgtccccatttagccatctccatggagctcctgctggagggccctgaaccctgcactgcgtggctgcccagccagctgcctcctgtcctgggaggaggcctcctgggtgtcctcatctggtgtgtctactggagggtcccacaggagaggcagcagaggggtcaggggaggtctcctgccgggggttggcctctcaagcctcaggggttctagcctgttgaatataccccacctggtggtggcccctccgatgtccccactgatggctctgacaccgtgttggtggcgatgtcccagacaatcccaccaggacggcccagacatccctactggcttcgctggtggctcatctcgaacatccacgccagcctttctggggccggccacccaggccgcctgtccgtctgtcctccctccagcagcaccccctggcccctggagtggtggggccatggcaagagacaccgtggcgtctcatgtgaactttcctgggcactgtggttttatttcctaattgatttaagaaataaacctgaagaccgtctggtgcaagctg

SEQ ID NO: 295484 - DNA, 2656 bp, Homo sapiens
  misc_feature (1582)..(1582): n is a, c, g, or t
ggtccacatgcagcatgcttccccatgcctgtaccctgggggatttaggtcccagcctctgccctcccggctccccctccccctgcaggtactaccgcatggcagccttcggccaccacgcctaccgcatgcaggcggctgacgtgctctatgactgcctgcccctgtaccactcggcaggaaacatcatcggcgtggggcagtgtctcatctatgggctgacagtcgtcctccgcaagaaattctcggccagccgcttctgggacgactgcatcaagtacaactgcacggtggttcagtacatcggggagatctgccgctacctgctgaagcagccggtgcgcgaggcggagaggcgacaccgcgtgcgcctggcggtggggaacgggctgcgtcctgccatctgggaggagttcacggagcgcttcggcgtacgccaaatcggggagttctacggcgccaccgagtgcaactgcagcattgccaacatggacggcaaggtcggctcctgtggtttcaacagccgcatcctgccccacgtgtaccccatccggctggtgaaggtcaatgaggacacaatggagctgctgcgggatgcccagggcctctgcatcccctgccaggccggggagcctggcctccttgtgggtcagatcaaccaacaggacccgctgcgccgcttcgatggctatgtcagcgagagcgccaccagcaagaagatcgcccacagcgtcttcagcaagggcgacagcgcctacctctcaggtgacgtgctagtgatggatgagctgggctacatgtacttccgggaccgtagcggggacaccttccgctggcgaggggagaacgtctccaccaccgaggtggagggcgtgctgagccgcctgctgggccagacagacgtggccgtctatggggtggctgttccaggcaccttcaagatccagaagacgaggctgcagcgagagggctttgacccacgccagacctcagaccggctcttcttcctggacctgaagcagggccactacctgcccttaaatgaggcagtctacactcgcatctgctcgggcgccttcgccctctgaagctgttcctctactggccacaaactctgggcctggtgggagaggccagcttgagccagacagcgctgcccaggggtggccgcctagtacacacccacctggccgagctgtacctggcacggcccatcctggactgagaaactggaacctcagaggaacccgtgcctctctgctgccttggtgcccctgtgtctgcctcctctccctgcttttcagcctctgtctccttccatccctgtccctgtctggccttaactcttccctctttttcttttctttctttctttcttttttttttaagatagagtctcactctgctgcccgggctagagtgcagtggtgggatctcggctcactgcaacctctgcctcctggggttcaagtgatcctcccacctcagcctcctgagtagctgggattacaggcacccgccaccacgtccagctaatttttatatttttagtagagacggggtttcaccatgttggtcaggntggtcttgaactcctgacctcaggtgatccgctggcctcggcctcccagagtgctgggattataggcgtgagcctctggcccggcctttcctttttcctctcctctcctgccgagagtggaacacgcgtgtcctgggagctgcatcttgtgtagggtccagctgcttttggggactgcaggaatcatctcccctgggccctggactcggactggggcctccccacctccctctcggctgtgccttacggagccccaatccaggcctcctgtggctgttgggttccagatgctgcagctccatgtgacttccaagcaggccctccgccctccctgctgaatggaggagccgggggtcccccaggccaactggaaaatctcccaggctaggccaattgccttttgcacttccccgttcctgtcacatttccccagccccaccttcccctcctgatgccctgaaagcttccggaattgactgtgaccacttggatgtcaccactgtcagcccctgccttgatgtccccatttagccatctccatggagctcctgctggagggccctgaaccctgcactgcgtggctgcccagccagctgcctcctgtcctgggaggaggcctcctgggtgtcctcatctggtgtgtctactggagggtcccacaggagaggcagcagaggggtcaggggaggtctcctgccgggggttggcctctcaagcctcaggggttctagcctgttgaatataccccacctggtggtggcccctccgatgtccccactgatggctctgacaccgtgttggtggcgatgtcccagacaatcccaccaggacggcccagacatccctactggcttcgctggtggctcatctcgaacatccacgccagcctttctggggccggccacccaggccgcctgtccgtctgtcctccctccagcagcaccccctggcccctggagtggtggggccatggcaagagacaccgtggcgtctcatgtgaactttcctgggcactgtggttttatttcctaattgatttaagaaataaacctgaagaccgtctggtgcaagctg

SEQ ID NO: 295485 - DNA, 2928 bp, Homo sapiens
  misc_feature (1854)..(1854): n is a, c, g, or t
gcggccgccctggacgtgggcatgaggtgcacggtctgggtatgccccgggcagggagttggtgcatcccaggcctcgggagggggcctgtccggcggtgaccatgacccatgtgttggggaccacagcggtggccgaagtgagcgggcatctggggaaaagtttgatcaagttctgctctggagacttggggcccgagggcatcttgccggacacccacctcctggacccgctgctgaaggaggcctctactgcccccttggcacagatccccagcaagggcatggacgatcgtcttttctacatctacacgtcggggaccaccgggctgcccaaggctgccattgtcgtgcacagcaggtactaccgcatggcagccttcggccaccacgcctaccgcatgcaggcggctgacgtgctctatgactgcctgcccctgtaccactcggcaggaaacatcatcggcgtggggcagtgtctcatctatgggctgacagtcgtcctccgcaagaaattctcggccagccgcttctgggacgactgcatcaagtacaactgcacggtggttcagtacatcggggagatctgccgctacctgctgaagcagccggtgcgcgaggcggagaggcgacaccgcgtgcgcctggcggtggggaacgggctgcgtcctgccatctgggaggagttcacggagcgcttcggcgtacgccaaatcggggagttctacggcgccaccgagtgcaactgcagcattgccaacatggacggcaaggtcggctcctgtggtttcaacagccgcatcctgccccacgtgtaccccatccggctggtgaaggtcaatgaggacacaatggagctgctgcgggatgcccagggcctctgcatcccctgccaggccggggagcctggcctccttgtgggtcagatcaaccaacaggacccgctgcgccgcttcgatggctatgtcagcgagagcgccaccagcaagaagatcgcccacagcgtcttcagcaagggcgacagcgcctacctctcaggtgacgtgctagtgatggatgagctgggctacatgtacttccgggaccgtagcggggacaccttccgctggcgaggggagaacgtctccaccaccgaggtggagggcgtgctgagccgcctgctgggccagacagacgtggccgtctatggggtggctgttccaggcaccttcaagatccagaagacgaggctgcagcgagagggctttgacccacgccagacctcagaccggctcttcttcctggacctgaagcagggccactacctgcccttaaatgaggcagtctacactcgcatctgctcgggcgccttcgccctctgaagctgttcctctactggccacaaactctgggcctggtgggagaggccagcttgagccagacagcgctgcccaggggtggccgcctagtacacacccacctggccgagctgtacctggcacggcccatcctggactgagaaactggaacctcagaggaacccgtgcctctctgctgccttggtgcccctgtgtctgcctcctctccctgcttttcagcctctgtctccttccatccctgtccctgtctggccttaactcttccctctttttcttttctttctttctttcttttttttttaagatagagtctcactctgctgcccgggctagagtgcagtggtgggatctcggctcactgcaacctctgcctcctggggttcaagtgatcctcccacctcagcctcctgagtagctgggattacaggcacccgccaccacgtccagctaatttttatatttttagtagagacggggtttcaccatgttggtcaggntggtcttgaactcctgacctcaggtgatccgctggcctcggcctcccagagtgctgggattataggcgtgagcctctggcccggcctttcctttttcctctcctctcctgccgagagtggaacacgcgtgtcctgggagctgcatcttgtgtagggtccagctgcttttggggactgcaggaatcatctcccctgggccctggactcggactggggcctccccacctccctctcggctgtgccttacggagccccaatccaggcctcctgtggctgttgggttccagatgctgcagctccatgtgacttccaagcaggccctccgccctccctgctgaatggaggagccgggggtcccccaggccaactggaaaatctcccaggctaggccaattgccttttgcacttccccgttcctgtcacatttccccagccccaccttcccctcctgatgccctgaaagcttccggaattgactgtgaccacttggatgtcaccactgtcagcccctgccttgatgtccccatttagccatctccatggagctcctgctggagggccctgaaccctgcactgcgtggctgcccagccagctgcctcctgtcctgggaggaggcctcctgggtgtcctcatctggtgtgtctactggagggtcccacaggagaggcagcagaggggtcaggggaggtctcctgccgggggttggcctctcaagcctcaggggttctagcctgttgaatataccccacctggtggtggcccctccgatgtccccactgatggctctgacaccgtgttggtggcgatgtcccagacaatcccaccaggacggcccagacatccctactggcttcgctggtggctcatctcgaacatccacgccagcctttctggggccggccacccaggccgcctgtccgtctgtcctccctccagcagcaccccctggcccctggagtggtggggccatggcaagagacaccgtggcgtctcatgtgaactttcctgggcactgtggttttatttcctaattgatttaagaaataaacctgaagaccgtctggtgcaagctg

SEQ ID NO: 295486 - DNA, 1850 bp, Homo sapiens
  misc_feature (776)..(776): n is a, c, g, or t
gcggccgtcgcagacccccacagcctgctggaccccaacgcgatataccaggagctgcagaaggtgctggcaccctatgcccggcccatcttcctgcgcctcctgccccaggtggacaccacaggcaccttcaagatccagaagacgaggctgcagcgagagggctttgacccacgccagacctcagaccggctcttcttcctggacctgaagcagggccactacctgcccttaaatgaggcagtctacactcgcatctgctcgggcgccttcgccctctgaagctgttcctctactggccacaaactctgggcctggtgggagaggccagcttgagccagacagcgctgcccaggggtggccgcctagtacacacccacctggccgagctgtacctggcacggcccatcctggactgagaaactggaacctcagaggaacccgtgcctctctgctgccttggtgcccctgtgtctgcctcctctccctgcttttcagcctctgtctccttccatccctgtccctgtctggccttaactcttccctctttttcttttctttctttctttcttttttttttaagatagagtctcactctgctgcccgggctagagtgcagtggtgggatctcggctcactgcaacctctgcctcctggggttcaagtgatcctcccacctcagcctcctgagtagctgggattacaggcacccgccaccacgtccagctaatttttatatttttagtagagacggggtttcaccatgttggtcaggntggtcttgaactcctgacctcaggtgatccgctggcctcggcctcccagagtgctgggattataggcgtgagcctctggcccggcctttcctttttcctctcctctcctgccgagagtggaacacgcgtgtcctgggagctgcatcttgtgtagggtccagctgcttttggggactgcaggaatcatctcccctgggccctggactcggactggggcctccccacctccctctcggctgtgccttacggagccccaatccaggcctcctgtggctgttgggttccagatgctgcagctccatgtgacttccaagcaggccctccgccctccctgctgaatggaggagccgggggtcccccaggccaactggaaaatctcccaggctaggccaattgccttttgcacttccccgttcctgtcacatttccccagccccaccttcccctcctgatgccctgaaagcttccggaattgactgtgaccacttggatgtcaccactgtcagcccctgccttgatgtccccatttagccatctccatggagctcctgctggagggccctgaaccctgcactgcgtggctgcccagccagctgcctcctgtcctgggaggaggcctcctgggtgtcctcatctggtgtgtctactggagggtcccacaggagaggcagcagaggggtcaggggaggtctcctgccgggggttggcctctcaagcctcaggggttctagcctgttgaatataccccacctggtggtggcccctccgatgtccccactgatggctctgacaccgtgttggtggcgatgtcccagacaatcccaccaggacggcccagacatccctactggcttcgctggtggctcatctcgaacatccacgccagcctttctggggccggccacccaggccgcctgtccgtctgtcctccctccagcagcaccccctggcccctggagtggtggggccatggcaagagacaccgtggcgtctcatgtgaactttcctgggcactgtggttttatttcctaattgatttaagaaataaacctgaagaccgtctggtgcaagctg

SEQ ID NO: 295487 - DNA, 3245 bp, Homo sapiens
  misc_feature (2311)..(2311): n is a, c, g, or t
tcagctctctctgcttccccaggatgcgggctccgggtgcgggcgcggcctcggtggtctcgctggcgctgttgtggctgctggggctgccgtggacctggagcgcggcagcggcgctcggcgtgtacgtgggcagcggcggctggcgcttcctgcgcatcgtctgcaagaccgcgaggcgagacctcttcggtctctctgtgctgatccgcgtgcgcctggagctgcggcggcaccagcgtgccggccacaccatcccgcgcatctttcaggcggtagtgcagcgacagcccgagcgcctggcgctggtggatgccgggaccggcgagtgctggacctttgcgcagctggacgcctactccaatgcggtagccaacctcttccgccagctgggcttcgcgccgggcgacgtggtggccatcttcctggagggccggccggagttcgtggggctgtggctgggcctggccaaggcgggcatggaggccgcgctgctcaacgtgaacctgcggcgcgagcccctggccttctgcctgggcacctcgggcgctaaggccctgatctttggaggagaaatggtggcggcggtggccgaagtgagcgggcatctggggaaaagtttgatcaagttctgctctggagacttggggcccgagggcatcttgccggacacccacctcctggacccgctgctgaaggaggcctctactgcccccttggcacagatccccagcaagggcatggacgatcgtcttttctacatctacacgtcggggaccaccgggctgcccaaggctgccattgtcgtgcacagcaggtactaccgcatggcagccttcggccaccacgcctaccgcatgcaggcggctgacgtgctctatgactgcctgcccctgtaccactcggcaggaaacatcatcggcgtggggcagtgtctcatctatgggctgacagtcgtcctccgcaagaaattctcggccagccgcttctgggacgactgcatcaagtacaactgcacggtggttcagtacatcggggagatctgccgctacctgctgaagcagccggtgcgcgaggcggagaggcgacaccgcgtgcgcctggcggtggggaacgggctgcgtcctgccatctgggaggagttcacggagcgcttcggcgtacgccaaatcggggagttctacggcgccaccgagtgcaactgcagcattgccaacatggacggcaaggtcggctcctgtggtttcaacagccgcatcctgccccacgtgtaccccatccggctggtgaaggtcaatgaggacacaatggagctgctgcgggatgcccagggcctctgcatcccctgccaggccggggagcctggcctccttgtgggtcagatcaaccaacaggacccgctgcgccgcttcgatggctatgtcagcgagagcgccaccagcaagaagatcgcccacagcgtcttcagcaagggcgacagcgcctacctctcaggtgacgtgctagtgatggatgagctgggctacatgtacttccgggaccgtagcggggacaccttccgctggcgaggggagaacgtctccaccaccgaggtggagggcgtgctgagccgcctgctgggccagacagacgtggccgtctatggggtggctgttccaggcaccttcaagatccagaagacgaggctgcagcgagagggctttgacccacgccagacctcagaccggctcttcttcctggacctgaagcagggccactacctgcccttaaatgaggcagtctacactcgcatctgctcgggcgccttcgccctctgaagctgttcctctactggccacaaactctgggcctggtgggagaggccagcttgagccagacagcgctgcccaggggtggccgcctagtacacacccacctggccgagctgtacctggcacggcccatcctggactgagaaactggaacctcagaggaacccgtgcctctctgctgccttggtgcccctgtgtctgcctcctctccctgcttttcagcctctgtctccttccatccctgtccctgtctggccttaactcttccctctttttcttttctttctttctttcttttttttttaagatagagtctcactctgctgcccgggctagagtgcagtggtgggatctcggctcactgcaacctctgcctcctggggttcaagtgatcctcccacctcagcctcctgagtagctgggattacaggcacccgccaccacgtccagctaatttttatatttttagtagagacggggtttcaccatgttggtcaggntggtcttgaactcctgacctcaggtgatccgctggcctcggcctcccagagtgctgggattataggcgtgagcctctggcccggcctttcctttttcctctcctctcctgccgagagtggaacacgcgtgtcctgggagctgcatcttgtgtagggtccagctgcttttggggactgcaggaatcatctccctgctgaatggaggagccgggggtcccccaggccaactggaaaatctcccaggctaggccaattgccttttgcacttccccgttcctgtcacatttccccagccccaccttcccctcctgatgccctgaaagcttccggaattgactgtgaccacttggatgtcaccactgtcagcccctgccttgatgtccccatttagccatctccatggagctcctgctggagggccctgaaccctgcactgcgtggctgcccagccagctgcctcctgtcctgggaggaggcctcctgggtgtcctcatctggtgtgtctactggagggtcccacaggagaggcagcagaggggtcaggggaggtctcctgccgggggttggcctctcaagcctcaggggttctagcctgttgaatataccccacctggtggtggcccctccgatgtccccactgatggctctgacaccgtgttggtggcgatgtcccagacaatcccaccaggacggcccagacatccctactggcttcgctggtggctcatctcgaacatccacgccagcctttctggggccggccacccaggccgcctgtccgtctgtcctccctccagcagcaccccctggcccctggagtggtggggccatggcaagagacaccgtggcgtctcatgtgaactttcctgggcactgtggttttatttcctaattgatttaagaaataaacctgaagaccgtctggtgcaagctg

SEQ ID NO: 295488 - DNA, 580 bp, Homo sapiens
ttttaaagatggagttttactcttgttgcccaggctggagtttaacggcacaatctcggctctgtctcccaggttcaagcaattctcctgcccagccagctgcctcctgtcctgggaggaggcctcctgggtgtcctcatctggtgtgtctactggagggtcccacaggagaggcagcagaggggtcaggggaggtctcctgccgggggttggcctctcaagcctcaggggttctagcctgttgaatataccccacctggtggtggcccctccgatgtccccactgatggctctgacaccgtgttggtggcgatgtcccagacaatcccaccaggacggcccagacatccctactggcttcgctggtggctcatctcgaacatccacgccagcctttctggggccggccacccaggccgcctgtccgtctgtcctccctccagcagcaccccctggcccctggagtggtggggccatggcaagagacaccgtggcgtctcatgtgaactttcctgggcactgtggttttatttcctaattgatttaagaaataaacctgaagaccgtctggtgcaagctg

SEQ ID NO: 295489 - DNA, 1577 bp, Homo sapiens
tcagctctctctgcttccccaggatgcgggctccgggtgcgggcgcggcctcggtggtctcgctggcgctgttgtggctgctggggctgccgtggacctggagcgcggcagcggcgctcggcgtgtacgtgggcagcggcggctggcgcttcctgcgcatcgtctgcaagaccgcgaggcgagacctcttcggtctctctgtgctgatccgcgtgcgcctggagctgcggcggcaccagcgtgccggccacaccatcccgcgcatctttcaggcggtagtgcagcgacagcccgagcgcctggcgctggtggatgccgggaccggcgagtgctggacctttgcgcagctggacgcctactccaatgcggtagccaacctcttccgccagctgggcttcgcgccgggcgacgtggtggccatcttcctggagggccggccggagttcgtggggctgtggctgggcctggccaaggcgggcatggaggccgcgctgctcaacgtgaacctgcggcgcgagcccctggccttctgcctgggcacctcgggcgctaaggccctgatctttggaggagaaatggtggcggcggtggccgaagtgagcgggcatctggggaaaagtttgatcaagttctgctctggagacttggggcccgagggcatcttgccggacacccacctcctggacccgctgctgaaggaggcctctactgcccccttggcacagatccccagcaagggcatggacgatcgtcttttctacatctacacgtcggggaccaccgggctgcccaaggctgccattgtcgtgcacagcaggtactaccgcatggcagccttcggccaccacgcctaccgcatgcaggcggctgacgtgctctatgactgcctgcccctgtaccactcggcaggaaacatcatcggcgtggggcagtgtctcatctatgggctgacagtcgtcctccgcaagaaattctcggccagccgcttctgggacgactgcatcaagtacaactgcacggtggttcagtacatcggggagatctgccgctacctgctgaagcagccggtgcgcgaggcggagaggcgacaccgcgtgcgcctggcggtggggaacgggctgcgtcctgccatctgggaggagttcacggagcgcttcggcgtacgccaaatcggggagttctacggcgccaccgagtgcaactgcagcattgccaacatggacggcaaggtgcacaccggcagggccccggggcaggtctcggagttcagggaagaccactgtctcctcttcctggggcccctgggatacataaaacagcctggactggcgcggaaggctccgccaaggcgcacgcagggcggggtgtaaggggagttcctgggactcccggtgcaccaccagagggacaatcctgcagcctgcacagatagtcatgtgactgtggtccttgggtcaggagagttggaggataggtatggctgtgcgccctggcaagtgcctcagcctttctgagcctcagtttctgcgtgtggagattagcaaggagaatagggctctgtgtaccgtgctgttatt

SEQ ID NO: 295490 - DNA, 297 bp, Homo sapiens
tgaatgcaggctgggaaggtgggaggaggggccctgagttggaggcgacgcttactaccctgcttttgcagatcagccaaggtcacagagcttagaatgacactggaggtgctaggtccaagccccagggcaaggcaggcaaagtgttactgagaaggaccccgcatatccccggctccttccaactcagttcaccccattccaggtcggctcctgtggtttcaacagccgcatcctgccccacgtgtaccccatccggctggtgaaggtcaatgaggacacaatggagctgctgcg

SEQ ID NO: 295491 - DNA, 463 bp, Homo sapiens
taggattagctccctgggtggggcggtctcggggtctctcctctgatccgggctccccaccgcctgccggtcccatcacccacttcctcaccccgtcccccaggtggttcagtacatcggggagatctgccgctacctgctgaagcagccggtgcgcgaggcggagaggcgacaccgcgtgcgcctggcggtggggaacgggctgcgtcctgccatctgggaggagttcacggagcgcttcggcgtacgccaaatcggggagttctacggcgccaccgagtgcaactgcagcattgccaacatggacggcaaggtgcacaccggcagggccccggggcaggtctcggagttcagggaagaccactgtctcctcttcctggggcccctgggatacataaaacagcctggactggcgcggaaggctccgccaaggcgcacgcagggcggggtgtaaggggagttc

SEQ ID NO: 295492 - DNA, 1129 bp, Homo sapiens
  misc_feature (946)..(946): n is a, c, g, or t
  misc_feature (951)..(951): n is a, c, g, or t
  misc_feature (954)..(955): n is a, c, g, or t
  misc_feature (959)..(959): n is a, c, g, or t
  misc_feature (970)..(970): n is a, c, g, or t
  misc_feature (1128)..(1128): n is a, c, g, or t
ggctaggttcgaggctgggtgtggcgactaccacgacctggagtcggtggttcagcaggtggagcagaacctggagctgatgaccaaacgggctgtaaaggcagaaaaccacgtcgtgaaactaaaacaggaaatcagtttgctccaggcgcaggtctccaacttccagcgagagaatgaagccctgcggtgcggccagggtgccagcctgaccgtggtgaagcagaacgccgacgtggccctgcagaacctccgggtggtcatgaacagtgcacaggcttccatcaagcaactggtttccggagctgagacactgaatcttgttgccgaaatccttaaatctatagacagaatttctgaagttaaagacgaggaggaagactcttgaggacccctgggtgttctcagcatgaagctccgtgtataccctgaggtcaccaccgctcgatctaaatgtgcagttgtgtccttaaatatgcagtcttcacccagagtaaagtgttgatcgcaagagtccagtgtcgtgccctcagccagttcttggccaccacaatgggagcagccctggccgagttgtctctgtggtttctatgcagcccttcttggcgaaattcctgcgatcttatagattctaatgagctcttggaagacattgtcataaaagccagtgattttaagaaaaagagtggttctggaatcaatgttttccagtcccatcccagaacatcagttgtaagataagtacaattggttgtccttgatttcataagtagaacaaacactaaatgtgcctctgagatggccaccccgggcagggacctgtgccttccgccgatgctcagggctccctctggctcccgggtcactcttgtggccccagtgggtggtccctgcagtcatggcctgagtgcgcagggcacggtggtgtgtggctctcggaccgggnacagnccnncggnggaaggcaaangcctgggggggctggggcgtcagggcttggaggcggaatcgatcagttgccggttgagcacggtttgggcgcccagggggaacaagttggatctcagcaaaaccgcagaggtttaagcacaaagggccgggctctgtttttcttgcgttgtgtgttcng

SEQ ID NO: 295493 - DNA, 2216 bp, Homo sapiens
gttcaggcacgcgctttcggtgctcggagcggaagcagcggcgagaggctcggaggcgcgggggcggccgagcggcgggcgacgggggcgggcgacgggggcgggcgacgcgggccgcggcacgggcggagccggggccatggagccgccgctgccgggctaggcaggtcgtgccccgccgggccggcggcgatgtcgggctaccagcgccgcccgggcgccaccccgctgtcccgagcccggagcctcgccattcccgacgattttggctatggaaaggggaaatgttctaagcagagcccgtcaggagcccacgggacacattttggagatgacagatttgaagatctggaagaggcaaatccattctcttttagagagtttctgaagaccaagaacctcggcctctcgaaagaggatccggccagcagaatttatgcaaaggaagcctcgaggcattccctgggacttgaccacaactccccaccctcccaaaccggcgggtatggcctggagtatcagcagccatttttcgaggatccgacaggggctggtgacctcctggatgaggaggaggatgaggacaccggatggagtggggcctacctgccgtccgccatcgagcagactcaccccgagagggtccctgccggcacgtcgccctgcagcacatacctttcctttttctccaccccgtcggagctggcagggcctgagtctctgccctcgtgggcgttgagtgacactgattctcgcgtgtctccggcctctccggcagggagtcctagcgcagactttgcggttcatggagagtctctgggagacaggcacctgcggacgctgcagataagttacgacgcactgaaagatgaaaattctaagctgagaagaaagctgaatgaggttcagagcttctctgaagctcaaacagaaatggtgaggacgcttgagcggaagttagaagcaaaaatgatcaaggaggaaagcgactaccacgacctggagtcggtggttcagcaggtggagcagaacctggagctgatgaccaaacgggctgtaaaggcagaaaaccacgtcgtgaaactaaaacaggaaatcagtttgctccaggcgcaggtctccaacttccagcgagagaatgaagccctgcggtgcggccagggtgccagcctgaccgtggtgaagcagaacgccgacgtggccctgcagaacctccgggtggtcatgaacagtgcacaggcttccatcaagcaactggtttccggagctgagacactgaatcttgttgccgaaatccttaaatctatagacagaatttctgaagttaaagacgaggaggaagactcttgaggacccctgggtgttctcagcatgaagctccgtgtataccctgaggtcaccaccgctcgatctaaatgtgcagttgtgtccttaaatatgcagtcttcacccagagtaaagtgttgatcgcaagagtccagtgtcgtgccctcagccagttcttggccaccacaatgggagcagccctggccgagttgtctctgtggtttctatgcagcccttcttggcgaaattcctgcgatcttatagattctaatgagctcttggaagacattgtcataaaagccagtgattttaagaaaaagagtggttctggaatcaatgttttccagtcccatcccagaacatcagttgtaagataagtacaattggttgtccttgatttcataagtagaacaaacactaaatgtgcctctgagatggccaccccgggcagggacctgtgccttccgccgatgctcagggctccctctggctcccgggtcactcttgtggccccagtgggtggtccctgcagtcatggcctgagtgcgcaggggccaccgcgtggctgctgctgtcctcctccgggacccacggggaccaaggtcacacgttccgtgctgtgaagctgtccagatgtgcctctttggctgggggttctggtggacgtttcaagtggcattttgtacaatgcaggttagaattcaggaatttcaagtatgtgcccgggtctgtcaggtcccagttgcctttctgacggcccccctcagagggacggcgatgagcactaaatgcttttttgactattttcctatagattttttttaaaacttttttttcctcctgttccaattgatagctttcttatttaataaattctgtagttcaccgca

SEQ ID NO: 295494 - DNA, 2366 bp, Homo sapiens
gttcaggcacgcgctttcggtgctcggagcggaagcagcggcgagaggctcggaggcgcgggggcggccgagcggcgggcgacgggggcgggcgacgggggcgggcgacgcgggccgcggcacgggcggagccggggccatggagccgccgctgccgggctaggcaggtcgtgccccgccgggccggcggcgatgtcgggctaccagcgccgcccgggcgccaccccgctgtcccgagcccggagcctcgccattcccgacgctccagcgttctatgagcgccggtcttgtctcccccagctaaattgtgagcgcccccatggcagggacctggactcccccttcttcggcattcggccggcctttatgtgctatgtgcccagcccggtgctggcttccgtgggagacacagattttggctatggaaaggggaaatgttctaagcagagcccgtcaggagcccacgggacacattttggagatgacagatttgaagatctggaagaggcaaatccattctcttttagagagtttctgaagaccaagaacctcggcctctcgaaagaggatccggccagcagaatttatgcaaaggaagcctcgaggcattccctgggacttgaccacaactccccaccctcccaaaccggcgggtatggcctggagtatcagcagccatttttcgaggatccgacaggggctggtgacctcctggatgaggaggaggatgaggacaccggatggagtggggcctacctgccgtccgccatcgagcagactcaccccgagagggtccctgccggcacgtcgccctgcagcacatacctttcctttttctccaccccgtcggagctggcagggcctgagtctctgccctcgtgggcgttgagtgacactgattctcgcgtgtctccggcctctccggcagggagtcctagcgcagactttgcggttcatggagagtctctgggagacaggcacctgcggacgctgcagataagttacgacgcactgaaagatgaaaattctaagctgagaagaaagctgaatgaggttcagagcttctctgaagctcaaacagaaatggtgaggacgcttgagcggaagttagaagcaaaaatgatcaaggaggaaagcgactaccacgacctggagtcggtggttcagcaggtggagcagaacctggagctgatgaccaaacgggctgtaaaggcagaaaaccacgtcgtgaaactaaaacaggaaatcagtttgctccaggcgcaggtctccaacttccagcgagagaatgaagccctgcggtgcggccagggtgccagcctgaccgtggtgaagcagaacgccgacgtggccctgcagaacctccgggtggtcatgaacagtgcacaggcttccatcaagcaactggtttccggagctgagacactgaatcttgttgccgaaatccttaaatctatagacagaatttctgaagttaaagacgaggaggaagactcttgaggacccctgggtgttctcagcatgaagctccgtgtataccctgaggtcaccaccgctcgatctaaatgtgcagttgtgtccttaaatatgcagtcttcacccagagtaaagtgttgatcgcaagagtccagtgtcgtgccctcagccagttcttggccaccacaatgggagcagccctggccgagttgtctctgtggtttctatgcagcccttcttggcgaaattcctgcgatcttatagattctaatgagctcttggaagacattgtcataaaagccagtgattttaagaaaaagagtggttctggaatcaatgttttccagtcccatcccagaacatcagttgtaagataagtacaattggttgtccttgatttcataagtagaacaaacactaaatgtgcctctgagatggccaccccgggcagggacctgtgccttccgccgatgctcagggctccctctggctcccgggtcactcttgtggccccagtgggtggtccctgcagtcatggcctgagtgcgcaggggccaccgcgtggctgctgctgtcctcctccgggacccacggggaccaaggtcacacgttccgtgctgtgaagctgtccagatgtgcctctttggctgggggttctggtggacgtttcaagtggcattttgtacaatgcaggttagaattcaggaatttcaagtatgtgcccgggtctgtcaggtcccagttgcctttctgacggcccccctcagagggacggcgatgagcactaaatgcttttttgactattttcctatagattttttttaaaacttttttttcctcctgttccaattgatagctttcttatttaataaattctgtagttcaccgca

SEQ ID NO: 295495 - DNA, 2297 bp, Homo sapiens
gttcaggcacgcgctttcggtgctcggagcggaagcagcggcgagaggctcggaggcgcgggggcggccgagcggcgggcgacgggggcgggcgacgggggcgggcgacgcgggccgcggcacgggcggagccggggccatggagccgccgctgccgggctaggcaggtcgtgccccgccgggccggcggcgatgtcgggctaccagcgccgcccgggcgccaccccgctgtcccgagcccggagcctcgccattcccgacgctccagcgttctatgagcgccggtcttgtctcccccagctaaattgtgagcgcccccatggcagggacctggactcccccttcttcggcattcggccggcctttatgtgctatgtgcccagcccggtgctggcttccgtgggagacacagatgacagatttgaagatctggaagaggcaaatccattctcttttagagagtttctgaagaccaagaacctcggcctctcgaaagaggatccggccagcagaatttatgcaaaggaagcctcgaggcattccctgggacttgaccacaactccccaccctcccaaaccggcgggtatggcctggagtatcagcagccatttttcgaggatccgacaggggctggtgacctcctggatgaggaggaggatgaggacaccggatggagtggggcctacctgccgtccgccatcgagcagactcaccccgagagggtccctgccggcacgtcgccctgcagcacatacctttcctttttctccaccccgtcggagctggcagggcctgagtctctgccctcgtgggcgttgagtgacactgattctcgcgtgtctccggcctctccggcagggagtcctagcgcagactttgcggttcatggagagtctctgggagacaggcacctgcggacgctgcagataagttacgacgcactgaaagatgaaaattctaagctgagaagaaagctgaatgaggttcagagcttctctgaagctcaaacagaaatggtgaggacgcttgagcggaagttagaagcaaaaatgatcaaggaggaaagcgactaccacgacctggagtcggtggttcagcaggtggagcagaacctggagctgatgaccaaacgggctgtaaaggcagaaaaccacgtcgtgaaactaaaacaggaaatcagtttgctccaggcgcaggtctccaacttccagcgagagaatgaagccctgcggtgcggccagggtgccagcctgaccgtggtgaagcagaacgccgacgtggccctgcagaacctccgggtggtcatgaacagtgcacaggcttccatcaagcaactggtttccggagctgagacactgaatcttgttgccgaaatccttaaatctatagacagaatttctgaagttaaagacgaggaggaagactcttgaggacccctgggtgttctcagcatgaagctccgtgtataccctgaggtcaccaccgctcgatctaaatgtgcagttgtgtccttaaatatgcagtcttcacccagagtaaagtgttgatcgcaagagtccagtgtcgtgccctcagccagttcttggccaccacaatgggagcagccctggccgagttgtctctgtggtttctatgcagcccttcttggcgaaattcctgcgatcttatagattctaatgagctcttggaagacattgtcataaaagccagtgattttaagaaaaagagtggttctggaatcaatgttttccagtcccatcccagaacatcagttgtaagataagtacaattggttgtccttgatttcataagtagaacaaacactaaatgtgcctctgagatggccaccccgggcagggacctgtgccttccgccgatgctcagggctccctctggctcccgggtcactcttgtggccccagtgggtggtccctgcagtcatggcctgagtgcgcaggggccaccgcgtggctgctgctgtcctcctccgggacccacggggaccaaggtcacacgttccgtgctgtgaagctgtccagatgtgcctctttggctgggggttctggtggacgtttcaagtggcattttgtacaatgcaggttagaattcaggaatttcaagtatgtgcccgggtctgtcaggtcccagttgcctttctgacggcccccctcagagggacggcgatgagcactaaatgcttttttgactattttcctatagattttttttaaaacttttttttcctcctgttccaattgatagctttcttatttaataaattctgtagttcaccgca

SEQ ID NO: 295496 - DNA, 2290 bp, Homo sapiens
gttcaggcacgcgctttcggtgctcggagcggaagcagcggcgagaggctcggaggcgcgggggcggccgagcggcgggcgacgggggcgggcgacgggggcgggcgacgcgggccgcccgggcgccaccccgctgtcccgagcccggagcctcgccattcccgacggtgagcggggcaggggccgagtccagcggtccaggtgggcggcggccgccccggcacgcagtaaagtcgctgttgtcgttgcttccagctccagcgttctatgagcgccggtcttgtctcccccagctaaattgtgagcgcccccatggcagggacctggactcccccttcttcggcattcggccggcctttatgtgctatgtgcccagcccggtgctggcttccgtgggagacacagatgacagatttgaagatctggaagaggcaaatccattctcttttagagagtttctgaagaccaagaacctcggcctctcgaaagaggatccggccagcagaatttatgcaaaggaagcctcgaggcattccctgggacttgaccacaactccccaccctcccaaaccggcgggtatggcctggagtatcagcagccatttttcgaggatccgacaggggctggtgacctcctggatgaggaggaggatgaggacaccggatggagtggggcctacctgccgtccgccatcgagcagactcaccccgagagggtccctgccggcacgtcgccctgcagcacatacctttcctttttctccaccccgtcggagctggcagggcctgagtctctgccctcgtgggcgttgagtgacactgattctcgcgtgtctccggcctctccggcagggagtcctagcgcagactttgcggttcatggagagtctctgggagacaggcacctgcggacgctgcagataagttacgacgcactgaaagatgaaaattctaagctgagaagaaagctgaatgaggttcagagcttctctgaagctcaaacagaaatggtgaggacgcttgagcggaagttagaagcaaaaatgatcaaggaggaaagcgactaccacgacctggagtcggtggttcagcaggtggagcagaacctggagctgatgaccaaacgggctgtaaaggcagaaaaccacgtcgtgaaactaaaacaggaaatcagtttgctccaggcgcaggtctccaacttccagcgagagaatgaagccctgcggtgcggccagggtgccagcctgaccgtggtgaagcagaacgccgacgtggccctgcagaacctccgggtggtcatgaacagtgcacaggcttccatcaagcaactggtttccggagctgagacactgaatcttgttgccgaaatccttaaatctatagacagaatttctgaagttaaagacgaggaggaagactcttgaggacccctgggtgttctcagcatgaagctccgtgtataccctgaggtcaccaccgctcgatctaaatgtgcagttgtgtccttaaatatgcagtcttcacccagagtaaagtgttgatcgcaagagtccagtgtcgtgccctcagccagttcttggccaccacaatgggagcagccctggccgagttgtctctgtggtttctatgcagcccttcttggcgaaattcctgcgatcttatagattctaatgagctcttggaagacattgtcataaaagccagtgattttaagaaaaagagtggttctggaatcaatgttttccagtcccatcccagaacatcagttgtaagataagtacaattggttgtccttgatttcataagtagaacaaacactaaatgtgcctctgagatggccaccccgggcagggacctgtgccttccgccgatgctcagggctccctctggctcccgggtcactcttgtggccccagtgggtggtccctgcagtcatggcctgagtgcgcaggggccaccgcgtggctgctgctgtcctcctccgggacccacggggaccaaggtcacacgttccgtgctgtgaagctgtccagatgtgcctctttggctgggggttctggtggacgtttcaagtggcattttgtacaatgcaggttagaattcaggaatttcaagtatgtgcccgggtctgtcaggtcccagttgcctttctgacggcccccctcagagggacggcgatgagcactaaatgcttttttgactattttcctatagattttttttaaaacttttttttcctcctgttccaattgatagctttcttatttaataaattctgtagttcaccgca

SEQ ID NO: 295497 - DNA, 2385 bp, Homo sapiens
gttcaggcacgcgctttcggtgctcggagcggaagcagcggcgagaggctcggaggcgcgggggcggccgagcggcgggcgacgggggcgggcgacgggggcgggcgacgcgggccgcggcacgggcggagccggggccatggagccgccgctgccgggctaggcaggtcgtgccccgccgggccggcggcgatgtcgggctaccagcgccgcccgggcgccaccccgctgtcccgagcccggagcctcgccattcccgacggtgagcggggcaggggccgagtccagcggtccaggtgggcggcggccgccccggcacgcagtaaagtcgctgttgtcgttgcttccagctccagcgttctatgagcgccggtcttgtctcccccagctaaattgtgagcgcccccatggcagggacctggactcccccttcttcggcattcggccggcctttatgtgctatgtgcccagcccggtgctggcttccgtgggagacacagatgacagatttgaagatctggaagaggcaaatccattctcttttagagagtttctgaagaccaagaacctcggcctctcgaaagaggatccggccagcagaatttatgcaaaggaagcctcgaggcattccctgggacttgaccacaactccccaccctcccaaaccggcgggtatggcctggagtatcagcagccatttttcgaggatccgacaggggctggtgacctcctggatgaggaggaggatgaggacaccggatggagtggggcctacctgccgtccgccatcgagcagactcaccccgagagggtccctgccggcacgtcgccctgcagcacatacctttcctttttctccaccccgtcggagctggcagggcctgagtctctgccctcgtgggcgttgagtgacactgattctcgcgtgtctccggcctctccggcagggagtcctagcgcagactttgcggttcatggagagtctctgggagacaggcacctgcggacgctgcagataagttacgacgcactgaaagatgaaaattctaagctgagaagaaagctgaatgaggttcagagcttctctgaagctcaaacagaaatggtgaggacgcttgagcggaagttagaagcaaaaatgatcaaggaggaaagcgactaccacgacctggagtcggtggttcagcaggtggagcagaacctggagctgatgaccaaacgggctgtaaaggcagaaaaccacgtcgtgaaactaaaacaggaaatcagtttgctccaggcgcaggtctccaacttccagcgagagaatgaagccctgcggtgcggccagggtgccagcctgaccgtggtgaagcagaacgccgacgtggccctgcagaacctccgggtggtcatgaacagtgcacaggcttccatcaagcaactggtttccggagctgagacactgaatcttgttgccgaaatccttaaatctatagacagaatttctgaagttaaagacgaggaggaagactcttgaggacccctgggtgttctcagcatgaagctccgtgtataccctgaggtcaccaccgctcgatctaaatgtgcagttgtgtccttaaatatgcagtcttcacccagagtaaagtgttgatcgcaagagtccagtgtcgtgccctcagccagttcttggccaccacaatgggagcagccctggccgagttgtctctgtggtttctatgcagcccttcttggcgaaattcctgcgatcttatagattctaatgagctcttggaagacattgtcataaaagccagtgattttaagaaaaagagtggttctggaatcaatgttttccagtcccatcccagaacatcagttgtaagataagtacaattggttgtccttgatttcataagtagaacaaacactaaatgtgcctctgagatggccaccccgggcagggacctgtgccttccgccgatgctcagggctccctctggctcccgggtcactcttgtggccccagtgggtggtccctgcagtcatggcctgagtgcgcaggggccaccgcgtggctgctgctgtcctcctccgggacccacggggaccaaggtcacacgttccgtgctgtgaagctgtccagatgtgcctctttggctgggggttctggtggacgtttcaagtggcattttgtacaatgcaggttagaattcaggaatttcaagtatgtgcccgggtctgtcaggtcccagttgcctttctgacggcccccctcagagggacggcgatgagcactaaatgcttttttgactattttcctatagattttttttaaaacttttttttcctcctgttccaattgatagctttcttatttaataaattctgtagttcaccgca

SEQ ID NO: 295498 - DNA, 2147 bp, Homo sapiens
gttcaggcacgcgctttcggtgctcggagcggaagcagcggcgagaggctcggaggcgcgggggcggccgagcggcgggcgacgggggcgggcgacgggggcgggcgacgcgggccgcggcacgggcggagccggggccatggagccgccgctgccgggctaggcaggtcgtgccccgccgggccggcggcgatgtcgggctaccagcgccgcccgggcgccaccccgctgtcccgagcccggagcctcgccattcccgacgatgacagatttgaagatctggaagaggcaaatccattctcttttagagagtttctgaagaccaagaacctcggcctctcgaaagaggatccggccagcagaatttatgcaaaggaagcctcgaggcattccctgggacttgaccacaactccccaccctcccaaaccggcgggtatggcctggagtatcagcagccatttttcgaggatccgacaggggctggtgacctcctggatgaggaggaggatgaggacaccggatggagtggggcctacctgccgtccgccatcgagcagactcaccccgagagggtccctgccggcacgtcgccctgcagcacatacctttcctttttctccaccccgtcggagctggcagggcctgagtctctgccctcgtgggcgttgagtgacactgattctcgcgtgtctccggcctctccggcagggagtcctagcgcagactttgcggttcatggagagtctctgggagacaggcacctgcggacgctgcagataagttacgacgcactgaaagatgaaaattctaagctgagaagaaagctgaatgaggttcagagcttctctgaagctcaaacagaaatggtgaggacgcttgagcggaagttagaagcaaaaatgatcaaggaggaaagcgactaccacgacctggagtcggtggttcagcaggtggagcagaacctggagctgatgaccaaacgggctgtaaaggcagaaaaccacgtcgtgaaactaaaacaggaaatcagtttgctccaggcgcaggtctccaacttccagcgagagaatgaagccctgcggtgcggccagggtgccagcctgaccgtggtgaagcagaacgccgacgtggccctgcagaacctccgggtggtcatgaacagtgcacaggcttccatcaagcaactggtttccggagctgagacactgaatcttgttgccgaaatccttaaatctatagacagaatttctgaagttaaagacgaggaggaagactcttgaggacccctgggtgttctcagcatgaagctccgtgtataccctgaggtcaccaccgctcgatctaaatgtgcagttgtgtccttaaatatgcagtcttcacccagagtaaagtgttgatcgcaagagtccagtgtcgtgccctcagccagttcttggccaccacaatgggagcagccctggccgagttgtctctgtggtttctatgcagcccttcttggcgaaattcctgcgatcttatagattctaatgagctcttggaagacattgtcataaaagccagtgattttaagaaaaagagtggttctggaatcaatgttttccagtcccatcccagaacatcagttgtaagataagtacaattggttgtccttgatttcataagtagaacaaacactaaatgtgcctctgagatggccaccccgggcagggacctgtgccttccgccgatgctcagggctccctctggctcccgggtcactcttgtggccccagtgggtggtccctgcagtcatggcctgagtgcgcaggggccaccgcgtggctgctgctgtcctcctccgggacccacggggaccaaggtcacacgttccgtgctgtgaagctgtccagatgtgcctctttggctgggggttctggtggacgtttcaagtggcattttgtacaatgcaggttagaattcaggaatttcaagtatgtgcccgggtctgtcaggtcccagttgcctttctgacggcccccctcagagggacggcgatgagcactaaatgcttttttgactattttcctatagattttttttaaaacttttttttcctcctgttccaattgatagctttcttatttaataaattctgtagttcaccgca

SEQ ID NO: 295499 - DNA, 2601 bp, Homo sapiens
gttcaggcacgcgctttcggtgctcggagcggaagcagcggcgagaggctcggaggcgcgggggcggccgagcggcgggcgacgggggcgggcgacgggggcgggcgacgcgggccgcggcacgggcggagccggggccatggagccgccgctgccgggctaggcaggtcgtgccccgccgggccggcggcgatgtcgggctaccagcgccgcccgggcgccaccccgctgtcccgagcccggagcctcgccattcccgacggtgagcggggcaggggccgagtccagcggtccaggtgggcggcggccgccccggcacgcagtaaagtcgctgttgtcgttgcttccagctccagcgttctatgagcgccggtcttgtctcccccagctaaattgtgagcgcccccatggcagggacctggactcccccttcttcggcattcggccggcctttatgtgctatgtgcccagcccggtgctggcttccgtgggagacacaggtgagagacgagggcgccggccccggggacgcttccagttcccgcgccacgtgtggcacctccgctgcagcacgagctcgtccattgacccatcaatgtgcagagcgctcactgcgtgccaggcactcggaattcaaaggcggagtcccctgctaggagctcacagtctggttgcggggagacctcccccaagacagacagttccagtacaggatgatgacagatttgaagatctggaagaggcaaatccattctcttttagagagtttctgaagaccaagaacctcggcctctcgaaagaggatccggccagcagaatttatgcaaaggaagcctcgaggcattccctgggacttgaccacaactccccaccctcccaaaccggcgggtatggcctggagtatcagcagccatttttcgaggatccgacaggggctggtgacctcctggatgaggaggaggatgaggacaccggatggagtggggcctacctgccgtccgccatcgagcagactcaccccgagagggtccctgccggcacgtcgccctgcagcacatacctttcctttttctccaccccgtcggagctggcagggcctgagtctctgccctcgtgggcgttgagtgacactgattctcgcgtgtctccggcctctccggcagggagtcctagcgcagactttgcggttcatggagagtctctgggagacaggcacctgcggacgctgcagataagttacgacgcactgaaagatgaaaattctaagctgagaagaaagctgaatgaggttcagagcttctctgaagctcaaacagaaatggtgaggacgcttgagcggaagttagaagcaaaaatgatcaaggaggaaagcgactaccacgacctggagtcggtggttcagcaggtggagcagaacctggagctgatgaccaaacgggctgtaaaggcagaaaaccacgtcgtgaaactaaaacaggaaatcagtttgctccaggcgcaggtctccaacttccagcgagagaatgaagccctgcggtgcggccagggtgccagcctgaccgtggtgaagcagaacgccgacgtggccctgcagaacctccgggtggtcatgaacagtgcacaggcttccatcaagcaactggtttccggagctgagacactgaatcttgttgccgaaatccttaaatctatagacagaatttctgaagttaaagacgaggaggaagactcttgaggacccctgggtgttctcagcatgaagctccgtgtataccctgaggtcaccaccgctcgatctaaatgtgcagttgtgtccttaaatatgcagtcttcacccagagtaaagtgttgatcgcaagagtccagtgtcgtgccctcagccagttcttggccaccacaatgggagcagccctggccgagttgtctctgtggtttctatgcagcccttcttggcgaaattcctgcgatcttatagattctaatgagctcttggaagacattgtcataaaagccagtgattttaagaaaaagagtggttctggaatcaatgttttccagtcccatcccagaacatcagttgtaagataagtacaattggttgtccttgatttcataagtagaacaaacactaaatgtgcctctgagatggccaccccgggcagggacctgtgccttccgccgatgctcagggctccctctggctcccgggtcactcttgtggccccagtgggtggtccctgcagtcatggcctgagtgcgcaggggccaccgcgtggctgctgctgtcctcctccgggacccacggggaccaaggtcacacgttccgtgctgtgaagctgtccagatgtgcctctttggctgggggttctggtggacgtttcaagtggcattttgtacaatgcaggttagaattcaggaatttcaagtatgtgcccgggtctgtcaggtcccagttgcctttctgacggcccccctcagagggacggcgatgagcactaaatgcttttttgactattttcctatagattttttttaaaacttttttttcctcctgttccaattgatagctttcttatttaataaattctgtagttcaccgca

SEQ ID NO: 295500 - DNA, 1689 bp, Homo sapiens
agagtggccccggagccagaggaccctgagcatcgcgaaagcacaggtcctgcccgggtgccatctcagagcacatttagtgtttgttctacttatgaaatcaaggaccacccattgtacttatcgtacaactgatgttctgggatgggactggaaaacattgattccagaaccactgctttgtcttaaaatcactggcttttatgacaatgtcttccctgattctcgcgtgtctccggcctctccggcagggagtcctagcgcagactttgcggttcatggagagtctctgggagacaggcacctgcggacgctgcagataagttacgacgcactgaaagatgaaaattctaagctgagaagaaagctgaatgaggttcagagcttctctgaagctcaaacagaaatggtgaggacgcttgagcggaagttagaagcaaaaatgatcaaggaggaaagcgactaccacgacctggagtcggtggttcagcaggtggagcagaacctggagctgatgaccaaacgggctgtaaaggcagaaaaccacgtcgtgaaactaaaacaggaaatcagtttgctccaggcgcaggtctccaacttccagcgagagaatgaagccctgcggtgcggccagggtgccagcctgaccgtggtgaagcagaacgccgacgtggccctgcagaacctccgggtggtcatgaacagtgcacaggcttccatcaagcaactggtttccggagctgagacactgaatcttgttgccgaaatccttaaatctatagacagaatttctgaagttaaagacgaggaggaagactcttgaggacccctgggtgttctcagcatgaagctccgtgtataccctgaggtcaccaccgctcgatctaaatgtgcagttgtgtccttaaatatgcagtcttcacccagagtaaagtgttgatcgcaagagtccagtgtcgtgccctcagccagttcttggccaccacaatgggagcagccctggccgagttgtctctgtggtttctatgcagcccttcttggcgaaattcctgcgatcttatagattctaatgagctcttggaagacattgtcataaaagccagtgattttaagaaaaagagtggttctggaatcaatgttttccagtcccatcccagaacatcagttgtaagataagtacaattggttgtccttgatttcataagtagaacaaacactaaatgtgcctctgagatggccaccccgggcagggacctgtgccttccgccgatgctcagggctccctctggctcccgggtcactcttgtggccccagtgggtggtccctgcagtcatggcctgagtgcgcaggggccaccgcgtggctgctgctgtcctcctccgggacccacggggaccaaggtcacacgttccgtgctgtgaagctgtccagatgtgcctctttggctgggggttctggtggacgtttcaagtggcattttgtacaatgcaggttagaattcaggaatttcaagtatgtgcccgggtctgtcaggtcccagttgcctttctgacggcccccctcagagggacggcgatgagcactaaatgcttttttgactattttcctatagattttttttaaaacttttttttcctcctgttccaattgatagctttcttatttaataaattctgtagttcaccgca

SEQ ID NO: 295501 - DNA, 2496 bp, Homo sapiens
gttcaggcacgcgctttcggtgctcggagcggaagcagcggcgagaggctcggaggcgcgggggcggccgagcggcgggcgacgggggcgggcgacgggggcgggcgacgcgggccgcggcacgggcggagccggggccatggagccgccgctgccgggctaggcaggtcgtgccccgccgggccggcggcgatgtcgggctaccagcgccgcccgggcgccaccccgctgtcccgagcccggagcctcgccattcccgacgctccagcgttctatgagcgccggtcttgtctcccccagctaaattgtgagcgcccccatggcagggacctggactcccccttcttcggcattcggccggcctttatgtgctatgtgcccagcccggtgctggcttccgtgggagacacagatgacagatttgaagatctggaagaggcaaatccattctcttttagagagtttctgaagaccaagaacctcggcctctcgaaagaggatccggccagcagaatttatgcaaaggaagcctcgaggcattccctgggacttgaccacaactccccaccctcccaaaccggcgggtatggcctggagtatcagcagccatttttcgaggatccgacaggggctggtgacctcctggatgaggaggaggatgaggacaccggatggagtggggcctacctgccgtccgccatcgagcagactcaccccgagagggtccctgccggcacgtcgccctgcagcacatacctttcctttttctccaccccgtcggagctggcagggcctgagtctctgccctcgtgggcgttgagtgacactgattctcgcgtgtctccggcctctccggcagggagtcctagcgcagactttgcggttcatggagagtctctgggagacaggcacctgcggacgctgcagataagttacgacgcagtaagtgagcctcacggcgccctctggcacagcgcctgtccgagcggcttctcccggggagaacctggagccatcctacctcttgggtggcctggtttgatttccaggacaaggcgatttgcgtgacagcctgctatccactttccctttgactttgcttctggttacacgtgggaatagaaccggctaaagaggactgctgaaagatgaaaattctaagctgagaagaaagctgaatgaggttcagagcttctctgaagctcaaacagaaatggtgaggacgcttgagcggaagttagaagcaaaaatgatcaaggaggaaagcgactaccacgacctggagtcggtggttcagcaggtggagcagaacctggagctgatgaccaaacgggctgtaaaggcagaaaaccacgtcgtgaaactaaaacaggaaatcagtttgctccaggcgcaggtctccaacttccagcgagagaatgaagccctgcggtgcggccagggtgccagcctgaccgtggtgaagcagaacgccgacgtggccctgcagaacctccgggtggtcatgaacagtgcacaggcttccatcaagcaactggtttccggagctgagacactgaatcttgttgccgaaatccttaaatctatagacagaatttctgaagttaaagacgaggaggaagactcttgaggacccctgggtgttctcagcatgaagctccgtgtataccctgaggtcaccaccgctcgatctaaatgtgcagttgtgtccttaaatatgcagtcttcacccagagtaaagtgttgatcgcaagagtccagtgtcgtgccctcagccagttcttggccaccacaatgggagcagccctggccgagttgtctctgtggtttctatgcagcccttcttggcgaaattcctgcgatcttatagattctaatgagctcttggaagacattgtcataaaagccagtgattttaagaaaaagagtggttctggaatcaatgttttccagtcccatcccagaacatcagttgtaagataagtacaattggttgtccttgatttcataagtagaacaaacactaaatgtgcctctgagatggccaccccgggcagggacctgtgccttccgccgatgctcagggctccctctggctcccgggtcactcttgtggccccagtgggtggtccctgcagtcatggcctgagtgcgcaggggccaccgcgtggctgctgctgtcctcctccgggacccacggggaccaaggtcacacgttccgtgctgtgaagctgtccagatgtgcctctttggctgggggttctggtggacgtttcaagtggcattttgtacaatgcaggttagaattcaggaatttcaagtatgtgcccgggtctgtcaggtcccagttgcctttctgacggcccccctcagagggacggcgatgagcactaaatgcttttttgactattttcctatagattttttttaaaacttttttttcctcctgttccaattgatagctttcttatttaataaattctgtagttcaccgca

SEQ ID NO: 295502 - DNA, 2997 bp, Homo sapiens
gttcaggcacgcgctttcggtgctcggagcggaagcagcggcgagaggctcggaggcgcgggggcggccgagcggcgggcgacgggggcgggcgacgggggcgggcgacgcgggccgcggcacgggcggagccggggccatggagccgccgctgccgggctaggcaggtcgtgccccgccgggccggcggcgatgtcgggctaccagcgccgcccgggcgccaccccgctgtcccgagcccggagcctcgccattcccgacgctccagcgttctatgagcgccggtcttgtctcccccagctaaattgtgagcgcccccatggcagggacctggactcccccttcttcggcattcggccggcctttatgtgctatgtgcccagcccggtgctggcttccgtgggagacacagatgacagatttgaagatctggaagaggcaaatccattctcttttagagagtttctgaagaccaagaacctcggcctctcgaaagaggatccggccagcagaatttatgcaaaggaagcctcgaggcattccctgggacttgaccacaactccccaccctcccaaaccggcgggtatggcctggagtatcagcagccatttttcgaggatccgacaggggctggtgacctcctggatgaggaggaggatgaggacaccggatggagtggggcctacctgccgtccgccatcgagcagactcaccccgagagggtccctgccggcacgtcgccctgcagcacatacctttcctttttctccaccccgtcggagctggcagggcctgagtctctgccctcgtgggcgttgagtgacactgattctcgcgtgtctccggcctctccggcagggagtcctagcgcagactttgcggttcatggagagtctctgggagacaggcacctgcggacgctgcagataagttacgacgcactgaaagatgaaaattctaagctgagaagaaagctgaatgaggttcagagcttctctgaagctcaaacagaaatgtatgtaagcttttagttaggaatgcaatccacaacatctaatacacagggaaatccgtttttaaatgataatgaagtaatcagagtcaaaccagatctgggttttattgtatataaatgttcagcatcaaacacatttctgtgttctgcctaaaagtttattttgagacagtcttgccgtgtcacccaggctcgggtgcagtggcgcaatcacggctcactgcagccttgacctccttggctccagcaatcctcccatctcagcctcctgagtagctgggacacaggcgtttgcactgcacctggctaatttttaaatcttatttttgtagagacagggtctcactatgttgcccaggcttgtctcaaactcctcggctcaaggaatcctcctgcctcaggctcctaaagtgttgggattataggcatgagccacggcgcctggccaaggtttattttaaactttaggcaaaaagccaccaaacaccttgttggagcagcagtgctgtgagagccgctccctgcacgcctgcctggtggctacaggtccaggcctgaggctgccgctgcctcccctctgtgcctgagacccattccatcacaggctcttagcgggttttatctggctcatgaggtatctttttgtagtcctcttaaaagtagccacagaaattaacaactcgggtttttctttaacaagggtgaggacgcttgagcggaagttagaagcaaaaatgatcaaggaggaaagcgactaccacgacctggagtcggtggttcagcaggtggagcagaacctggagctgatgaccaaacgggctgtaaaggcagaaaaccacgtcgtgaaactaaaacaggaaatcagtttgctccaggcgcaggtctccaacttccagcgagagaatgaagccctgcggtgcggccagggtgccagcctgaccgtggtgaagcagaacgccgacgtggccctgcagaacctccgggtggtcatgaacagtgcacaggcttccatcaagcaactggtttccggagctgagacactgaatcttgttgccgaaatccttaaatctatagacagaatttctgaagttaaagacgaggaggaagactcttgaggacccctgggtgttctcagcatgaagctccgtgtataccctgaggtcaccaccgctcgatctaaatgtgcagttgtgtccttaaatatgcagtcttcacccagagtaaagtgttgatcgcaagagtccagtgtcgtgccctcagccagttcttggccaccacaatgggagcagccctggccgagttgtctctgtggtttctatgcagcccttcttggcgaaattcctgcgatcttatagattctaatgagctcttggaagacattgtcataaaagccagtgattttaagaaaaagagtggttctggaatcaatgttttccagtcccatcccagaacatcagttgtaagataagtacaattggttgtccttgatttcataagtagaacaaacactaaatgtgcctctgagatggccaccccgggcagggacctgtgccttccgccgatgctcagggctccctctggctcccgggtcactcttgtggccccagtgggtggtccctgcagtcatggcctgagtgcgcaggggccaccgcgtggctgctgctgtcctcctccgggacccacggggaccaaggtcacacgttccgtgctgtgaagctgtccagatgtgcctctttggctgggggttctggtggacgtttcaagtggcattttgtacaatgcaggttagaattcaggaatttcaagtatgtgcccgggtctgtcaggtcccagttgcctttctgacggcccccctcagagggacggcgatgagcactaaatgcttttttgactattttcctatagattttttttaaaacttttttttcctcctgttccaattgatagctttcttatttaataaattctgtagttcaccgca

SEQ ID NO: 295503 - DNA, 3169 bp, Homo sapiens
gttcaggcacgcgctttcggtgctcggagcggaagcagcggcgagaggctcggaggcgcgggggcggccgagcggcgggcgacgggggcgggcgacgggggcgggcgacgcgggccgcggcacgggcggagccggggccatggagccgccgctgccgggctaggcaggtcgtgccccgccgggccggcggcgatgtcgggctaccagcgccgcccgggcgccaccccgctgtcccgagcccggagcctcgccattcccgacgctccagcgttctatgagcgccggtcttgtctcccccagctaaattgtgagcgcccccatggcagggacctggactcccccttcttcggcattcggccggcctttatgtgctatgtgcccagcccggtgctggcttccgtgggagacacagatgacagatttgaagatctggaagaggcaaatccattctcttttagagagtttctgaagaccaagaacctcggcctctcgaaagaggatccggccagcagaatttatgcaaaggaagcctcgaggcattccctgggacttgaccacaactccccaccctcccaaaccggcgggtatggcctggagtatcagcagccatttttcgaggatccgacaggggctggtgacctcctggatgaggaggaggatgaggacaccggatggagtggggcctacctgccgtccgccatcgagcagactcaccccgagagggtccctgccggcacgtcgccctgcagcacatacctttcctttttctccaccccgtcggagctggcagggcctgagtctctgccctcgtgggcgttgagtgacactgattctcgcgtgtctccggcctctccggcagggagtcctagcgcagactttgcggttcatggagagtctctgggagacaggcacctgcggacgctgcagataagttacgacgcactgaaagatgaaaattctaagctgagaagaaagctgaatgaggttcagagcttctctgaagctcaaacagaaatggtgaggacgcttgagcggaagttagaagcaaaaatgatcaaggaggaaagcgactaccacgacctggagtcggtggttcagcaggtggagcagaacctggagctgatgaccaaacgggctgtaaaggcagaaaaccacgtcgtgaaactaaaacaggaaatcagtttgctccaggcgcaggtctccaacttccagcgagagaatgaagccctgcggtgcggccagggtgccagcctgaccgtggtgaagcagaacgccgacgtggccctgcagaacctccgggtggtcatgaacagtgcacaggcttccatcaagcaactggtttccggagctgagacactgaatcttgttgccgaaatccttaaatctatagacagaatttctgaagttaaagacgaggaggaagactcttgaggacccctgggtgttctcagcatgaagctccgtgtataccctgaggtcaccaccgctcgatctaaatgtgcagttgtgtccttaaatatgcagtcttcacccagagtaaagtgttgatcgcaagagtccagtgtcgtgccctcagccagttcttggccaccacaatgggagcagccctggccgagttgtctctgtggtttctatgcagcccttcttggcgaaattcctgcgatcttatagattctaatgagctcttggaagacattgtcataaaagccagtgattttaagaaaaagagtggttctggaatcaatgttttccagtcccatcccagaacatcagttgtaagataagtacaattggttgtccttgatttcataagtagaacaaacactaaatgtgcctctgagatggccaccccgggcagggacctgtgccttccgccgatgctcagggctccctctggctcccgggtcactcttgtggccccagtgggtggtccctgcagtcatggcctgagtgcgcaggggccaccgcgtggctgctgctgtcctcctccgggacccacggggaccaaggtcacacgttccgtgctgtgaagctgtccagatgtgcctctttggctgggggttctggtggacgtttcaagtggcattttgtacaatgcaggttagaattcaggaatttcaagtatgtgcccgggtctgtcaggtcccagttgcctttctgacggcccccctcagagggacggcgatgagcactaaatgcttttttgactattttcctatagattttttttaaaacttttttttcctcctgttccaattgatagctttcttatttaataaattctgtagttcaccgcaaaaaaaaaaaaaaaaaaaaaaaaaaaaaaaccccggagggcctccatatcgcgcggggggcgggaaaaagggcgtattgcgaagggcgccatgggcgccaaaacgtgtgttcccgtggaccccagctctttcgtgtgccccaagggggcggaaaaccggcgcggcgtcaccccataaaggggacgcggaatataattgcggaataaagcgcggtgtttaaccctcgtctttatactctctctggtcagaaacaaaacgggcaacgagagaggagaggagaagagagaggagacggaaagaagcggggggagaaccgacgaactatggtgggccacaagaaacgattgatggtagccgagaaggagaacggatcataaaaacaaagggtagtggggaagagataagatagaatgacaaagcgtaatatataatgaagagagaggcagaaaagaagtgtaaatgaaggcgcgagcaagaggttttaagtagagataaaatacgaataagaacatgaaacaaatggaataagataaagaagagggagaaggaaagaacgaagataataaattagatagaaaagaagaggagaaccccaagagagaggaaacagcggagaggacgcaaaaaaagagcgatgaaaaaaagaaacaatgcgagaagaagacgaaagcggacgcgataaaaaagactagagggacgcgacgaagacaccacacccaacaaaagagcaggacgacaaaaaaaaagaagacgagaagggagagacgaaacaagacaacagggagagaacaacaacaacacaagacgagaaaacaaccccggcgacgagagagagcagagaaacgggagaaaaggacccgcaaaggaggcgg

SEQ ID NO: 295504 - DNA, 2270 bp, Homo sapiens
gttcaggcacgcgctttcggtgctcggagcggaagcagcggcgagaggctcggaggcgcgggggcggccgagcggcgggcgacgggggcgggcgacgggggcgggcgacgcgggccgcggcacgggcggagccggggccatggagccgccgctgccgggctaggcaggtcgtgccccgccgggccggcggcgatgtcgggctaccagcgccgcccgggcgccaccccgctgtcccgagcccggagcctcgccattcccgacgctccagcgttctatgagcgccggtcttgtctcccccagctaaattgtgagcgcccccatggcagggacctggactcccccttcttcggcattcggccggcctttatgtgctatgtgcccagcccggtgctggcttccgtgggagacacagatgacagatttgaagatctggaagaggcaaatccattctcttttagagagtttctgaagaccaagaacctcggcctctcgaaagaggatccggccagcagaatttatgcaaaggaagcctcgaggcattccctgggacttgaccacaactccccaccctcccaaaccggcgggtatggcctggagtatcagcagccatttttcgaggatccgacaggggctggtgacctcctggatgaggaggaggatgaggacaccggatggagtggggcctacctgccgtccgccatcgagcagactcaccccgagagggtccctgccggcacgtcgccctgcagcacatacctttcctttttctccaccccgtcggagctggcagggcctgagtctctgccctcgtgggcgttgagtgacactgattctcgcgtgtctccggcctctccggcagggagtcctagcgcagactttgcggttcatggagagtctctgggagacaggcacctgcggacgctgcagataagttacgacgcactgaaagatgaaaattctaagctgagaagaaagctgaatgaggttcagagcttctctgaagctcaaacagaaatggtgaggacgcttgagcggaagttagaagcaaaaatgatcaaggaggaaagcgactaccacgacctggagtcggtggttcagcagaaacgggctgtaaaggcagaaaaccacgtcgtgaaactaaaacaggaaatcagtttgctccaggcgcaggtctccaacttccagcgagagaatgaagccctgcggtgcggccagggtgccagcctgaccgtggtgaagcagaacgccgacgtggccctgcagaacctccgggtggtcatgaacagtgcacaggcttccatcaagcaactggtttccggagctgagacactgaatcttgttgccgaaatccttaaatctatagacagaatttctgaagttaaagacgaggaggaagactcttgaggacccctgggtgttctcagcatgaagctccgtgtataccctgaggtcaccaccgctcgatctaaatgtgcagttgtgtccttaaatatgcagtcttcacccagagtaaagtgttgatcgcaagagtccagtgtcgtgccctcagccagttcttggccaccacaatgggagcagccctggccgagttgtctctgtggtttctatgcagcccttcttggcgaaattcctgcgatcttatagattctaatgagctcttggaagacattgtcataaaagccagtgattttaagaaaaagagtggttctggaatcaatgttttccagtcccatcccagaacatcagttgtaagataagtacaattggttgtccttgatttcataagtagaacaaacactaaatgtgcctctgagatggccaccccgggcagggacctgtgccttccgccgatgctcagggctccctctggctcccgggtcactcttgtggccccagtgggtggtccctgcagtcatggcctgagtgcgcaggggccaccgcgtggctgctgctgtcctcctccgggacccacggggaccaaggtcacacgttccgtgctgtgaagctgtccagatgtgcctctttggctgggggttctggtggacgtttcaagtggcattttgtacaatgcaggttagaattcaggaatttcaagtatgtgcccgggtctgtcaggtcccagttgcctttctgacggcccccctcagagggacggcgatgagcactaaatgcttttttgactattttcctatagattttttttaaaacttttttttcctcctgttccaattgatagctttcttatttaataaattctgtagttcaccgca

SEQ ID NO: 295505 - DNA, 2339 bp, Homo sapiens
gttcaggcacgcgctttcggtgctcggagcggaagcagcggcgagaggctcggaggcgcgggggcggccgagcggcgggcgacgggggcgggcgacgggggcgggcgacgcgggccgcggcacgggcggagccggggccatggagccgccgctgccgggctaggcaggtcgtgccccgccgggccggcggcgatgtcgggctaccagcgccgcccgggcgccaccccgctgtcccgagcccggagcctcgccattcccgacgctccagcgttctatgagcgccggtcttgtctcccccagctaaattgtgagcgcccccatggcagggacctggactcccccttcttcggcattcggccggcctttatgtgctatgtgcccagcccggtgctggcttccgtgggagacacagatgacagatttgaagatctggaagaggcaaatccattctcttttagagagtttctgaagaccaagaacctcggcctctcgaaagaggatccggccagcagaatttatgcaaaggaagcctcgaggcattccctgggacttgaccacaactccccaccctcccaaaccggcgggtatggcctggagtatcagcagccatttttcgaggatccgacaggggctggtgacctcctggatgaggaggaggatgaggacaccggatggagtggggcctacctgccgtccgccatcgagcagactcaccccgagagggtccctgccggcacgtcgccctgcagcacatacctttcctttttctccaccccgtcggagctggcagggcctgagtctctgccctcgtgggcgttgagtgacactgattctcgcgtgtctccggcctctccggcagggagtcctagcgcagactttgcggttcatggagagtctctgggagacaggcacctgcggacgctgcagataagttacgacgcactgaaagatgaaaattctaagctgagaagaaagctgaatgaggttcagagcttctctgaagctcaaacagaaatggtgaggacgcttgagcggaagttagaagcaaaaatgatcaaggaggaaagcgactaccacgacctggagtcggtggttcagcaggtggagcagaacctggagctgatgaccaaacgggctgtaaaggcagaaaaccacgtcgtgaaactaaaacaggaaatcagtttgctccaggcgcaggtctccaacttccagcgagagaatgaagccctgcggtgcggccagggtgccagcctgaccgtggtgaagcagaacgccgacgtggccctgcagaacctccgggtggtcatgaacagtgcacaggcttccatcaagtgagtgcctgggaggcaccgggaagcctggcggggaaaggggcaactggtttccggagctgagacactgaatcttgttgccgaaatccttaaatctatagacagaatttctgaagttaaagacgaggaggaagactcttgaggacccctgggtgttctcagcatgaagctccgtgtataccctgaggtcaccaccgctcgatctaaatgtgcagttgtgtccttaaatatgcagtcttcacccagagtaaagtgttgatcgcaagagtccagtgtcgtgccctcagccagttcttggccaccacaatgggagcagccctggccgagttgtctctgtggtttctatgcagcccttcttggcgaaattcctgcgatcttatagattctaatgagctcttggaagacattgtcataaaagccagtgattttaagaaaaagagtggttctggaatcaatgttttccagtcccatcccagaacatcagttgtaagataagtacaattggttgtccttgatttcataagtagaacaaacactaaatgtgcctctgagatggccaccccgggcagggacctgtgccttccgccgatgctcagggctccctctggctcccgggtcactcttgtggccccagtgggtggtccctgcagtcatggcctgagtgcgcaggggccaccgcgtggctgctgctgtcctcctccgggacccacggggaccaaggtcacacgttccgtgctgtgaagctgtccagatgtgcctctttggctgggggttctggtggacgtttcaagtggcattttgtacaatgcaggttagaattcaggaatttcaagtatgtgcccgggtctgtcaggtcccagttgcctttctgacggcccccctcagagggacggcgatgagcactaaatgcttttttgactattttcctatagattttttttaaaacttttttttcctcctgttccaattgatagctttcttatttaataaattctgtagttcaccgca

SEQ ID NO: 295506 - DNA, 2399 bp, Homo sapiens
gttcaggcacgcgctttcggtgctcggagcggaagcagcggcgagaggctcggaggcgcgggggcggccgagcggcgggcgacgggggcgggcgacgggggcgggcgacgcgggccgcggcacgggcggagccggggccatggagccgccgctgccgggctaggcaggtcgtgccccgccgggccggcggcgatgtcgggctaccagcgccgcccgggcgccaccccgctgtcccgagcccggagcctcgccattcccgacggtgagcggggcaggggccgagtccagcggtccaggtgggcggcggccgccccggcacgcagtaaagtcgctgttgtcgttgcttccagctccagcgttctatgagcgccggtcttgtctcccccagctaaattgtgagcgcccccatggcagggacctggactcccccttcttcggcattcggccggcctttatgtgctatgtgcccagcccggtgctggcttccgtgggagacacaggtgagagacgagggcgccggccccggggacgcttccagttcccgcgccacgtgtggcacctccgctgcagcacgagctcgtccattgacccatcaatgtgcagagcgctcactgcgtgccaggcactcggaattcaaaggcggagtcccctgctaggagctcacagtctggttgcggggagacctcccccaagacagacagttccagtacaggatgatgacagatttgaagatctggaagaggcaaatccattctcttttagagagtttctgaagaccaagaacctcggcctcccaaagtgctgggattacaggcgcgagccactgcccccggcctctgagtaaaattaactggcatctgtgaccacaggtctttgaaaagtgcctgcctccgtctgtggtctccctctgtagtggctgcaggtggatgctgcactgacccagcatctctgcttatcaggaggctctggagccacaccgcagaagcacacgcccttttgagccagacatgctgactttctaataaggatgttctctctccacagctgaaagatgaaaattctaagctgagaagaaagctgaatgaggttcagagcttctctgaagctcaaacagaaatggtgaggacgcttgagcggaagttagaagcaaaaatgatcaaggaggaaagcgactaccacgacctggagtcggtggttcagcaggtggagcagaacctggagctgatgaccaaacgggctgtaaaggcagaaaaccacgtcgtgaaactaaaacaggaaatcagtttgctccaggcgcaggtctccaacttccagcgagagaatgaagccctgcggtgcggccagggtgccagcctgaccgtggtgaagcagaacgccgacgtggccctgcagaacctccgggtggtcatgaacagtgcacaggcttccatcaagcaactggtttccggagctgagacactgaatcttgttgccgaaatccttaaatctatagacagaatttctgaagttaaagacgaggaggaagactcttgaggacccctgggtgttctcagcatgaagctccgtgtataccctgaggtcaccaccgctcgatctaaatgtgcagttgtgtccttaaatatgcagtcttcacccagagtaaagtgttgatcgcaagagtccagtgtcgtgccctcagccagttcttggccaccacaatgggagcagccctggccgagttgtctctgtggtttctatgcagcccttcttggcgaaattcctgcgatcttatagattctaatgagctcttggaagacattgtcataaaagccagtgattttaagaaaaagagtggttctggaatcaatgttttccagtcccatcccagaacatcagttgtaagataagtacaattggttgtccttgatttcataagtagaacaaacactaaatgtgcctctgagatggccaccccgggcagggacctgtgccttccgccgatgctcagggctccctctggctcccgggtcactcttgtggccccagtgggtggtccctgcagtcatggcctgagtgcgcaggggccaccgcgtggctgctgctgtcctcctccgggacccacggggaccaaggtcacacgttccgtgctgtgaagctgtccagatgtgcctctttggctgggggttctggtggacgtttcaagtggcattttgtacaatgcaggttagaattcaggaatttcaagtatgtgcccgggtctgtcaggtcccagttgcctttctgacggcccccctcagagggacggcgatgagcactaaatgcttttttgactattttcctatagattttttttaaaacttttttttcctcctgttccaattgatagctttcttatttaataaattctgtagttcaccgca

SEQ ID NO: 295507 - DNA, 2645 bp, Homo sapiens
gttcaggcacgcgctttcggtgctcggagcggaagcagcggcgagaggctcggaggcgcgggggcggccgagcggcgggcgacgggggcgggcgacgggggcgggcgacgcgggccgcggcacgggcggagccggggccatggagccgccgctgccgggctaggcaggtcgtgccccgccgggccggcggcgatgtcgggctaccagcgccgcccgggcgccaccccgctgtcccgagcccggagcctcgccattcccgacgatgacagatttgaagatctggaagaggcaaatccattctcttttagagagtttctgaagaccaagaacctcggcctcccaaagtgctgggattacaggcgcgagccactgcccccggcctctgagtaaaattaactggcatctgtgaccacaggtctttgaaaagtgcctgcctccgtctgtggtctccctctgtagtggctgcaggtggatgctgcactgacccagcatctctgcttatcaggaggctctggagccacaccgcagaagcacacgcccttttgagccagacatgctgactttctaataaggatgttctctctccacagctgaaagatgaaaattctaagctgagaagaaagctgaatgaggttcagagcttctctgaagctcaaacagaaatgtatgtaagcttttagttaggaatgcaatccacaacatctaatacacagggaaatccgtttttaaatgataatgaagtaatcagagtcaaaccagatctgggttttattgtatataaatgttcagcatcaaacacatttctgtgttctgcctaaaagtttattttgagacagtcttgccgtgtcacccaggctcgggtgcagtggcgcaatcacggctcactgcagccttgacctccttggctccagcaatcctcccatctcagcctcctgagtagctgggacacaggcgtttgcactgcacctggctaatttttaaatcttatttttgtagagacagggtctcactatgttgcccaggcttgtctcaaactcctcggctcaaggaatcctcctgcctcaggctcctaaagtgttgggattataggcatgagccacggcgcctggccaaggtttattttaaactttaggcaaaaagccaccaaacaccttgttggagcagcagtgctgtgagagccgctccctgcacgcctgcctggtggctacaggtccaggcctgaggctgccgctgcctcccctctgtgcctgagacccattccatcacaggctcttagcgggttttatctggctcatgaggtatctttttgtagtcctcttaaaagtagccacagaaattaacaactcgggtttttctttaacaagggtgaggacgcttgagcggaagttagaagcaaaaatgatcaaggaggaaagcgactaccacgacctggagtcggtggttcagcaggtggagcagaacctggagctgatgaccaaacgggctgtaaaggcagaaaaccacgtcgtgaaactaaaacaggaaatcagtttgctccaggcgcaggtctccaacttccagcgagagaatgaagccctgcggtgcggccagggtgccagcctgaccgtggtgaagcagaacgccgacgtggccctgcagaacctccgggtggtcatgaacagtgcacaggcttccatcaagcaactggtttccggagctgagacactgaatcttgttgccgaaatccttaaatctatagacagaatttctgaagttaaagacgaggaggaagactcttgaggacccctgggtgttctcagcatgaagctccgtgtataccctgaggtcaccaccgctcgatctaaatgtgcagttgtgtccttaaatatgcagtcttcacccagagtaaagtgttgatcgcaagagtccagtgtcgtgccctcagccagttcttggccaccacaatgggagcagccctggccgagttgtctctgtggtttctatgcagcccttcttggcgaaattcctgcgatcttatagattctaatgagctcttggaagacattgtcataaaagccagtgattttaagaaaaagagtggttctggaatcaatgttttccagtcccatcccagaacatcagttgtaagataagtacaattggttgtccttgatttcataagtagaacaaacactaaatgtgcctctgagatggccaccccgggcagggacctgtgccttccgccgatgctcagggctccctctggctcccgggtcactcttgtggccccagtgggtggtccctgcagtcatggcctgagtgcgcaggggccaccgcgtggctgctgctgtcctcctccgggacccacggggaccaaggtcacacgttccgtgctgtgaagctgtccagatgtgcctctttggctgggggttctggtggacgtttcaagtggcattttgtacaatgcaggttagaattcaggaatttcaagtatgtgcccgggtctgtcaggtcccagttgcctttctgacggcccccctcagagggacggcgatgagcactaaatgcttttttgactattttcctatagattttttttaaaacttttttttcctcctgttccaattgatagctttcttatttaataaattctgtagttcaccgca

SEQ ID NO: 295508 - DNA, 1259 bp, Homo sapiens
ccctcctgctccctgggttggggcccgtgtccggtatgaatgtgaggacatcagtgatgctttttgtggtttttcttttttgggtaacagaaacgggctgtaaaggcagaaaaccacgtcgtgaaactaaaacaggaaatcagtttgctccaggcgcaggtctccaacttccagcgagagaatgaagccctgcggtgcggccagggtgccagcctgaccgtggtgaagcagaacgccgacgtggccctgcagaacctccgggtggtcatgaacagtgcacaggcttccatcaagcaactggtttccggagctgagacactgaatcttgttgccgaaatccttaaatctatagacagaatttctgaagttaaagacgaggaggaagactcttgaggacccctgggtgttctcagcatgaagctccgtgtataccctgaggtcaccaccgctcgatctaaatgtgcagttgtgtccttaaatatgcagtcttcacccagagtaaagtgttgatcgcaagagtccagtgtcgtgccctcagccagttcttggccaccacaatgggagcagccctggccgagttgtctctgtggtttctatgcagcccttcttggcgaaattcctgcgatcttatagattctaatgagctcttggaagacattgtcataaaagccagtgattttaagaaaaagagtggttctggaatcaatgttttccagtcccatcccagaacatcagttgtaagataagtacaattggttgtccttgatttcataagtagaacaaacactaaatgtgcctctgagatggccaccccgggcagggacctgtgccttccgccgatgctcagggctccctctggctcccgggtcactcttgtggccccagtgggtggtccctgcagtcatggcctgagtgcgcaggggccaccgcgtggctgctgctgtcctcctccgggacccacggggaccaaggtcacacgttccgtgctgtgaagctgtccagatgtgcctctttggctgggggttctggtggacgtttcaagtggcattttgtacaatgcaggttagaattcaggaatttcaagtatgtgcccgggtctgtcaggtcccagttgcctttctgacggcccccctcagagggacggcgatgagcactaaatgcttttttgactattttcctatagattttttttaaaacttttttttcctcctgttccaattgatagctttcttatttaataaattctgtagttcaccgca

SEQ ID NO: 295509 - DNA, 2382 bp, Homo sapiens
gttcaggcacgcgctttcggtgctcggagcggaagcagcggcgagaggctcggaggcgcgggggcggccgagcggcgggcgacgggggcgggcgacgggggcgggcgacgcgggccgcggcacgggcggagccggggccatggagccgccgctgccgggctaggcaggtcgtgccccgccgggccggcggcgatgtcgggctaccagcgccgcccgggcgccaccccgctgtcccgagcccggagcctcgccattcccgacgctccagcgttctatgagcgccggtcttgtctcccccagctaaattgtgagcgcccccatggcagggacctggactcccccttcttcggcattcggccggcctttatgtgctatgtgcccagcccggtgctggcttccgtgggagacacagatgacagatttgaagatctggaagaggcaaatccattctcttttagagagtttctgaagaccaagaacctcggcctctcgaaagaggatccggccagcagaatttatgcaaaggaagcctcgaggcattccctgggacttgaccacaactccccaccctcccaaaccggcgggtatggcctggagtatcagcagccatttttcgaggatccgacaggggctggtgacctcctggatgaggaggaggatgaggacaccggatggagtggggcctacctgccgtccgccatcgagcagactcaccccgagagggtccctgccggcacgtcgccctgcagcacatacctttcctttttctccaccccgtcggagctggcagggcctgagtctctgccctcgtgggcgttgagtgacactgattctcgcgtgtctccggcctctccggcagggagtcctagcgcagactttgcggttcatggagagtctctgggagacaggcacctgcggacgctgcagataagttacgacgcactgaaagatgaaaattctaagctgagaagaaagctgaatgaggttcagagcttctctgaagctcaaacagaaatgtatgtaagcttttagttaggaatgcaatccacaacatctaatacacagggaaatccgtttttaaatgataatgaagtaatcagagtcaaaccagatctgggttttattgtatataaatgttcagcatcaaacacatttctgtgttctgcctaaaagtttattttgagacagtcttgccgtgtcacccaggctcgggtgcagtggcgcaatcacggctcactgcagccttgacctccttggctccagcaatcctcccatctcagcctcctgagtagctgggacacaggcgtttgcactgcacctggctaatttttaaatcttatttttgtagagacagggtctcactatgttgcccaggcttgtctcaaactcctcggctcaaggaatcctcctgcctcaggctcctaaagtgttgggattataggcatgagccacggcgcctggccaaggtttattttaaactttaggcaaaaagccaccaaacaccttgttggagcagcagtgctgtgagagccgctccctgcacgcctgcctggtggctacaggtccaggcctgaggctgccgctgcctcccctctgtgcctgagacccattccatcacagagtaaagtgttgatcgcaagagtccagtgtcgtgccctcagccagttcttggccaccacaatgggagcagccctggccgagttgtctctgtggtttctatgcagcccttcttggcgaaattcctgcgatcttatagattctaatgagctcttggaagacattgtcataaaagccagtgattttaagaaaaagagtggttctggaatcaatgttttccagtcccatcccagaacatcagttgtaagataagtacaattggttgtccttgatttcataagtagaacaaacactaaatgtgcctctgagatggccaccccgggcagggacctgtgccttccgccgatgctcagggctccctctggctcccgggtcactcttgtggccccagtgggtggtccctgcagtcatggcctgagtgcgcaggggccaccgcgtggctgctgctgtcctcctccgggacccacggggaccaaggtcacacgttccgtgctgtgaagctgtccagatgtgcctctttggctgggggttctggtggacgtttcaagtggcattttgtacaatgcaggttagaattcaggaatttcaagtatgtgcccgggtctgtcaggtcccagttgcctttctgacggcccccctcagagggacggcgatgagcactaaatgcttttttgactattttcctatagattttttttaaaacttttttttcctcctgttccaattgatagctttcttatttaataaattctgtagttcaccgca

SEQ ID NO: 295510 - DNA, 2172 bp, Homo sapiens
  misc_feature (1989)..(1989): n is a, c, g, or t
  misc_feature (1994)..(1994): n is a, c, g, or t
  misc_feature (1997)..(1998): n is a, c, g, or t
  misc_feature (2002)..(2002): n is a, c, g, or t
  misc_feature (2013)..(2013): n is a, c, g, or t
  misc_feature (2171)..(2171): n is a, c, g, or t
gttcaggcacgcgctttcggtgctcggagcggaagcagcggcgagaggctcggaggcgcgggggcggccgagcggcgggcgacgggggcgggcgacgggggcgggcgacgcgggccgcggcacgggcggagccggggccatggagccgccgctgccgggctaggcaggtcgtgccccgccgggccggcggcgatgtcgggctaccagcgccgcccgggcgccaccccgctgtcccgagcccggagcctcgccattcccgacgctccagcgttctatgagcgccggtcttgtctcccccagctaaattgtgagcgcccccatggcagggacctggactcccccttcttcggcattcggccggcctttatgtgctatgtgcccagcccggtgctggcttccgtgggagacacagatgacagatttgaagatctggaagaggcaaatccattctcttttagagagtttctgaagaccaagaacctcggcctctcgaaagaggatccggccagcagaatttatgcaaaggaagcctcgaggcattccctgggacttgaccacaactccccaccctcccaaaccggcgggtatggcctggagtatcagcagccatttttcgaggatccgacaggggctggtgacctcctggatgaggaggaggatgaggacaccggatggagtggggcctacctgccgtccgccatcgagcagactcaccccgagagggtccctgccggcacgtcgccctgcagcacatacctttcctttttctccaccccgtcggagctggcagggcctgagtctctgccctcgtgggcgttgagtgacactgattctcgcgtgtctccggcctctccggcagggagtcctagcgcagactttgcggttcatggagagtctctgggagacaggcacctgcggacgctgcagataagttacgacgcactgaaagatgaaaattctaagctgagaagaaagctgaatgaggttcagagcttctctgaagctcaaacagaaatggtgaggacgcttgagcggaagttagaagcaaaaatgatcaaggaggaaagcgactaccacgacctggagtcggtggttcagcaggtggagcagaacctggagctgatgaccaaacgggctgtaaaggcagaaaaccacgtcgtgaaactaaaacaggaaatcagtttgctccaggcgcaggtctccaacttccagcgagagaatgaagccctgcggtgcggccagggtgccagcctgaccgtggtgaagcagaacgccgacgtggccctgcagaacctccgggtggtcatgaacagtgcacaggcttccatcaagcaactggtttccggagctgagacactgaatcttgttgccgaaatccttaaatctatagacagaatttctgaagttaaagacgaggaggaagactcttgaggacccctgggtgttctcagcatgaagctccgtgtataccctgaggtcaccaccgctcgatctaaatgtgcagttgtgtccttaaatatgcagtcttcacccagagtaaagtgttgatcgcaagagtccagtgtcgtgccctcagccagttcttggccaccacaatgggagcagccctggccgagttgtctctgtggtttctatgcagcccttcttggcgaaattcctgcgatcttatagattctaatgagctcttggaagacattgtcataaaagccagtgattttaagaaaaagagtggttctggaatcaatgttttccagtcccatcccagaacatcagttgtaagataagtacaattggttgtccttgatttcataagtagaacaaacactaaatgtgcctctgagatggccaccccgggcagggacctgtgccttccgccgatgctcagggctccctctggctcccgggtcactcttgtggccccagtgggtggtccctgcagtcatggcctgagtgcgcagggcacggtggtgtgtggctctcggaccgggnacagnccnncggnggaaggcaaangcctgggggggctggggcgtcagggcttggaggcggaatcgatcagttgccggttgagcacggtttgggcgcccagggggaacaagttggatctcagcaaaaccgcagaggtttaagcacaaagggccgggctctgtttttcttgcgttgtgtgttcng

SEQ ID NO: 295511 - DNA, 1850 bp, Homo sapiens
  misc_feature (1537)..(1537): n is a, c, g, or t
gttcaggcacgcgctttcggtgctcggagcggaagcagcggcgagaggctcggaggcgcgggggcggccgagcggcgggcgacgggggcgggcgacgggggcgggcgacgcgggccgcggcacgggcggagccggggccatggagccgccgctgccgggctaggcaggtcgtgccccgccgggccggcggcgatgtcgggctaccagcgccgcccgggcgccaccccgctgtcccgagcccggagcctcgccattcccgacgctccagcgttctatgagcgccggtcttgtctcccccagctaaattgtgagcgcccccatggcagggacctggactcccccttcttcggcattcggccggcctttatgtgctatgtgcccagcccggtgctggcttccgtgggagacacagatgacagatttgaagatctggaagaggcaaatccattctcttttagagagtttctgaagaccaagaacctcggcctctcgaaagaggatccggccagcagaatttatgcaaaggaagcctcgaggcattccctgggacttgaccacaactccccaccctcccaaaccggcgggtatggcctggagtatcagcagccatttttcgaggatccgacaggggctggtgacctcctggatgaggaggaggatgaggacaccggatggagtggggcctacctgccgtccgccatcgagcagactcaccccgagagggtccctgccggcacgtcgccctgcagcacatacctttcctttttctccaccccgtcggagctggcagggcctgagtctctgccctcgtgggcgttgagtgacactgattctcgcgtgtctccggcctctccggcagggagtcctagcgcagactttgcggttcatggagagtctctgggagacaggcacctgcggacgctgcagataagttacgacgcactgaaagatgaaaattctaagctgagaagaaagctgaatgaggttcagagcttctctgaagctcaaacagaaatggtgaggacgcttgagcggaagttagaagcaaaaatgatcaaggaggaaagcgactaccacgacctggagtcggtggttcagcaggtggagcagaacctggagctgatgaccaaacgggctgtaaaggcagaaaaccacgtcgtgaaactaaaacaggaaatcagtttgctccaggcgcaggtctccaacttccagcgagagaatgaagccctgcggtgcggccagggtgccagcctgaccgtggtgaagcagaacgccgacgtggccctgcagaacctccgggtggtcatgaacagtgcacaggcttccatcaagcaactggtttccggagctgagacactgaatcttgttgccgaaatccttaaatctatagacagaatttctgaagttaaagacgaggaggaagactcttgaggacccctgggtgttctcagcatgaagctccgtgtataccctgaggtcaccaccgctcgatctaaatgtgcagttgtgtccttaaatatgcagtcttcacccagantaaagttgtttgactcccaaaaaaaaaaaaaaaaaaaaaaaaaaaaaaaaaaaaacaaaaaaaaaaacacccacgacacaactattattatatgtaggaacgaccaaaaaagaagagatagaataagaagatgtcgtcacgatgaaggaacaaaacgagatgtcttaacgatccaacccaatcatttattttctacctacagacgggagtagaaactagcaagagagactcctcaccaaatataagaaatagtaataattatatacgataaccgaggggatatacgagtattatatacatatgtaataagtga

SEQ ID NO: 295512 - DNA, 1552 bp, Homo sapiens
  misc_feature (1452)..(1453): n is a, c, g, or t
  misc_feature (1456)..(1456): n is a, c, g, or t
gttcaggcacgcgctttcggtgctcggagcggaagcagcggcgagaggctcggaggcgcgggggcggccgagcggcgggcgacgggggcgggcgacgggggcgggcgacgcgggccgcggcacgggcggagccggggccatggagccgccgctgccgggctaggcaggtcgtgccccgccgggccggcggcgatgtcgggctaccagcgccgcccgggcgccaccccgctgtcccgagcccggagcctcgccattcccgacgctccagcgttctatgagcgccggtcttgtctcccccagctaaattgtgagcgcccccatggcagggacctggactcccccttcttcggcattcggccggcctttatgtgctatgtgcccagcccggtgctggcttccgtgggagacacagatgacagatttgaagatctggaagaggcaaatccattctcttttagagagtttctgaagaccaagaacctcggcctctcgaaagaggatccggccagcagaatttatgcaaaggaagcctcgaggcattccctgggacttgaccacaactccccaccctcccaaaccggcgggtatggcctggagtatcagcagccatttttcgaggatccgacaggggctggtgacctcctggatgaggaggaggatgaggacaccggatggagtggggcctacctgccgtccgccatcgagcagactcaccccgagagggtccctgccggcacgtcgccctgcagcacatacctttcctttttctccaccccgtcggagctggcagggcctgagtctctgccctcgtgggcgttgagtgacactgattctcgcgtgtctccggcctctccggcagggagtcctagcgcagactttgcggttcatggagagtctctgggagacaggcacctgcggacgctgcagataagttacgacgcactgaaagatgaaaattctaagctgagaagaaagctgaatgaggttcagagcttctctgaagctcaaacagaaatggtgaggacgcttgagcggaagttagaagcaaaaatgatcaaggaggaaagcgactaccacgacctggagtcggtggttcagcaggtggagcagaacctggagctgatgaccaaacgggctgtaaaggcagaaaaccacgtcgtgaaactaaaacaggaaatcagtttgctccaggcgcaggtctccaacttccagcgagagaatgaagccctgcggtgcggccagggtgccagcctgaccgtggtgaagcagaacgccgacgtggccctgcagaacctccgggtggtcatgaacagtgcacaggcttccatcaagcaactggtttccggagctgagacactgaatcttgttgccgaaatccttaaatctatagacagaatttctgaagttaaagacgaggaggaagactcttgaggaccccggcgcctgtcattnnaancaggtgagtgctctgggcaccgctgtgtgtttacgttacactgaggccccatgtgctatccagtctctcgcattaggatggtggtgtagtgtagca

SEQ ID NO: 295513 - DNA, 1302 bp, Homo sapiens
gttcaggcacgcgctttcggtgctcggagcggaagcagcggcgagaggctcggaggcgcgggggcggccgagcggcgggcgacgggggcgggcgacgggggcgggcgacgcgggccgcggcacgggcggagccggggccatggagccgccgctgccgggctaggcaggtcgtgccccgccgggccggcggcgatgtcgggctaccagcgccgcccgggcgccaccccgctgtcccgagcccggagcctcgccattcccgacgctccagcgttctatgagcgccggtcttgtctcccccagctaaattgtgagcgcccccatggcagggacctggactcccccttcttcggcattcggccggcctttatgtgctatgtgcccagcccggtgctggcttccgtgggagacacagatgacagatttgaagatctggaagaggcaaatccattctcttttagagagtttctgaagaccaagaacctcggcctctcgaaagaggatccggccagcagaatttatgcaaaggaagcctcgaggcattccctgggacttgaccacaactccccaccctcccaaaccggcgggtatggcctggagtatcagcagccatttttcgaggatccgacaggggctggtgacctcctggatgaggaggaggatgaggacaccggatggagtggggcctacctgccgtccgccatcgagcagactcaccccgagagggtccctgccggcacgtcgccctgcagcacatacctttcctttttctccaccccgtcggagctggcagggcctgagtctctgccctcgtgggcgttgagtgacactgattctcgcgtgtctccggcctctccggcagggagtcctagcgcagactttgcggttcatggagagtctctgggagacaggcacctgcggacgctgcagataagttacgacgcagtaagtgagcctcacggcgccctctggcacagcgcctgtccgagcggcttctcccggggagaacctggagccatcctacctcttgggtggcctggtttgatttccaggacaaggcgatttgcgtgacagcctgctatccactttccctttgactttgcttctggttacacgtgggaatagaaccggctaaagaggactggtgagctagaagctgtgaattggatgcagttgggcacttacagggctgtaccctcagtaaaggcaggctgcagtcgccagcttgctaagtattccaagaggaggaaaatttttaaaaaattataatcacctaaaaggttataagctctgaataaaaaaaaa

SEQ ID NO: 295514 - DNA, 1286 bp, Homo sapiens
gttcaggcacgcgctttcggtgctcggagcggaagcagcggcgagaggctcggaggcgcgggggcggccgagcggcgggcgacgggggcgggcgacgggggcgggcgacgcgggccgcggcacgggcggagccggggccatggagccgccgctgccgggctaggcaggtcgtgccccgccgggccggcggcgatgtcgggctaccagcgccgcccgggcgccaccccgctgtcccgagcccggagcctcgccattcccgacggtgagcggggcaggggccgagtccagcggtccaggtgggcggcggccgccccggcacgcagtaaagtcgctgttgtcgttgcttccagctccagcgttctatgagcgccggtcttgtctcccccagctaaattgtgagcgcccccatggcagggacctggactcccccttcttcggcattcggccggcctttatgtgctatgtgcccagcccggtgctggcttccgtgggagacacaggtgagagacgagggcgccggccccggggacgcttccagttcccgcgccacgtgtggcacctccgctgcagcacgagctcgtccattgacccatcaatgtgcagagcgctcactgcgtgccaggcactcggaattcaaaggcggagtcccctgctaggagctcacagtctggttgcggggagacctcccccaagacagacagttccagtacaggatggttagtgcccggggagcacaggagcccgcccgctttcctcgtggggctggagtcggggtgccttcacctagtgggcagtgattggaaaccgagctggagcattccatctgcctccacagccgggcagtggccagatctggttcgtcctcgttctacccaagcagaagtgctgctgggtgcccggggtgtgcaggagtgtttgtgtggttatgccaggatctgaggacattcgggggttgtcacaagacaagaggacgcgcttgccccggctgggcttcaaaatctgctgaggagccgctttcagaccacggacaccagggccagtctgcaagtcaggccatctccagggtcacaagtctgggagcttgtgttttttttaaagttttctcggctgaccgggcgcagtggcttacgcctgtaatcccagcactttgggaggccgaggcaggcggatcatgaggtcaggagattgagaccatcctggctaacagggtgaaaacccgtctctacaaaaaatacaaaaaaattagccgggcgtggtggcaggtgcctgtagtcccagctactcgg

SEQ ID NO: 295515 - DNA, 741 bp, Homo sapiens
  misc_feature (428)..(428): n is a, c, g, or t
agaataaatatatcccttcatattctaaaaaaataaattcttcaaaaatttaatttccattaaaaaatttgaaaactttccaaataagaacctctcccctttccctaccccttggaacccctccctttttccccctaccaacccctcccctttctccccccagaaccctgttgctgctgagtagctgctgccacccatcctgatatccatgcttgttttcaggcaactggtttccggagctgagacactgaatcttgttgccgaaatccttaaatctatagacagaatttctgaagttaaagacgaggaggaagactcttgaggacccctgggtgttctcagcatgaagctccgtgtataccctgaggtcaccaccgctcgatctaaatgtgcagttgtgtccttaaatatgcagtcttcacccagantaaagttgtttgactcccaaaaaaaaaaaaaaaaaaaaaaaaaaaaaaaaaaaaacaaaaaaaaaaacacccacgacacaactattattatatgtaggaacgaccaaaaaagaagagatagaataagaagatgtcgtcacgatgaaggaacaaaacgagatgtcttaacgatccaacccaatcatttattttctacctacagacgggagtagaaactagcaagagagactcctcaccaaatataagaaatagtaataattatatacgataaccgaggggatatacgagtattatatacatatgtaataagtga

SEQ ID NO: 295516 - DNA, 2495 bp, Homo sapiens
caaaccagagacactgactccattaataaaccatattttgtgccgttttgactgttctgaccaaatactaatgggaacaattcttgacgtttttctgttgctgattgttaacatagagcagtctctacactaccctgaggcaactctacattggaacactgaggcttacagcctgcaagagcatcagagctgaccatacatttaaacagaaatgctggtttatttgcaaaatcaccagtatattttctattgtgtctataaaaaatcagtcatttaagtacaagaatcatattttccattcctttttagaaatttattttgttgtccctatggaaatcattcacatctgacaatttatatgttaaagagttttactctctctattttggtccaatttgtatctagtggctgagaaattaaataattctaaagtatgaagttacctatctgaaaatgtacttacagagtatcattttaaaatggatgtctctttaaaaattttgttacttttaccaacaatgtaatataatttatgtatattttattaataatagtgaattccttaaaatttgttctatgtacttatatttaatttgatttaatggttactgcccagatattgagaaatggttcaaatattgagtgtgtttcaatatattatctggcttatttcaacatgagtaatatgagcaaaataagttaaaacctgcgtctgatcaattttcctcatgactagaactaaaacagtaaatttggacaatattaagcctcaaataatcatctccaaactccttctaacactttttaaatcagattggaagacatggacaaatcaggttcatgtgttgcatctttatgtcctttgccaatatccaagatcatcacatatggtagatattcacatggagtttcaaattcagaatagattaccattaccttcctgcccttacacatcctactccttatttaaaagttctatttgtgacttttcatttcctgaaagtttaaaaatacaatttgagaatgtttataatacattctctcctgtcttttcacggttacgtctgttattgctgaaatacaccacattttctttgttctggtcaaggttaactcaatatctgtgtgaaagagaactactaacaacgttacaatagaggctagatttgaaaaaaaaaatctatagatctaattgatacaattgtagaacaaaatgtcaaaataatgttttaagtataagagaagatggaccaaggagagagagatcatttgaaaatctaattgtagcttttctaggctcacattcatgtactacttttagcacccttatgggctgtgctcgccccctggacagttgagctttggattatcttcctcttcaattttccctctattgacccgagtgtctccctctgcttctacagatttatagtactccttggctcttttgagtctccacttttactcactgtctctgggatttttaagatccttttcttctcttataaatcatcctcttaatgaaaattagcctaacaaaagtttggagactggaatcctactttgagccactgacttgaaataactcttttggcaagttgcctgacatcctgtcttaccaaggtggcatatttgcatttttactgcttaaaacatttttttttttttaccatctttatccaaatttatcatattgatggtaggactaacaggctttttagaagctggctttaactttgagtctcaagctacaatgctgttgggcagcctggtcttcccacgtgagggtttaactttgtttatttgcctccagttattccaaaatgcttattaaatgaaaggcccaggaacatgtttattttagtcacctttgctttttaacaattttgttttgtaatcaatgagtaattcatgatgaattatttttgactaatggatagccgaaggccaagcttttaattctaataggtaatgttcttcttttgtcttattgaaacaatgagaatactctgtgcatttcaaatgcactccgattatgctgtggttttattcacataagcacaatatgtgttttatttataacttcataacaaacttataatataataatttaccttagcagacatgcaaaagcttattcttgtgtgacttactttctttaagctaataatataaaaataaatatgtatcttaaaaatctataataaaacattagaaattaaagatatgtgctttttattttgcagatgagttcatttgcttctgtagatgtgttttcagagctaggtacagaggaatgtttgctacctttagcggtgaaaaaagaaagagagtcaagaattttgttggattgtgtttgtgtgtgcatatatttgatatcatcattatatttgtaatctttggacttgtaatcatagcctgtttattctactgtgccattaaatatactttaccttatacataacgaataaaatacctagatgtagatttattta

SEQ ID NO: 295517 - DNA, 2485 bp, Homo sapiens
cgctctagagatccactcgcggctggatagggccgttttgactgttctgaccaaatactaatgggaacaattcttgacgtttttctgttgctgattgttaacatagagcagtctctacactaccctgaggcaactctacattggaacactgaggcttacagcctgcaagagcatcagagctgaccatacatttaaacagaaatgctggtttatttgcaaaatcaccagtatattttctattgtgtctataaaaaatcagtcatttaagtacaagaatcatattttccattcctttttagaaatttattttgttgtccctatggaaatcattcacatctgacaatttatatgttaaagagttttactctctctattttggtccaatttgtatctagtggctgagaaattaaataattctaaagtatgaagttacctatctgaaaatgtacttacagagtatcattttaaaatggatgtctctttaaaaattttgttacttttaccaacaatgtaatataatttatgtatattttattaataatagtgaattccttaaaatttgttctatgtacttatatttaatttgatttaatggttactgcccagatattgagaaatggttcaaatattgagtgtgtttcaatatattatctggcttatttcaacatgagtaatatgagcaaaataagttaaaacctgcgtctgatcaattttcctcatgactagaactaaaacagtaaatttggacaatattaagcctcaaataatcatctccaaactccttctaacactttttaaatcagattggaagacatggacaaatcaggttcatgtgttgcatctttatgtcctttgccaatatccaagatcatcacatatggtagatattcacatggagtttcaaattcagaatagattaccattaccttcctgcccttacacatcctactccttatttaaaagttctatttgtgacttttcatttcctgaaagtttaaaaatacaatttgagaatgtttataatacattctctcctgtcttttcacggttacgtctgttattgctgaaatacaccacattttctttgttctggtcaaggttaactcaatatctgtgtgaaagagaactactaacaacgttacaatagaggctagatttgaaaaaaaaaatctatagatctaattgatacaattgtagaacaaaatgtcaaaataatgttttaagtataagagaagatggaccaaggagagagagatcatttgaaaatctaattgtagcttttctaggctcacattcatgtactacttttagcacccttatgggctgtgctcgccccctggacagttgagctttggattatcttcctcttcaattttccctctattgacccgagtgtctccctctgcttctacagatttatagtactccttggctcttttgagtctccacttttactcactgtctctgggatttttaagatccttttcttctcttataaatcatcctcttaatgaaaattagcctaacaaaagtttggagactggaatcctactttgagccactgacttgaaataactcttttggcaagttgcctgacatcctgtcttaccaaggtggcatatttgcatttttactgcttaaaacatttttttttttttaccatctttatccaaatttatcatattgatggtaggactaacaggctttttagaagctggctttaactttgagtctcaagctacaatgctgttgggcagcctggtcttcccacgtgagggtttaactttgtttatttgcctccagttattccaaaatgcttattaaatgaaaggcccaggaacatgtttattttagtcacctttgctttttaacaattttgttttgtaatcaatgagtaattcatgatgaattatttttgactaatggatagccgaaggccaagcttttaattctaataggtaatgttcttcttttgtcttattgaaacaatgagaatactctgtgcatttcaaatgcactccgattatgctgtggttttattcacataagcacaatatgtgttttatttataacttcataacaaacttataatataataatttaccttagcagacatgcaaaagcttattcttgtgtgacttactttctttaagctaataatataaaaataaatatgtatcttaaaaatctataataaaacattagaaattaaagatatgtgctttttattttgcagatgagttcatttgcttctgtagatgtgttttcagagctaggtacagaggaatgtttgctacctttagcggtgaaaaaagaaagagagtcaagaattttgttggattgtgtttgtgtgtgcatatatttgatatcatcattatatttgtaatctttggacttgtaatcatagcctgtttattctactgtgccattaaatatactttaccttatacataacgaataaaatacctagatgtagatttattta

SEQ ID NO: 295518 - DNA, 2238 bp, Homo sapiens
cggacgcgtgggtcgacccacgcgttcaatcatattttccattcctttttagaaatttattttgttgtccctatggaaatcattcacatctgacaatttatatgttaaagagttttactctctctattttggtccaatttgtatctagtggctgagaaattaaataattctaaagtatgaagttacctatctgaaaatgtacttacagagtatcattttaaaatggatgtctctttaaaaattttgttacttttaccaacaatgtaatataatttatgtatattttattaataatagtgaattccttaaaatttgttctatgtacttatatttaatttgatttaatggttactgcccagatattgagaaatggttcaaatattgagtgtgtttcaatatattatctggcttatttcaacatgagtaatatgagcaaaataagttaaaacctgcgtctgatcaattttcctcatgactagaactaaaacagtaaatttggacaatattaagcctcaaataatcatctccaaactccttctaacactttttaaatcagattggaagacatggacaaatcaggttcatgtgttgcatctttatgtcctttgccaatatccaagatcatcacatatggtagatattcacatggagtttcaaattcagaatagattaccattaccttcctgcccttacacatcctactccttatttaaaagttctatttgtgacttttcatttcctgaaagtttaaaaatacaatttgagaatgtttataatacattctctcctgtcttttcacggttacgtctgttattgctgaaatacaccacattttctttgttctggtcaaggttaactcaatatctgtgtgaaagagaactactaacaacgttacaatagaggctagatttgaaaaaaaaaatctatagatctaattgatacaattgtagaacaaaatgtcaaaataatgttttaagtataagagaagatggaccaaggagagagagatcatttgaaaatctaattgtagcttttctaggctcacattcatgtactacttttagcacccttatgggctgtgctcgccccctggacagttgagctttggattatcttcctcttcaattttccctctattgacccgagtgtctccctctgcttctacagatttatagtactccttggctcttttgagtctccacttttactcactgtctctgggatttttaagatccttttcttctcttataaatcatcctcttaatgaaaattagcctaacaaaagtttggagactggaatcctactttgagccactgacttgaaataactcttttggcaagttgcctgacatcctgtcttaccaaggtggcatatttgcatttttactgcttaaaacatttttttttttttaccatctttatccaaatttatcatattgatggtaggactaacaggctttttagaagctggctttaactttgagtctcaagctacaatgctgttgggcagcctggtcttcccacgtgagggtttaactttgtttatttgcctccagttattccaaaatgcttattaaatgaaaggcccaggaacatgtttattttagtcacctttgctttttaacaattttgttttgtaatcaatgagtaattcatgatgaattatttttgactaatggatagccgaaggccaagcttttaattctaataggtaatgttcttcttttgtcttattgaaacaatgagaatactctgtgcatttcaaatgcactccgattatgctgtggttttattcacataagcacaatatgtgttttatttataacttcataacaaacttataatataataatttaccttagcagacatgcaaaagcttattcttgtgtgacttactttctttaagctaataatataaaaataaatatgtatcttaaaaatctataataaaacattagaaattaaagatatgtgctttttattttgcagatgagttcatttgcttctgtagatgtgttttcagagctaggtacagaggaatgtttgctacctttagcggtgaaaaaagaaagagagtcaagaattttgttggattgtgtttgtgtgtgcatatatttgatatcatcattatatttgtaatctttggacttgtaatcatagcctgtttattctactgtgccattaaatatactttaccttatacataacgaataaaatacctagatgtagatttattta

SEQ ID NO: 295519 - DNA, 2221 bp, Homo sapiens
caaaccagagacactgactccattaataaaccatattttgtgccgttttgactgttctgaccaaatactaatgggaacaattcttgacgtttttctgttgctgattgttaacatagagcagtctctacactaccctgaggcaactctacattggaacactgaggcttacagcctgcaagagcatcagagctgaccatacatttaaacagaaatgctggtttatttgcaaaatcaccagtatattttctattgtgtctataaaaaatcagtcatttaagtacaagaatcatattttccattcctttttagaaatttattttgttgtccctatggaaatcattcacatctgacaatttatatgttaaagagttttactctctctattttggtccaatttgtatctagtggctgagaaattaaataattctaaagtatgaagttacctatctgaaaatgtacttacagagtatcattttaaaatggatgtctctttaaaaattttgttacttttaccaacaatgtaatataatttatgtatattttattaataatagtgaattccttaaaatttgttctatgtacttatatttaatttgatttaatggttactgcccagatattgagaaatggttcaaatattgagtgtgtttcaatatattatctggcttatttcaacatgagtaatatgagcaaaataagttaaaacctgcgtctgatcaattttcctcatgactagaactaaaacagtaaatttggacaatattaagcctcaaataatcatctccaaactccttctaacactttttaaatcagattggaagacatggacaaatcaggttcatgtgttgcatctttatgtcctttgccaatatccaagatcatcacatatggtagatattcacatggagtttcaaattcagaatagattaccattaccttcctgcccttacacatcctactccttatttaaaagttctatttgtgacttttcatttcctgaaagtttaaaaatacaatttgagaatgtttataatacattctctcctgtcttttcacggttacgtctgttattgctgaaatacaccacattttctttgttctggtcaaggttaactcaatatctgtgtgaaagagaactactaacaacgttacaatagaggctagatttgaaaaaaaaaatctatagatctaattgatacaattgtagaacaaaatgtcaaaataatgttttaagtataagagaagatggaccaaggagagagagatcatttgaaaatctaattgtagcttttctaggctcacattcatgtactacttttagcacccttatgggctgtgctcgccccctggacagttgagctttggattatcttcctcttcaattttccctctattgacccgagtgtctccctctgcttctacagatttatagtactccttggctcttttgagtctccacttttactcactgtctctgggatttttaagatccttttcttctcttataaatcatcctcttaatgaaaattagcctaacaaaagtttggagactggaatcctactttgagccactgacttgaaataactcttttggcaagttgcctgacatcctgtcttaccaaggtggcatatttgcatttttactgcttaaaacatttttttttttttaccatctttatccaaatttatcatattgatggtaggactaacaggctttttagaagctggctttaactttgagtctcaagctacaatgctgttgggcagcctggtcttcccacgtgagggtttaactttgtttatttgcctccagttattccaaaatgcttattaaatgaaaggcccaggaacatgtttattttagtcacctttgctttttaacaattttgttttgtaatcaatgagtaattcatgatgaattatttttgactaatggatagccgaaggccaagcttttaattctaataggtaatgttcttcttttgtcttattgaaacaatgagaatactctgtgcatttcaaatgcactccgattatgctgtggttttattcacataagcacaatatgtgttttatttataacttcataacaaacttataatataataatttaccttagcagacatgcaaaagcttattcttgtgtgacttactttctttaagctaataatataaaaataaatatgtatcttaaaaatctataataaaacattagaaatta

SEQ ID NO: 295520 - DNA, 2603 bp, Homo sapiens
caaaccagagacactgactccattaataaaccatattttgtgccgttttgactgttctgaccaaatactaatgggaacaattcttgacgtttttctgttgctgattgttaacatagagcagtctctacactaccctgaggcaactctacattggaacactgaggcttacagcctgcaagagcatcagagctgaccatacatttaaacagaaatgctggtttatttgcaaaatcaccagtatattttctattgtgtctataaaaaatcagtcatttaagtacaagaatcatattttccattcctttttagaaatttattttgttgtccctatggaaatcattcacatctgacaatttatatgttaaagagttttactctctctattttggtccaatttgtatctagtggctgagaaattaaataattctaaagtatgaagttacctatctgaaaatgtacttacagagtatcattttaaaatggatgtctctttaaaaattttgttacttttaccaacaatgtaatataatttatgtatattttattaataatagtgaattccttaaaatttgttctatgtacttatatttaatttgatttaatggttactgcccagatattgagaaatggttcaaatattgagtgtgtttcaatatattatctggcttatttcaacatgagtaatatgagcaaaataagttaaaacctgcgtctgatcaattttcctcatgactagaactaaaacagtaaatttggacaatattaagcctcaaataatcatctccaaactccttctaacactttttaaatcagattggaagacatggacaaatcaggttcatgtgttgcatctttatgtcctttgccaatatccaagatcatcacatatggtagatattcacatggagtttcaaattcagaatagattaccattaccttcctgcccttacacatcctactccttatttaaaagttctatttgtgacttttcatttcctgaaagtttaaaaatacaatttgagaatgtttataatacattctctcctgtcttttcacggttacgtctgttattgctgaaatacaccacattttctttgttctggtcaaggttaactcaatatctgtgtgaaagagaactactaacaacgttacaatagaggctagatttgaaaaaaaaaatctatagatctaattgatacaattgtagaacaaaatgtcaaaataatgttttaagtataagagaagatggaccaaggagagagagatcatttgaaaatctaattgtagcttttctaggctcacattcatgtactacttttagcacccttatgggctgtgctcgccccctggacagttgagctttggattatcttcctcttcaattttccctctattgacccgagtgtctccctctgcttctacagatttatagtactccttggctcttttgagtctccacttttactcactgtctctgggatttttaagatccttttcttctcttataaatcatcctcttaatgaaaattagcctaacaaaagtttggagactggaatcctactttgagccactgacttgaaataactcttttggcaagttgcctgacatcctgtcttaccaaggtggcatatttgcatttttactgcttaaaacatttttttttttttaccatctttatccaaatttatcatattgatggtaggactaacaggctttttagaagctggctttaactttgagtctcaagctacaatgctgttgggcagcctggtcttcccacgtgagggtttaactttgtttatttgcctccagttattccaaaatgcttattaaatgaaaggcccaggaacatgtttattttagtcacctttgctttttaacaattttgttttgtaatcaatgagtaattcatgatgaattatttttgactaatggatagccgaaggccaagcttttaattctaataggtaatgttcttcttttgtcttattgaaacaatgagaatactctgtgcatttcaaatgcactccgattatgctgtggttttattcacataagcacaatatgtgttttatttataacttcataacaaacttataatataataatttaccttagcagacatgcaaaagcttattcttgtgtgacttactttctttaagctaataatataaaaataaatatgtatcttaaaaatctataataaaacattagaaattaaagatatgtgctttttattttgcagatgagttcatttgcttctgtagatgtgttttcagagctaggtacagaggaatgtttgctacctttagcggtgaaaaaagaaagagagtcaagaattttgttggattgtgtttgtgtgtgcatatatttgatatcatcattatatttgtaatctttggacttgtaatcatagcctgtttattctactgtgccattaaatatactttaccttatacataacgaataaaatacctagatgtagatttatttacacactgtcttatgaaattcttatgtttatgtcagcacagaacaagcacacatttagagcattcatctgaaaattatatggaaattgaacatgggtcaaataaagatg

SEQ ID NO: 295521 - DNA, 1431 bp, Homo sapiens
caaaccagagacactgactccattaataaaccatattttgtgccgttttgactgttctgaccaaatactaatgggaacaattcttgacgtttttctgttgctgattgttaacatagagcagtctctacactaccctgaggcaactctacattggaacactgaggcttacagcctgcaagagcatcagagctgaccatacatttaaacagaaatgctggtttatttgcaaaatcaccagtatattttctattgtgtctataaaaaatcagtcatttaagtacaagaatcatattttccattcctttttagaaatttattttgttgtccctatggaaatcattcacatctgacaatttatatgttaaagagttttactctctctattttggtccaatttgtatctagtggctgagaaattaaataattctaaagtatgaagttacctatctgaaaatgtacttacagagtatcattttaaaatggatgtctctttaaaaattttgttacttttaccaacaatgtaatataatttatgtatattttattaataatagtgaattccttaaaatttgttctatgtacttatatttaatttgatttaatggttactgcccagatattgagaaatggttcaaatattgagtgtgtttcaatatattatctggcttatttcaacatgagtaatatgagcaaaataagttaaaacctgcgtctgatcaattttcctcatgactagaactaaaacagtaaatttggacaatattaagcctcaaataatcatctccaaactccttctaacactttttaaatcagattggaagacatggacaaatcaggttcatgtgttgcatctttatgtcctttgccaatatccaagatcatcacatatggtagatattcacatggagtttcaaattcagaatagattaccattaccttcctgcccttacacatcctactccttatttaaaagttctatttgtgacttttcatttcctgaaagtttaaaaatacaatttgagaatgtttataatacattctctcctgtcttttcacggttacgtctgttattgctgaaatacaccacattttctttgttctggtcaaggttaactcaatatctgtgtgaaagagaactactaacaacgttacaatagaggctagatttgaaaaaaaaaatctatagatctaattgatacaattgtagaacaaaatgtcaaaataatgttttaagtataagagaagatggaccaaggagagagagatcatttgaaaatctaattgtagcttttctaggctcacattcatgtactacttttagcacccttatgggctgtgctcgcccccggccaagatactcatattacacactttgtagctctttaatctgacttcacacctacatccagcataatgtccccgtggacttcc

SEQ ID NO: 295522 - DNA, 1122 bp, Homo sapiens
agcagggctcaaaacctggccaggaggtcttgttgggccaggaatgtccgtggttggtgaggaggctgggagaaggcctttttgatggctccattgttcacagcgctgccctacaaataccatatccgtccccacctcctctgcaagggtcgagcggaagagtaggtctggtgagctgagctctagggcgctggtaccatcttccctcaatccccctcggttaccccttggggcagcaacgacgccatcccagccccttccagagaacacacaaaggaagccccacccgtccttagacctgaggacacgctcgggagcgggctgacgtggaccccgtttcagggcgccccgggcccctgcggggaacaatagccgccgcctcctgggcggtctggcgggcgcgcggcacaaacgtccgcgccgccatgtgatgcgcgcgctcgttccgcgctctccgcgcctcagcgagcggccaggctgcgggccgggtgggctggcgctcctgatccacctggaacacttttgcaaagacagacgcggttcctcctacttcagagcaagtctgggccagctgggatccgaccagaaaccgcaagcggaggagacgcaggagcgcaggctgagcgctaactgaaggcgcgacctgagcccggcgcctgctggggagctgcgcagccaggacagcggtcggcagcacagggcctgggcgcagggcccgccgtcaccacctcacgtcggaagccagcactgctgcccgccagccctgccgcctgccctcggacttcccagggcgcccagggtcctcccaacgcgcctgcacccacacccgcccctgagccacagtgaccttgcattccccgccccctgccacacctcctgcgtgcccgagtgtcacccttaaataccgctctacacccagagagggacgaatacacctctgaagacagggcaagactaatttcaatgggtcagaaggttcttgcaggcactgttttatttaagagtgcctatttactggcaggagtatttgtgtgggaggaagtaggctaagactgctgttgaacttgaagctaaacttgaatgccatttaaaataacaataaaaatatacttaaaacaccaa

SEQ ID NO: 295523 - DNA, 1293 bp, Homo sapiens
agcagggctcaaaacctggccaggaggtcttgttgggccaggaatgtccgtggttggtgaggaggctgggagaaggcctttttgatggctccattgttcacagcgctgccctacaaataccatatccgtccccacctcctctgcaagggtcgagcggaagagtaggtctggtgagctgagctctagggcgctggtaccatcttccctcaatccccctcggttaccccttggggcagcaacgacgccatcccagccccttccagagaacacacaaaggaagccccacccgtccttagacctgaggacacgctcgggagcgggctgacgtggaccccgtttcagggcgccccgggcccctgcggggaacaatagccgccgcctcctgggcggtctggcgggcgcgcggcacaaacgtccgcgccgccatgtgatgcgcgcgctcgttccgcgctctccgcgcctcagcgagcggccaggctgcgggccgggtgggctggcgctcctgatccacctggaacacttttgcaaagacagacggtgagttaatcaccctaccggctggcggccgcgtcccctctcgcccgcgaggaggactggagaaggggctggggtggaggttttctctgtgtgtgtctagggttgggggcaggagaggttagttctattaagagttcatcaatcacccggtgtgcacttttcgctcgacagcggttcctcctacttcagagcaagtctgggccagctgggatccgaccagaaaccgcaagcggaggagacgcaggagcgcaggctgagcgctaactgaaggcgcgacctgagcccggcgcctgctggggagctgcgcagccaggacagcggtcggcagcacagggcctgggcgcagggcccgccgtcaccacctcacgtcggaagccagcactgctgcccgccagccctgccgcctgccctcggacttcccagggcgcccagggtcctcccaacgcgcctgcacccacacccgcccctgagccacagtgaccttgcattccccgccccctgccacacctcctgcgtgcccgagtgtcacccttaaataccgctctacacccagagagggacgaatacacctctgaagacagggcaagactaatttcaatgggtcagaaggttcttgcaggcactgttttatttaagagtgcctatttactggcaggagtatttgtgtgggaggaagtaggctaagactgctgttgaacttgaagctaaacttgaatgccatttaaaataacaataaaaatatacttaaaacaccaa

SEQ ID NO: 295524 - DNA, 739 bp, Homo sapiens
acctgcatgctactcagtacagttggggcattgtgctcagacaagaaaggggcacttgtgatccagacaatgggctgggtcgctcccatttggcctgggcttcagcttccctgggtcagcaatatcctttcctctgctcctgcccactctgcttccacccctccctggagaatggtggctaggaacacggagcagagactcaccgcgggcccatgcccggtttggcacgtgcctcggccgtgaggaggaggagggatgcaagcttcgctcctctaccctggtatagaccaagagaaatggcggcatctgcacacacaaaaacttgtacaggaatgttcacagcagcaataacagccaaaaagtgggaacaatcttaatgtctaccaactgacgaacaggtatagaccaagaggtatggaggccaaggcgagcagattacttgaggtcaggagttcgagaccagcctggccagcggttccagtgaggcccatgtgaggcagtcactcagggcagtagccccctcactggcctccccacttccactcacacccactatggcccactccccacacctcacattcctgcccagggtcccccagcggtcccatcttgctgagaacctgccggcactcctctttgcctgcacgggctcactcagccacacaggtgtcctcgcggtgctccacctcacagggctggcccctgcctcaggactgcaatacccggctgtttcttctgc

SEQ ID NO: 295525 - DNA, 457 bp, Homo sapiens
tcagctcggtaccgtgaggtacagctggataacactaacttgaactaaggacagtcaaagacaaccacaaaacgcaaaacataaaagtttggtggccgggtgcggtggctcaggcctataatcccagcactttgggaggccgaggcgggcggatcacctgaggtcaggagttcgagaccagcctggccagcggttccagtgaggcccatgtgaggcagtcactcagggcagtagccccctcactggcctccccacttccactcacacccactatggcccactccccacacctcacattcctgcccagggtcccccagcggtcccatcttgctgagaacctgccggcactcctctttgcctgcacgggctcactcagccacacaggtgtcctcgcggtgctccacctcacagggctggcccctgcctcaggactgcaatacccggctgtttcttctgc

SEQ ID NO: 295526 - DNA, 564 bp, Homo sapiens
tcgaaggggccgaagaactcggcggcgaaggtgaccacgtcctccggctggcgcagcagcaggaagagcaggaagtcggagatgagcgcgtgggcttcggggtgctgccgcagatagctggcgtggccgagccggagctcctcctggcaggggacagagcccgagcctcagccggacgggacccccgcgccccaggagcccccagccgctcgctccaaggagagctaaggggcgctggagccttctagcccctacgggtgtgcatttcaatcaggcatcttggtgatgatgcagcaccctggggagcccacctgtattctcttggccaggtgcctggagtgcaacacaacatgtgagagtgagaatcttcccagaccgcctgctatggactgaattgtctctctaacccccagtgtggtggtatttggagaaaggccatgtgaggacacattgagaaggcacttgtctgcaagctaggaagacagccctcaccagaaaccaaccctgatggcaccatgatcttggacttcctgccttccagcaaatatatttctcttgaagcca

SEQ ID NO: 295527 - DNA, 509 bp, Homo sapiens
tcgaaggggccgaagaactcggcggcgaaggtgaccacgtcctccggctggcgcagcagcaggaagagcaggaagtcggagatgagcgcgtgggcttcggggtgctgccgcagatagctggcgtggccgagccggagctcctcctggcaggggacagagcccgagcctcagccggacgggacccccgcgccccaggagcccccagccgctcgctccaaggagagctaaggggcgctggagccttctagcccctacgggtgtgcatttcaatcaggtgcctggagtgcaacacaacatgtgagagtgagaatcttcccagaccgcctgctatggactgaattgtctctctaacccccagtgtggtggtatttggagaaaggccatgtgaggacacattgagaaggcacttgtctgcaagctaggaagacagccctcaccagaaaccaaccctgatggcaccatgatcttggacttcctgccttccagcaaatatatttctcttgaagcca

SEQ ID NO: 295528 - DNA, 490 bp, Homo sapiens
agacaacccccatcccctgctgtagcgggacagttggagggtcatgggtgggtgaagtgtttggctgagggaaactcagaccaaagagcagcggcaagaaagcagttgggtccccacaaaacgcccgaagtcaaggtgagggtcacacaacgactcttgacgattccggcgagttcatcctggtgcacatcccactccatgcctctctcttctggttggacaatagttacatccttacgaaaaggaggcaagctgctgggccttggtggatccactcaaccttgttaccaagggacatgccgccatgctatgtgaaaaggggggttttgttgtttgtttttaatttaagtatctaattcgtttcacgaaagaatgatcaataccggcccagagtaaacttgataagtaattaaactgtcagggcatagagttcccatagaggtgcttgttctttcaatacacaaataaagggatgcaaaagtcaacatgc

SEQ ID NO: 295529 - DNA, 805 bp, Homo sapiens
  misc_feature (8)..(8): n is a, c, g, or t
  misc_feature (15)..(15): n is a, c, g, or t
  misc_feature (22)..(22): n is a, c, g, or t
gcgacagntaccgcncctggcnccgacctggcggataaagtggccagtgtgtacgaagccccgggctttttcctggacctggagcccatcccgggagccttggacgctgtgcgggagatgaacgacctaccggacacgcaggtcttcatctgcaccagccccctgctgaagtaccaccactgtgtgggtgagaaggtgtggctgccccgcccctactccgcacgtggagctgcctaaatcctgattttaaaaagaaaccaccagaaacccagaagtaccgctgggtggagcagcacctggggccccagttcgtagaacgaattatcctgacaagggacaagacggtggtcttgggggacctgctcattgatgacaaggacacagttcgaggccaggaggagaccccaagctgggagcacatcttgttcacctgctgccacaatcggcacctggtcctgcccccgacaaggagacggctgctctcctggagtgacaactggagggagatcttagatagcaagcgcggagctgcgcagcgggaatgagcggggatgccgcgggcagcagctggagctaaaggaagggcaggcccacaggggccaccgcagagccgagtcggggcggcatcgtgctggtgcctctggccccgtggagtggagcaggcagataccgttaagcgctgtgctaccgggccccaggcccagccacccggtacctcccgagaggctgtccctggaccctggctggcatggaaatacagtgggaaaaccagtcgggacctttaataaaagaccttggctttcta

SEQ ID NO: 295530 - DNA, 5089 bp, Homo sapiens
ccagtggacgagaatcgcggagcctgcggggctggaggttgagcgcccgggccagcacctaggcgggcgcgggggtgtgcaggccagggttcgcgcgggccgggtggaggcttgagcggggacccccgagcttgagccccggagccggcggcgctggggccagaggggccggacgggaggtggcggaggtggcggcggaggcgaaggggcggcgggacgcgggcctggcccgtgtgtgtcctggcggcctggcccaggctgccgctgtacggtgagcccgagggaggcggatctgggtcccgggaaggacacccgcctggatttgccccttaggcccggcccgggcccctcgggagcagaacaaccttagtgaggtggacaggaggggacctcgcgagcagacgcgcgccagcgacagcagccccgccccggcctctcgggagccgtggggcagaggctgcggagccccagaagggtctaccagccacagtctctgcacgtttccaagagcagcagaaaatgaacacattgcaggggccagtgtcattcaaagatgtggctgtggatttcacccaggaggagtggcagcagctggaccctgatgagaagataacttacagggatgtgatgttggagaactatagccatctagtttctgtgggatatgataccaccaagccaaacgtcatcattaagttggagcagggagaggagccgtggataatgggaggtgaatttccatgtcaacatagtccagaagcctggagagttgatgacctgatagagagaatccaagaaaacgaagacaaacattcaaggcaagctgcttgtatcaatagcaaaaccctgactgaagagaaagagaatacatttagtcaaatttacatggaaacaagccttgttccttcaagcataatagctcataattgtgtctcatgtggaaagaatttagaatctatttcgcaattaattagtagtgatggaagctatgctaggacaaaacctgatgagtgtaatgaatgtgggaaaacatatcatggagagaaaatgtgtgaatttaatcaaaatggggatacctattctcacaatgaagaaaatattcttcagaaaattagtattttggagaaaccctttgaatataatgaatgcatggaagccttagacaatgaggctgtttttattgctcataagagagcttacataggggagaagccctatgagtggaatgattctggaccagacttcatacagatgtcaaattttaatgcatatcagagatcacaaatggaaatgaagccctttgaatgcagtgaatgtggaaaatccttctgtaaaaagtcaaaattcatcatccaccagagggctcacacaggagagaaaccttatgaatgtaatgtatgtgggaaatccttcagccaaaagggaaccctcactgtacatcggagatcacacttagaggagaagccctataaatgtaatgaatgtgggaaaaccttttgtcagaagttacacctcactcaacacctaagaactcattcaggagagaaaccctacgaatgtagcgaatgtgggaaaaccttctgccaaaagacacatctcaccctgcaccagaggaatcattcaggagagaggccctatccatgtaacgaatgtgggaaatccttctcccgcaagtctgctctcagtgaccatcagagaactcacacgggagagaagctttataaatgtaatgaatgtgggaaatcctactaccgaaagtctactctgattacacatcagagaacacacacgggagagaagccctatcagtgtagcgagtgtgggaaattcttttctcgggtgtcatacctcactatacattatagaagtcatttagaagagaaaccctatgaatgtaatgaatgtggcaaaaccttcaatttaaattcagccttcattagacatcggaaagtacacacagaagagaaatcccatgaatgtagtgaatgtggaaagttctctcagttgtatctcaccgaccatcatacagctcatttagaagagaaaccctatgaatgtaatgaatgtgggaaaaccttccttgtaaattcagccttcgatgggcaccagccacttccaaaaggggagaaatcctatgaatgtaatgtatgtggaaagttattcaatgagttgtcatactatactgaacattatagaagtcattcagaagagaaaccttatggatgtagcgaatgtgggaaaaccttttcccataattcatccctcttcagacatcaaagagtacacacaggcgagaaaccctatgaatgttacgaatgtggaaaattcttctctcagaaatcatatctcactatacatcatcgaattcattcaggagagaaaccctatgaatgtagtaaatgtggaaaagtcttctctcggatgtcaaacctcactgtccactacagaagccattcaggagagaaaccctatgaatgtaatgaatgtgggaaagtcttttctcagaagtcatacctcactgtacactatagaactcattcaggagagaaaccctatgaatgtaacgagtgtgggaaaaaattccaccacagatcagccttcaatagccatcagagaattcatagaagaggaaatatgaacgtacttgatgtggaaaatctctgaagtcagatctcaatttttagaaaactctctgaatataatgaatatggggaatccaataggaagtcaaagcgtttatctgagagttcgtgttcctgaacggtgagaagcatttaggcattagagtcattttaatccaaattttcacagagaagaatcccgaagaatgtaacaagaagcaaagccttcagcaagatcatacgactcatcggacactaatttatataggagtgaagttttataaatatttaatatttattttggattcaaattgtatttacatatcagggaatcatacaaaggcaaaatctgtcaatatggtgaatgtggaaaatatattgtcttggaaatttgttgtaaaagccatatttctaatggaaaatcaggtgtttacaggaaagatctcagaggctatgagctctgaataaatcttcattgtataaaatgaagtttttaaattgtcaggagttgatcatgaggacagtagcattaaataagtatatggccgttttttatcatgtcttaaaaatgcaatctaatggtaattctatgcaagtttggaattggatgacttgtgaagaggcagttttcttatttgagtattaggatggcaaaatgtattaagacaggacatattgttggtgagataatatttaataggtataaaatggtaaaatacctagttttctatttagaggaatttacaaatgggtttttaacaaatgcctcattagtacaggaggcagtcgttttgtaaagttttcaactgcatctgagtaagataagattttctaaaagactattttgataaactatacatacataatttggaattgtttaagtctatttcagtgaaagagaacaagcatactgcccatactctaaaatatccccagctctcacaccacccttgttttttaacccataggtttgagtgtgcctagtgccaatattttgtaatttagaaattttattcacaaacttctgtttggtacaaatacagtgtcattgttttgtgcattctcctttttcccagtatttcagaacaaattgattcaagtttctagcagatattttttgatcaattaacttaatgtcctcgctccatttcttgctggaacagtttaggtacctaccacttcttcacatgacacaggggaatcctgattagtcaaaataataatgatttcattctctttgccagtaacttgttttatagtggtcatatgacctgatactgggtaaacaaaacaaagatggacttgttctgggaaaaggtaaaatggtaatcaaatagattgtgttccaggaatgcaaaggtggcttaatattcacaagtcagttgctattatacaccacctgtagaaaagtaatctggcatgcagaacattcttgtggtacaattaatgttcgtttatgatcttagcaaatgatggattgaaagggacttacttaactgcataaagagacttaaactacaacaaacaatatgcttaatgatgaaatagtgaacatttctcctaagattataaaaataagacaaggatatctgctgtcaatgattttatcggagcgtgcgcgtgctggtggacatggacggcgtcctggccgacttcgaggccggcctcctgcggggcttccgccgccgcttccctgaggagccgcacgtgccgctggagcagcgccgcggcttcctggcccgcgagcagtaccgcgccctgcggcccgacctggcggataaagtggccagtgtgtacgaagccccgggctttttcctggacctggagcccatcccgggagccttggacgctgtgcgggagatgaacgacctaccggacacgcaggtcttcatctgcaccagccccctgctgaagtaccaccactgtgtgggtgagaagtaccgctgggtggagcagcacctggggccccagttcgtagaacgaattatcctgacaagggacaagacggtggtcttgggggacctgctcattgatgacaaggacacagttcgaggccaggaggagaccccaagctgggagcacatcttgttcacctgctgccacaatcggcacctggtcctgcccccgacaaggagacggctgctctcctggagtgacaactggagggagatcttagatagcaagcgcggagctgcgcagcgggaatgagcggggatgccgcgggcagcagctggagctaaaggaagggcaggcccacaggggccaccgcagagccgagtcggggcggcatcgtgctggtgcctctggccccgtggagtggagcaggcagataccgttaagcgctgtgctaccgggccccaggcccagccacccggtacctcccgagaggctgtccctggaccctggctggcatggaaatacagtgggaaaaccagtcgggacctttaataaaagaccttggctttcta

SEQ ID NO: 295531 - DNA, 941 bp, Homo sapiens
agcagcgctccctccgcttccggccgagcccgcgccccccagaccccgagagctcgcagctccggcccggcggcgatggcgcggagcgtgcgcgtgctggtggacatggacggcgtcctggccgacttcgaggccggcctcctgcggggcttccgccgccgcttccctgaggagccgcacgtgccgctggagcagcgccgcggcttcctggcccgcgagcagtaccgcgccctgcggcccgacctggcggataaagtggccagtgtgtacgaagccccgggctttttcctggacctggagcccatcccgggagccttggacgctgtgcgggagatgaacgacctaccggacacgcaggtcttcatctgcaccagccccctgctgaagtaccaccactgtgtgggtgagaagtaccgctgggtggagcagcacctggggccccagttcgtagaacgaattatcctgacaagggacaagacggtggtcttgggggacctgctcattgatgacaaggacacagttcgaggccaggaggagaccccaagctgggagcacatcttgttcacctgctgccacaatcggcacctggtcctgcccccgacaaggagacggctgctctcctggagtgacaactggagggagatcttagatagcaagcgcggagctgcgcagcgggaatgagcggggatgccgcgggcagcagctggagctaaaggaagggcaggcccacaggggccaccgcagagccgagtcggggcggcatcgtgctggtgcctctggccccgtggagtggagcaggcagataccgttaagcgctgtgctaccgggccccaggcccagccacccggtacctcccgagaggctgtccctggaccctggctggcatggaaatacagtgggaaaaccagtcgggacctttaataaaagaccttggctttcta

SEQ ID NO: 295532 - DNA, 997 bp, Homo sapiens
agcagcgctccctccgcttccggccgagcccgcgccccccagaccccgagagctcgcagctccggcccggcggcgatggcgcggagcgtgcgcgtgctggtggacatggacggcgtcctggccgacttcgaggccggcctcctgcggggcttccgccgccgcttccctgaggagccgcacgtgccgctggagcagcgccgcggcttcctggcccgcgagcagtaccgcgccctgcggcccgacctggcggataaagtggccagtgtgtacgaagccccgggctttttcctggacctggagcccatcccgggagccttggacgctgtgcgggagatgaacgacctaccggaccccctgctgaagtaccaccactgtgtgggtgagaaggtgtggctgccccgcccctactccgcacgtggagctgcctaaatcctgattttaaaaagaaaccaccagaaacccagaagtaccgctgggtggagcagcacctggggccccagttcgtagaacgaattatcctgacaagggacaagacggtggtcttgggggacctgctcattgatgacaaggacacagttcgaggccaggaggagaccccaagctgggagcacatcttgttcacctgctgccacaatcggcacctggtcctgcccccgacaaggagacggctgctctcctggagtgacaactggagggagatcttagatagcaagcgcggagctgcgcagcgggaatgagcggggatgccgcgggcagcagctggagctaaaggaagggcaggcccacaggggccaccgcagagccgagtcggggcggcatcgtgctggtgcctctggccccgtggagtggagcaggcagataccgttaagcgctgtgctaccgggccccaggcccagccacccggtacctcccgagaggctgtccctggaccctggctggcatggaaatacagtgggaaaaccagtcgggacctttaataaaagaccttggctttcta

SEQ ID NO: 295533 - DNA, 906 bp, Homo sapiens
agcagcgctccctccgcttccggccgagcccgcgccccccagaccccgagagctcgcagctccggcccggcggcgatggcgcggagcgtgcgcgtgctggtggacatggacggcgtcctggccgacttcgaggccggcctcctgcggggcttccgccgccgcttccctgaggagccgcacgtgccgctggagcagcgccgcggcttcctggcccgcgagcagtaccgcgccctgcggcccgacctggcggataaagtggccagtgtgtacgaagccccgggctttttcctggacctggagcccatcccgggagccttggacgctgtgcgggagatgaacgacctaccggacacgcaggtcttcatctgcaccagccccctgctgaagtaccaccactgtgtgggtgagaagtaccgctgggtggagcagcacctggggccccagttcgtagaacgaattatcctgacaagggacaagacggtggtcttgggggacctgctcattgatgacaaggacacagttcgaggccaggaggagaccccaagctgggagcacatcttgttcacctgctgccacaatcggcacctggagtgacaactggagggagatcttagatagcaagcgcggagctgcgcagcgggaatgagcggggatgccgcgggcagcagctggagctaaaggaagggcaggcccacaggggccaccgcagagccgagtcggggcggcatcgtgctggtgcctctggccccgtggagtggagcaggcagataccgttaagcgctgtgctaccgggccccaggcccagccacccggtacctcccgagaggctgtccctggaccctggctggcatggaaatacagtgggaaaaccagtcgggacctttaataaaagaccttggctttcta

SEQ ID NO: 295534 - DNA, 1096 bp, Homo sapiens
agcagcgctccctccgcttccggccgagcccgcgccccccagaccccgagagctcgcagctccggcccggcggcgatggcgcggagcgtgcgcgtgctggtggacatggacggcgtcctggccgacttcgaggccggcctcctgcggggcttccgccgccgcttccctgaggagccgcacgtgccgctggagcagcgccgcggcttcctggcccgcgagcagtaccgcgccctgcggcccgacctggcggataaagtggccagtgtgtacgaagccccgggctttttcctggacctggagcccatcccgggagccttggacgctgtgcgggagatgaacgacctaccggagtaaggagagaggggggcgggcggagtcctgggcgggctcctggctcccggcggtaacggcgtccttctccgcagcacgcaggtcttcatctgcaccagccccctgctgaagtaccaccactgtgtgggtgagaaggtgtggctgccccgcccctactccgcacgtggagctgcctaaatcctgattttaaaaagaaaccaccagaaacccagaagtaccgctgggtggagcagcacctggggccccagttcgtagaacgaattatcctgacaagggacaagacggtggtcttgggggacctgctcattgatgacaaggacacagttcgaggccaggaggagaccccaagctgggagcacatcttgttcacctgctgccacaatcggcacctggtcctgcccccgacaaggagacggctgctctcctggagtgacaactggagggagatcttagatagcaagcgcggagctgcgcagcgggaatgagcggggatgccgcgggcagcagctggagctaaaggaagggcaggcccacaggggccaccgcagagccgagtcggggcggcatcgtgctggtgcctctggccccgtggagtggagcaggcagataccgttaagcgctgtgctaccgggccccaggcccagccacccggtacctcccgagaggctgtccctggaccctggctggcatggaaatacagtgggaaaaccagtcgggacctttaataaaagaccttggctttcta

SEQ ID NO: 295535 - DNA, 1348 bp, Homo sapiens
agcagcgctccctccgcttccggccgagcccgcgccccccagaccccgagagctcgcagctccggcccggcggcgatggcgcggagcgtgcgcgtgctggtggacatggacggcgtcctggccgacttcgaggccggcctcctgcggggcttccgccgccgcttccctgaggagccgcacgtgccgctggagcagcgccgcggcttcctggcccgcgagcagtaccgcgccctgcggcccgacctggcggtagggggcgcagggtccccacccgggcagggcccgctcgctccgttccgggggtctcccccttctctgtgaagggcgcagagctctcaccctggaacccgcgggcagcgcaccctggggaggagcctttgggcgcgtgcccctgaccgacgccccctccgcccctctgagctcgggcccggagcccccaggagcctccctgcgggtcctcgcgggaacgggaagccgggacccagaactcttgtctttcaggataaagtggccagtgtgtacgaagccccgggctttttcctggacctggagcccatcccgggagccttggacgctgtgcgggagatgaacgacctaccggagtaaggagagaggggggcgggcggagtcctgggcgggctcctggctcccggcggtaacggcgtccttctccgcagcacgcaggtcttcatctgcaccagccccctgctgaagtaccaccactgtgtgggtgagaaggtgtggctgccccgcccctactccgcacgtggagctgcctaaatcctgattttaaaaagaaaccaccagaaacccagaagtaccgctgggtggagcagcacctggggccccagttcgtagaacgaattatcctgacaagggacaagacggtggtcttgggggacctgctcattgatgacaaggacacagttcgaggccaggaggagaccccaagctgggagcacatcttgttcacctgctgccacaatcggcacctggtcctgcccccgacaaggagacggctgctctcctggagtgacaactggagggagatcttagatagcaagcgcggagctgcgcagcgggaatgagcggggatgccgcgggcagcagctggagctaaaggaagggcaggcccacaggggccaccgcagagccgagtcggggcggcatcgtgctggtgcctctggccccgtggagtggagcaggcagataccgttaagcgctgtgctaccgggccccaggcccagccacccggtacctcccgagaggctgtccctggaccctggctggcatggaaatacagtgggaaaaccagtcgggacctttaataaaagaccttggctttcta

SEQ ID NO: 295536 - DNA, 1445 bp, Homo sapiens
agcagcgctccctccgcttccggccgagcccgcgccccccagaccccgagagctcgcagctccggcccggcggcgatggcgcggagcgtgcgcgtgctggtggacatggacggcgtcctggccgacttcgaggccggcctcctgcggggcttccgccgccgcttccctgaggagccgcacgtgccgctggagcagcgccgcggcttcctggcccgcgagcagtaccgcgccctgcggcccgacctggcggtagggggcgcagggtccccacccgggcagggcccgctcgctccgttccgggggtctcccccttctctgtgaagggcgcagagctctcaccctggaacccgcgggcagcgcaccctggggaggagcctttgggcgcgtgcccctgaccgacgccccctccgcccctctgagctcgggcccggagcccccaggagcctccctgcgggtcctcgcgggaacgggaagccgggacccagaactcttgtctttcaggataaagtggccagtgtgtacgaagccccgggctttttcctggacctggagcccatcccgggagccttggacgctgtgcgggagatgaacgacctaccggagtaaggagagaggggggcgggcggagtcctgggcgggctcctggctcccggcggtaacggcgtccttctccgcagcacgcaggtcttcatctgcaccagccccctgctgaagtaccaccactgtgtgggtgagaaggtgtggctgccccgcccctactccgcacgtggagctgcctaaatcctgattttaaaaagaaaccaccagaaacccagaaggtgggggtggggggctctcaagggcttagagccaactccctatccctgaattccggcttccatcaggccctactcacagactgtgttttctacacagtaccgctgggtggagcagcacctggggccccagttcgtagaacgaattatcctgacaagggacaagacggtggtcttgggggacctgctcattgatgacaaggacacagttcgaggccaggaggagaccccaagctgggagcacatcttgttcacctgctgccacaatcggcacctggtcctgcccccgacaaggagacggctgctctcctggagtgacaactggagggagatcttagatagcaagcgcggagctgcgcagcgggaatgagcggggatgccgcgggcagcagctggagctaaaggaagggcaggcccacaggggccaccgcagagccgagtcggggcggcatcgtgctggtgcctctggccccgtggagtggagcaggcagataccgttaagcgctgtgctaccgggccccaggcccagccacccggtacctcccgagaggctgtccctggaccctggctggcatggaaatacagtgggaaaaccagtcgggacctttaataaaagaccttggctttcta

SEQ ID NO: 295537 - DNA, 1016 bp, Homo sapiens
agcagcgctccctccgcttccggccgagcccgcgccccccagaccccgagagctcgcagctccggcccggcggcgatggcgcggagcgtgcgcgtgctggtggacatggacggcgtcctggccgacttcgaggccggcctcctgcggggcttccgccgccgcttccctgaggagccgcacgtgccgctggagcagcgccgcggcttcctggcccgcgagcagtaccgcgccctgcggcccgacctggcggataaagtggccagtgtgtacgaagccccgggctttttcctggacctggagcccatcccgggagccttggacgctgtgcgggagatgaacgacctaccggagtaaggagagaggggggcgggcggagtcctgggcgggctcctggctcccggcggtaacggcgtccttctccgcagcacgcaggtcttcatctgcaccagccccctgctgaagtaccaccactgtgtgggtgagaagtaccgctgggtggagcagcacctggggccccagttcgtagaacgaattatcctgacaagggacaagacggtggtcttgggggacctgctcattgatgacaaggacacagttcgaggccaggaggagaccccaagctgggagcacatcttgttcacctgctgccacaatcggcacctggtcctgcccccgacaaggagacggctgctctcctggagtgacaactggagggagatcttagatagcaagcgcggagctgcgcagcgggaatgagcggggatgccgcgggcagcagctggagctaaaggaagggcaggcccacaggggccaccgcagagccgagtcggggcggcatcgtgctggtgcctctggccccgtggagtggagcaggcagataccgttaagcgctgtgctaccgggccccaggcccagccacccggtacctcccgagaggctgtccctggaccctggctggcatggaaatacagtgggaaaaccagtcgggacctttaataaaagaccttggctttcta

SEQ ID NO: 295538 - DNA, 1268 bp, Homo sapiens
agcagcgctccctccgcttccggccgagcccgcgccccccagaccccgagagctcgcagctccggcccggcggcgatggcgcggagcgtgcgcgtgctggtggacatggacggcgtcctggccgacttcgaggccggcctcctgcggggcttccgccgccgcttccctgaggagccgcacgtgccgctggagcagcgccgcggcttcctggcccgcgagcagtaccgcgccctgcggcccgacctggcggtagggggcgcagggtccccacccgggcagggcccgctcgctccgttccgggggtctcccccttctctgtgaagggcgcagagctctcaccctggaacccgcgggcagcgcaccctggggaggagcctttgggcgcgtgcccctgaccgacgccccctccgcccctctgagctcgggcccggagcccccaggagcctccctgcgggtcctcgcgggaacgggaagccgggacccagaactcttgtctttcaggataaagtggccagtgtgtacgaagccccgggctttttcctggacctggagcccatcccgggagccttggacgctgtgcgggagatgaacgacctaccggagtaaggagagaggggggcgggcggagtcctgggcgggctcctggctcccggcggtaacggcgtccttctccgcagcacgcaggtcttcatctgcaccagccccctgctgaagtaccaccactgtgtgggtgagaagtaccgctgggtggagcagcacctggggccccagttcgtagaacgaattatcctgacaagggacaagacggtggtcttgggggacctgctcattgatgacaaggacacagttcgaggccaggaggagaccccaagctgggagcacatcttgttcacctgctgccacaatcggcacctggtcctgcccccgacaaggagacggctgctctcctggagtgacaactggagggagatcttagatagcaagcgcggagctgcgcagcgggaatgagcggggatgccgcgggcagcagctggagctaaaggaagggcaggcccacaggggccaccgcagagccgagtcggggcggcatcgtgctggtgcctctggccccgtggagtggagcaggcagataccgttaagcgctgtgctaccgggccccaggcccagccacccggtacctcccgagaggctgtccctggaccctggctggcatggaaatacagtgggaaaaccagtcgggacctttaataaaagaccttggctttcta

SEQ ID NO: 295539 - DNA, 1273 bp, Homo sapiens
agcagcgctccctccgcttccggccgagcccgcgccccccagaccccgagagctcgcagctccggcccggcggcgatggcgcggagcgtgcgcgtgctggtggacatggacggcgtcctggccgacttcgaggccggcctcctgcggggcttccgccgccgcttccctgaggagccgcacgtgccgctggagcagcgccgcggcttcctggcccgcgagcagtaccgcgccctgcggcccgacctggcggtagggggcgcagggtccccacccgggcagggcccgctcgctccgttccgggggtctcccccttctctgtgaagggcgcagagctctcaccctggaacccgcgggcagcgcaccctggggaggagcctttgggcgcgtgcccctgaccgacgccccctccgcccctctgagctcgggcccggagcccccaggagcctccctgcgggtcctcgcgggaacgggaagccgggacccagaactcttgtctttcaggataaagtggccagtgtgtacgaagccccgggctttttcctggacctggagcccatcccgggagccttggacgctgtgcgggagatgaacgacctaccggacacgcaggtcttcatctgcaccagccccctgctgaagtaccaccactgtgtgggtgagaaggtgtggctgccccgcccctactccgcacgtggagctgcctaaatcctgattttaaaaagaaaccaccagaaacccagaagtaccgctgggtggagcagcacctggggccccagttcgtagaacgaattatcctgacaagggacaagacggtggtcttgggggacctgctcattgatgacaaggacacagttcgaggccaggaggagaccccaagctgggagcacatcttgttcacctgctgccacaatcggcacctggtcctgcccccgacaaggagacggctgctctcctggagtgacaactggagggagatcttagatagcaagcgcggagctgcgcagcgggaatgagcggggatgccgcgggcagcagctggagctaaaggaagggcaggcccacaggggccaccgcagagccgagtcggggcggcatcgtgctggtgcctctggccccgtggagtggagcaggcagataccgttaagcgctgtgctaccgggccccaggcccagccacccggtacctcccgagaggctgtccctggaccctggctggcatggaaatacagtgggaaaaccagtcgggacctttaataaaagaccttggctttcta

SEQ ID NO: 295540 - DNA, 826 bp, Homo sapiens
agcagcgctccctccgcttccggccgagcccgcgccccccagaccccgagagctcgcagctccggcccggcggcgatggcgcggagcgtgcgcgtgctggtggacatggacggcgtcctggccgacttcgaggccggcctcctgcggggcttccgccgccgcttccctgaggagccgcacgtgccgctggagcagcgccgcggcttcctggcccgcgagcagtaccgcgccctgcggcccgacctggcggataaagtggccagtgtgtacgaagccccgggctttttcctggacctggagcccatcccgggagccttggacgctgtgcgggagatgaacgacctaccggacacgcaggtcttcatctgcaccagccccctgctgaagtaccaccactgtgtgggtgagaaggccaggaggagaccccaagctgggagcacatcttgttcacctgctgccacaatcggcacctggtcctgcccccgacaaggagacggctgctctcctggagtgacaactggagggagatcttagatagcaagcgcggagctgcgcagcgggaatgagcggggatgccgcgggcagcagctggagctaaaggaagggcaggcccacaggggccaccgcagagccgagtcggggcggcatcgtgctggtgcctctggccccgtggagtggagcaggcagataccgttaagcgctgtgctaccgggccccaggcccagccacccggtacctcccgagaggctgtccctggaccctggctggcatggaaatacagtgggaaaaccagtcgggacctttaataaaagaccttggctttcta

SEQ ID NO: 295541 - DNA, 1274 bp, Homo sapiens
  misc_feature (945)..(945): n is a, c, g, or t
agcagcgctccctccgcttccggccgagcccgcgccccccagaccccgagagctcgcagctccggcccggcggcgatggcgcggagcgtgcgcgtgctggtggacatggacggcgtcctggccgacttcgaggccggcctcctgcggggcttccgccgccgcttccctgaggagccgcacgtgccgctggagcagcgccgcggcttcctggcccgcgagcagtaccgcgccctgcggcccgacctggcggataaagtggccagtgtgtacgaagccccgggctttttcctggacctggagcccatcccgggagccttggacgctgtgcgggagatgaacgacctaccggacacgcaggtcttcatctgcaccagccccctgctgaagtaccaccactgtgtgggtgagaagtaccgctgggtggagcagcacctggggccccagttcgtagaacgaattatcctgacaagggacaagacggtggtcttgggggacctgctcattgatgacaaggacacagttcgaggccaggaggagaccccaagctgggagcacatcttgttcacctgctgccacaatcggcacctggtcctgcccccgacaaggagacggctgctctcctggagtgacaactggagggagatcttagatagcaagcgcggagctgcgcagcgggaatgagcggggatgccgcgggcagcagctggagctaaaggaagggcaggcccacaggggccaccgcagagccgagtcggggcggcatcgtgctggtgcctctggccccgtggagtggagcaggcagataccgttaagcgctgtgctaccgggccccaggcccagccacccggtacctcccgagaggctgtccctggaccctggctggcatggaaatacagtgggaaaaccagtcgggacctttaataaaagaccttggctttctaaaanaaaaaaaaaaaaaaaaaaaaaaaaaaaaaaaaaaaaaaaaaaaaaaaaaaaacaaaaacaaaagaaaaaaagaaaaaagaaaaaaaaaaaagagggggggggcccagaaaaaaccagaggggacaccaagaaaagaccatcgcacactatccaagaagggcgcaccaaaggggggacgaagaaaagaaaggagggcggggcgggccaaacacagagaggaagggcggagacaaaggccgcgccggcctatagggagagcgcacaacaactggcgggagaggaacaagaggggaaaccaacaccgcaagaaaaggaagcgggggaagcac

SEQ ID NO: 295542 - DNA, 998 bp, Homo sapiens
agcagcgctccctccgcttccggccgagcccgcgccccccagaccccgagagctcgcagctccggcccggcggcgatggcgcggagcgtgcgcgtgctggtggacatggacggcgtcctggccgacttcgaggccggcctcctgcggggcttccgccgccgcttccctgaggagccgcacgtgccgctggagcagcgccgcggcttcctggcccgcgagcagtaccgcgccctgcggcccgacctggcggataaagtggccagtgtgtacgaagccccgggctttttcctggacctggagcccatcccgggagccttggacgctgtgcgggagatgaacgacctaccggacacgcaggtcttcatctgcaccagccccctgctgaagtaccaccactgtgtgggtgagaagtaccgctgggtggagcagcacctggggccccagttcgtagaacgaattatcctgacaagggacaagacggtggtcttgggggacctgctcattgatgacaaggacacagttcgaggccaggaggagaccccaagctgggagcacatcttgttcacctgctgccacaatcggcacctggtcctgcccccgacaaggagacggctgctctcctggagtgacaactggagggagatcttagatagcaagcgcggagctgcgcagcgggaatgagcggggatgccgcgggcagcagctggagctaaaggaagggcaggcccacaggggccaccgcagagccgagtcggggcggcatcgtgctggtgcctctggccccgtggagtggagcaggcagataccgttaagcgctgtgctaccgggccccaggcccagccacccggtacctcccgagaggctgtccctggaccctggctggcatggaaatacagtgggaaaaccagtcgggacctttaataaaagaccttggctttctaataaaaagaaaacaaacacacttgacacgtgaatctagcaataaaaaacacaaagaa

SEQ ID NO: 295543 - DNA, 1020 bp, Homo sapiens
agcagcgctccctccgcttccggccgagcccgcgccccccagaccccgagagctcgcagctccggcccggcggcgatggcgcggagcgtgcgcgtgctggtggacatggacggcgtcctggccgacttcgaggccggcctcctgcggggcttccgccgccgcttccctgaggagccgcacgtgccgctggagcagcgccgcggcttcctggcccgcgagcagtaccgcgccctgcggcccgacctggcggataaagtggccagtgtgtacgaagccccgggctttttcctggacctggagcccatcccgggagccttggacgctgtgcgggagatgaacgacctaccggagtaaggagagaggggggcgggcggagtcctgggcgggctcctggctcccggcggtaacggcgtccttctccgcagcacgcaggtcttcatctgcaccagccccctgctgaagtaccaccactgtgtgggtgagaaggtgtggctgccccgcccctactccgcacgtggagctgcctaaatcctgattttaaaaagaaaccaccagaaacccagaagtaccgctgggtggagcagcacctggggccccagttcgtagaacgaattatcctgacaagggacaagacggtggtcttgggggacctgctcattgatgacaaggacacagttcgaggccaggaggagaccccaagctgggagcacatcttgttcacctgctgccacaatcggcacctggtcctgcccccgacaaggagacggctgctctcctggagtgacaactggagggagatcttagatagcaagcgccaccgcagagccgagtcggggcggcatcgtgctggtgcctctggccccgtggagtggagcaggcagataccgttaagcgctgtgctaccgggccccaggcccagccacccggtacctcccgagaggctgtccctggaccctggctggcatggaaatacagtgggaaaaccagtcgggacctttaataaaagaccttggctttcta

SEQ ID NO: 295544 - DNA, 1307 bp, Homo sapiens
agcagcgctccctccgcttccggccgagcccgcgccccccagaccccgagagctcgcagctccggcccggcggcgatggcgcggagcgtgcgcgtgctggtggacatggacggcgtcctggccgacttcgaggccggcctcctgcggggcttccgccgccgcttccctgaggagccgcacgtgccgctggagcagcgccgcggcttcctggcccgcgagcagtaccgcgccctgcggcccgacctggcggtagggggcgcagggtccccacccgggcagggcccgctcgctccgttccgggggtctcccccttctctgtgaagggcgcagagctctcaccctggaacccgcgggcagcgcaccctggggaggagcctttgggcgcgtgcccctgaccgacgccccctccgcccctctgagctcgggcccggagcccccaggagcctccctgcgggtcctcgcgggaacgggaagccgggacccagaactcttgtctttcaggataaagtggccagtgtgtacgaagccccgggctttttcctggacctggagcccatcccgggagccttggacgctgtgcgggagatgaacgacctaccggacacgcaggtcttcatctgcaccagccccctgctgaagtaccaccactgtgtgggtgagaaggtgtggctgccccgcccctactccgcacgtggagctgcctaaatcctgattttaaaaagaaaccaccagaaacccagaagtaccgctgggtggagcagcacctggggccccagttcgtagaacgaattatcctgacaagggacaagacggtggtcttgggggacctgctcattgatgacaaggacacagttcgaggttggacccgttatccttggcagcctccaggcctctggcctgcccggattagggagagggagtaataatacccatgacagatggcagcgcgctgtctttcactgtcctaggccaggaggagaccccaagctgggagcacatcttgttcacctgctgccacaatcggcacctggtcctgcccccgacaaggagacggctgctctcctggagtgacaactggagggagatcttagatagcaagcgccaccgcagagccgagtcggggcggcatcgtgctggtgcctctggccccgtggagtggagcaggcagataccgttaagcgctgtgctaccgggccccaggcccagccacccggtacctcccgagaggctgtccctggaccctggctggcatggaaatacagtgggaaaaccagtcgggacctttaataaaagaccttggctttcta

SEQ ID NO: 295545 - DNA, 883 bp, Homo sapiens
agcagcgctccctccgcttccggccgagcccgcgccccccagaccccgagagctcgcagctccggcccggcggcgatggcgcggagcgtgcgcgtgctggtggacatggacggcgtcctggccgacttcgaggccggcctcctgcggggcttccgccgccgcttccctgaggagccgcacgtgccgctggagcagcgccgcggcttcctggcccgcgagcagtaccgcgccctgcggcccgacctggcggataaagtggccagtgtgtacgaagccccgggctttttcctggacctggagcccatcccgggagccttggacgctgtgcgggagatgaacgacctaccggacacgcaggtcttcatctgcaccagccccctgctgaagtaccaccactgtgtgggtgagaaggccaggaggagaccccaagctgggagcacatcttgttcacctgctgccacaatcggcacctggtcctgcccccgacaaggagacggctgctctcctggagtgacaactggagggagatcttagatagcaagcgcggagctgcgcagcgggaatgagcggggatgccgcgggcagcagctggagctaaaggaagggcaggcccacaggggccaccgcagagccgagtcggggcggcatcgtgctggtgcctctggccccgtggagtggagcaggcagataccgttaagcgctgtgctaccgggccccaggcccagccacccggtacctcccgagaggctgtccctggaccctggctggcatggaaatacagtgggaaaaccagtcgggacctttaataaaagaccttggctttctaataaaaagaaaacaaacacacttgacacgtgaatctagcaataaaaaacacaaagaa

SEQ ID NO: 295546 - DNA, 1083 bp, Homo sapiens
agcagcgctccctccgcttccggccgagcccgcgccccccagaccccgagagctcgcagctccggcccggcggcgatggcgcggagcgtgcgcgtgctggtggacatggacggcgtcctggccgacttcgaggccggcctcctgcggggcttccgccgccgcttccctgaggagccgcacgtgccgctggagcagcgccgcggcttcctggcccgcgagcagtaccgcgccctgcggcccgacctggcggtagggggcgcagggtccccacccgggcagggcccgctcgctccgttccgggggtctcccccttctctgtgaagggcgcagagctctcaccctggaacccgcgggcagcgcaccctggggaggagcctttgggcgcgtgcccctgaccgacgccccctccgcccctctgagctcgggcccggagcccccaggagcctccctgcgggtcctcgcgggaacgggaagccgggacccagaactcttgtctttcaggataaagtggccagtgtgtacgaagccccgggctttttcctggacctggagcccatcccgggagccttggacgctgtgcgggagatgaacgacctaccggagtaaggagagaggggggcgggcggagtcctgggcgggctcctggctcccggcggtaacggcgtccttctccgcagcacgcaggtcttcatctgcaccagccccctgctgaagtaccaccactgtgtgggtgagaaggtgtggctgccccgcccctactccgcacgtggagctgcctaaatcctgattttaaaaagaaaccaccagaaacccagaagtaccgctgggtggagcagcacctggggccccagttcgtagaacgaattatcctgacaagccaccgcagagccgagtcggggcggcatcgtgctggtgcctctggccccgtggagtggagcaggcagataccgttaagcgctgtgctaccgggccccaggcccagccacccggtacctcccgagaggctgtccctggaccctggctggcatggaaatacagtgggaaaaccagtcgggacctttaataaaagaccttggctttcta

SEQ ID NO: 295547 - DNA, 643 bp, Homo sapiens
agcagcgctccctccgcttccggccgagcccgcgccccccagaccccgagagctcgcagctccggcccggcggcgatggcgcggagcgtgcgcgtgctggtggacatggacggcgtcctggccgacttcgaggccggcctcctgcggggcttccgccgccgcttccctgaggagccgcacgtgccgctggagcagcgccgcggcttcctggcccgcgagcagtaccgcgccctgcggcccgacctggcggataaagtggccagtgtgtacgaagccccgggctttttcctggacctggagcccatcccgggagccttggacgctgtgcgggagatgaacgacctaccggacacgcaggtcttcatctgcaccagccccctgctgaagtaccaccactgtgtgggtgagaagtaccgctgggtggagcagcacctgggccaccgcagagccgagtcggggcggcatcgtgctggtgcctctggccccgtggagtggagcaggcagataccgttaagcgctgtgctaccgggccccaggcccagccacccggtacctcccgagaggctgtccctggaccctggctggcatggaaatacagtgggaaaaccagtcgggacctttaataaaagaccttggctttcta

SEQ ID NO: 295548 - DNA, 969 bp, Homo sapiens
agcagcgctccctccgcttccggccgagcccgcgccccccagaccccgagagctcgcagctccggcccggcggcgatggcgcggagcgtgcgcgtgctggtggacatggacggcgtcctggccgacttcgaggccggcctcctgcggggcttccgccgccgcttccctgaggagccgcacgtgccgctggagcagcgccgcggcttcctggcccgcgagcagtaccgcgccctgcggcccgacctggcggtagggggcgcagggtccccacccgggcagggcccgctcgctccgttccgggggtctcccccttctctgtgaagggcgcagagctctcaccctggaacccgcgggcagcgcaccctggggaggagcctttgggcgcgtgcccctgaccgacgccccctccgcccctctgagctcgggcccggagcccccaggagcctccctgcgggtcctcgcgggaacgggaagccgggacccagaactcttgtctttcaggataaagtggccagtgtgtacgaagccccgggctttttcctggacctggagcccatcccgggagccttggacgctgtgcgggagatgaacgacctaccggagtaaggagagaggggggcgggcggagtcctgggcgggctcctggctcccggcggtaacggcgtccttctccgcagcacgcaggtcttcatctgcaccagccccctgctgaagtaccaccactgtgtgggtgagaaggtgtggctgccccgcccctactccgcacgtggagctgcctaaatcctgattttaaaaagaaaccaccagaaacccagaaggtgggggtggggggctctcaagggcttagagccaactcccccaggcccagccacccggtacctcccgagaggctgtccctggaccctggctggcatggaaatacagtgggaaaaccagtcgggacctttaataaaagaccttggctttcta

SEQ ID NO: 295549 - DNA, 649 bp, Homo sapiens
agcagcgctccctccgcttccggccgagcccgcgccccccagaccccgagagctcgcagctccggcccggcggcgatggcgcggagcgtgcgcgtgctggtggacatggacggcgtcctggccgacttcgaggccggcctcctgcggggcttccgccgccgcttccctgaggagccgcacgtgccgctggagcagcgccgcggcttcctggcccgcgagcagtaccgcgccctgcggcccgacctggcggataaagtggccagtgtgtacgaagccccgggctttttcctggacctggagcccatcccgggagccttggacgctgtgcgggagatgaacgacctaccggacacgcaggtcttcatctgcaccagccccctgctgaagtaccaccactgtgtgggtgagaagctggagctaaaggaagggcaggcccacaggggccaccgcagagccgagtcggggcggcatcgtgctggtgcctctggccccgtggagtggagcaggcagataccgttaagcgctgtgctaccgggccccaggcccagccacccggtacctcccgagaggctgtccctggaccctggctggcatggaaatacagtgggaaaaccagtcgggacctttaataaaagaccttggctttcta

SEQ ID NO: 295550 - DNA, 507 bp, Homo sapiens
ttcagtgaaaactttttgaagaatatatttactatttattgacaccaagacccaggtagtgcttagatctttacccctactctggtgcttcttctttcccaagtattagggaacacaaaccaaactcctgggtttagatgacaaaaggaatttagaactttgaaatccaagtctaattaaaatgtctgaactgttctggaaggaggaagaagagacatagagaagaaaggtgtcaaacgacaaattattattattattattattattattattgctgtttatttatttttgagacagggtcttgctctgtcacccaggctagagtgcagtggcgtaatcacagctcactgcagccttgacctcctgggctcaagtaatcctcccatctcattctcctgagtaccttggactaaaggcaggtgctaccacacctggctaatttttttttatttttagtagagacgtgatctcgctatgttgcccaggctggtctagaactcgctctca

SEQ ID NO: 295551 - DNA, 448 bp, Homo sapiens
ccagaaaagggtccatccacaaggagagaaacgtggaaagggcagaggcttcaccctacctttacagccacacttcttgcaggtagtgttcaagacagcctcaagggtgatcttctgcccagtgtaatcctggaaggatcgcctccgcctctcttcttgcctataatgaaaaagataccgactgccggcccccttaagagatatggccagagatactacaaggatgacatatgagttcgatggaccagacctgggcacaagaagaagaaataacgtaaagcagagggcatatctggtatttatactctaaactggataagaaggtagctctctcctggataaacatgaccagtctagaagcgttagcagtgaaaaactggaaacaacttaaaatgattatgtggtacatctgaatgacagaataaagccattaaatgtttatagaaaa

SEQ ID NO: 295552 - DNA, 350 bp, Homo sapiens
agtagcttacttagcctcgatgtttaatactgaccacgttataccgtgagctgataaggctattcttgagctcttaccttttcccgtggtttacaaatacgcttatgtttttgataactttttttgtagctctggtattatggagaacatttgtttatgctacatggaaaatctctaactgtgattccatacaagtgtgaagtgtcatcattagcaggtgctcttggaaaactcaagcatagtcaagatccaggtagaaacttacttctgtttgttttattaatacaaaccgttttattaacttgtagtttcgtacagattcccacagccttctatttgtaaagcttttt

SEQ ID NO: 295553 - DNA, 2547 bp, Homo sapiens
agcgggccgggagtgagcgcggccgtacttaggtttgctcaaaatggcagcgctggaggaagaattcacgttgtcttcggtagtcctgagcgccgggcctgaaggactcctaggcgtggagcagagcgacaaaacagaccagtttctagtgacagacagcggcaggacagtcatcctctataaggtttctgatcagaaacccttggggagctggtcagtgaaacaaggtcaaattataacatgtccagctgtgtgcaactttcaaactggagagtatgttgttgtacacgataataaggttttaagaatatggaataatgaagatgtaaacctggataaagtatttaaagctacattgtcagcagaagtatataggatactttcagtgcaagggacagaacccttggtgctcttcaaggaaggtgctgttcgtggtttagaggccttgcttgcagacccccagcagaaaattgaaactgttatctctgatgaagaagtgattaaatggacaaagtttttcgtagtattcagacatcctgttttaatttttattactgaaaaacatggaaattactttgcttacgtgcaaatgtttaactcacgtatcttaaccaaatatacactcttacttggacaagacgaaaactctgttataaagagttttactgcatctgtagatcggaaattcatctctttgatgtcattaagctctgatggttgtatatatgaaaccttgataccaatacgtccagctgacccagaaaaaaatcagagcttagttaaatcactgctgctcaaggctgttgtatctggtaacgctcgaaatggagttgcactcactgccctggatcaggatcacgtcgcagtcctaggaagtccactagcagcttctaaggaatgcctctctgtatggaacataaaatttcaaacactacagacttcaaaagagttaccacaagggaccagtggtcaactctggtattatggagaacatttgtttatgctacatggaaaatctctaactgtgattccatacaagtgtgaagtgtcatcattagcaggtgctcttggaaaactcaagcatagtcaagatccaggaactcatgtcgtgtcccattttgtaaactgggagacacctcaaggatgtggacttgggttccagaactcagagcagtcaagaagaattttaaggagacgaaaaattgaagtgagtttacagccagaggttccaccatccaaacaacttttgtcaaccataatgaaagattcagaaaaacacattgaagtagaagtacggaaatttttggctctgaagcagacacctgactttcatactgtcattggggacacagtaacaggacttctggaaaggtgtaaagcagaaccatcattttatccccggaactgtctgatgcagcttatccaaacgcatgtgctttcttacagtttgtgccccgacttaatggagattgccttaaaaaagaaagatgtacagttgttacaactctgtctacagcagttccctgacattcctgaatcagtcacctgtgcttgcttaaaaattttcttgagcattggtgatgacagtcttcaagaaacagatgttaatatggagtcagtttttgactatagtataaattctgtacatgatgagaaaatggaagagcaaactgaaattcttcaaaatggcttcaatcctgaagaagataaatgcaataactgtgatcaagagttaaataaaaagccccaggacgaaacaaaggagagcacttcatgccctgtggtacaaaaaagagcagctctacttaatgcaattcttcattcagcatatagcgagacatttcttctgcctcatttgaaagacatcccagcacagcatatcacgctgtttcttaagtatttgtatttcctgtacctgaagtgtagcgaaaatgctactatgactcttcctggaatacacccacctaccttgaaccagattatggattggatatgtctacttctggatgcgaattttactgttgttgtaatgatgccagaagcaaagaggctactgataaatctttacaagcttgtaaaatctcagatatctgtttattctgagctcaacaagattgaagtaagttttcgggagctacagaaattaaatcaagaaaagaataatagaggattatattcaattgaagtgctggagctcttctgatattatcaattctccttcatagacattttataaagctcttttatgtgaactcttgcttcatccaggcaagaacggtgttttgtttgcgaccatctcagtgtcaagagaaacgtgtcagtgagtacctggaccatcacttaactgatgctccggggtaggactgcaggtttcacatgaacctgttctaggctgtggacattggtgtggagaggttctgcaattttttaaaaatatgtaactgggttgattttaagtaaaattatttgtgtattgataaaagtctaatttcttatcatgtgttttgaattttttcttttaataaaaaatgaccattgaagcagtga

SEQ ID NO: 295554 - DNA, 2581 bp, Homo sapiens
agcgggccgggagtgagcgcggccgtacttaggtttgctcaaaatggcagcgctggaggaagaattcacgttgtcttcggtagtcctgagcgccgggcctgaaggactcctaggcgtggagcagagcgacaaaacagaccagtttctagtgacagacagcggcaggacagtcatcctctataaggtttctgatcagaaacccttggggagctggtcagtgaaacaaggtcaaattataacatgtccagctgtgtgcaactttcaaactggagagtatgttgttgtacacgataataaggttttaagaatatggaataatgaagatgtaaacctggataaagtatttaaagctacattgtcagcagaagtatataggatactttcagtgcaagggacagaacccttggtgctcttcaaggaaggtgctgttcgtggtttagaggccttgcttgcagacccccagcagaaaattgaaactgttatctctgatgaagaagtgattaaatggacaaagtttttcgtagtattcagacatcctgttttaatttttattactgaaaaacatggaaattactttgcttacgtgcaaatgtttaactcacgtatcttaaccaaatatacactcttacttggacaagacgaaaactctgttataaagagttttactgcatctgtagatcggaaattcatctctttgatgtcattaagctctgatggttgtatatatgaaaccttgataccaatacgtccagctgacccagaaaaaaatcagagcttagttaaatcactgctgctcaaggctgttgtatctggtaacgctcgaaatggagttgcactcactgccctggatcaggatcacgtcgcagtcctaggaagtccactagcagcttctaaggaatgcctctctgtatggaacataaaatttcaaacactacagacttcaaaagagttaccacaagggaccagtggtcaactctggtattatggagaacatttgtttatgctacatggaaaatctctaactgtgattccatacaagtgtgaagtgtcatcattagcaggtgctcttggaaaactcaagcatagtcaagatccaggaactcatgtcgtgtcccattttgtaaactgggagacacctcaaggatgtggacttgggttccagaactcagagcagtcaagaagaattttaaggagacgaaaaattgaagtgagtttacagccagaggttccaccatccaaacaacttttgtcaaccataatgaaagattcagaaaaacacattgaagtagaagtacggaaatttttggctctgaagcagacacctgactttcatactgtcattggggacacagtaacaggacttctggaaaggtgtaaagcagaaccatcattttatccccggaactgtctgatgcagcttatccaaacgcatgtgctttcttacagtttgtgccccgacttaatggagattgccttaaaaaagaaagatgtacagttgttacaactctgtctacagcagttccctgacattcctgaatcagtcacctgtgcttgcttaaaaattttcttgagcattggtgatgacagtcttcaagaaacagatgttaatatggagtcagtttttgactatagtataaattctgtacatgatgagaaaatggaagagcaaactgaaattcttcaaaatggcttcaatcctgaagaagataaatgcaataactgtgatcaagagttaaataaaaagccccaggacgaaacaaaggagagcacttcatgccctgtggtacaaaaaagagcagctctacttaatgcaattcttcattcagcatatagcgagacatttcttctgcctcatttgaaagacatcccagcacagcatatcacgctgtttcttaagtatttgtatttcctgtacctgaagtgtagcgaaaatgctactatgactcttcctggaatacacccacctaccttgaaccagattatggattggatatgtctacttctggatgcgaattttactgttgttgtaatgatgccagaagcaaagaggctactgataaatctttacaagcttgtaaaatctcagatatctgtttattctgagctcaacaagattgaagtaagttttcgggagctacagaaattaaatcaagaaaagaataatagaggattatattcaattgaagtgctggagctcttctgatattatcaattctccttcatagacattttataaagctcttttatgtgaactcttgcttcatccaggcaagaacggtgttttgtttgcgaccatctcagtgtcaagagaaacgtgtcagtgagtacctggaccatcacttaactgatgctccggggtaggactgcaggtttcacatgaacctgttctaggctgtggacattggtgtggagaggttctgcaattttttaaaaatatgtaactgggttgattttaagtaaaattatttgtgtattgataaaagtctaatttcttatcatgtgttttgaattttttcttttaataaaaaatgaccattgaagcagtgaaaaaaaaaagaatgtaattttatcagagtcagaa

SEQ ID NO: 295555 - DNA, 2724 bp, Homo sapiens
agcgggccgggagtgagcgcggccgtacttaggtttgctcaaaatggcagcgctggaggaagaattcacgttgtcttcggtagtcctgagcgccgggcctgaaggactcctaggcgtggagcagagcgacaaaacagaccagtttctagtgacagacagcggcaggacagtcatcctctataaggtttctgatcagaaacccttggggagctggtcagtgaaacaaggtcaaattataacatgtccagctgtgtgcaactttcaaactggagagtatgttgttgtacacgataataaggttttaagaatatggaataatgaagatgtaaacctggataaagtatttaaagctacattgtcagcagaagtatataggatactttcagtgcaagggacagaacccttggtgctcttcaaggaaggtgctgttcgtggtttagaggccttgcttgcagacccccagcagaaaattgaaactgttatctctgatgaagaagtgattaaatggacaaagtttttcgtagtattcagacatcctgttttaatttttattactgaaaaacatggaaattactttgcttacgtgcaaatgtttaactcacgtatcttaaccaaatatacactcttacttggacaagacgaaaactctgttataaagagttttactgcatctgtagatcggaaattcatctctttgatgtcattaagctctgatggttgtatatatgaaaccttgataccaatacgtccagctgacccagaaaaaaatcagagcttagttaaatcactgctgctcaaggctgttgtatctggtaacgctcgaaatggagttgcactcactgccctggatcaggatcacgtcgcagtcctaggaagtccactagcagcttctaaggaatgcctctctgtatggaacataaaatttcaaacactacagacttcaaaagagttaccacaagggaccagtggtcaactctggtattatggagaacatttgtttatgctacatggaaaatctctaactgtgattccatacaagtgtgaagtgtcatcattagcaggtgctcttggaaaactcaagcatagtcaagatccaggaactcatgtcgtgtcccattttgtaaactgggagacacctcaaggatgtggacttgggttccagaactcagagcagtcaagaagaattttaaggagacgaaaaattgaagtgagtttacagccagaggttccaccatccaaacaacttttgtcaaccataatgaaagattcagaaaaacacattgaagtagaagtacggaaatttttggctctgaagcagacacctgactttcatactgtcattggggacacagtaacaggacttctggaaaggtgtaaagcagaaccatcattttatccccggaactgtctgatgcagcttatccaaacgcatgtgctttcttacagtttgtgccccgacttaatggagattgccttaaaaaagaaagatgtacagttgttacaactctgtctacagcagttccctgacattcctgaatcagtcacctgtgcttgcttaaaaattttcttgagcattggtgatgacagtcttcaagaaacagatgttaatatggagtcagtttttgactatagtataaattctgtacatgatgagaaaatggaagagcaaactgaaattcttcaaaatggcttcaatcctgaagaagataaatgcaataactgtgatcaagagttaaataaaaagccccaggacgaaacaaaggagagcacttcatgccctgtggtacaaaaaagagcagctctacttaatgcaattcttcattcagcatatagcgagacatttcttctgcctcatttgaaagacatcccagcacagcatatcacgctgtttcttaagtatttgtatttcctgtacctgaagtgtagcgaaaatgctactatgactcttcctggaatacacccacctaccttgaaccagattatggattggatatgtctacttctggatgcgaattttactgttgttgtaatgatgccagaagcaaagaggctactgataaatctttacaagcttgtaaaatctcagatatctgtttattctgagctcaacaagattgaagtaagttttcgggagctacagaaattaaatcaagaaaagaataatagaggattatattcaattgaagtgctggagctcttctgatattatcaattctccttcatagacattttataaagctcttttatgtgaactcttgcttcatccaggcaagaacggtgttttgtttgcgaccatctcagtgtcaagagaaacgtgtcagtgagtacctggaccatcacttaactgatgctccggggtaggactgcaggtttcacatgaacctgttctaggctgtggacattggtgtggagaggttctgcaattttttaaaaatatgtaactgggttgattttaagtaaaattatttgtgtattgataaaagtctaataaaaaaaaaaaaaaaaaaaaaaaaaaaaaaaaaaaaaaccccgaagggcatcttcaatattgcgcggggggcgggaaaaagagaggggaacggagaaaggggcacagtggcactaagcgtgtctcccaggcccccggtttcttgttgtacaaggggggaaaatcaggcggggccccccaaaaaagggaaggccgagaataaaatcgagaaagccccgggtaacccggatataagg

SEQ ID NO: 295556 - DNA, 2556 bp, Homo sapiens
agcgggccgggagtgagcgcggccgtacttaggtttgctcaaaatggcagcgctggaggaagaattcacgttgtcttcggtagtcctgagcgccgggcctgaaggactcctaggcgtggagcagagcgacaaaacagaccagtttctagtgacagacagcggcaggacagtcatcctctataaggtttctgatcagaaacccttggggagctggtcagtgaaacaaggtcaaattataacatgtccagctgtgtgcaactttcaaactggagagtatgttgttgtacacgataataaggttttaagaatatggaataatgaagatgtaaacctggataaagtatttaaagctacattgtcagcagaagtatataggatactttcagtgcaagggacagaacccttggtgctcttcaaggaaggtgctgttcgtggtttagaggccttgcttgcagacccccagcagaaaattgaaactgttatctctgatgaagaagtgattaaatggacaaagtttttcgtagtattcagacatcctgttttaatttttattactgaaaaacatggaaattactttgcttacgtgcaaatgtttaactcacgtatcttaaccaaatatacactcttacttggacaagacgaaaactctgttataaagagttttactgcatctgtagatcggaaattcatctctttgatgtcattaagctctgatggttgtatatatgaaaccttgataccaatacgtccagctgacccagaaaaaaatcagagcttagttaaatcactgctgctcaaggctgttgtatctggtaacgctcgaaatggagttgcactcactgccctggatcaggatcacgtcgcagtcctaggaagtccactagcagcttctaaggaatgcctctctgtatggaacataaaatttcaaacactacagacttcaaaagagttaccacaagggaccagtggtcaactctggtattatggagaacatttgtttatgctacatggaaaatctctaactgtgattccatacaagtgtgaagtgtcatcattagcaggtgctcttggaaaactcaagcatagtcaagatccaggaactcatgtcgtgtcccattttgtaaactgggagacacctcaaggatgtggacttgggttccagaactcagagcagtcaagaagaattttaaggagacgaaaaattgaagtgagtttacagccagaggttccaccatccaaacaacttttgtcaaccataatgaaagattcagaaaaacacattgaagtagaagtacggaaatttttggctctgaagcagacacctgactttcatactgtcattggggacacagtaacaggacttctggaaaggtgtaaagcagaaccatcattttatccccggaactgtctgatgcagcttatccaaacgcatgtgctttcttacagtttgtgccccgacttaatggagattgccttaaaaaagaaagatgtacagttgttacaactctgtctacagcagttccctgacattcctgaatcagtcacctgtgcttgcttaaaaattttcttgagcattggtgatgacagtcttcaagaaacagatgttaatatggagtcagtttttgactatagtataaattctgtacatgatgagaaaatggaagagcaaactgaaattcttcaaaatggcttcaatcctgaagaagataaatgcaataactgtgatcaagagttaaataaaaagccccaggacgaaacaaaggagagcacttcatgccctgtggtacaaaaaagagcagctctacttaatgcaattcttcattcagcatatagcgagacatttcttctgcctcatttgaaagacatcccagcacagcatatcacgctgtttcttaagtatttgtatttcctgtacctgaagtgtagcgaaaatgctactatgactcttcctggaatacacccacctaccttgaaccagattatggattggatatgtctacttctggatgcgaattttactgttgttgtaatgatgccagaagcaaagaggctactgataaatctttacaagcttgtaaaatctcagatatctgtttattctgagctcaacaagattgaagtaagttttcgggagctacagaaattaaatcaagaaaagaataatagaggattatattcaattgaagtgctggagctcttctgatattatcaattctccttcatagacattttataaagctcttttatgtgaactcttgcttcatccaggcaagaacggtgttttgtttgcgaccatctcagtgtcaagagaaacgtgtcagtgagtacctggaccatcacttaactgatgctccggggtaggactgcaggtttcacatgaacctgttctaggctgtggacattggtgtggagaggttctgcaattttttaaaaatatgtaactgggttgattttaagtaaaattatttgtgtattgataaaagtctaatttcaaaacacatgataagaaattagacttttatcaatacacaaataattttacttaaaatgtcgacg

SEQ ID NO: 295557 - DNA, 3123 bp, Homo sapiens
  misc_feature (2163)..(2163): n is a, c, g, or t
agcgggccgggagtgagcgcggccgtacttaggtttgctcaaaatggcagcgctggaggaagaattcacgttgtcttcggtagtcctgagcgccgggcctgaaggactcctaggcgtggagcagagcgacaaaacagaccagtttctagtgacagacagcggcaggacagtcatcctctataaggtttctgatcagaaacccttggggagctggtcagtgaaacaaggtcaaattataacatgtccagctgtgtgcaactttcaaactggagagtatgttgttgtacacgataataaggttttaagaatatggaataatgaagatgtaaacctggataaagtatttaaagctacattgtcagcagaagtatataggatactttcagtgcaagggacagaacccttggtgctcttcaaggaaggtgctgttcgtggtttagaggccttgcttgcagacccccagcagaaaattgaaactgttatctctgatgaagaagtgattaaatggacaaagtttttcgtagtattcagacatcctgttttaatttttattactgaaaaacatggaaattactttgcttacgtgcaaatgtttaactcacgtatcttaaccaaatatacactcttacttggacaagacgaaaactctgttataaagagttttactgcatctgtagatcggaaattcatctctttgatgtcattaagctctgatggttgtatatatgaaaccttgataccaatacgtccagctgacccagaaaaaaatcagagcttagttaaatcactgctgctcaaggctgttgtatctggtaacgctcgaaatggagttgcactcactgccctggatcaggatcacgtcgcagtcctaggaagtccactagcagcttctaaggaatgcctctctgtatggaacataaaatttcaaacactacagacttcaaaagagttaccacaagggaccagtggtcaactctggtattatggagaacatttgtttatgctacatggaaaatctctaactgtgattccatacaagtgtgaagtgtcatcattagcaggtgctcttggaaaactcaagcatagtcaagatccaggaactcatgtcgtgtcccattttgtaaactgggagacacctcaaggatgtggacttgggttccagaactcagagcagtcaagaagaattttaaggagacgaaaaattgaagtgagtttacagccagaggttccaccatccaaacaacttttgtcaaccataatgaaagattcagaaaaacacattgaagtagaagtacggaaatttttggctctgaagcagacacctgactttcatactgtcattggggacacagtaacaggacttctggaaaggtgtaaagcagaaccatcattttatccccggaactgtctgatgcagcttatccaaacgcatgtgctttcttacagtttgtgccccgacttaatggagattgccttaaaaaagaaagatgtacagttgttacaactctgtctacagcagttccctgacattcctgaatcagtcacctgtgcttgcttaaaaattttcttgagcattggtgatgacagtcttcaagaaacagatgttaatatggagtcagtttttgactatagtataaattctgtacatgatgagaaaatggaagagcaaactgaaattcttcaaaatggcttcaatcctgaagaagataaatgcaataactgtgatcaagagttaaataaaaagccccaggacgaaacaaaggagagcacttcatgccctgtggtacaaaaaagagcagctctactgtatcctttgacatagagcatccctctgtttctctttatagggtatagttatatgccaagcagtaaccaaggagtaactcaataatttaaggtttttctttccttttccaattgttttttgtttctgtttgaaaatagattatgttcaatgctacgttaagtaaggtttacttaaacctgtttaatttaactaggctgggcatgggtggctcatgcctgtagtcccagcactttttgaggccgaggtgggaggattgtctgagcccaggagtctgagaccagcctgggcaacatggcgagacccccatctctacatcagatttaaaaaaaaaaaaaagaagaagctatactaacacngaagctctatcaattctgaagatcagtattctgaataaataccaattaaagtattccacatgatctccaatgattaggagagtgtttggtgatagagctcttttagagatgtaaaacttttgtataaatttagaaaactaacattgacaaaggaagttactcataagttcaatagaatagcttctatttgttgaagtacgattttcctttagtcctaagtaatgcaattcttcattcagcatatagcgagacatttcttctgcctcatttgaaagacatcccagcacagcatatcacgctgtttcttaagtatttgtatttcctgtacctgaagtgtagcgaaaatgctactatgactcttcctggaatacacccacctaccttgaaccagattatggattggatatgtctacttctggatgcgaattttactgttgttgtaatgatgccagaagcaaagaggctactgataaatctttacaagcttgtaaaatctcagatatctgtttattctgagctcaacaagattgaagtaagttttcgggagctacagaaattaaatcaagaaaagaataatagaggattatattcaattgaagtgctggagctcttctgatattatcaattctccttcatagacattttataaagctcttttatgtgaactcttgcttcatccaggcaagaacggtgttttgtttgcgaccatctcagtgtcaagagaaacgtgtcagtgagtacctggaccatcacttaactgatgctccggggtaggactgcaggtttcacatgaacctgttctaggctgtggacattggtgtggagaggttctgcaattttttaaaaatatgtaactgggttgattttaagtaaaattatttgtgtattgataaaagtctaatttcttatcatgtgttttgaattttttcttttaataaaaaatgaccattgaagcagtga

SEQ ID NO: 295558 - DNA, 2377 bp, Homo sapiens
gatccccctagctgctggcagtttggtagtatgctggagataacaggaggaaagttacctgagaagcagactattactgttaggaggacactggagaaacataattagactagaaagatagggctatacattagcctttactatatgaaatgatagtcttcctagtctaatttatcatacccagtacccggaagtatgtagtcgactacatacttctgcaagggacagaacccttggtgctcttcaaggaaggtgctgttcgtggtttagaggccttgcttgcagacccccagcagaaaattgaaactgttatctctgatgaagaagtgattaaatggacaaagtttttcgtagtattcagacatcctgttttaatttttattactgaaaaacatggaaattactttgcttacgtgcaaatgtttaactcacgtatcttaaccaaatatacactcttacttggacaagacgaaaactctgttataaagagttttactgcatctgtagatcggaaattcatctctttgatgtcattaagctctgatggttgtatatatgaaaccttgataccaatacgtccagctgacccagaaaaaaatcagagcttagttaaatcactgctgctcaaggctgttgtatctggtaacgctcgaaatggagttgcactcactgccctggatcaggatcacgtcgcagtcctaggaagtccactagcagcttctaaggaatgcctctctgtatggaacataaaatttcaaacactacagacttcaaaagagttaccacaagggaccagtggtcaactctggtattatggagaacatttgtttatgctacatggaaaatctctaactgtgattccatacaagtgtgaagtgtcatcattagcaggtgctcttggaaaactcaagcatagtcaagatccaggaactcatgtcgtgtcccattttgtaaactgggagacacctcaaggatgtggacttgggttccagaactcagagcagtcaagaagaattttaaggagacgaaaaattgaagtgagtttacagccagaggttccaccatccaaacaacttttgtcaaccataatgaaagattcagaaaaacacattgaagtagaagtacggaaatttttggctctgaagcagacacctgactttcatactgtcattggggacacagtaacaggacttctggaaaggtgtaaagcagaaccatcattttatccccggaactgtctgatgcagcttatccaaacgcatgtgctttcttacagtttgtgccccgacttaatggagattgccttaaaaaagaaagatgtacagttgttacaactctgtctacagcagttccctgacattcctgaatcagtcacctgtgcttgcttaaaaattttcttgagcattggtgatgacagtcttcaagaaacagatgttaatatggagtcagtttttgactatagtataaattctgtacatgatgagaaaatggaagagcaaactgaaattcttcaaaatggcttcaatcctgaagaagataaatgcaataactgtgatcaagagttaaataaaaagccccaggacgaaacaaaggagagcacttcatgccctgtggtacaaaaaagagcagctctacttaatgcaattcttcattcagcatatagcgagacatttcttctgcctcatttgaaagacatcccagcacagcatatcacgctgtttcttaagtatttgtatttcctgtacctgaagtgtagcgaaaatgctactatgactcttcctggaatacacccacctaccttgaaccagattatggattggatatgtctacttctggatgcgaattttactgttgttgtaatgatgccagaagcaaagaggctactgataaatctttacaagcttgtaaaatctcagatatctgtttattctgagctcaacaagattgaagtaagttttcgggagctacagaaattaaatcaagaaaagaataatagaggattatattcaattgaagtgctggagctcttctgatattatcaattctccttcatagacattttataaagctcttttatgtgaactcttgcttcatccaggcaagaacggtgttttgtttgcgaccatctcagtgtcaagagaaacgtgtcagtgagtacctggaccatcacttaactgatgctccggggtaggactgcaggtttcacatgaacctgttctaggctgtggacattggtgtggagaggttctgcaattttttaaaaatatgtaactgggttgattttaagtaaaattatttgtgtattgataaaagtctaatttcttatcatgtgttttgaattttttcttttaataaaaaatgaccattgaagcagtga

SEQ ID NO: 295559 - DNA, 2346 bp, Homo sapiens
agcgggccgggagtgagcgcggccgtacttaggtttgctcaaaatggcagcgctggaggaagaattcacgttgtcttcggtagtcctgagcgccgggcctgaaggactcctaggcgtggagcagagcgacaaaacagaccagtttctagtgacagacagcggcaggacagtcatcctctataaggtttctgatcagaaacccttggggagctggtcagtgaaacaaggtcaaattataacatgtccagctgtgtgcaactttcaaactggagagtatgttgttgtacacgataataaggttttaagaatatggaataatgaagatgtaaacctggataaagtatttaaagctacattgtcagcagaagtatataggatactttcagtgcaagggacagaacccttggtgctcttcaaggaaggtgctgttcgtggtttagaggccttgcttgcagacccccagcagaaaattgaaactgttatctctgatgaagaagtgattaaatggacaaagtttttcgtagtattcagacatcctgttttaatttttattactgaaaaacatggaaattactttgcttacgtgcaaatgtttaactcacgtatcttaaccaaatatacactcttacttggacaagacgaaaactctgttataaagagttttactgcatctgtagatcggaaattcatctctttgatgtcattaagctctgatggttgtatatatgaaaccttgataccaatacgtccagctgacccagaaaaaaatcagagcttagttaaatcactgctgctcaaggctgttgtatctggtaacgctcgaaatggagttgcactcactgccctggatcaggatcacgtcgcagtcctaggaagtccactagcagcttctaagggaactcatgtcgtgtcccattttgtaaactgggagacacctcaaggatgtggacttgggttccagaactcagagcagtcaagaagaattttaaggagacgaaaaattgaagtgagtttacagccagaggttccaccatccaaacaacttttgtcaaccataatgaaagattcagaaaaacacattgaagtagaagtacggaaatttttggctctgaagcagacacctgactttcatactgtcattggggacacagtaacaggacttctggaaaggtgtaaagcagaaccatcattttatccccggaactgtctgatgcagcttatccaaacgcatgtgctttcttacagtttgtgccccgacttaatggagattgccttaaaaaagaaagatgtacagttgttacaactctgtctacagcagttccctgacattcctgaatcagtcacctgtgcttgcttaaaaattttcttgagcattggtgatgacagtcttcaagaaacagatgttaatatggagtcagtttttgactatagtataaattctgtacatgatgagaaaatggaagagcaaactgaaattcttcaaaatggcttcaatcctgaagaagataaatgcaataactgtgatcaagagttaaataaaaagccccaggacgaaacaaaggagagcacttcatgccctgtggtacaaaaaagagcagctctacttaatgcaattcttcattcagcatatagcgagacatttcttctgcctcatttgaaagacatcccagcacagcatatcacgctgtttcttaagtatttgtatttcctgtacctgaagtgtagcgaaaatgctactatgactcttcctggaatacacccacctaccttgaaccagattatggattggatatgtctacttctggatgcgaattttactgttgttgtaatgatgccagaagcaaagaggctactgataaatctttacaagcttgtaaaatctcagatatctgtttattctgagctcaacaagattgaagtaagttttcgggagctacagaaattaaatcaagaaaagaataatagaggattatattcaattgaagtgctggagctcttctgatattatcaattctccttcatagacattttataaagctcttttatgtgaactcttgcttcatccaggcaagaacggtgttttgtttgcgaccatctcagtgtcaagagaaacgtgtcagtgagtacctggaccatcacttaactgatgctccggggtaggactgcaggtttcacatgaacctgttctaggctgtggacattggtgtggagaggttctgcaattttttaaaaatatgtaactgggttgattttaagtaaaattatttgtgtattgataaaagtctaatttcttatcatgtgttttgaattttttcttttaataaaaaatgaccattgaagcagtga

SEQ ID NO: 295560 - DNA, 2477 bp, Homo sapiens
gaaatccttggaggatttgagttctagttgccgctttgccacaaactgtgcagccagtaacttctctatgcctcagcttcctctatattgagatcttaatgttttcctcagaacacgagtcccaaaagtaactctgaagaaaatgaggtaggggagtcaatttaagtttgggaagcactgcatctcccctcttagaactttaaaattcacattatcatctggggagttcaataacctgcatttaatccagagctgcatttgacaaatgcgtattgcttgtggtatatgtttcaaaacgcccaattaagtgttctctgatgtctttctggttctaaaaaatatttaatgaaaactttgattaaattttgattgatatgtgtctcccagctggtgatttttgcatcctataatttttcttttttctttttttgtagatggacaaagtttttcgtagtattcagacatcctgttttaatttttattactgaaaaacatggaaattactttgcttacgtgcaaatgtttaactcacgtatcttaaccaaatatacactcttacttggacaagacgaaaactctgttataaagagttttactgcatctgtagatcggaaattcatctctttgatgtcattaagctctgatggttgtatatatgaaaccttgataccaatacgtccagctgacccagaaaaaaatcagagcttagttaaatcactgctgctcaaggctgttgtatctggtaacgctcgaaatggagttgcactcactgccctggatcaggatcacgtcgcagtcctaggaagtccactagcagcttctaaggaatgcctctctgtatggaacataaaatttcaaacactacagacttcaaaagagttaccacaagggaccagtggtcaactctggtattatggagaacatttgtttatgctacatggaaaatctctaactgtgattccatacaagtgtgaagtgtcatcattagcaggtgctcttggaaaactcaagcatagtcaagatccaggaactcatgtcgtgtcccattttgtaaactgggagacacctcaaggatgtggacttgggttccagaactcagagcagtcaagaagaattttaaggagacgaaaaattgaagtgagtttacagccagaggttccaccatccaaacaacttttgtcaaccataatgaaagattcagaaaaacacattgaagtagaagtacggaaatttttggctctgaagcagacacctgactttcatactgtcattggggacacagtaacaggacttctggaaaggtgtaaagcagaaccatcattttatccccggaactgtctgatgcagcttatccaaacgcatgtgctttcttacagtttgtgccccgacttaatggagattgccttaaaaaagaaagatgtacagttgttacaactctgtctacagcagttccctgacattcctgaatcagtcacctgtgcttgcttaaaaattttcttgagcattggtgatgacagtcttcaagaaacagatgttaatatggagtcagtttttgactatagtataaattctgtacatgatgagaaaatggaagagcaaactgaaattcttcaaaatggcttcaatcctgaagaagataaatgcaataactgtgatcaagagttaaataaaaagccccaggacgaaacaaaggagagcacttcatgccctgtggtacaaaaaagagcagctctacttaatgcaattcttcattcagcatatagcgagacatttcttctgcctcatttgaaagacatcccagcacagcatatcacgctgtttcttaagtatttgtatttcctgtacctgaagtgtagcgaaaatgctactatgactcttcctggaatacacccacctaccttgaaccagattatggattggatatgtctacttctggatgcgaattttactgttgttgtaatgatgccagaagcaaagaggctactgataaatctttacaagcttgtaaaatctcagatatctgtttattctgagctcaacaagattgaagtaagttttcgggagctacagaaattaaatcaagaaaagaataatagaggattatattcaattgaagtgctggagctcttctgatattatcaattctccttcatagacattttataaagctcttttatgtgaactcttgcttcatccaggcaagaacggtgttttgtttgcgaccatctcagtgtcaagagaaacgtgtcagtgagtacctggaccatcacttaactgatgctccggggtaggactgcaggtttcacatgaacctgttctaggctgtggacattggtgtggagaggttctgcaattttttaaaaatatgtaactgggttgattttaagtaaaattatttgtgtattgataaaagtctaatttcttatcatgtgttttgaattttttcttttaataaaaaatgaccattgaagcagtga

SEQ ID NO: 295561 - DNA, 2085 bp, Homo sapiens
cacgcatttcactcggcaggaggtttaaaacaacaacagtcaatggacaaagtttttcgtagtattcagacatcctgttttaatttttattactgaaaaacatggaaattactttgcttacgtgcaaatgtttaactcacgtatcttaaccaaatatacactcttacttggacaagacgaaaactctgttataaagagttttactgcatctgtagatcggaaattcatctctttgatgtcattaagctctgatggttgtatatatgaaaccttgataccaatacgtccagctgacccagaaaaaaatcagagcttagttaaatcactgctgctcaaggctgttgtatctggtaacgctcgaaatggagttgcactcactgccctggatcaggatcacgtcgcagtcctaggaagtccactagcagcttctaaggaatgcctctctgtatggaacataaaatttcaaacactacagacttcaaaagagttaccacaagggaccagtggtcaactctggtattatggagaacatttgtttatgctacatggaaaatctctaactgtgattccatacaagtgtgaagtgtcatcattagcaggtgctcttggaaaactcaagcatagtcaagatccaggaactcatgtcgtgtcccattttgtaaactgggagacacctcaaggatgtggacttgggttccagaactcagagcagtcaagaagaattttaaggagacgaaaaattgaagtgagtttacagccagaggttccaccatccaaacaacttttgtcaaccataatgaaagattcagaaaaacacattgaagtagaagtacggaaatttttggctctgaagcagacacctgactttcatactgtcattggggacacagtaacaggacttctggaaaggtgtaaagcagaaccatcattttatccccggaactgtctgatgcagcttatccaaacgcatgtgctttcttacagtttgtgccccgacttaatggagattgccttaaaaaagaaagatgtacagttgttacaactctgtctacagcagttccctgacattcctgaatcagtcacctgtgcttgcttaaaaattttcttgagcattggtgatgacagtcttcaagaaacagatgttaatatggagtcagtttttgactatagtataaattctgtacatgatgagaaaatggaagagcaaactgaaattcttcaaaatggcttcaatcctgaagaagataaatgcaataactgtgatcaagagttaaataaaaagccccaggacgaaacaaaggagagcacttcatgccctgtggtacaaaaaagagcagctctacttaatgcaattcttcattcagcatatagcgagacatttcttctgcctcatttgaaagacatcccagcacagcatatcacgctgtttcttaagtatttgtatttcctgtacctgaagtgtagcgaaaatgctactatgactcttcctggaatacacccacctaccttgaaccagattatggattggatatgtctacttctggatgcgaattttactgttgttgtaatgatgccagaagcaaagaggctactgataaatctttacaagcttgtaaaatctcagatatctgtttattctgagctcaacaagattgaagtaagttttcgggagctacagaaattaaatcaagaaaagaataatagaggattatattcaattgaagtgctggagctcttctgatattatcaattctccttcatagacattttataaagctcttttatgtgaactcttgcttcatccaggcaagaacggtgttttgtttgcgaccatctcagtgtcaagagaaacgtgtcagtgagtacctggaccatcacttaactgatgctccggggtaggactgcaggtttcacatgaacctgttctaggctgtggacattggtgtggagaggttctgcaattttttaaaaatatgtaactgggttgattttaagtaaaattatttgtgtattgataaaagtctaatttcttatcatgtgttttgaattttttcttttaataaaaaatgaccattgaagcagtga

SEQ ID NO: 295562 - DNA, 2812 bp, Homo sapiens
  misc_feature (2776)..(2776): n is a, c, g, or t
  misc_feature (2803)..(2804): n is a, c, g, or t
agcgggccgggagtgagcgcggccgtacttaggtttgctcaaaatggcagcgctggaggaagaattcacgttgtcttcggtagtcctgagcgccgggcctgaaggactcctaggcgtggagcagagcgacaaaacagaccagtttctagtgacagacagcggcaggacagtcatcctctataaggtttctgatcagaaacccttggggagctggtcagtgaaacaaggtcaaattataacatgtccagctgtgtgcaactttcaaactggagagtatgttgttgtacacgataataaggttttaagaatatggaataatgaagatgtaaacctggataaagtatttaaagctacattgtcagcagaagtatataggatactttcagtgcaagggacagaacccttggtgctcttcaaggaaggtgctgttcgtggtttagaggccttgcttgcagacccccagcagaaaattgaaactgttatctctgatgaagaagtgattaaatggacaaagtttttcgtagtattcagacatcctgttttaatttttattactgaaaaacatggaaattactttgcttacgtgcaaatgtttaactcacgtatcttaaccaaatatacactcttacttggacaagacgaaaactctgttataaagagttttactgcatctgtagatcggaaattcatctctttgatgtcattaagctctgatggttgtatatatgaaaccttgataccaatacgtccagctgacccagaaaaaaatcagagcttagttaaatcactgctgctcaaggctgttgtatctggtaacgctcgaaatggagttgcactcactgccctggatcaggatcacgtcgcagtcctaggaagtccactagcagcttctaaggaatgcctctctgtatggaacataaaatttcaaacactacagacttcaaaagagttaccacaagggaccagtggtcaactctggtattatggagaacatttgtttatgctacatggaaaatctctaactgtgattccatacaagtgtgaagtgtcatcattagcaggtgctcttggaaaactcaagcatagtcaagatccaggaactcatgtcgtgtcccattttgtaaactgggagacacctcaaggatgtggacttgggttccagaactcagagcagtcaagaagaattttaaggagacgaaaaattgaagtgagtttacagccagaggttccaccatccaaacaacttttgtcaaccataatgaaagattcagaaaaacacattgaagtagaagtacggaaatttttggctctgaagcagacacctgactttcatactgtcattggggacacagtaacaggacttctggaaaggtgtaaagcagaaccatcattttatccccggaactgtctgatgcagcttatccaaacgcatgtgctttcttacagtttgtgccccgacttaatggagattgccttaaaaaagaaagatgtacagttgttacaactctgtctacagcagttccctgacattcctgaatcagtcacctgtgcttgcttaaaaattttcttgagcattggtgatgacagtcttcaagaaacagatgttaatatggagtcagtttttgactatagtataaattctgtacatgatgagaaaatggaagagcaaactgaaattcttcaaaatggcttcaatcctgaagaagataaatgcaataactgtgatcaagagttaaataaaaagccccaggacgaaacaaaggagagcacttcatgccctgtggtacaaaaaagagcagctctacttaatgcaattcttcattcagcatatagcgagacatttcttctgcctcatttgaaagacatcccagcacagcatatcacgctgtttcttaagtatttgtatttcctgtacctgaagtgtagcgaaaatgctactatgactcttcctggaatacacccacctaccttgaaccagattatggattggatatgtctacttctggatgcgaattttactgttgttgtaatgatgccagaagcaaagaggctactgataaatctttacaagcttgtaaaatctcagatatctgtttattctgagctcaacaagattgaagtaagttttcgggagctacagaaattaaatcaagaaaagaataatagaggattatattcaattgaagtgctggagctcttctgatattatcaattctccttcatagacattttataaagctcttttatgtgaactcttgcttcatccaggcaagaacggtgttttgtttgcgaccatctcagtgtcaagagaaacgtgtcagtgagtacctggaccatcacttaactgatgctccggggtaggactgcaggtttcacatgaacctgttctaggctgtggacattggtgtggagaggttctgcaattttttaaaaatatgtaactggattcagataggaggcctcctatctgaatccagatttagatctccttaggagccttctctagtctccctagaaacctgtctctataactaataaactcctttttacactcttaatatcattaccagttttgatatccaaaccaaacattgggggtaggagggttcaccccaacactatggggtggaccagaacaaatatgtaaatttttgagattgggttttttaaaactcagcttaatctcttgagattcatccataatgttacatgtattggccattcattccattttaatgctgggtaacacttcatggtatgacacaccacacatatnattcaagacatctgattcagataggannaggatccg

SEQ ID NO: 295563 - DNA, 2562 bp, Homo sapiens
agcgggccgggagtgagcgcggccgtacttaggtttgctcaaaatggcagcgctggaggaagaattcacgttgtcttcggtagtcctgagcgccgggcctgaaggactcctaggcgtggagcagagcgacaaaacagaccagtttctagtgacagacagcggcaggacagtcatcctctataaggtttctgatcagaaacccttggggagctggtcagtgaaacaaggtcaaattataacatgtccagctgtgtgcaactttcaaactggagagtatgttgttgtacacgataataaggttttaagaatatggaataatgaagatgtaaacctggataaagtatttaaagctacattgtcagcagaagtatataggatactttcagtgcaagggacagaacccttggtgctcttcaaggaaggtgctgttcgtggtttagaggccttgcttgcagacccccagcagaaaattgaaactgttatctctgatgaagaagtgattaaatggacaaagtttttcgtagtattcagacatcctgttttaatttttattactgaaaaacatggaaattactttgcttacgtgcaaatgtttaactcacgtatcttaaccaaatatacactcttacttggacaagacgaaaactctgttataaagagttttactgcatctgtagatcggaaattcatctctttgatgtcattaagctctgatggttgtatatatgaaaccttgataccaatacgtccagctgacccagaaaaaaatcagagcttagttaaatcactgctgctcaaggctgttgtatctggtaacgctcgaaatggagttgcactcactgccctggatcaggatcacgtcgcagtcctaggaagtccactagcagcttctaaggaatgcctctctgtatggaacataaaatttcaaacactacagacttcaaaagagttaccacaagggaccagtggtcaactctggtattatggagaacatttgtttatgctacatggaaaatctctaactgtgattccatacaagtgtgaagtgtcatcattagcaggtgctcttggaaaactcaagcatagtcaagatccaggaactcatgtcgtgtcccattttgtaaactgggagacacctcaaggatgtggacttgggttccagaactcagagcagtcaagaagaattttaaggagacgaaaaattgaagtgagtttacagccagaggttccaccatccaaacaacttttgtcaaccataatgaaagattcagaaaaacacattgaagtagaagtacggaaatttttggctctgaagcagacacctgactttcatactgtcattggggacacagtaacaggacttctggaaaggtgtaaagcagaaccatcattttatccccggaactgtctgatgcagcttatccaaacgcatgtgctttcttacagtttgtgccccgacttaatggagattgccttaaaaaagaaagatgtacagttgttacaactctgtctacagcagttccctgacattcctgaatcagtcacctgtgcttgcttaaaaattttcttgagcattggtgatgacagtcttcaagaaacagatgttaatatggagtcagtttttgactatagtataaattctgtacatgatgagaaaatggaagagcaaactgaaattcttcaaaatggcttcaatcctgaagaagataaatgcaataactgtgatcaagagttaaataaaaagccccaggacgaaacaaaggagagcacttcatgccctgtggtacaaaaaagagcagctctacttaatgcaattcttcattcagcatatagcgagacatttcttctgcctcatttgaaagacatcccagcacagcatatcacgctgtttcttaagtatttgtatttcctgtacctgaagtgtagcgaaaatgctactatgactcttcctggaatacacccacctaccttgaaccagattatggattggatatgtctacttctggatgcgaattttactgttgttgtaatgatgccagaagcaaagaggctactgataaatctttacaagcttgtaaaatctcagatatctgtttattctgagctcaacaagattgaagtaagttttcgggagctacagaaattaaatcaagaaaagaataatagaggattatattcaattgaagtgctggagctcttctgatattatcaattctccttcatagacattttataaagctcttttatgtgaactcttgcttcatccaggcaagaacggtgttttgtttgcgaccatctcagtgtcaagagaaacgtgtcagtgagtacctggaccatcacttaactgatgctccggggtaggactgcaggtttcacatgaacctgttctaggctgtggacattggtgtggagaggttctgcaattttttaaaaatatgtaactggattcagataggaggcctcctatctgaatccagatgcgacgacaataaaagtacaaggccatcctctcatttttgtcatcatggcaatctgattcaataggagagggatctctagatc

SEQ ID NO: 295564 - DNA, 2376 bp, Homo sapiens
  misc_feature (2368)..(2368): n is a, c, g, or t
agcgggccgggagtgagcgcggccgtacttaggtttgctcaaaatggcagcgctggaggaagaattcacgttgtcttcggtagtcctgagcgccgggcctgaaggactcctaggcgtggagcagagcgacaaaacagaccagtttctagtgacagacagcggcaggacagtcatcctctataaggtttctgatcagaaacccttggggagctggtcagtgaaacaaggtcaaattataacatgtccagctgtgtgcaactttcaaactggagagtatgttgttgtacacgataataaggttttaagaatatggaataatgaagatgtaaacctggataaagtatttaaagctacattgtcagcagaagtatataggatactttcagtgcaagggacagaacccttggtgctcttcaaggaaggtgctgttcgtggtttagaggccttgcttgcagacccccagcagaaaattgaaactgttatctctgatgaagaagtgattaaatggacaaagtttttcgtagtattcagacatcctgttttaatttttattactgaaaaacatggaaattactttgcttacgtgcaaatgtttaactcacgtatcttaaccaaatatacactcttacttggacaagacgaaaactctgttataaagagttttactgcatctgtagatcggaaattcatctctttgatgtcattaagctctgatggttgtatatatgaaaccttgataccaatacgtccagctgacccagaaaaaaatcagagcttagttaaatcactgctgctcaaggctgttgtatctggtaacgctcgaaatggagttgcactcactgccctggatcaggatcacgtcgcagtcctaggaagtccactagcagcttctaaggaatgcctctctgtatggaacataaaatttcaaacactacagacttcaaaagagttaccacaagggaccagtggtcaactctggtattatggagaacatttgtttatgctacatggaaaatctctaactgtgattccatacaagtgtgaagtgtcatcattagcaggtgctcttggaaaactcaagcatagtcaagatccaggaactcatgtcgtgtcccattttgtaaactgggagacacctcaaggatgtggacttgggttccagaactcagagcagtcaagaagaattttaaggagacgaaaaattgaagtgagtttacagccagaggttccaccatccaaacaacttttgtcaaccataatgaaagattcagaaaaacacattgaagtagaagtacggaaatttttggctctgaagcagacacctgactttcatactgtcattggggacacagtaacaggacttctggaaaggtgtaaagcagaaccatcattttatccccggaactgtctgatgcagcttatccaaacgcatgtgctttcttacagtttgtgccccgacttaatggagattgccttaaaaaagaaagatgtacagttgttacaactctgtctacagcagttccctgacattcctgaatcagtcacctgtgcttgcttaaaaattttcttgagcattggtgatgacagtcttcaagaaacagatgttaatatggagtcagtttttgactatagtataaattctgtacatgatgagaaaatggaagagcaaactgaaattcttcaaaatggcttcaatcctgaagaagataaatgcaataactgtgatcaagagttaaataaaaagccccaggacgaaacaaaggagagcacttcatgccctgtggtacaaaaaagagcagctctacttaatgcaattcttcattcagcatatagcgagacatttcttctgcctcatttgaaagacatcccagcacagcatatcacgctgtttcttaagtatttgtatttcctgtacctgaagtgtagcgaaaatgctactatgactcttcctggaatacacccacctaccttgaaccagattatggattggatatgtctacttctggatgcgaattttactgttgttgtaatgatgccagaagcaaagaggctactgataaatctttacaagcttgtaaaatctcagatatctgtttattctgagctcaacaagattgaagtaagttttcgggagctacagaaattaaatcaagaaaagaataatagaggattatattcaattgaagtgctggagctcttctgatattatcaattctccttcatagacattttataaagctcttttatgtgaactcttgcttcatccaggcaagaacggtgttttgtttgcgaccacaccaatgtccacagcctagaacaggttcatgtgaaacctgcagtcctaccccggagcatcagttaagtgatnggtcaggt

SEQ ID NO: 295565 - DNA, 2365 bp, Homo sapiens
agcgggccgggagtgagcgcggccgtacttaggtttgctcaaaatggcagcgctggaggaagaattcacgttgtcttcggtagtcctgagcgccgggcctgaaggactcctaggcgtggagcagagcgacaaaacagaccagtttctagtgacagacagcggcaggacagtcatcctctataaggtttctgatcagaaacccttggggagctggtcagtgaaacaaggtcaaattataacatgtccagctgtgtgcaactttcaaactggagagtatgttgttgtacacgataataaggttttaagaatatggaataatgaagatgtaaacctggataaagtatttaaagctacattgtcagcagaagtatataggatactttcagtgcaagggacagaacccttggtgctcttcaaggaaggtgctgttcgtggtttagaggccttgcttgcagacccccagcagaaaattgaaactgttatctctgatgaagaagtgattaaatggacaaagtttttcgtagtattcagacatcctgttttaatttttattactgaaaaacatggaaattactttgcttacgtgcaaatgtttaactcacgtatcttaaccaaatatacactcttacttggacaagacgaaaactctgttataaagagttttactgcatctgtagatcggaaattcatctctttgatgtcattaagctctgatggttgtatatatgaaaccttgataccaatacgtccagctgacccagaaaaaaatcagagcttagttaaatcactgctgctcaaggctgttgtatctggtaacgctcgaaatggagttgcactcactgccctggatcaggatcacgtcgcagtcctaggaagtccactagcagcttctaaggaatgcctctctgtatggaacataaaatttcaaacactacagacttcaaaagagttaccacaagggaccagtggtcaactctggtattatggagaacatttgtttatgctacatggaaaatctctaactgtgattccatacaagtgtgaagtgtcatcattagcaggtgctcttggaaaactcaagcatagtcaagatccaggaactcatgtcgtgtcccattttgtaaactgggagacacctcaaggatgtggacttgggttccagaactcagagcagtcaagaagaattttaaggagacgaaaaattgaagtgagtttacagccagaggttccaccatccaaacaacttttgtcaaccataatgaaagattcagaaaaacacattgaagtagaagtacggaaatttttggctctgaagcagacacctgactttcatactgtcattggggacacagtaacaggacttctggaaaggtgtaaagcagaaccatcattttatccccggaactgtctgatgcagcttatccaaacgcatgtgctttcttacagtttgtgccccgacttaatggagattgccttaaaaaagaaagatgtacagttgttacaactctgtctacagcagttccctgacattcctgaatcagtcacctgtgcttgcttaaaaattttcttgagcattggtgatgacagtcttcaagaaacagatgttaatatggagtcagtttttgactatagtataaattctgtacatgatgagaaaatggaagagcaaactgaaattcttcaaaatggcttcaatcctgaagaagataaatgcaataactgtgatcaagagttaaataaaaagccccaggacgaaacaaaggagagcacttcatgccctgtggtacaaaaaagagcagctctacttaatgcaattcttcattcagcatatagcgagacatttcttctgcctcatttgaaagacatcccagcacagcatatcacgctgtttcttaagtatttgtatttcctgtacctgaagtgtagcgaaaatgctactatgactcttcctggaatacacccacctaccttgaaccagattatggattggatatgtctacttctggatgcgaattttactgttgttgtaatgatgccagaagcaaagaggctactgataaatctttacaagcttgtaaaatctcaggcaagaacggtgttttgtttgcgaccatctcagtgtcaagagaaacgtgtcagtgagtacctggaccatcacttaactgatgctccggggtaggactgcaggtttcacatgaacctgttctaggctgtggacattggtgtggagaggttctgcaattttttaaaaatatgtaactgggttgattttaagtaaaattatttgtgtattgataaaagtctaatttcttatcatgtgttttgaattttttcttttaataaaaaatgaccattgaagcagtga

SEQ ID NO: 295566 - DNA, 2059 bp, Homo sapiens
agcgggccgggagtgagcgcggccgtacttaggtttgctcaaaatggcagcgctggaggaagaattcacgttgtcttcggtagtcctgagcgccgggcctgaaggactcctaggcgtggagcagagcgacaaaacagaccagtttctagtgacagacagcggcaggacagtcatcctctataaggtttctgatcagaaacccttggggagctggtcagtgaaacaaggtcaaattataacatgtccagctgtgtgcaactttcaaactggagagtatgttgttgtacacgataataaggttttaagaatatggaataatgaagatgtaaacctggataaagtatttaaagctacattgtcagcagaagtatataggatactttcagtgcaagggacagaacccttggtgctcttcaaggaaggtgctgttcgtggtttagaggccttgcttgcagacccccagcagaaaattgaaactgttatctctgatgaagaagtgattaaatggacaaagtttttcgtagtattcagacatcctgttttaatttttattactgaaaaacatggaaattactttgcttacgtgcaaatgtttaactcacgtatcttaaccaaatatacactcttacttggacaagacgaaaactctgttataaagagttttactgcatctgtagatcggaaattcatctctttgatgtcattaagctctgatggttgtatatatgaaaccttgataccaatacgtccagctgacccagaaaaaaatcagagcttagttaaatcactgctgctcaaggctgttgtatctggtaacgctcgaaatggagttgcactcactgccctggatcaggatcacgtcgcagtcctaggaagtccactagcagcttctaaggaatgcctctctgtatggaacataaaatttcaaacactacagacttcaaaagagttaccacaagggaccagtggtcaactctggtattatggagaacatttgtttatgctacatggaaaatctctaactgtgattccatacaagtgtgaagtgtcatcattagcaggtgctcttggaaaactcaagcatagtcaagatccaggaactcatgtcgtgtcccattttgtaaactgggagacacctcaaggatgtggacttgggttccagaactcagagcagtcaagaagaattttaaggagacgaaaaattgaagtgagtttacagccagaggttccaccatccaaacaacttttgtcaaccataatgaaagattcagaaaaacacattgaagtagaagtacggaaatttttggctctgaagcagacacctgactttcatactgtcattggggacacagtaacaggacttctggaaaggtgtaaagcagaaccatcattttatccccggaactgtctgatgcagcttatccaaacgcatgtgctttcttacagtttgtgccccgacttaatggagattgccttaaaaaagaaagatgtacagttgttacaactctgtctacagcagttccctgacattcctgaatcagtcacctgtgcttgcttaaaaattttcttgagcattggtgatgacagtcttcaagaaacagatgttaatatggagtcagtttttgactatagtataaattctgtacatgatgagaaaatggaagagcaaactgaaattcttcaaaatggcttcaatcctgaagaagataaatgcaataactgtgatcaagagttaaataaaaagccccaggacgaaacaaaggagagcacttcatgccctgtggtacaaaaaagagcagctctacttaatgcaattcttcattcagcatatagcgagacatttcttctgcctcatttgaaagacatcccagcacagcatatcacgctgtttcttaagtatttgtatttcctgtacctgaagtcatccttgattcttcttttagcacccatatccaatccattagcaaatctggtagaccctaccttcacaatatatctaaagctgaccacctctttttgacctctactattaacggcctattccaaggcaccatcatct

SEQ ID NO: 295567 - DNA, 2123 bp, Homo sapiens
  misc_feature (1163)..(1163): n is a, c, g, or t
tttgtgatcctaatcaatttacttaattccagttaaggagacgaaaaattgaagtgagtttacagccagaggttccaccatccaaacaacttttgtcaaccataatgaaagattcagaaaaacacattgaagtagaagtacggaaatttttggctctgaagcagacacctgactttcatactgtcattggggacacagtaacaggacttctggaaaggtgtaaagcagaaccatcattttatccccggaactgtctgatgcagcttatccaaacgcatgtgctttcttacaggtagctgtttgtgtgtaccacactgtacgtgcataattcttctgaccttgttttttatagttctaatcttctgaaactctcaaaaggcttataaatgttctgcagttgagaattttcttaatatgtaatagtgattcagatttttttgtcttagtttgtgccccgacttaatggagattgccttaaaaaagaaagatgtacagttgttacaactctgtctacagcagttccctgacattcctgaatcagtcacctgtgcttgcttaaaaattttcttgagcattggtgatgacagtcttcaagaaacagatgttaatatggagtcagtttttgactatagtataaattctgtacatgatgagaaaatggaagagcaaactgaaattcttcaaaatggcttcaatcctgaagaagataaatgcaataactgtgatcaagagttaaataaaaagccccaggacgaaacaaaggagagcacttcatgccctgtggtacaaaaaagagcagctctactgtatcctttgacatagagcatccctctgtttctctttatagggtatagttatatgccaagcagtaaccaaggagtaactcaataatttaaggtttttctttccttttccaattgttttttgtttctgtttgaaaatagattatgttcaatgctacgttaagtaaggtttacttaaacctgtttaatttaactaggctgggcatgggtggctcatgcctgtagtcccagcactttttgaggccgaggtgggaggattgtctgagcccaggagtctgagaccagcctgggcaacatggcgagacccccatctctacatcagatttaaaaaaaaaaaaaagaagaagctatactaacacngaagctctatcaattctgaagatcagtattctgaataaataccaattaaagtattccacatgatctccaatgattaggagagtgtttggtgatagagctcttttagagatgtaaaacttttgtataaatttagaaaactaacattgacaaaggaagttactcataagttcaatagaatagcttctatttgttgaagtacgattttcctttagtcctaagtaatgcaattcttcattcagcatatagcgagacatttcttctgcctcatttgaaagacatcccagcacagcatatcacgctgtttcttaagtatttgtatttcctgtacctgaagtgtagcgaaaatgctactatgactcttcctggaatacacccacctaccttgaaccagattatggattggatatgtctacttctggatgcgaattttactgttgttgtaatgatgccagaagcaaagaggctactgataaatctttacaagcttgtaaaatctcagatatctgtttattctgagctcaacaagattgaagtaagttttcgggagctacagaaattaaatcaagaaaagaataatagaggattatattcaattgaagtgctggagctcttctgatattatcaattctccttcatagacattttataaagctcttttatgtgaactcttgcttcatccaggcaagaacggtgttttgtttgcgaccatctcagtgtcaagagaaacgtgtcagtgagtacctggaccatcacttaactgatgctccggggtaggactgcaggtttcacatgaacctgttctaggctgtggacattggtgtggagaggttctgcaattttttaaaaatatgtaactgggttgattttaagtaaaattatttgtgtattgataaaagtctaatttcttatcatgtgttttgaattttttcttttaataaaaaatgaccattgaagcagtga

SEQ ID NO: 295568 - DNA, 1059 bp, Homo sapiens
caaaattttgatgcttaggaaatgaaatttttcccaaaagcttggtgataaggattaacctcttgctttcaactaccatcatagcattggtgatgacagtcttcaagaaacagatgttaatatggagtcagtttttgactatagtataaattctgtacatgatgagaaaatggaagagcaaactgaaattcttcaaaatggcttcaatcctgaagaagataaatgcaataactgtgatcaagagttaaataaaaagccccaggacgaaacaaaggagagcacttcatgccctgtggtacaaaaaagagcagctctacttaatgcaattcttcattcagcatatagcgagacatttcttctgcctcatttgaaagacatcccagcacagcatatcacgctgtttcttaagtatttgtatttcctgtacctgaagtgtagcgaaaatgctactatgactcttcctggaatacacccacctaccttgaaccagattatggattggatatgtctacttctggatgcgaattttactgttgttgtaatgatgccagaagcaaagaggctactgataaatctttacaagcttgtaaaatctcagatatctgtttattctgagctcaacaagattgaagtaagttttcgggagctacagaaattaaatcaagaaaagaataatagaggattatattcaattgaagtgctggagctcttctgatattatcaattctccttcatagacattttataaagctcttttatgtgaactcttgcttcatccaggcaagaacggtgttttgtttgcgaccatctcagtgtcaagagaaacgtgtcagtgagtacctggaccatcacttaactgatgctccggggtaggactgcaggtttcacatgaacctgttctaggctgtggacattggtgtggagaggttctgcaattttttaaaaatatgtaactgggttgattttaagtaaaattatttgtgtattgataaaagtctaatttcttatcatgtgttttgaattttttcttttaataaaaaatgaccattgaagcagtga

SEQ ID NO: 295569 - DNA, 1457 bp, Homo sapiens
agcgggccgggagtgagcgcggccgtacttaggtttgctcaaaatggcagcgctggaggaagaattcacgttgtcttcggtagtcctgagcgccgggcctgaaggactcctaggcgtggagcagagcgacaaaacagaccagtttctagtgacagacagcggcaggacagtcatcctctataaggtttctgatcagaaacccttggggagctggtcagtgaaacaaggtcaaattataacatgtccagctgtgtgcaactttcaaactggagagtatgttgttgtacacgataataaggttttaagaatatggaataatgaagatgtaaacctggataaagtatttaaagctacattgtcagcagaagtatataggatactttcagtgcaagggacagaacccttggtgctcttcaaggaaggtgctgttcgtggtttagaggccttgcttgcagacccccagcagaaaattgaaactgttatctctgatgaagaagtgattaaatggacaaagtttttcgtagtattcagacatcctgttttaatttttattactgaaaaacatggaaattactttgcttacgtgcaaatgtttaactcacgtatcttaaccaaatatacactcttacttgtgatcaagagttaaataaaaagccccaggacgaaacaaaggagagcacttcatgccctgtggtacaaaaaagagcagctctacttaatgcaattcttcattcagcatatagcgagacatttcttctgcctcatttgaaagacatcccagcacagcatatcacgctgtttcttaagtatttgtatttcctgtacctgaagtgtagcgaaaatgctactatgactcttcctggaatacacccacctaccttgaaccagattatggattggatatgtctacttctggatgcgaattttactgttgttgtaatgatgccagaagcaaagaggctactgataaatctttacaagcttgtaaaatctcagatatctgtttattctgagctcaacaagattgaagtaagttttcgggagctacagaaattaaatcaagaaaagaataatagaggattatattcaattgaagtgctggagctcttctgatattatcaattctccttcatagacattttataaagctcttttatgtgaactcttgcttcatccaggcaagaacggtgttttgtttgcgaccatctcagtgtcaagagaaacgtgtcagtgagtacctggaccatcacttaactgatgctccggggtaggactgcaggtttcacatgaacctgttctaggctgtggacattggtgtggagaggttctgcaattttttaaaaatatgtaactgggttgattttaagtaaaattatttgtgtattgataaaagtctaatttcttatcatgtgttttgaattttttcttttaataaaaaatgaccattgaagcagtga

SEQ ID NO: 295570 - DNA, 1276 bp, Homo sapiens
agcgggccgggagtgagcgcggccgtacttaggtttgctcaaaatggcagcgctggaggaagaattcacgttgtcttcggtagtcctgagcgccgggcctgaaggactcctaggcgtggagcagagcgacaaaacagaccagtttctagtgacagacagcggcaggacagtcatcctctataaggtttctgatcagaaacccttggggagctggtcagtgaaacaaggtcaaattataacatgtccagctgtgtgcaactttcaaactggagagtatgttgttgtacacgataataaggttttaagaatatggaataatgaagatgtaaacctggataaagtatttaaagctacattgtcagcagaagtatataggatactttcagtgcaagggacagaacccttggtgctcttcaaggaaggtgctgttcgtggtttagaggccttgcttgcagacccccagcagaaaattgaaactgttatctctgatgaagaagtgattaaatggacaaagtttttcgtagtattcagacatcctgttttaatttttattactgaaaaacatggaaattactttgcttacgtgcaaatgtttaactcacgtatcttaaccaaatatacactcttacttggacaagacgaaaactctgttataaagagttttactgcatctgtagatcggaaattcatctctttgatgtcattaagctctgatggttgtatatatgaaaccttgataccaatacgtccagctgacccagaaaaaaatcagagcttagttaaatcactgctgctcaaggctgttgtatctggtaacgctcgaaatggagttgcactcactgccctggatcaggatcacgtcgcagtcctaggaagtccactagcagcttctaagggtaactgacatccaattcattaagaaggcctttgtatgtttccttcacggtgtaccttttagtcttccttttctttttcatttcgttattacccagactaattcattctctttatcagcatactcaattttttttgtgccttcctaattcttcttgaattggtttttatttttattttgcattgatctttcaaaaacacttcttgctatcaccaccatgctcataactatgtcataaagaaataaaaatggcgaatatactagtcaccatcatactagcctgcaggtatttgaaacattagtaagcctacatttgaggattggattcttggcaacatttcacatcatggaaatccactggacatgaacaccttgaaatgt

SEQ ID NO: 295571 - DNA, 1707 bp, Homo sapiens
ggcacgagggagagatcgtccaggaggcggtgttgatgcggcaaagggcaacaggaagggcattaggacttgaaatcggagacgcacgcaggggagggagtcagtgtcggaacctggtaggccctgggagaactccggcttttcgtctgcgtgagctggagaagagccgaaggtttctgcgcacagcacggacctgcgtgcctcagctttaaggaaatcaccgtggccgccgctgtgaacgcagagaagggcgcgagcgtgggagcaggaacccaaggcggtgggaaacggtggggctttctgagtgtattggaaagtagagcccacagatctgctgcagaccagaaaggggcgcgagaaagagcggacagaggcagacgccggggctggcggcgatggagcagcagtcggaggacgcggaaggcctgcgagagtcgcccgcggcccagcgccggccttcgggtcccaccttgcgggtgatgttgtgcacgtaggggcacgtgttgcaggcgaagcggtggcagcgttgtccctcctccacgatcagcccgttcccgcagccggggcagaacagcagcatggtctcgaactccgcaggctccaactcccggcagctcccactgccgctcagcgccgatgcgccgcccgcctcgagctcacattggtcctggcagccttcccgccacaccaaccaaccaatagacagggcgattctgcgctcccggccctgctgcaggctgtctcgcacttgtcattggtcactgcagccgccccaccccccccggcgcgccagtggctgggcggcctcgctggggcgggccgcagttcctgcgcgtgcgcgcttggcctccctagtgcgggctggcagtgcgggcagagcccggctgagaggggcggccctggaggagacggaggccgcgggtgggcccgaggcgcaagaggaagatgaggacgaagaagaggcgctgccgcactccgaggccatggacgtgttccaggagggtctggctatggtggtgcaggacccgctgctctgcgatctgccgatccaggttactctggaagaagtcaactcccaaatagccctagaatacggccaggcaatgacggtccgagtgtgcaagatggatggagaagtaatgcccgtggttgtagtgcagagtgccacagtcctggacctgaagaaggccatccagagatacgtgcagctcaagcaggagcgtgaagggggcattcagcacatcagctggtcctacgtgtggaggacgtaccatctgacctctgcaggagagaaactcacggaagacagaaagaagctccgagactacggcatccggaatcgagacgaggtttccttcatcaaaaagctgaggcaaaagtgagcctccagacaggacaaccctcttcatcactggtggctgagctttttcccagcaggaatgggtcctcgaatcatcgtgcctctttcacagaaaggacgttgtggtggcctcaccccaggcatgcccaacaggaactgtcagcataaacctgggggccctcaggactaggacagggtgagccagtgctccctcctttcatgtacttggcctgagactgacctctccctaggtccaaatgccctagtcacatggcagacccacggcctggccccactgtataaaataaacctgtttgcttcttagtttgaaaagtagaaagccacag

SEQ ID NO: 295572 - DNA, 1222 bp, Homo sapiens
ggcacgagggagagatcgtccaggaggcggtgttgatgcggcaaagggcaacaggaagggcattaggacttgaaatcggagacgcacgcaggggagggagtcagtgtcggaacctggtaggccctgggagaactccggcttttcgtctgcgtgagctggagaagagccgaaggtttctgcgcacagcacggacctgcgtgcctcagctttaaggaaatcaccgtggccgccgctgtgaacgcagagaagggcgcgagcgtgggagcaggaacccaaggcggtgggaaacggtggggctttctgagtgtattggaaagtagagcccacagatctgctgcagaccagaaaggggcgcgagaaagagcggacagaggcagacgccggggctggcggcgatggagcagcagtcggaggacgcggaaggcctgcgagagtcgcccgcggcccagcgccggccttcgggtcccaccttgcgggtgatgttgtgcacgtaggggcacgtgttgcaggcgaagcggtggcagcgttgtccctcctccacgatcagcccgttcccgcagccggggcagaacagcagcatggtctcgaactccgcaggctccaactcccggcagctcccactgccgctcagcgccgatgcgccgcccgcctcgagctcacattggtcctggcagccttcccgccacaccaaccaaccaatagacagggcgattctgcgctcccggccctgctgcaggctgtctcgcacttgtcattggtcactgcagccgccccaccccccccggcgcgccagtggctgggcggcctcgctggggcgggccgcagttcctgcgcgtgcgcgcttggcctccctagtgcgggctggcagtgcgggcagagcccggctgagaggggcggccctggaggagacggaggccgcgggtgggcccgaggcgcaagaggaagatgaggacgaagaagaggcgctgccgcactccgaggccatggacgtgttccaggagggtctggctatggtggtgcaggacccgctgctctgcgatctgccgatccaggttactctggaagaagtcaactcccaaatagccctagaatacggccaggcaatgacggtccgagtgtgcaagatggatggagaagtaatgcctacttgggaggctgaggtaggagtatcatttacacctggaaggttgaggctgcagtgagctgtgatcgtgccactgca

SEQ ID NO: 295573 - DNA, 1976 bp, Homo sapiens
ggcacgagggagagatcgtccaggaggcggtgttgatgcggcaaagggcaacaggaagggcattaggacttgaaatcggagacgcacgcaggggagggagtcagtgtcggaacctggtaggccctgggagaactccggcttttcgtctgcgtgagctggagaagagccgaaggtttctgcgcacagcacggacctgcgtgcctcagctttaaggaaatcaccgtggccgccgctgtgaacgcagagaagggcgcgagcgtgggagcaggaacccaaggcggtgggaaacggtggggctttctgagtgtattggaaagtagagcccacagatctgctgcagaccagaaaggggcgcgagaaagagcggacagaggcagacgccggggctggcggcgatggagcagcagtcggaggacgcggaaggcctgcgagagtcgcccgcggcccagcgccggccttcgggtcccaccttgcgggtgatgttgtgcacgtaggggcacgtgttgcaggcgaagcggtggcagcgttgtccctcctccacgatcagcccgttcccgcagccggggcagaacagcagcatggtctcgaactccgcaggctccaactcccggcagctcccactgccgctcagcgccgatgcgccgcccgcctcgagctcacattggtcctggcagccttcccgccacaccaaccaaccaatagacagggcgattctgcgctcccggccctgctgcaggctgtctcgcacttgtcattggtcactgcagccgccccaccccccccggcgcgccagtggctgggcggcctcgctggggcgggccgcagttcctgcgcgtgcgcgcttggcctccctagtgcgggctggcagtgcgggcagagcccggctgagaggggcggccctggaggagacggaggccgcgggtgggcccgaggcgcaagaggaagatgaggacgaagaagaggcgctgccgcactccgaggccatggacgtgttccaggagggtctggctatggtggtgcaggacccgctgctctgcgatctgccgatccaggttactctggaagaagtcaactcccaaatagccctagaatacggccaggcaatgacggtccgagtgtgcaagatggatggagaagtaatgcccgtggttgtagtgcagagtgccacagtcctggacctgaagaaggccatccagagatacgtgcagctcaagcaggagcgtgaagggggcattcagcacatcagctggtcctacgtgtggaggacgtaccatctgacctctgcaggagagaaactcacggaagacagaaagaagctccgagactacggcatccggaatcgagacgaggtttccttcatcaaaaagctgaggcaaaagtgagcctccagacaggacaaccctcttcatcactggtggctgagctttttcccagcaggaatgggtcctcgaatcatcgtgcctctttcacagaaaggacgttgtggtggcctcaccccaggcatgcccaacaggaactgtcagcataaacctgggggccctcaggactaggacagggtgagccagtgctccctcctttcatgtacttggcctgagactgacctctccctaggtccaaatgccctagtcacatggcagacccacggcctggccccactgtataaaataaacctgtttgcttcttagtttgaaaagtagaaagccacaggaaactcgtaccaaaacccaaggtagaaaagtagcttgcggggcggcggttggcgcaatacaggggtcctctacagcatcagagggggcgccgcgggaccagataagctatcctgaaaaggcaggaagccggcttcccagagggaccgggggccaagacacataccgggatacttccaatgaaacccgcgcggctgacagacgagtgtgaaagacaccgagggggcgcgggccgaacggcgttaacagggcctccgggggaataaatcg

SEQ ID NO: 295574 - DNA, 1918 bp, Homo sapiens
ggcacgagggagagatcgtccaggaggcggtgttgatgcggcaaagggcaacaggaagggcattaggacttgaaatcggagacgcacgcaggggagggagtcagtgtcggaacctggtaggccctgggagaactccggcttttcgtctgcgtgagctggagaagagccgaaggtttctgcgcacagcacggacctgcgtgcctcagctttaaggaaatcaccgtggccgccgctgtgaacgcagagaagggcgcgagcgtgggagcaggaacccaaggcggtgggaaacggtggggctttctgagtgtattggaaagtagagcccacagatctgctgcagaccagaaaggggcgcgagaaagagcggacagaggcagacgccggggctggcggcgatggagcagcagtcggaggacgcggaaggcctgcgagagtcgcccgcggcccagcgccggccttcgggtcccaccttgcgggtgatgttgtgcacgtaggggcacgtgttgcaggcgaagcggtggcagcgttgtccctcctccacgatcagcccgttcccgcagccggggcagaacagcagcatggtctcgaactccgcaggctccaactcccggcagctcccactgccgctcagcgccgatgcgccgcccgcctcgagctcacattggtcctggcagccttcccgccacaccaaccaaccaatagacagggcgattctgcgctcccggccctgctgcaggctgtctcgcacttgtcattggtcactgcagccgccccaccccccccggcgcgccagtggctgggcggcctcgctggggcgggccgcagttcctgcgcgtgcgcgcttggcctccctagtgcgggctggcagtgcgggcagagcccggctgagaggggcggccctggaggagacggaggccgcgggtgggcccgaggcgcaagaggaagatgaggacgaagaagaggcgctgccgcactccgaggccatggacgtgttccaggagggtctggctatggtggtgcaggacccgctgctctgcgatctgccgatccaggttactctggaagaagtcaactcccaaatagccctagaatacggccaggcaatgacggtccgagtgtgcaagatggatggagaagtaatgcccgtggttgtagtgcagagtgccacagtcctggacctgaagaaggccatccagagatacgtgcagctcaagcaggagcgtgaagggggcattcagcacatcagctggtcctacgtgtggaggacgtaccatctgacctctgcaggagagaaactcacggaagacagaaagaagctccgagactacggcatccggaatcgagacgaggtttccttcatcaaaaagctgaggcaaaagtgagcctccagacaggacaaccctcttcatcactggtggctgagctttttcccagcaggaatgggtcctcgaatcatcgtgcctctttcacagaaaggacgttgtggtggcctcaccccaggcatgcccaacaggaactgtcagcataaacctgggggccctcaggactaggacagggtgagccagtgctccctcctttcatgtacttggcctgagactgacctctccctaggtccaaatgccctagtcacatggcagacccacggcctggccccactgtataaaataaacctgtttgcttcttagtttgaaaagtagaaagccacagtaacctgggtagcaaagactgagattgccccatcacagaggtgagttaaggggagagaattggtacaggcgagtcctatagtccaagatggcgccacaccaccaaagccttgaggccacaccactccccaaaccacacaactgtgttaccatgatctccacagcaaggaggaaataaaagcagagcggctttagggtttgcatcctggagc

SEQ ID NO: 295575 - DNA, 2363 bp, Homo sapiens
ggcacgagggagagatcgtccaggaggcggtgttgatgcggcaaagggcaacaggaagggcattaggacttgaaatcggagacgcacgcaggggagggagtcagtgtcggaacctggtaggccctgggagaactccggcttttcgtctgcgtgagctggagaagagccgaaggtttctgcgcacagcacggacctgcgtgcctcagctttaaggaaatcaccgtggccgccgctgtgaacgcagagaagggcgcgagcgtgggagcaggaacccaaggcggtgggaaacggtggggctttctgagtgtattggaaagtagagcccacagatctgctgcagaccagaaaggggcgcgagaaagagcggacagaggcagacgccggggctggcggcgatggagcagcagtcggaggacgcggaaggcctgcgagagtcgcccgcggcccagcgccggccttcgggtcccaccttgcgggtgatgttgtgcacgtaggggcacgtgttgcaggcgaagcggtggcagcgttgtccctcctccacgatcagcccgttcccgcagccggggcagaacagcagcatggtctcgaactccgcaggctccaactcccggcagctcccactgccgctcagcgccgatgcgccgcccgcctcgagctcacattggtcctggcagccttcccgccacaccaaccaaccaatagacagggcgattctgcgctcccggccctgctgcaggctgtctcgcacttgtcattggtcactgcagccgccccaccccccccggcgcgccagtggctgggcggcctcgctggggcgggccgcagttcctgcgcgtgcgcgcttggcctccctagtgcgggctggcagtgcgggcagagcccggctgagaggggcggccctggaggagacggaggccgcgggtgggcccgaggcgcaagaggaagatgaggacgaagaagaggcgctgccgcactccgaggccatggacgtgttccaggagggtctggctatggtggtgcaggacccgctgctctgcgatctgccgatccaggttactctggaagaagtcaactcccaaatagccctagaatacggccaggcaatgacggtccgagtgtgcaagatggatggagaagtaatgcccgtggttgtagtgcagagtgccacagtcctggacctgaagaaggccatccagagatacgtgcagctcaagcaggagcgtgaagggggcattcagcacatcagctggtaagtggaacaacattcccttcattatagcccttcgtggggctagtgcccttcttggcactgtcaccaggcaccacctggaaacagctctcagctctgcatgagtacagcaccactgaagtgatgagctccctgtcacaagagtgatgagctccctgtcacagacagtgcgggtcgttctgtgcctgggactcctgcctcggccatccccaacattctgctcttccatcggcatcaccccatccgagctgctgggtatcttcacttggggacactgtcgggaatttccagtgtgtctggaagtggcctccctagttttggatggtacacctgtaggggctcccatccccttctcacctgggtgctgtcagccctcactctcctattggatcaactatcctgttcactgagtctcaacactgtcgcctgttgcattagcaaggtttgtttggccaagccgccccagacagccctctgagaacagagcctccttgtagctgcctcagacccaatctgcacattgtacagaacagcccaggtagggaggacagctgccccaggtcccataggactgcatgcctcaagcccacgtcatgcagagccactcagctcaccctgctcagggcacgtggtttacctgcattcccctcttgcaggtcctacgtgtggaggacgtaccatctgacctctgcaggagagaaactcacggaagacagaaagaagctccgagactacggcatccggaatcgagacgaggtttccttcatcaaaaagctgaggcaaaagtgagcctccagacaggacaaccctcttcatcactggtggctgagctttttcccagcaggaatgggtcctcgaatcatcgtgcctctttcacagaaaggacgttgtggtggcctcaccccaggcatgcccaacaggaactgtcagcataaacctgggggccctcaggactaggacagggtgagccagtgctccctcctttcatgtacttggcctgagactgacctctccctaggtccaaatgccctagtcacatggcagacccacggcctggccccactgtataaaataaacctgtttgcttcttagtttgaaaagtagaaagccacag

SEQ ID NO: 295576 - DNA, 2123 bp, Homo sapiens
tcgtgtttcggtgagtgtggcggagatggagagccgggatcccgcccagccgatgtcgcctggagaagcgacgcagagtggcgcccggcctgccgaccgctatggcctattgaagcacagtcgcgagttcttggacttcttctgggacattgcgaagcctgagcaggagacgcgacttgcggccacggagaagctgctggagtatctgcgtggcaggccgaaggggtccgagatgaaatatgccctgaagcgtctaatcacgggactcggggtcgggcgagaaacagcccggccctgctacagtttggccctggcacagctgttacagtcttttgaagacctccccttgtgcagcatcctgcagcagatacaagaaaaatatgacctgcatcaggtgaagaaggcaatgctgagacctgctctctttgcaaacctgtttggagtgctcgccctctttcagtcaggtcggctggtgaaggaccaggaggcactgatgaagtcggtgaagctgctgcaggccctggcccagtaccaaaaccacttgcaggagcagccccggaaggccctggtggacatcctctccgaggtctcgaaggccacattgcaggagatcctgccggaggtcctcaaagccgacttgaatataatactcagctcccctgaacagctagagctcttcctcctggcccagcagaaggtgccctccaagctcaagaagctggtgggatccgtgaacctattctcagatgagaatgtccccaggctggtgaatgtgctgaagatggccgcctcctctgtgaagaaggaccgcaagctgcccgccattgctctggacctgctccgcctggcgctcaaggaagacaagttcccacggttctggaaggaggtggtggaacaagggctgctgaagatgcagttctggccagccagctacctgtgtttccacctgctgggcgcggccctgcccctgctgaccaaggagcagctgcacctggtgatgcagggagacgtgatccgccattacggggagcacgtgtgcactgctaagctcccaaagcagttcaagtttgccccagagatggacgattacgtgggcaccttcctagaggggtgccaggatgaccctgagcggcagctggccgtgctagtggccttctcatctgtcaccaaccaaggcctccctgtcacgcctactttctggcgggtcgtgcggttcctgagccctccggccctgcagggctatgtggcctggctgcgggccatgtttctccagccagacctggactccttggttgacttcagcaccaacaaccagaagaaagcccaggattcatcgctccacatgcctgagcgagctgtgttccggctgaggaaatggatcatctttcgattggtgagcattgtggacagcctgcacctggagatggaggaggccttgactgagcaggtggccaggttttgtttgttccactcgttctttgtcacaaagaagcccacatcccagatccctgagacaaagcacccgttctccttccctttggaaaaccaggcccgagaggctgtcagcagtgccttcttcagtctgttgcagaccctcagcacgcagttcaagcaggcaccgggccagacccagggtgggcagccctggacctaccacctggtgcagttcgcagacctcctgttgaatcacagccacaacgtgaccaccgtgacacccttcactgcgcagcagcgccaggcctgggaccggatgctgcagactctgaaggagctggaggcccactccgcagaggccagggctgctgccttccagcaccttctgctcctcgtgggcatccacctcctcaaggtactggggcctgggagggaggggctgtgagcctggggttctatggcacaatgggccccctaccgagaggcttttgagggctgtgcgggtttccaggaaaggttctgggggagttaagttgggaggtttttgaagccaactttgtcacaggtggaaacatccctccggccacttagcggcaccagctggtgtcctaggctttccatgcaggatctcgtaatccccacagctttgaggcagacaccccctctccatgtttgacatggagaaacta

SEQ ID NO: 295577 - DNA, 777 bp, Homo sapiens
  misc_feature (21)..(22): n is a, c, g, or t
tcggcggtacggcccgagtanntgatatcgtcgaccacgccgcctcttctgactggatattgtgaggccccagagcgctgtcctggtgagcacgggcacagctgtccctgccccactggcttggctgtgggtacatggtctctgaagggggtggccgtgccctggcccctgccacacagtgaacacacaggagctgagggggcagggccagcctcactcccgcagccactgctgcccatctggccacacacaggatgcccctggtagtgtctgctctggtgccagggctgttgggggcaggctggaggaagatggcactaagccaataatgggcaggaattgtcccaacctgaggtcccacctctatccagctgggaggccttggtgtccccacctgcacacaaaggcacaggagcaggtagtcacagagcccagagcagcaggcagcctcacacgctgcccacagcagtgcccagcgggcccccgagccctcatgcatccctgagccgtgagcacccaacgtgccaaggctcctgccacccacctttgcccacccacaggcctgcctgctgctccagaagaccctgtccatgcgggaggtgaggtcgtgctttgaggaccccgagtggaagcagctgatgggccaggtcctagcaaaggtcaccgaggtaacagccggggggcgccctttccccaccccctcagaatcagttctccgggagaccgatctctgggaaagaagtgaggattggagcctgagtccagagtcgggagaac

SEQ ID NO: 295578 - DNA, 4663 bp, Homo sapiens
tcgtgtttcggtgagtgtggcggagatggagagccgggatcccgcccagccgatgtcgcctggagaagcgacgcagagtggcgcccggcctgccgaccgctatggcctattgaagcacagtcgcgagttcttggacttcttctgggacattgcgaagcctgagcaggagacgcgacttgcggccacggagaagctgctggagtatctgcgtggcaggccgaaggggtccgagatgaaatatgccctgaagcgtctaatcacgggactcggggtcgggcgagaaacagcccggccctgctacagtttggccctggcacagctgttacagtcttttgaagacctccccttgtgcagcatcctgcagcagatacaagaaaaatatgacctgcatcaggtgaagaaggcaatgctgagacctgctctctttgcaaacctgtttggagtgctcgccctctttcagtcaggtcggctggtgaaggaccaggaggcactgatgaagtcggtgaagctgctgcaggccctggcccagtaccaaaaccacttgcaggagcagccccggaaggccctggtggacatcctctccgaggtctcgaaggccacattgcaggagatcctgccggaggtcctcaaagccgacttgaatataatactcagctcccctgaacagctagagctcttcctcctggcccagcagaaggtgccctccaagctcaagaagctggtgggatccgtgaacctattctcagatgagaatgtccccaggctggtgaatgtgctgaagatggccgcctcctctgtgaagaaggaccgcaagctgcccgccattgctctggacctgctccgcctggcgctcaaggaagacaagttcccacggttctggaaggaggtggtggaacaagggctgctgaagatgcagttctggccagccagctacctgtgtttccacctgctgggcgcggccctgcccctgctgaccaaggagcagctgcacctggtgatgcagggagacgtgatccgccattacggggagcacgtgtgcactgctaagctcccaaagcagttcaagtttgccccagagatggacgattacgtgggcaccttcctagaggggtgccaggatgaccctgagcggcagctggccgtgctagtggccttctcatctgtcaccaaccaaggcctccctgtcacgcctactttctggcgggtcgtgcggttcctgagccctccggccctgcagggctatgtggcctggctgcgggccatgtttctccagccagacctggactccttggttgacttcagcaccaacaaccagaagaaagcccaggattcatcgctccacatgcctgagcgagctgtgttccggctgaggaaatggatcatctttcgattggtgagcattgtggacagcctgcacctggagatggaggaggccttgactgagcaggtggccaggttttgtttgttccactcgttctttgtcacaaagaagcccacatcccagatccctgagacaaagcacccgttctccttccctttggaaaaccaggcccgagaggctgtcagcagtgccttcttcagtctgttgcagaccctcagcacgcagttcaagcaggcaccgggccagacccagggtgggcagccctggacctaccacctggtgcagttcgcagacctcctgttgaatcacagccacaacgtgaccaccgtgacacccttcactgcgcagcagcgccaggcctgggaccggatgctgcagactctgaaggagctggaggcccactccgcagaggccagggctgctgccttccagcaccttctgctcctcgtgggcatccacctcctcaagtcccctgcagagagctgtgacctgctgggtgacatccagacctgcatcaggaaaagtctgggagagaagccccgccggagccgcaccaagaccatcgacccccaggaacccccgtgggtagaggtgctggtggagatcttgctggccctgttggcccagcccagccacctcatgcgccaggtggcccggagcgtgtttggccacatctgctcccacctgaccccgcgtgccctgcagctaattctggatgtgctgaaccccgagaccagtgaggatgagaatgaccgtgtggtggtgacggacgattctgatgagcggcggctgaagggtgcagaggacaagagcgaggaaggtgaggacaacagaagctcagagagtgaagaggagagcgagggggaggagagcgaggaggaggagcgcgacggggacgtggatcagggcttccgggaacagctgatgaccgtgctgcaggctgggaaggcgctgggtggagaggacagtgagaacgaggaggagctgggggatgaggccatgatggccctggaccagagcctcgccagcctctttgccgagcagaagctgcgtatccaggcccggcgagacgagaagaacaagctgcagaaggagaaggctctgcggcgcgacttccagatccgggtgctggacctggtggaggtgctagtgaccaagcagcccgagaatgccctggtcctggagctgctggagccgctgctgagcatcatccggcgcagcctgcgcagcagcagctccaaacaggagcaggaccttctgcacaagacggcgcgcatcttcacgcaccacctgtgccgtgcccggcgctactgccacgacttgggtgagcgcgcaggggccctgcacgcccaggtggagcggttggtgcagcaggctggccgccagcccgactcccccaccgccctctaccacttcaacgcctctctctacctgctccgggtcttgaagggcaacactgctgagggctgcgtgcatgagacacaggagaagcagaaagctggcactgaccccagccacatgcccacgggcccgcaggctgccagctgcttggacttgaacctggtgacccgggtgtactcgacagcactgagctccttcctgaccaagcgcaacagccccctcacagttcccatgttcctcagcctcttctcccggcacccggtgctctgtcagagcctgctccccatcctggtccagcatatcacgggcccggtgcggccccgtcatcaggcctgcctgctgctccagaagaccctgtccatgcgggaggtgaggtcgtgctttgaggaccccgagtggaagcagctgatgggccaggtcctagcaaaggtcaccgagaacttgcgcgtgctgggggaggcgcagaccaaggcgcagcatcagcaggcactgtcctccctggagctgctcaacgttctcttcaggacctgcaaacatgagaagctgaccttggacctgacggtgctcctgggtgtgctgcaggggcaacagcagagcctacagcagggggcacactccaccggctccagccgcctgcacgacctctactggcaggccatgaaaaccctgggagtccagcgccccaagttggagaagaaggatgccaaggagatccccagtgccacccagagccccatcagtaagaagcggaagaaaaagggattcttgccagagacgaagaagcgcaagaaacgcaagtcagaggatggcacgccagcggaggatggcacacctgcagccaccggcgggagccagccccccagcatgggcaggaagaagaggaacaggacaaaggctaaggtcccagcccaggcaaacgggacgccaaccaccaagagtccagcccctggcgcccccacccggagccccagcacccctgccaaatccccaaaactgcagaagaaaaaccagaagccgtcccaggtgaatggagctcccgggtcccccacggaacctgcaggccaaaagcagcatcagaaggctcttcccaaaaagggggtcttgggcaaatcaccactgtccgcgctggcacggaaaaaggcaaggctgtctttggtcatcaggagtcccagcctgcttcagagtggggccaagaagaaagcacaggtgaggaaggcagggaagccctgagcacaggtacgggcccccctcagcccctgcctccatctgcctgagacgcctatttttttttttttttttaaaaccatgattttaatacgcaagctgtttctaaggcgctgccactggggagggtggctgttgccgcctgcccgggcatcctgctctggcaagcacagcctgagccattcctgcaggggtcccagggtgcagagacctccccacccccggttctgggctgggaccctggctccagggccatgtccagggctctggtgtttgcctgggttggtgcaggttgatgtgctggctgcaggcaggtgtgaccatctctcgtgcctgccacctctttgcccccaggcttttttgctgtgagggagccaccagggggtgatttaaataggtttatttcttcatttacaagaggaatatatttggcttctctcttaagactctgagattcacaatcagcagctctaaaaaataaaggagcagtttggcttccggaaggaagaggaggcaaaaaaaaaacagacagaataaacagagaaaaagaaagcatagtaataaaaataaaaataaaaaaagagggggggggggaaaaaatatggagggggagaaatatgtgaccctttttagaaagggcctaagagggagtataaa

SEQ ID NO: 295579 - DNA, 5439 bp, Homo sapiens
tcgtgtttcggtgagtgtggcggagatggagagccgggatcccgcccagccgatgtcgcctggagaagcgacgcagagtggcgcccggcctgccgaccgctatggcctattgaagcacagtcgcgagttcttggacttcttctgggacattgcgaagcctgagcaggagacgcgacttgcggccacggagaagctgctggagtatctgcgtggcaggccgaaggggtccgagatgaaatatgccctgaagcgtctaatcacgggactcggggtcgggcgagaaacagcccggccctgctacagtttggccctggcacagctgttacagtcttttgaagacctccccttgtgcagcatcctgcagcagatacaagaaaaatatgacctgcatcaggtgaagaaggcaatgctgagacctgctctctttgcaaacctgtttggagtgctcgccctctttcagtcaggtcggctggtgaaggaccaggaggcactgatgaagtcggtgaagctgctgcaggccctggcccagtaccaaaaccacttgcaggagcagccccggaaggccctggtggacatcctctccgaggtctcgaaggccacattgcaggagatcctgccggaggtcctcaaagccgacttgaatataatactcagctcccctgaacagctagagctcttcctcctggcccagcagaaggtgccctccaagctcaagaagctggtgggatccgtgaacctattctcagatgagaatgtccccaggctggtgaatgtgctgaagatggccgcctcctctgtgaagaaggaccgcaagctgcccgccattgctctggacctgctccgcctggcgctcaaggaagacaagttcccacggttctggaaggaggtggtggaacaagggctgctgaagatgcagttctggccagccagctacctgtgtttccacctgctgggcgcggccctgcccctgctgaccaaggagcagctgcacctggtgatgcagggagacgtgatccgccattacggggagcacgtgtgcactgctaagctcccaaagcagttcaagtttgccccagagatggacgattacgtgggcaccttcctagaggggtgccaggatgaccctgagcggcagctggccgtgctagtggccttctcatctgtcaccaaccaaggcctccctgtcacgcctactttctggcgggtcgtgcggttcctgagccctccggccctgcagggctatgtggcctggctgcgggccatgtttctccagccagacctggactccttggttgacttcagcaccaacaaccagaagaaagcccaggattcatcgctccacatgcctgagcgagctgtgttccggctgaggaaatggatcatctttcgattggtgagcattgtggacagcctgcacctggagatggaggaggccttgactgagcaggtggccaggttttgtttgttccactcgttctttgtcacaaagaagcccacatcccagatccctgagacaaagcacccgttctccttccctttggaaaaccaggcccgagaggctgtcagcagtgccttcttcagtctgttgcagaccctcagcacgcagttcaagcaggcaccgggccagacccagggtgggcagccctggacctaccacctggtgcagttcgcagacctcctgttgaatcacagccacaacgtgaccaccgtgacacccttcactgcgcagcagcgccaggcctgggaccggatgctgcagactctgaaggagctggaggcccactccgcagaggccagggctgctgccttccagcaccttctgctcctcgtgggcatccacctcctcaagtcccctgcagagagctgtgacctgctgggtgacatccagacctgcatcaggaaaagtctgggagagaagccccgccggagccgcaccaagaccatcgacccccaggaacccccgtgggtagaggtgctggtggagatcttgctggccctgttggcccagcccagccacctcatgcgccaggtggcccggagcgtgtttggccacatctgctcccacctgaccccgcgtgccctgcagctaattctggatgtgctgaaccccgagaccagtgaggatgagaatgaccgtgtggtggtgacggacgattctgatgagcggcggctgaagggtgcagaggacaagagcgaggaaggtgaggacaacagaagctcagagagtgaagaggagagcgagggggaggagagcgaggaggaggagcgcgacggggacgtggatcagggcttccgggaacagctgatgaccgtgctgcaggctgggaaggcgctgggtggagaggacagtgagaacgaggaggagctgggggatgaggccatgatggccctggaccagagcctcgccagcctctttgccgagcagaagctgcgtatccaggcccggcgagacgagaagaacaagctgcagaaggagaaggctctgcggcgcgacttccagatccgggtgctggacctggtggaggtgctagtgaccaagcagcccgagaatgccctggtcctggagctgctggagccgctgctgagcatcatccggcgcagcctgcgcagcagcagctccaaacaggagcaggaccttctgcacaagacggcgcgcatcttcacgcaccacctgtgccgtgcccggcgctactgccacgacttgggtgagcgcgcaggggccctgcacgcccaggtggagcggttggtgcagcaggctggccgccagcccgactcccccaccgccctctaccacttcaacgcctctctctacctgctccgggtcttgaagggcaacactgctgagggctgcgtgcatgagacacaggagaagcagaaagctggcactgaccccagccacatgcccacgggcccgcaggctgccagctgcttggacttgaacctggtgacccgggtgtactcgacagcactgagctccttcctgaccaagcgcaacagccccctcacagttcccatgttcctcagcctcttctcccggcacccggtgctctgtcagagcctgctccccatcctggtccagcatatcacgggcccggtgcggccccgtcatcaggcctgcctgctgctccagaagaccctgtccatgcgggaggtgaggtcgtgctttgaggaccccgagtggaagcagctgatgggccaggtcctagcaaaggtcaccgagaacttgcgcgtgctgggggaggcgcagaccaaggcgcagcatcagcaggcactgtcctccctggagctgctcaacgttctcttcaggacctgcaaacatgagaagctgaccttggacctgacggtgctcctgggtgtgctgcaggggcaacagcagagcctacagcagggggcacactccaccggctccagccgcctgcacgacctctactggcaggccatgaaaaccctgggagtccagcgccccaagttggagaagaaggatgccaaggagatccccagtgccacccagagccccatcagtaagaagcggaagaaaaagggattcttgccagagacgaagaagcgcaagaaacgcaagtcagaggatggcacgccagcggaggatggcacacctgcagccaccggcgggagccagccccccagcatgggcaggaagaagaggaacaggacaaaggctaaggtcccagcccaggcaaacgggacgccaaccaccaagagtccagcccctggcgcccccacccggagccccagcacccctgccaaatccccaaaactgcagaagaaaaaccagaagccgtcccaggtgaatggagctcccgggtcccccacggaacctgcaggccaaaagcagcatcagaaggctcttcccaaaaagggggtcttgggcaaatcaccactgtccgcgctggcacggaaaaaggcaaggctgtctttggtcatcaggagtcccagcctgcttcagagtggggccaagaagaaagcacaggtgaggaaggcagggaagccctgagcacaggtacgggcccccctcagcccctgcctccatctgcctgagacgcctatttttttttttttttttaaaaccatgattttaatacgcaagctgtttctaaggcgctgccactggggagggtggctgttgccgcctgcccgggcatcctgctctggcaagcacagcctgagccattcctgcaggggtcccagggtgcagagacctccccacccccggttctgggctgggaccctggctccagggccatgtccagggctctggtgtttgcctgggttggtgcaggttgatgtgctggctgcaggcaggtgtgaccatctctcgtgcctgccacctctttgcccccaggcttttttgctgtgagggagccaccagggggtgatttaaataggtttatttcttcatttacaagaggaatatatttggcttctctcttaagactctgagattcacaatcagcagctctaaaaaataaaggagcagtttggcttccggaaggaagaggaggcaacactcggacctggttcttgtacaacaagaaaacatcgctggggccccgctgaggctggagtgggggtggaggctggtctttggaggatgccacccccaccccatcctcttgtcaggccctcggggtaccccagagcttggtgggtgagtattccacctgcttacacaccactgaagccacagccagccagtaactaaggggcaagaagagcattgtccaagctggctcttggggggtcccccattggccacaaggcctcaccccccaccccacccccgcaccagaaccaccttgattgcagcagaagtgcagggagtgggtgacgcagggggctaagctcccccaaagcgggttggggctggtgtgaagttggcagctgcatcctggtgtgtgcatggatgggaggtgggtgatcgaaggcctggcccccccctggggtcacttggtggaatgccagcagccagtgtttgggtaggggccgcctctcccggggcctcagcctcagctctggggcaggaagctttgtggatagctgcttcctccagcagccggagccctggctactgccccatggattctgggaatggtctcctgggccctgcccctggaaaaggctcagctcagcctcggggaaggagtggggtcctggcttggggggtggtggcagggagagaagccctgcagagttgggctggtgtgcacctgccagagaccttgagcctgggggcacaggtggtgtacagctgcagccagggccttcacccctggtgatgccagcttgtcagaacagtccccatctgggacctccaggctgggagccaacccgagacagtgagacagtgtcctccagggagtacccagagacttgggcgcccagcttcatttgccaggttgcgtccaatatccccaaggtccg

SEQ ID NO: 295580 - DNA, 4976 bp, Homo sapiens
tcgtgtttcggtgagtgtggcggagatggagagccgggatcccgcccagccgatgtcgcctggagaagcgacgcagagtggcgcccggcctgccgaccgctatggcctattgaagcacagtcgcgagttcttggacttcttctgggacattgcgaagcctgagcaggagacgcgacttgcggccacggagaagctgctggagtatctgcgtggcaggccgaaggggtccgagatgaaatatgccctgaagcgtctaatcacgggactcggggtcgggcgagaaacagcccggccctgctacagtttggccctggcacagctgttacagtcttttgaagacctccccttgtgcagcatcctgcagcagatacaagaaaaatatgacctgcatcaggtgaagaaggcaatgctgagacctgctctctttgcaaacctgtttggagtgctcgccctctttcagtcaggtcggctggtgaaggaccaggaggcactgatgaagtcggtgaagctgctgcaggccctggcccagtaccaaaaccacttgcaggagcagccccggaaggccctggtggacatcctctccgaggtctcgaaggccacattgcaggagatcctgccggaggtcctcaaagccgacttgaatataatactcagctcccctgaacagctagagctcttcctcctggcccagcagaaggtgccctccaagctcaagaagctggtgggatccgtgaacctattctcagatgagaatgtccccaggctggtgaatgtgctgaagatggccgcctcctctgtgaagaaggaccgcaagctgcccgccattgctctggacctgctccgcctggcgctcaaggaagacaagttcccacggttctggaaggaggtggtggaacaagggctgctgaagatgcagttctggccagccagctacctgtgtttccacctgctgggcgcggccctgcccctgctgaccaaggagcagctgcacctggtgatgcagggagacgtgatccgccattacggggagcacgtgtgcactgctaagctcccaaagcagttcaagtttgccccagagatggacgattacgtgggcaccttcctagaggggtgccaggatgaccctgagcggcagctggccgtgctagtggccttctcatctgtcaccaaccaaggcctccctgtcacgcctactttctggcgggtcgtgcggttcctgagccctccggccctgcagggctatgtggcctggctgcgggccatgtttctccagccagacctggactccttggttgacttcagcaccaacaaccagaagaaagcccaggattcatcgctccacatgcctgagcgagctgtgttccggctgaggaaatggatcatctttcgattggtgagcattgtggacagcctgcacctggagatggaggaggccttgactgagcaggtggccaggttttgtttgttccactcgttctttgtcacaaagaagcccacatcccagatccctgagacaaagcacccgttctccttccctttggaaaaccaggcccgagaggctgtcagcagtgccttcttcagtctgttgcagaccctcagcacgcagttcaagcaggcaccgggccagacccagggtgggcagccctggacctaccacctggtgcagttcgcagacctcctgttgaatcacagccacaacgtgaccaccgtgacacccttcactgcgcagcagcgccaggcctgggaccggatgctgcagactctgaaggagctggaggcccactccgcagaggccagggctgctgccttccagcaccttctgctcctcgtgggcatccacctcctcaagtcccctgcagagagctgtgacctgctgggtgacatccagacctgcatcaggaaaagtctgggagagaagccccgccggagccgcaccaagaccatcgacccccaggaacccccgtgggtagaggtgctggtggagatcttgctggccctgttggcccagcccagccacctcatgcgccaggtggcccggagcgtgtttggccacatctgctcccacctgaccccgcgtgccctgcagctaattctggatgtgctgaaccccgagaccagtgaggatgagaatgaccgtgtggtggtgacggacgattctgatgagcggcggctgaagggtgcagaggacaagagcgaggaaggtgaggacaacagaagctcagagagtgaagaggagagcgagggggaggagagcgaggaggaggagcgcgacggggacgtggatcagggcttccgggaacagctgatgaccgtgctgcaggctgggaaggcgctgggtggagaggacagtgagaacgaggaggagctgggggatgaggccatgatggccctggaccagagcctcgccagcctctttgccgagcagaagctgcgtatccaggcccggcgagacgagaagaacaagctgcagaaggagaaggctctgcggcgcgacttccagatccgggtgctggacctggtggaggtgctagtgaccaagcagcccgagaatgccctggtcctggagctgctggagccgctgctgagcatcatccggcgcagcctgcgcagcagcagctccaaacaggagcaggaccttctgcacaagacggcgcgcatcttcacgcaccacctgtgccgtgcccggcgctactgccacgacttgggtgagcgcgcaggggccctgcacgcccaggtggagcggttggtgcagcaggctggccgccagcccgactcccccaccgccctctaccacttcaacgcctctctctacctgctccgggtcttgaagggcaacactgctgagggctgcgtgcatgagacacaggagaagcagaaagctggcactgaccccagccacatgcccacgggcccgcaggctgccagctgcttggacttgaacctggtgacccgggtgtactcgacagcactgagctccttcctgaccaagcgcaacagccccctcacagttcccatgttcctcagcctcttctcccggcacccggtgctctgtcagagcctgctccccatcctggtccagcatatcacgggcccggtgcggccccgtcatcaggcctgcctgctgctccagaagaccctgtccatgcgggaggtgaggtcgtgctttgaggaccccgagtggaagcagctgatgggccaggtcctagcaaaggtcaccgagaacttgcgcgtgctgggggaggcgcagaccaaggcgcagcatcagcaggcactgtcctccctggagctgctcaacgttctcttcaggacctgcaaacatgagaagctgaccttggacctgacggtgctcctgggtgtgctgcaggggcaacagcagagcctacagcagggggcacactccaccggctccagccgcctgcacgacctctactggcaggccatgaaaaccctgggagtccagcgccccaagttggagaagaaggatgccaaggagatccccagtgccacccagagccccatcagtaagaagcggaagaaaaagggattcttgccagagacgaagaagcgcaagaaacgcaagtcagaggatggcacgccagcggaggatggcacacctgcagccaccggcgggagccagccccccagcatgggcaggaagaagaggaacaggacaaaggctaaggtcccagcccaggcaaacgggacgccaaccaccaagagtccagcccctggcgcccccacccggagccccagcacccctgccaaatccccaaaactgcagaagaaaaaccagaagccgtcccaggtgaatggagctcccgggtcccccacggaacctgcaggccaaaagcagcatcagaaggctcttcccaaaaagggggtcttgggcaaatcaccactgtccgcgctggcacggaaaaaggcaaggctgtctttggtcatcaggagtcccagcctgcttcagagtggggccaagaagaaagcacagactctgagattcacaatcagcagctctaaaaaataaaggagcagtttggcttccggaaggaagaggaggcaacactcggacctggttcttgtacaacaagaaaacatcgctggggccccgctgaggctggagtgggggtggaggctggtctttggaggatgccacccccaccccatcctcttgtcaggccctcggggtaccccagagcttggtgggtgagtattccacctgcttacacaccactgaagccacagccagccagtaactaaggggcaagaagagcattgtccaagctggctcttggggggtcccccattggccacaaggcctcaccccccaccccacccccgcaccagaaccaccttgattgcagcagaagtgcagggagtgggtgacgcagggggctaagctcccccaaagcgggttggggctggtgtgaagttggcagctgcatcctggtgtgtgcatggatgggaggtgggtgatcgaaggcctggcccccccctggggtcacttggtggaatgccagcagccagtgtttgggtaggggccgcctctcccggggcctcagcctcagctctggggcaggaagctttgtggatagctgcttcctccagcagccggagccctggctactgccccatggattctgggaatggtctcctgggccctgcccctggaaaaggctcagctcagcctcggggaaggagtggggtcctggcttggggggtggtggcagggagagaagccctgcagagttgggctggtgtgcacctgccagagaccttgagcctgggggcacaggtggtgtacagctgcagccagggccttcacccctggtgatgccagcttgtcagaacagtccccatctgggacctccaggctgggagccaacccgagacagtgagacagtgtcctccagggagtacccagagacttgggcgcccagcttcatttgccaggttgcgtccaatatccccaaggtccg

SEQ ID NO: 295581 - DNA, 4584 bp, Homo sapiens
tcgtgtttcggtgagtgtggcggagatggagagccgggatcccgcccagccgatgtcgcctggagaagcgacgcagagtggcgcccggcctgccgaccgctatggcctattgaagcacagtcgcgagttcttggacttcttctgggacattgcgaagcctgagcaggagacgcgacttgcggccacggagaagctgctggagtatctgcgtggcaggccgaaggggtccgagatgaaatatgccctgaagcgtctaatcacgggactcggggtcgggcgagaaacagcccggccctgctacagtttggccctggcacagctgttacagtcttttgaagacctccccttgtgcagcatcctgcagcagatacaagaaaaatatgacctgcatcaggtgaagaaggcaatgctgagacctgctctctttgcaaacctgtttggagtgctcgccctctttcagtcaggtcggctggtgaaggaccaggaggcactgatgaagtcggtgaagctgctgcaggccctggcccagtaccaaaaccacttgcaggagcagccccggaaggccctggtggacatcctctccgaggtctcgaaggccacattgcaggagatcctgccggaggtcctcaaagccgacttgaatataatactcagctcccctgaacagctagagctcttcctcctggcccagcagaaggtgccctccaagctcaagaagctggtgggatccgtgaacctattctcagatgagaatgtccccaggctggtgaatgtgctgaagatggccgcctcctctgtgaagaaggaccgcaagctgcccgccattgctctggacctgctccgcctggcgctcaaggaagacaagttcccacggttctggaaggaggtggtggaacaagggctgctgaagatgcagttctggccagccagctacctgtgtttccacctgctgggcgcggccctgcccctgctgaccaaggagcagctgcacctggtgatgcagggagacgtgatccgccattacggggagcacgtgtgcactgctaagctcccaaagcagttcaagtttgccccagagatggacgattacgtgggcaccttcctagaggggtgccaggatgaccctgagcggcagctggccgtgctagtggccttctcatctgtcaccaaccaaggcctccctgtcacgcctactttctggcgggtcgtgcggttcctgagccctccggccctgcagggctatgtggcctggctgcgggccatgtttctccagccagacctggactccttggttgacttcagcaccaacaaccagaagaaagcccaggattcatcgctccacatgcctgagcgagctgtgttccggctgaggaaatggatcatctttcgattggtgagcattgtggacagcctgcacctggagatggaggaggccttgactgagcaggtggccaggttttgtttgttccactcgttctttgtcacaaagaagcccacatcccagatccctgagacaaagcacccgttctccttccctttggaaaaccaggcccgagaggctgtcagcagtgccttcttcagtctgttgcagaccctcagcacgcagttcaagcaggcaccgggccagacccagggtgggcagccctggacctaccacctggtgcagttcgcagacctcctgttgaatcacagccacaacgtgaccaccgtgacacccttcactgcgcagcagcgccaggcctgggaccggatgctgcagactctgaaggagctggaggcccactccgcagaggccagggctgctgccttccagcaccttctgctcctcgtgggcatccacctcctcaagtcccctgcagagagctgtgacctgctgggtgacatccagacctgcatcaggaaaagtctgggagagaagccccgccggagccgcaccaagaccatcgacccccaggaacccccgtgggtagaggtgctggtggagatcttgctggccctgttggcccagcccagccacctcatgcgccaggtggcccggagcgtgtttggccacatctgctcccacctgaccccgcgtgccctgcagctaattctggatgtgctgaaccccgagaccagtgaggatgagaatgaccgtgtggtggtgacggacgattctgatgagcggcggctgaagggtgcagaggacaagagcgaggaaggtgaggacaacagaagctcagagagtgaagaggagagcgagggggaggagagcgaggaggaggagcgcgacggggacgtggatcagggcttccgggaacagctgatgaccgtgctgcaggctgggaaggcgctgggtggagaggacagtgagaacgaggaggagctgggggatgaggccatgatggccctggaccagagcctcgccagcctctttgccgagcagaagctgcgtatccaggcccggcgagacgagaagaacaagctgcagaaggagaaggctctgcggcgcgacttccagatccgggtgctggacctggtggaggtgctagtgaccaagcagcccgagaatgccctggtcctggagctgctggagccgctgctgagcatcatccggcgcagcctgcgcagcagcagctccaaacaggagcaggaccttctgcacaagacggcgcgcatcttcacgcaccacctgtgccgtgcccggcgctactgccacgacttgggtgagcgcgcaggggccctgcacgcccaggtggagcggttggtgcagcaggctggccgccagcccgactcccccaccgccctctaccacttcaacgcctctctctacctgctccgggtcttgaagggcaacactgctgagggctgcgtgcatgagacacaggagaagcagaaagctggcactgaccccagccacatgcccacgggcccgcaggctgccagctgcttggacttgaacctggtgacccgggtgtactcgacagcactgagctccttcctgaccaagcgcaacagccccctcacagttcccatgttcctcagcctcttctcccggcacccggtgctctgtcagagcctgctccccatcctggtccagcatatcacgggcccggtgcggccccgtcatcaggcctgcctgctgctccagaagaccctgtccatgcgggaggtgaggtcgtgctttgaggaccccgagtggaagcagctgatgggccaggtcctagcaaaggtcaccgagaacttgcgcgtgctgggggaggcgcagaccaaggcgcagcatcagcaggcactgtcctccctggagctgctcaacgttctcttcaggacctgcaaacatgagaagctgaccttggacctgacggtgctcctgggtgtgctgcaggggcaacagcagagcctacagcagggggcacactccaccggctccagccgcctgcacgacctctactggcaggccatgaaaaccctgggagtccagcgccccaagttggagaagaaggatgccaaggagatccccagtgccacccagagccccatcagtaagaagcggaagaaaaagggattcttgccagagacgaagaagcgcaagaaacgcaagtcagaggatggcacgccagcggaggatggcacacctgcagccaccggcgggagccagccccccagcatgggcaggaagaagaggaacaggacaaaggctaaggtcccagcccaggcaaacgggacgccaaccaccaagagtcccaggtgaatggagctcccgggtcccccacggaacctgcaggccaaaagcagcatcagaaggctcttcccaaaaagggggtcttgggcaaatcaccactgtccgcgctggcacggaaaaaggcaaggctgtctttggtcatcaggagtcccagcctgcttcagagtggggccaagaagaaagcacaggtgaggaaggcagggaagccctgagcacaggtacgggcccccctcagcccctgcctccatctgcctgagacgcctatttttttttttttttttaaaaccatgattttaatacgcaagctgtttctaaggcgctgccactggggagggtggctgttgccgcctgcccgggcatcctgctctggcaagcacagcctgagccattcctgcaggggtcccagggtgcagagacctccccacccccggttctgggctgggaccctggctccagggccatgtccagggctctggtgtttgcctgggttggtgcaggttgatgtgctggctgcaggcaggtgtgaccatctctcgtgcctgccacctctttgcccccaggcttttttgctgtgagggagccaccagggggtgatttaaataggtttatttcttcatttacaagaggaatatatttggcttctctcttaagactctgagattcacaatcagcagctctaaaaaataaaggagcagtttggcttccggaaggaagaggaggcaaaaaaaaaacagacagaataaacagagaaaaagaaagcatagtaataaaaataaaaataaaaaaagagggggggggggaaaaaatatggagggggagaaatatgtgaccctttttagaaagggcctaagagggagtataaa

SEQ ID NO: 295582 - DNA, 5006 bp, Homo sapiens
tcgtgtttcggtgagtgtggcggagatggagagccgggatcccgcccagccgatgtcgcctggagaagcgacgcagagtggcgcccggcctgccgaccgctatggcctattgaagcacagtcgcgagttcttggacttcttctgggacattgcgaagcctgagcaggagacgcgacttgcggccacggagaagctgctggagtatctgcgtggcaggccgaaggggtccgagatgaaatatgccctgaagcgtctaatcacgggactcggggtcgggcgagaaacagcccggccctgctacagtttggccctggcacagctgttacagtcttttgaagacctccccttgtgcagcatcctgcagcagatacaagaaaaatatgacctgcatcaggtgaagaaggcaatgctgagacctgctctctttgcaaacctgtttggagtgctcgccctctttcagtcaggtcggctggtgaaggaccaggaggcactgatgaagtcggtgaagctgctgcaggccctggcccagtaccaaaaccacttgcaggagcagccccggaaggccctggtggacatcctctccgaggtctcgaaggccacattgcaggagatcctgccggaggtcctcaaagccgacttgaatataatactcagctcccctgaacagctagagctcttcctcctggcccagcagaaggtgccctccaagctcaagaagctggtgggatccgtgaacctattctcagatgagaatgtccccaggctggtgaatgtgctgaagatggccgcctcctctgtgaagaaggaccgcaagctgcccgccattgctctggacctgctccgcctggcgctcaaggaagacaagttcccacggttctggaaggaggtggtggaacaagggctgctgaagatgcagttctggccagccagctacctgtgtttccacctgctgggcgcggccctgcccctgctgaccaaggagcagctgcacctggtgatgcagggagacgtgatccgccattacggggagcacgtgtgcactgctaagctcccaaagcagttcaagtttgccccagagatggacgattacgtgggcaccttcctagaggggtgccaggatgaccctgagcggcagctggccgtgctagtggccttctcatctgtcaccaaccaaggcctccctgtcacgcctactttctggcgggtcgtgcggttcctgagccctccggccctgcagggctatgtggcctggctgcgggccatgtttctccagccagacctggactccttggttgacttcagcaccaacaaccagaagaaagcccaggattcatcgctccacatgcctgagcgagctgtgttccggctgaggaaatggatcatctttcgattggtgagcattgtggacagcctgcacctggagatggaggaggccttgactgagcaggtggccaggttttgtttgttccactcgttctttgtcacaaagaagcccacatcccagatccctgagacaaagcacccgttctccttccctttggaaaaccaggcccgagaggctgtcagcagtgccttcttcagtctgttgcagaccctcagcacgcagttcaagcaggcaccgggccagacccagggtgggcagccctggacctaccacctggtgcagttcgcagacctcctgttgaatcacagccacaacgtgaccaccgtgacacccttcactgcgcagcagcgccaggcctgggaccggatgctgcagactctgaaggagctggaggcccactccgcagaggccagggctgctgccttccagcaccttctgctcctcgtgggcatccacctcctcaagtcccctgcagagagctgtgacctgctgggtgacatccagacctgcatcaggaaaagtctgggagagaagccccgccggagccgcaccaagaccatcgacccccaggaacccccgtgggtagaggtgctggtggagatcttgctggccctgttggcccagcccagccacctcatgcgccaggtggcccggagcgtgtttggccacatctgctcccacctgaccccgcgtgccctgcagctaattctggatgtgctgaaccccgagaccagtgaggatgagaatgaccgtgtggtggtgacggacgattctgatgagcggcggctgaagggtgcagaggacaagagcgaggaaggtgaggacaacagaagctcagagagtgaagaggagagcgagggggaggagagcgaggaggaggagcgcgacggggacgtggatcagggcttccgggaacagctgatgaccgtgctgcaggctgggaaggcgctgggtggagaggacagtgagaacgaggaggagctgggggatgaggccatgatggccctggaccagagcctcgccagcctctttgccgagcagaagctgcgtatccaggcccggcgagacgagaagaacaagctgcagaaggagaaggctctgcggcgcgacttccagatccgggtgctggacctggtggaggtgctagtgaccaagcagcccgagaatgccctggtcctggagctgctggagccgctgctgagcatcatccggcgcagcctgcgcagcagcagctccaaacaggagcaggaccttctgcacaagacggcgcgcatcttcacgcaccacctgtgccgtgcccggcgctactgccacgacttgggtgagcgcgcaggggccctgcacgcccaggtggagcggttggtgcagcaggctggccgccagcccgactcccccaccgccctctaccacttcaacgcctctctctacctgctccgggtcttgaagggcaacactgctgagggctgcgtgcatgagacacaggagaagcagaaagctggcactgaccccagccacatgcccacgggcccgcaggctgccagctgcttggacttgaacctggtgacccgggtgtactcgacagcactgagctccttcctgaccaagcgcaacagccccctcacagttcccatgttcctcagcctcttctcccggcacccggtgctctgtcagagcctgctccccatcctggtccagcatatcacgggcccggtgcggccccgtcatcaggcctgcctgctgctccagaagaccctgtccatgcgggaggtgaggtcgtgctttgaggaccccgagtggaagcagctgatgggccaggtcctagcaaaggtcaccgagaacttgcgcgtgctgggggaggcgcagaccaaggcgcagcatcagcaggcactgtcctccctggagctgctcaacgttctcttcaggacctgcaaacatgagaagctgaccttggacctgacggtgctcctgggtgtgctgcaggggcaacagcagagcctacagcagggggcacactccaccggctccagccgcctgcacgacctctactggcaggccatgaaaaccctgggagtccagcgccccaagttggagaagaaggatgccaaggagatccccagtgccacccagagccccatcagtaagaagcggaagaaaaagggattcttgccagagacgaagaagcgcaagaaacgcaagtcagaggatggcacgccagcggaggatggcacacctgcagccaccggcgggagccagccccccagcatgggcaggaagaagaggaacaggacaaaggctaaggtcccagcccaggcaaacgggacgccaaccaccaagagtccagcccctggcgcccccacccggagccccagcacccctgccaaatccccaaaactgcagaagaaaaaccagaagccttctgggctgggaccctggctccagggccatgtccagggctctggtgtttgcctgggttggtgcaggttgatgtgctggctgcaggcaggtgtgaccatctctcgtgcctgccacctctttgcccccaggcttttttgctgtgagggagccaccagggggtgatttaaataggtttatttcttcatttacaagaggaatatatttggcttctctcttaagactctgagattcacaatcagcagctctaaaaaataaaggagcagtttggcttccggaaggaagaggaggcaacactcggacctggttcttgtacaacaagaaaacatcgctggggccccgctgaggctggagtgggggtggaggctggtctttggaggatgccacccccaccccatcctcttgtcaggccctcggggtaccccagagcttggtgggtgagtattccacctgcttacacaccactgaagccacagccagccagtaactaaggggcaagaagagcattgtccaagctggctcttggggggtcccccattggccacaaggcctcaccccccaccccacccccgcaccagaaccaccttgattgcagcagaagtgcagggagtgggtgacgcagggggctaagctcccccaaagcgggttggggctggtgtgaagttggcagctgcatcctggtgtgtgcatggatgggaggtgggtgatcgaaggcctggcccccccctggggtcacttggtggaatgccagcagccagtgtttgggtaggggccgcctctcccggggcctcagcctcagctctggggcaggaagctttgtggatagctgcttcctccagcagccggagccctggctactgccccatggattctgggaatggtctcctgggccctgcccctggaaaaggctcagctcagcctcggggaaggagtggggtcctggcttggggggtggtggcagggagagaagccctgcagagttgggctggtgtgcacctgccagagaccttgagcctgggggcacaggtggtgtacagctgcagccagggccttcacccctggtgatgccagcttgtcagaacagtccccatctgggacctccaggctgggagccaacccgagacagtgagacagtgtcctccagggagtacccagagacttgggcgcccagcttcatttgccaggttgcgtccaatatccccaaggtccg

SEQ ID NO: 295583 - DNA, 1225 bp, Homo sapiens
ccccgtcccgatggccatggcccgtccccgtcccgtgctgtaggctctgctgttgcccctgcagcacacccagagccccatcagtaagaagcggaagaaaaagggattcttgccagagacgaagaagcgcaagaaacgcaagtcagaggatggcacgccagcggaggatggcacacctgcagccaccggcgggagccagccccccagcatgggcaggaagaagaggaacaggacaaaggctaaggtcccagcccaggcaaacgggacgccaaccaccaagagtccagcccctggcgcccccacccggagccccagcacccctgccaaatccccaaaactgcagaagaaaaaccagaagccgtcccaggtgaatggagctcccgggtcccccacggaacctgcaggccaaaagcagcatcagaaggctcttcccaaaaagggggtcttgggcaaatcaccactgtccgcgctggcacggaaaaaggcaaggctgtctttggtcatcaggagtcccagcctgcttcagagtggggccaagaagaaagcacaggtgaggaaggcagggaagccctgagcacaggtacgggcccccctcagcccctgcctccatctgcctgagacgcctatttttttttttttttttaaaaccatgattttaatacgcaagctgtttctaaggcgctgccactggggagggtggctgttgccgcctgcccgggcatcctgctctggcaagcacagcctgagccattcctgcaggggtcccagggtgcagagacctccccacccccggttctgggctgggaccctggctccagggccatgtccagggctctggtgtttgcctgggttggtgcaggttgatgtgctggctgcaggcaggtgtgaccatctctcgtgcctgccacctctttgcccccaggcttttttgctgtgagggagccaccagggggtgatttaaataggtttatttcttcatttacaagaggaatatatttggcttctctcttaagactctgagattcacaatcagcagctctaaaaaataaaggagcagtttggcttccggaaggaagaggaggcaaaaaaaaaacagacagaataaacagagaaaaagaaagcatagtaataaaaataaaaataaaaaaagagggggggggggaaaaaatatggagggggagaaatatgtgaccctttttagaaagggcctaagagggagtataaa

SEQ ID NO: 295584 - DNA, 1255 bp, Homo sapiens
cccacctgctccacataagcccaaatctgacctgttctcattttcccttctgggctgggaccctggctccagggccatgtccagggctctggtgtttgcctgggttggtgcaggttgatgtgctggctgcaggcaggtgtgaccatctctcgtgcctgccacctctttgcccccaggcttttttgctgtgagggagccaccagggggtgatttaaataggtttatttcttcatttacaagaggaatatatttggcttctctcttaagactctgagattcacaatcagcagctctaaaaaataaaggagcagtttggcttccggaaggaagaggaggcaacactcggacctggttcttgtacaacaagaaaacatcgctggggccccgctgaggctggagtgggggtggaggctggtctttggaggatgccacccccaccccatcctcttgtcaggccctcggggtaccccagagcttggtgggtgagtattccacctgcttacacaccactgaagccacagccagccagtaactaaggggcaagaagagcattgtccaagctggctcttggggggtcccccattggccacaaggcctcaccccccaccccacccccgcaccagaaccaccttgattgcagcagaagtgcagggagtgggtgacgcagggggctaagctcccccaaagcgggttggggctggtgtgaagttggcagctgcatcctggtgtgtgcatggatgggaggtgggtgatcgaaggcctggcccccccctggggtcacttggtggaatgccagcagccagtgtttgggtaggggccgcctctcccggggcctcagcctcagctctggggcaggaagctttgtggatagctgcttcctccagcagccggagccctggctactgccccatggattctgggaatggtctcctgggccctgcccctggaaaaggctcagctcagcctcggggaaggagtggggtcctggcttggggggtggtggcagggagagaagccctgcagagttgggctggtgtgcacctgccagagaccttgagcctgggggcacaggtggtgtacagctgcagccagggccttcacccctggtgatgccagcttgtcagaacagtccccatctgggacctccaggctgggagccaacccgagacagtgagacagtgtcctccagggagtacccagagacttgggcgcccagcttcatttgccaggttgcgtccaatatccccaaggtccg

SEQ ID NO: 295585 - DNA, 464 bp, Homo sapiens
aagtgggacttgggttggctctgcttggcggagcagggtggaccgagaatgttctgaccagctctcgtcctcaccacccacaggcaccacctgtgccgtgcccggcgctactgccacgacttgggtgagcgcgcaggggccctgcacgcccaggtggagcggttggtgcagcaggctggccgccagcccgactcccccaccgccctctaccacttcaacgcctctctctacctgctccgggtcttgaagggcaacactgctgagggctgcgtgcatgagacacaggagaagcagaaagctggcactgaccccagccacatgcccacgggcccgcaggtgagcagggcctggcccaggagcagccccaggcatttcacagccagggagtggaggccgggacttccccagggcccaaccctcagccttctgatgaaggtaggccaggctctgctcccatcccaggg

SEQ ID NO: 295586 - DNA, 1498 bp, Homo sapiens
cacttggcgcatgggagacatgtgctgggtctgtggggccgtggcccggtggccaggcgagttcttctccagcacgttcagccgggcctccagcttggagatgacctgctgcagctcctgtaccacactgcgcaggctctggttctccactttcagactggtgatccggacgacgagctcgctgtggtctccgctggggccgctggaggccccggggcctgagtttccggccagggatttctggatgttctctctggctctcgcgatgtcacggaggatcacgctggcgtcgttctcttggcgggaggcaccggccacaggcccattcatctgctcgtagaatctcctttctgcgtcgtcatatttgaacttgtcgaaccagatcttctcatgtactaggaagtttgtagccatttttctgacgcctgccaaggacgcgacgaccagggaggaggaatcggcggacgcgggacacctgaggaaagggtactaccttaaaaatcttttcctatagtcttggtaaattttaaatgatagctctataaatgatatttataagttatggttatttttttttttagtttttcattaattttgatcaattgtatcttactaggagatcacccatttactgtaggtagtattctcttcctactatatttcatatctacctactacatttcatatcattcctactacatttcatatctacctacatttacatgtaggtagatatgaaatgattcaatatccatgtctccttttactcattacaaatcttacataattttgctctctcttatctctttaccttactcgggtttatgtgaggtatttagtttactaaggttttaaaatattttcatattcattttagtaggaaaaggacggattattttataaatttcattgcctgaataagtttaggtatggtttcgggtacaataagaaagagataaaatggaatgctttatgccaaacatgtttatttttatcacacagctaaagtctgtagttaagttgctgctacttttgagtcaataacatcaagaccagtgttggtgaatcttttggcctttccccaatgcttgaaagaagatcaccactgctggaggcataatgtacaaggcaggaaaagggatggaattgatggtgacagctaagtctgtcttttttcttaggaaataaaggttttcctaggatacatttaagtgttttgcttctcttgggctgaggcaggtcatttggccactaccagtttcagaagatgatgatgttacagcactattcacaatagcaaagacatggaatcaacctaaatgctcatcaatagtagactgcataaagaaaatgtggtacatatacatcatggaatactatgcagccattaaaaagaatgagatcatgtcctttgcagggatatggatggagctgaaggccattatccttagcaaactaacgcaggaacagaaaaccaaacatcacatattctcactta

SEQ ID NO: 295587 - DNA, 982 bp, Homo sapiens
cacttggcgcatgggagacatgtgctgggtctgtggggccgtggcccggtggccaggcgagttcttctccagcacgttcagccgggcctccagcttggagatgacctgctgcagctcctgtaccacactgcgcaggctctggttctccactttcagactggtgatccggacgacgagctcgctgtggtctccgctggggccgctggaggccccggggcctgagtttccggccagggatttctggatgttctctctggctctcgcgatgtcacggaggatcacgctggcgtcgttctcttggcgggaggcaccggccacaggcccattcatctgctcgtagaatctcctttctgcgtcgtcatatttgaacttgtcgaaccagatcttctcatgtactaggaagtttgtagccatttttctgacgcctgccaaggacgcgacgaccagggaggaggaatcggcggacgcgggacacctgaggaaaggctaaagtctgtagttaagttgctgctacttttgagtcaataacatcaagaccagtgttggtgaatcttttggcctttccccaatgcttgaaagaagatcaccactgctggaggcataatgtacaaggcaggaaaagggatggaattgatggtgacagctaagtctgtcttttttcttaggaaataaaggttttcctaggatacatttaagtgttttgcttctcttgggctgaggcaggtcatttggccactaccagtttcagaagatgatgatgttacagcactattcacaatagcaaagacatggaatcaacctaaatgctcatcaatagtagactgcataaagaaaatgtggtacatatacatcatggaatactatgcagccattaaaaagaatgagatcatgtcctttgcagggatatggatggagctgaaggccattatccttagcaaactaacgcaggaacagaaaaccaaacatcacatattctcactta

SEQ ID NO: 295588 - DNA, 1626 bp, Homo sapiens
gggcctggttgtggaggccccttttgcaaaacctcagtctgaatttagtagacagaagtcactaggaatgccttgacaggatcctgccttagctaaggctccctccagctgcagagggtgtttttgttagactcacacactgcgtgaaactgctcagaatagagccatgatctcaaccacgaaatgggaacttagattttggagaaactaacggggacggacttctttcctagcctgagtgttgagcagtgtcatgccttggcgtttcagctcctcgttgtctaggtggtgaaatgacagaactcattcgcttctttgattggtgattttgaaataatctttcatcaagttccatctcctttaccctcatatggaatatatctctctgtctgttgttaaactatgatgacatgtctgtagctatcagaaagagaagctgggaagaacatgtgacccactggatgggacagccttttaattctgatgatcgtaacacagcatgtcatcatggactagtagctgacagcttgcaggcaagtatggaaaaagatgcaactctaaatgtggaccgcaaagagaagtgtgtttcactacctgactgctgtcatggatcagagctgagagattttcctgggaggccaatgggtcatctttcaaaggatgtggacgaaaatgacagccatgaaggtgaagatcagtttctttctctggaagccagcacagaaacactagtgcatgtttctgatgaggataacaatgctgatttatgccttacagatgataaacaggttttaaatacccaagggcagaaaacatcaggccaacatatgatccaaggagcaggctccttagaaaaggcactgcccatcatacaaagtaaccaagtttcttctaactcctggggaatagctggtgaaactgaattagcactggtaaaagaaagtggggagagaaaagttactgactctataagtaaaagcctggagctttgcaatgaaataagcttaagtgaaataaaagatgcacccaaagtaaatgcagtggatactttgaacgtgaaagatattgcacctgagaaacaattgcttaactctgctgtaattgctcagcaacgaaggaaacctgacccccctaaagatgaaaatgaaagaagcacctgcaatgtagtacacgatgagttcttggatattccttgcacaaacagaggactgccattattaaaaacagattttggaagctgccttctgcagcctccttcctgccccaatggaatgtcagctgaaaatggcctggagaagagtggtttttcacaacatcaaaacaaaagtccaccaaaggtcaaggcagaagatggcatgcagtgtttacaattaaaggagaccctggccacccaggaacccacagataaccaagtcagacttcgtaagagaaaggtaagacatatgcacagattctctggcttttgaaattttgtaaatatccttggatttatcagttatcattttgcttggattaaaaagatatgaagatggttcttttgccctgttatgcagatgtgtaattcaacgactacccacttggtcaaaccatcaaaatatgtaaaaattaaagaataataatctatcc

SEQ ID NO: 295589 - DNA, 7447 bp, Homo sapiens
gggcctggttgtggaggccccttttgcaaaacctcagtctgaatttagtagacagaagtcactaggaatgccttgacaggatcctgccttagctaaggctccctccagctgcagagggtgtttttgttagactcacacactgcgtgaaactgctcagaatagagccatgatctcaaccacgaaatgggaacttagattttggagaaactaacggggacggacttctttcctagcctgagtgttgagcagtgtcatgccttggcgtttcagctcctcgttgtctaggtggtgaaatgacagaactcattcgcttctttgattggtgattttgaaataatctttcatcaagttccatctcctttaccctcatatggaatatatctctctgtctgttgttaaactatgatgacatgtctgtagctatcagaaagagaagctgggaagaacatgtgacccactggatgggacagccttttaattctgatgatcgtaacacagcatgtcatcatggactagtagctgacagcttgcaggcaagtatggaaaaagatgcaactctaaatgtggaccgcaaagagaagtgtgtttcactacctgactgctgtcatggatcagagctgagagattttcctgggaggccaatgggtcatctttcaaaggatgtggacgaaaatgacagccatgaaggtgaagatcagtttctttctctggaagccagcacagaaacactagtgcatgtttctgatgaggataacaatgctgatttatgccttacagatgataaacaggttttaaatacccaagggcagaaaacatcaggccaacatatgatccaaggagcaggctccttagaaaaggcactgcccatcatacaaagtaaccaagtttcttctaactcctggggaatagctggtgaaactgaattagcactggtaaaagaaagtggggagagaaaagttactgactctataagtaaaagcctggagctttgcaatgaaataagcttaagtgaaataaaagatgcacccaaagtaaatgcagtggatactttgaacgtgaaagatattgcacctgagaaacaattgcttaactctgctgtaattgctcagcaacgaaggaaacctgacccccctaaagatgaaaatgaaagaagcacctgcaatgtagtacacgatgagttcttggatattccttgcacaaacagaggactgccattattaaaaacagattttggaagctgccttctgcagcctccttcctgccccaatggaatgtcagctgaaaatggcctggagaagagtggtttttcacaacatcaaaacaaaagtccaccaaaggtcaaggcagaagatggcatgcagtgtttacaattaaaggagaccctggccacccaggaacccacagataaccaagtcagacttcgtaagagaaaggaaataagagaagatcgagatagggcgcggctggactccatggtgctgctgattatgaaactggaccagcttgatcaggacatagaaaatgccctcagcaccagctcctctccatcaggcacaccaacaaacctgcggcggcacgttcctgatctggaatcaggatctgaaagtggagcagataccatttcagtaaatcagacacgagtaaatttgtcttctgacactgagtccacggacctcccatcttccactccagtagccaattctggaaccaaacccaagactacggctattcaaggtatttcagagaaggaaaaggctgaaattgaagccaaggaagcttgtgattggctacgggcaactggtttcccccagtatgcacagctttatgaagatttcctgttccccatcgatatttccttggtcaagagagagcatgattttttggacagagatgccattgaggctctatgcaggcgtctaaatactttaaacaaatgtgcggtgatgaagctagaaattagtcctcatcggaaacgaagtgacgattcagacgaggatgagccttgtgccatcagtggcaaatggactttccaaagggacagcaagaggtggtcccggcttgaagagtttgatgtcttttctccaaaacaagacctggtccctgggtccccagacgactcccacccgaaggacggccccagccccggaggcacgctgatggacctcagcgagcgccaggaggtgtcttccgtccgcagcctcagcagcactggcagcctccccagccacgcgccccccagcgaggatgctgccaccccccggactaactccgtcatcagcgtttgctcctccagcaacttggcaggcaatgacgactctttcggcagcctgccctctcccaaggaactgtccagcttcagcttcagcatgaaaggccacgaaaaaactgccaagtccaagacgcgcagtctgctgaaacggatggagagcctgaagctcaagagctcccatcacagcaagcacaaagcgccctcaaagctggggttgatcatcagcgggcccatcttgcaagaggggatggatgaggagaagctgaagcagctcaactgcgtggagatctccgccctcaatggcaaccgcatcaacgtccccatggtacgaaagaggagcgtttccaactccacgcagaccagcagcagcagcagccagtcggagaccagcagcgcggtcagcacgcccagccctgttacgaggacccggagcctcagtgcgtgcaacaagcgggtgggcatgtacttagagggcttcgatcctttcaatcagtcaacatttaacaacgtggtggagcagaactttaagaaccgcgagagctacccagaggacacggtgttctacatccctgaagatcacaagcctggcactttccccaaagctctcaccaatggcagtttctccccctcggggaataacggctctgtgaactggaggacgggaagcttccacggccctggccacatcagcctcaggagggaaaacagtagcgacagccccaaggaactgaagagacgcaattcttccagctccatgagcagccgcctgagcatctacgacaacgtgccgggctccatcctctactccagttcaggggacctggcggatctggagaacgaggacatcttccccgagctggacgacatcctctaccacgtgaaggggatgcagcggatagtcaatcagtggtcggagaagttttctgatgagggagattcggactcagccctggactcggtctctccctgcccgtcctctccaaaacagatacacctggatgtggacaacgaccgaaccacacccagcgacctggacagcacaggcaactccctgaatgaaccggaagagccctccgagatcccggaaagaagggattctggggttggggcttccctaaccaggtccaacaggcaccgactgagatggcacagtttccagagctcacatcggccaagcctcaactctgtatcactacagattaactgccagtctgtggcccagatgaacctgctgcagaaatactcactcctaaagctaacggccctgctggagaaatacacaccttctaacaagcatggttttagctgggccgtgcccaagttcatgaagaggatcaaggttccagactacaaggaccggagtgtgtttggggtcccactgacggtcaacgtgcagcgcacaggacaaccgttgcctcagagcatccagcaggccatgcgatacctccggaaccattgtttggatcaggttgggctcttcagaaaatcgggggtcaagtcccggattcaggctctgcgccagatgaatgaaggtgccatagactgtgtcaactacgaaggacagtctgcttatgacgtggcagacatgctgaagcagtattttcgagatcttcctgagccactaatgacgaacaaactctcggaaacctttctacagatctaccaatatgtgcccaaggaccagcgcctgcaggccatcaaggctgccatcatgctgctgcctgacgagaaccgggaggttctgcagaccctgctttatttcctgagcgatgtcacagcagccgtaaaagaaaaccagatgaccccaaccaacctggccgtgtgcttagcgccttccctcttccatctcaacaccctgaagagagagaattcctctcccagggtaatgcaaagaaaacaaagtttgggcaaaccagatcagaaagatttgaatgaaaacctagctgccactcaagggctggcccatatgatcgccgagtgcaagaagcttttccaggttcccgaggaaatgagccgatgtcgtaattcctataccgaacaagagctgaagcccctcactctggaagcactcgggcacctgggtaatgatgactcagctgactaccaacacttcctccaggactgtgtggatggcctgtttaaagaagtcaaagagaagtttaaaggctgggtcagctactccacttcggagcaggctgagctgtcctataagaaggtgagcgaaggaccccctctgaggctttggaggtcagtcattgaagtccctgctgtgccagaggaaatcttaaagcgcctacttaaagaacagcacctctgggatgtagacctgttggattcaaaagtgatcgaaattctggacagccaaactgaaatttaccagtatgtccaaaacagtatggcacctcatcctgctcgagactacgttgttttaagaacctggaggactaatttacccaaaggagcctgtgcccttttactaacctctgtggatcacgatcgcgcacctgtggtgggtgtgagggttaatgtgctcttgtccaggtatttgattgaaccctgtgggccaggaaaatccaaactcacctacatgtgcagagttgacttaaggggccacatgccagaatggtacacaaaatcttttggacatttgtgtgcagctgaagttgtaaagatccgggattccttcagtaaccagaacactgaaaccaaagacaccaaatctaggtgatcactgaagcaacgcaaccgcttccaccaccatggtgtttgtttctagaacttttgccagtccttgaagaatgggttctgtgtctaatcctgaaacaaagaaaactacaagctggagtgtaggaattgactatagcaatttgatacatttttaaagctgcttcctgtttgttgagggtctgtattcatagaccttgactggaatatgtaagactgtgcaaaaaaaaaaaaaaaatttatgtgtattcttattcagattgcttctgagaagcaaaactctttaaatacattatggaagataatgaagatacttcattctcttgtgatatcagtgtatgcgtacctgtgtcgctttatttgcagtgtgttgagggactggtgtatccactggaatagttggtactcttggatgtgttttctcaccaagatgagcaaagaaaggtttgcacagaggagtgtgaatgtgtgtttgttgctggctgaatggcaatagatgtctaaggtggattcagtgtctggcacactgagacacctccaagaaggagattgatgcatcaggttcagtttaacctggaatatctgactacccctgaatccacccagaaagggggcccaacacccttgtccatttatgggtattttttttcgaagttattaagcatattccttttccacgaacctcttctgtactttgattgtaataggttggctcttacacccattccaaatgcagtttatttttagacccgattgcaaatagtgatgtagttttaaccagtatggattagttcagggatgaactgctccctccagccttactggctctgatccacagggttttgttttgttttgttttgttttttgtttaagtcgagatataaaaactgaacacgataacacttactcttaaatcaagcatcaacactttttccctgttagaattctttgcatttttgtgtttgtaacagaaacgccttaagacactatgtttgggaatataggaaactatgtgtgtcccaaggaaatccctgtaaatttaactcacctacaaaaggctttttccccgcctttggttgttaacggcattcctgaaagccacatgtgtttattcattgggcttgttcttatcagcaaataggttttctggttttatgactttttgtcttattttatttttcctacatttctttttttttttttttcctttagaatgccctggaaatatatttaagtggtaatgaaaaatagtaatcatagtaaaacgcaacaagaagaaaaccaacccaaaccagtgaagttttttagaacctttagaagggtggtctttattcaggttttactgtaatggtaaggattgactcaagagacagtattagtaaatttattgtgtatggatcaaaagtgaataatgtatgaatgagagctgtaagaaggatttttattttgttataatttagttaccattttcagtgttatttcaaaggttctttgaagaattttggggcagggcatcagattagagttttaaaatttgagtattttggatatcagtgttcctcatgaagatatacatggatattcaattttgatggcttccagatttgtaagattgtatgttgtatataccattctattaagaaacatgtccactgtgctttcaaacatagataaagcatgataaagattattatttaagatatacttgtatttatacctcagatattcttttgggttttgtacctcaaggcttttttcttcttattgtaaatacactttacgtgaatacagtctaagtgaagaaaataaataaaaggaagaggtttataacttgctctatatctgtacagattataatcaataagtgcactattattaaatgtttaaagtaagggaaaagtctgggctgccttccttaatattgcatctcactcccacccttaaaaccacagattgcaaagcatagcattttagcatcaactacaatcaaaagagcgatttgctgaaggaaaaatcggactgcaaatcattccaaggccaaactgcaactgagccacccactcccaaacaggaaaccctggtgaaggttcaggaagcacggagattctctccaacaaaggtccagttaggaaacgacgctgagaggatgacgacaacgtgcaacagcagaaagatgcttgcaagcagagtcagggtcaccagtgaatgccacaaaagttctctttcccactgtttaatttgacaagagaagaatttgaaggatatgaacattttcaagaactctgctgaggtcacttagagcgccatcacaacttatttgtgtgactaattgcctagattgtaagctctttgagggcagggcttgtctcttacacatctttataatcccctgcagcggctttcagtattttgtacttgtaggcacctaataaatttattatttgctatactgaa

SEQ ID NO: 295590 - DNA, 1961 bp, Homo sapiens
gggcctggttgtggaggccccttttgcaaaacctcagtctgaatttagtagacagaagtcactaggaatgccttgacaggatcctgccttagctaaggctccctccagctgcagagggtgtttttgttagactcacacactgcgtgaaactgctcagaatagagccatgatctcaaccacgaaatgggaacttagattttggagaaactaacggggacggacttctttcctagcctgagtgttgagcagtgtcatgccttggcgtttcagctcctcgttgtctaggtggtgaaatgacagaactcattcgcttctttgattggtgattttgaaataatctttcatcaagttccatctcctttaccctcatatggaatatatctctctgtctgttgttaaactatgatgacatgtctgtagctatcagaaagagaagctgggaagaacatgtgacccactggatgggacagccttttaattctgatgatcgtaacacagcatgtcatcatggactagtagctgacagcttgcaggcaagtatggaaaaagatgcaactctaaatgtggaccgcaaagagaagtgtgtttcactacctgactgctgtcatggatcagagctgagagattttcctgggaggccaatgggtcatctttcaaaggatgtggacgaaaatgacagccatgaaggtgaagatcagtttctttctctggaagccagcacagaaacactagtgcatgtttctgatgaggataacaatgctgatttatgccttacagatgataaacaggttttaaatacccaagggcagaaaacatcaggccaacatatgatccaaggagcaggctccttagaaaaggcactgcccatcatacaaagtaaccaagtttcttctaactcctggggaatagctggtgaaactgaattagcactggtaaaagaaagtggggagagaaaagttactgactctataagtaaaagcctggagctttgcaatgaaataagcttaagtgaaataaaagatgcacccaaagtaaatgcagtggatactttgaacgtgaaagatattgcacctgagaaacaattgcttaactctgctgtaattgctcagcaacgaaggaaacctgacccccctaaagatgaaaatgaaagaagcacctgcaatgtagtacacgatgagttcttggatattccttgcacaaacagaggactgccattattaaaaacagattttggaagctgccttctgcagcctccttcctgccccaatggaatgtcagctgaaaatggcctggagaagagtggtttttcacaacatcaaaacaaaagtccaccaaaggtcaaggcagaagatggcatgcagtgtttacaattaaaggagaccctggccacccaggaacccacagataaccaagtcagacttcgtaagagaaaggaaataagagaagatcgagatagggcgcggctggactccatggtgctgctgattatgaaactggaccagcttgatcaggacatagaaaatgccctcagcaccagctcctctccatcaggcacaccaacaaacctgcggcggcacgttcctgatctggaatcaggatctgaaagtggagcagataccatttcagtaaatcagacacgagtaaatttgtcttctgacactgagtccacggacctcccatcttccactccagtagccaattctggaaccaaacccaagactacggctattcaaggtatttcagagaaggaaaaggctgcagcggtaaaatcagtaaagttggaagtggatgaagataagagcacaaagggatccaatttttccaactcggaagtggcaattggtttgtctccttacacctttccccagaagaggcttttccatgttgctggagaagaaaacatcacctaggccggtgtgtgcctggcagaacactgcactccaatttcctcgggcagccac

SEQ ID NO: 295591 - DNA, 6050 bp, Homo sapiens
tatgggctcgagcggccgcccgggcaggtgcccgagcgagggcgcttcgctcccagccaggacatggccgcacctctccgcatcaggagcgccggctcacggacttctcgcccaactccctgagcgctccctcgtttcgatctttagaaaaccccgctttctttctggggccgtgacgaggggcagggagcggcgagcaaggatgcgttgaggaccgcgagggcgcgcgtctcgggtgccgccgtgggtcccgacgcggaagccgagccgcctccgcctgcctcgacttccccacagcgcttccgccgccgcctgccgtgcttgatgtgcagaaagaagccggacaccatgatcctaacacaaattgaagccaaggaagcttgtgattggctacgggcaactggtttcccccagtatgcacagctttatgaagatttcctgttccccatcgatatttccttggtcaagagagagcatgattttttggacagagatgccattgaggctctatgcaggcgtctaaatactttaaacaaatgtgcggtgatgaagctagaaattagtcctcatcggaaacgaagtgacgattcagacgaggatgagccttgtgccatcagtggcaaatggactttccaaagggacagcaagaggtggtcccggcttgaagagtttgatgtcttttctccaaaacaagacctggtccctgggtccccagacgactcccacccgaaggacggccccagccccggaggcacgctgatggacctcagcgagcgccaggaggtgtcttccgtccgcagcctcagcagcactggcagcctccccagccacgcgccccccagcgaggatgctgccaccccccggactaactccgtcatcagcgtttgctcctccagcaacttggcaggcaatgacgactctttcggcagcctgccctctcccaaggaactgtccagcttcagcttcagcatgaaaggccacgaaaaaactgccaagtccaagacgcgcagtctgctgaaacggatggagagcctgaagctcaagagctcccatcacagcaagcacaaagcgccctcaaagctggggttgatcatcagcgggcccatcttgcaagaggggatggatgaggagaagctgaagcagctcaactgcgtggagatctccgccctcaatggcaaccgcatcaacgtccccatggtacgaaagaggagcgtttccaactccacgcagaccagcagcagcagcagccagtcggagaccagcagcgcggtcagcacgcccagccctgttacgaggacccggagcctcagtgcgtgcaacaagcgggtgggcatgtacttagagggcttcgatcctttcaatcagtcaacatttaacaacgtggtggagcagaactttaagaaccgcgagagctacccagaggacacggtgttctacatccctgaagatcacaagcctggcactttccccaaagctctcaccaatggcagtttctccccctcggggaataacggctctgtgaactggaggacgggaagcttccacggccctggccacatcagcctcaggagggaaaacagtagcgacagccccaaggaactgaagagacgcaattcttccagctccatgagcagccgcctgagcatctacgacaacgtgccgggctccatcctctactccagttcaggggacctggcggatctggagaacgaggacatcttccccgagctggacgacatcctctaccacgtgaaggggatgcagcggatagtcaatcagtggtcggagaagttttctgatgagggagattcggactcagccctggactcggtctctccctgcccgtcctctccaaaacagatacacctggatgtggacaacgaccgaaccacacccagcgacctggacagcacaggcaactccctgaatgaaccggaagagccctccgagatcccggaaagaagggattctggggttggggcttccctaaccaggtccaacaggcaccgactgagatggcacagtttccagagctcacatcggccaagcctcaactctgtatcactacagattaactgccagtctgtggcccagatgaacctgctgcagaaatactcactcctaaagctaacggccctgctggagaaatacacaccttctaacaagcatggttttagctgggccgtgcccaagttcatgaagaggatcaaggttccagactacaaggaccggagtgtgtttggggtcccactgacggtcaacgtgcagcgcacaggacaaccgttgcctcagagcatccagcaggccatgcgatacctccggaaccattgtttggatcaggttgggctcttcagaaaatcgggggtcaagtcccggattcaggctctgcgccagatgaatgaaggtgccatagactgtgtcaactacgaaggacagtctgcttatgacgtggcagacatgctgaagcagtattttcgagatcttcctgagccactaatgacgaacaaactctcggaaacctttctacagatctaccaatatgtgcccaaggaccagcgcctgcaggccatcaaggctgccatcatgctgctgcctgacgagaaccgggaggttctgcagaccctgctttatttcctgagcgatgtcacagcagccgtaaaagaaaaccagatgaccccaaccaacctggccgtgtgcttagcgccttccctcttccatctcaacaccctgaagagagagaattcctctcccagggtaatgcaaagaaaacaaagtttgggcaaaccagatcagaaagatttgaatgaaaacctagctgccactcaagggctggcccatatgatcgccgagtgcaagaagcttttccaggttcccgaggaaatgagccgatgtcgtaattcctataccgaacaagagctgaagcccctcactctggaagcactcgggcacctgggtaatgatgactcagctgactaccaacacttcctccaggactgtgtggatggcctgtttaaagaagtcaaagagaagtttaaaggctgggtcagctactccacttcggagcaggctgagctgtcctataagaaggtgagcgaaggaccccctctgaggctttggaggtcagtcattgaagtccctgctgtgccagaggaaatcttaaagcgcctacttaaagaacagcacctctgggatgtagacctgttggattcaaaagtgatcgaaattctggacagccaaactgaaatttaccagtatgtccaaaacagtatggcacctcatcctgctcgagactacgttgttttaagaacctggaggactaatttacccaaaggagcctgtgcccttttactaacctctgtggatcacgatcgcgcacctgtggtgggtgtgagggttaatgtgctcttgtccaggtatttgattgaaccctgtgggccaggaaaatccaaactcacctacatgtgcagagttgacttaaggggccacatgccagaatggtacacaaaatcttttggacatttgtgtgcagctgaagttgtaaagatccgggattccttcagtaaccagaacactgaaaccaaagacaccaaatctaggtgatcactgaagcaacgcaaccgcttccaccaccatggtgtttgtttctagaacttttgccagtccttgaagaatgggttctgtgtctaatcctgaaacaaagaaaactacaagctggagtgtaggaattgactatagcaatttgatacatttttaaagctgcttcctgtttgttgagggtctgtattcatagaccttgactggaatatgtaagactgtgcaaaaaaaaaaaaaaaatttatgtgtattcttattcagattgcttctgagaagcaaaactctttaaatacattatggaagataatgaagatacttcattctcttgtgatatcagtgtatgcgtacctgtgtcgctttatttgcagtgtgttgagggactggtgtatccactggaatagttggtactcttggatgtgttttctcaccaagatgagcaaagaaaggtttgcacagaggagtgtgaatgtgtgtttgttgctggctgaatggcaatagatgtctaaggtggattcagtgtctggcacactgagacacctccaagaaggagattgatgcatcaggttcagtttaacctggaatatctgactacccctgaatccacccagaaagggggcccaacacccttgtccatttatgggtattttttttcgaagttattaagcatattccttttccacgaacctcttctgtactttgattgtaataggttggctcttacacccattccaaatgcagtttatttttagacccgattgcaaatagtgatgtagttttaaccagtatggattagttcagggatgaactgctccctccagccttactggctctgatccacagggttttgttttgttttgttttgttttttgtttaagtcgagatataaaaactgaacacgataacacttactcttaaatcaagcatcaacactttttccctgttagaattctttgcatttttgtgtttgtaacagaaacgccttaagacactatgtttgggaatataggaaactatgtgtgtcccaaggaaatccctgtaaatttaactcacctacaaaaggctttttccccgcctttggttgttaacggcattcctgaaagccacatgtgtttattcattgggcttgttcttatcagcaaataggttttctggttttatgactttttgtcttattttatttttcctacatttctttttttttttttttcctttagaatgccctggaaatatatttaagtggtaatgaaaaatagtaatcatagtaaaacgcaacaagaagaaaaccaacccaaaccagtgaagttttttagaacctttagaagggtggtctttattcaggttttactgtaatggtaaggattgactcaagagacagtattagtaaatttattgtgtatggatcaaaagtgaataatgtatgaatgagagctgtaagaaggatttttattttgttataatttagttaccattttcagtgttatttcaaaggttctttgaagaattttggggcagggcatcagattagagttttaaaatttgagtattttggatatcagtgttcctcatgaagatatacatggatattcaattttgatggcttccagatttgtaagattgtatgttgtatataccattctattaagaaacatgtccactgtgctttcaaacatagataaagcatgataaagattattatttaagatatacttgtatttatacctcagatattcttttgggttttgtacctcaaggcttttttcttcttattgtaaatacactttacgtgaatacagtctaagtgaagaaaataaataaaaggaagaggtttataacttgctctatatctgtacagattataatcaataagtgcactattattaaatgtttaaagtaagggaaaagtctgggctgccttccttaatattgcatctcactcccacccttaaaaccacagattgcaaagcatagcattttagcatcaactacaatcaaaagagcgatttgctgaaggaaaaatcggactgcaaatcattccaaggccaaactgcaactgagccacccactcccaaacaggaaaccctggtgaaggttcaggaagcacggagattctctccaacaaaggtccagttaggaaacgacgctgagaggatgacgacaacgtgcaacagcagaaagatgcttgcaagcagagtcagggtcaccagtgaatgccacaaaagttctctttcccactgtttaatttgacaagagaagaatttgaaggatatgaacattttcaagaactctgctgaggtcacttagagcgccatcacaacttatttgtgtgactaattgcctagattgtaagctctttgagggcagggcttgtctcttacacatctttataatcccctgcagcggctttcagtattttgtacttgtaggcacctaataaatttattatttgctatactgaa

SEQ ID NO: 295592 - DNA, 5995 bp, Homo sapiens
tatgggctcgagcggccgcccgggcaggtgcccgagcgagggcgcttcgctcccagccaggacatggccgcacctctccgcatcaggagcgccggctcacggacttctcgcccaactccctgagcgctccctcgtttcgatctttagaaaaccccgctttctttctggggccgtgacgaggggcagggagcggcgagcaaggatgcgttgaggaccgcgagggcgcgcgtctcgggtgccgccgtgggtcccgacgcggaagccgagccgcctccgcctgcctcgacttccccacagcgcttccgccgccgcctgccgtgcttgatgtgcagaaagaagccggacaccatgatcctaacacaaattgaagccaaggaagcttgtgattggctacgggcaactggtttcccccagtatgcacagctttatgaagatttcctgttccccatcgatatttccttggtcaagagagagcatgattttttggacagagatgccattgaggctctatgcaggcgtctaaatactttaaacaaatgtgcggtgatgaagctagaaattagtcctcatcggaaacgaagtgacgattcagacgaggatgagccttgtgccatcagtggcaaatggactttccaaagggacagcaagaggtggtcccggcttgaagagtttgatgtcttttctccaaaacaagacctggtccctgggtccccagacgactcccacccgaaggacggccccagccccggaggcacgctgatggacctcagcgagcgccaggaggtgtcttccgtccgcagcctcagcagcactggcagcctccccagccacgcgccccccagcgaggatgctgccaccccccggactaactccgtcatcagcgtttgctcctccagcaacttggcaggcaatgacgactctttcggcagcctgccctctcccaaggaactgtccagcttcagcttcagcatgaaaggccacgaaaaaactgccaagtccaagacgcgcagtctgctgaaacggatggagagcctgaagctcaagagctcccatcacagcaagcacaaagcgccctcaaagctggggttgatcatcagcgggcccatcttgcaagaggggatggatgaggagaagctgaagcagctcaactgcgtggagatctccgccctcaatggcaaccgcatcaacgtccccatggtacgaaagaggagcgtttccaactccacgcagaccagcagcagcagcagccagtcggagaccagcagcgcggtcagcacgcccagccctgttacgaggacccggagcctcagtgcgtgcaacaagcgggtgggcatgtacttagagggcttcgatcctttcaatcagtcaacatttaacaacgtggtggagcagaactttaagaaccgcgagagctacccagaggacacggtgttctacatccctgaagatcacaagcctggcactttccccaaagctctcaccaatggcagtttctccccctcggggaataacggctctgtgaactggaggacgggaagcttccacggccctggccacatcagcctcaggagggaaaacagtagcgacagccccaaggaactgaagagacgcaattcttccagctccatgagcagccgcctgagcatctacgacaacgtgccgggctccatcctctactccagttcaggggacctggcggatctggagaacgaggacatcttccccgagctggacgacatcctctaccacgtgaaggggatgcagcggatagtcaatcagtggtcggagaagttttctgatgagggagattcggactcagccctggactcggtctctccctgcccgtcctctccaaaacagatacacctggatgtggacaacgaccgaaccacacccagcgacctggacagcacaggcaactccctgaatgaaccggaagagccctccgagatcccggaaagaagggattctggggttggggcttccctaaccaggtccaacaggcaccgactgagatggcacagtttccagagctcacatcggccaagcctcaactctgtatcactacagattaactgccagtctgtggcccagatgaacctgctgcagaaatactcactcctaaagctaacggccctgctggagaaatacacaccttctaacaagcatggttttagctgggccgtgcccaagttcatgaagaggatcaaggttccagactacaaggaccggagtgtgtttggggtcccactgacggtcaacgtgcagcgcacaggacaaccgttgcctcagagcatccagcaggccatgcgatacctccggaaccattgtttggatcaggttgggctcttcagaaaatcgggggtcaagtcccggattcaggctctgcgccagatgaatgaaggtgccatagactgtgtcaactacgaaggacagtctgcttatgacgtggcagacatgctgaagcagtattttcgagatcttcctgagccactaatgacgaacaaactctcggaaacctttctacagatctaccaatatgtgcccaaggaccagcgcctgcaggccatcaaggctgccatcatgctgctgcctgacgagaaccgggaggttctgcagaccctgctttatttcctgagcgatgtcacagcagccgtaaaagaaaaccagatgaccccaaccaacctggccgtgtgcttagcgccttccctcttccatctcaacaccctgaagagagagaattcctctcccagggtaatgcaaagaaaacaaagtttgggcaaaccagatcagaaagatttgaatgaaaacctagctgccactcaagggctggcccatatgatcgccgagtgcaagaagcttttccaggttcccgaggaaatgagccgatgtcgtaattcctataccgaacaagagctgaagcccctcactctggaagcactcgggcacctgggtaatgatgactcagctgactaccaacacttcctccaggactgtgtggatggcctgtttaaagaagtcaaagagaagtttaaaggctgggtcagctactccacttcggagcaggctgagctgtcctataagaaggtgagcgaaggaccccctctgaggctttggaggtcagtcattgaagtccctgctgtgccagaggaaatcttaaagcgcctacttaaagaacagcacctctgggatgtagacctgttggattcaaaagtgatcgaaattctggacagccaaactgaaatttaccagtatgtccaaaacagtatggcacctcatcctgctcgagactacgttgttttaagaacctggaggactaatttacccaaaggagcctgtgcccttttactaacctctgtggatcacgatcgcgcacctgtggtgggtgtgagggttaatgtgctcttgtccaggtatttgattgaaccctgtgggccaggaaaatccaaactcacctacatgtgcagagttgacttaaggggccacatgccagaatggtacacaaaatcttttggacatttgtgtgcagctgaagttgtaaagatccgggattccttcagtaaccagaacactgaaaccaaagacaccaaatctaggtgatcactgaagcaacgcaaccgcttccaccaccatggtgtttgtttctagaacttttgccagtccttgaagaatgggttctgtgtctaatcctgaaacaaagaaaactacaagctggagtgtaggaattgactatagcaatttgatacatttttaaagctgcttcctgtttgttgagggtctgtattcatagaccttgactggaatatgtaagactgtgcaaaaaaaaaaaaaaaatttatgtgtattcttattcagattgcttctgagaagcaaaactctttaaatacattatggaagataatgaagatacttcattctcttgtgatatcagtgtatgcgtacctgtgtcgctttatttgcagtgtgttgagggactggtgtatccactggaatagttggtactcttggatgtgttttctcaccaagatgagcaaagaaaggtttgcacagaggagtgtgaatgtgtgtttgttgctggctgaatggcaatagatgtctaaggtggattcagtgtctggcacactgagacacctccaagaaggagattgatgcatcaggttcagtttaacctggaatatctgactacccctgaatccacccagaaagggggcccaacacccttgtccatttatgggtattttttttcgaagttattaagcatattccttttccacgaacctcttctgtactttgattgtaataggttggctcttacacccattccaaatgcagtttatttttagacccgattgcaaatagtgatgtagttttaaccagtatggattagttcagggatgaactgctccctccagccttactggctctgatccacagggttttgttttgttttgttttgttttttgtttaagtcgagatataaaaactgaacacgataacacttactcttaaatcaagcatcaacactttttccctgttagaattctttgcatttttgtgtttgtaacagaaacgccttaagacactatgtttgggaatataggaaactatgtgtgtcccaaggaaatccctgtaaatttaactcacctactttattcattgggcttgttcttatcagcaaataggttttctggttttatgactttttgtcttattttatttttcctacatttctttttttttttttttcctttagaatgccctggaaatatatttaagtggtaatgaaaaatagtaatcatagtaaaacgcaacaagaagaaaaccaacccaaaccagtgaagttttttagaacctttagaagggtggtctttattcaggttttactgtaatggtaaggattgactcaagagacagtattagtaaatttattgtgtatggatcaaaagtgaataatgtatgaatgagagctgtaagaaggatttttattttgttataatttagttaccattttcagtgttatttcaaaggttctttgaagaattttggggcagggcatcagattagagttttaaaatttgagtattttggatatcagtgttcctcatgaagatatacatggatattcaattttgatggcttccagatttgtaagattgtatgttgtatataccattctattaagaaacatgtccactgtgctttcaaacatagataaagcatgataaagattattatttaagatatacttgtatttatacctcagatattcttttgggttttgtacctcaaggcttttttcttcttattgtaaatacactttacgtgaatacagtctaagtgaagaaaataaataaaaggaagaggtttataacttgctctatatctgtacagattataatcaataagtgcactattattaaatgtttaaagtaagggaaaagtctgggctgccttccttaatattgcatctcactcccacccttaaaaccacagattgcaaagcatagcattttagcatcaactacaatcaaaagagcgatttgctgaaggaaaaatcggactgcaaatcattccaaggccaaactgcaactgagccacccactcccaaacaggaaaccctggtgaaggttcaggaagcacggagattctctccaacaaaggtccagttaggaaacgacgctgagaggatgacgacaacgtgcaacagcagaaagatgcttgcaagcagagtcagggtcaccagtgaatgccacaaaagttctctttcccactgtttaatttgacaagagaagaatttgaaggatatgaacattttcaagaactctgctgaggtcacttagagcgccatcacaacttatttgtgtgactaattgcctagattgtaagctctttgagggcagggcttgtctcttacacatctttataatcccctgcagcggctttcagtattttgtacttgtaggcacctaataaatttattatttgctatactgaa

SEQ ID NO: 295593 - DNA, 5976 bp, Homo sapiens
  misc_feature (162)..(162): n is a, c, g, or t
gcagttggcgcttcccggggccgcagtgccagccgcaatgccggcctcctgaaggcaggcgacagcctgcggccgggagcacagcgcggggcggagtaccgaggcatggtcgcggcgcccgggctgcgctgaaggcgtctgcgagcggatgggggaccccanggcccacgtgatggcgcgccccctgcgagcccctctccggaggtcctttagcgatcacatcagggactccacggccagagccctggatgtcatttggaaaaacactagagacagacggctggcagaaattgaagccaaggaagcttgtgattggctacgggcaactggtttcccccagtatgcacagctttatgaagatttcctgttccccatcgatatttccttggtcaagagagagcatgattttttggacagagatgccattgaggctctatgcaggcgtctaaatactttaaacaaatgtgcggtgatgaagctagaaattagtcctcatcggaaacgaagtgacgattcagacgaggatgagccttgtgccatcagtggcaaatggactttccaaagggacagcaagaggtggtcccggcttgaagagtttgatgtcttttctccaaaacaagacctggtccctgggtccccagacgactcccacccgaaggacggccccagccccggaggcacgctgatggacctcagcgagcgccaggaggtgtcttccgtccgcagcctcagcagcactggcagcctccccagccacgcgccccccagcgaggatgctgccaccccccggactaactccgtcatcagcgtttgctcctccagcaacttggcaggcaatgacgactctttcggcagcctgccctctcccaaggaactgtccagcttcagcttcagcatgaaaggccacgaaaaaactgccaagtccaagacgcgcagtctgctgaaacggatggagagcctgaagctcaagagctcccatcacagcaagcacaaagcgccctcaaagctggggttgatcatcagcgggcccatcttgcaagaggggatggatgaggagaagctgaagcagctcaactgcgtggagatctccgccctcaatggcaaccgcatcaacgtccccatggtacgaaagaggagcgtttccaactccacgcagaccagcagcagcagcagccagtcggagaccagcagcgcggtcagcacgcccagccctgttacgaggacccggagcctcagtgcgtgcaacaagcgggtgggcatgtacttagagggcttcgatcctttcaatcagtcaacatttaacaacgtggtggagcagaactttaagaaccgcgagagctacccagaggacacggtgttctacatccctgaagatcacaagcctggcactttccccaaagctctcaccaatggcagtttctccccctcggggaataacggctctgtgaactggaggacgggaagcttccacggccctggccacatcagcctcaggagggaaaacagtagcgacagccccaaggaactgaagagacgcaattcttccagctccatgagcagccgcctgagcatctacgacaacgtgccgggctccatcctctactccagttcaggggacctggcggatctggagaacgaggacatcttccccgagctggacgacatcctctaccacgtgaaggggatgcagcggatagtcaatcagtggtcggagaagttttctgatgagggagattcggactcagccctggactcggtctctccctgcccgtcctctccaaaacagatacacctggatgtggacaacgaccgaaccacacccagcgacctggacagcacaggcaactccctgaatgaaccggaagagccctccgagatcccggaaagaagggattctggggttggggcttccctaaccaggtccaacaggcaccgactgagatggcacagtttccagagctcacatcggccaagcctcaactctgtatcactacagattaactgccagtctgtggcccagatgaacctgctgcagaaatactcactcctaaagctaacggccctgctggagaaatacacaccttctaacaagcatggttttagctgggccgtgcccaagttcatgaagaggatcaaggttccagactacaaggaccggagtgtgtttggggtcccactgacggtcaacgtgcagcgcacaggacaaccgttgcctcagagcatccagcaggccatgcgatacctccggaaccattgtttggatcaggttgggctcttcagaaaatcgggggtcaagtcccggattcaggctctgcgccagatgaatgaaggtgccatagactgtgtcaactacgaaggacagtctgcttatgacgtggcagacatgctgaagcagtattttcgagatcttcctgagccactaatgacgaacaaactctcggaaacctttctacagatctaccaatatgtgcccaaggaccagcgcctgcaggccatcaaggctgccatcatgctgctgcctgacgagaaccgggaggttctgcagaccctgctttatttcctgagcgatgtcacagcagccgtaaaagaaaaccagatgaccccaaccaacctggccgtgtgcttagcgccttccctcttccatctcaacaccctgaagagagagaattcctctcccagggtaatgcaaagaaaacaaagtttgggcaaaccagatcagaaagatttgaatgaaaacctagctgccactcaagggctggcccatatgatcgccgagtgcaagaagcttttccaggttcccgaggaaatgagccgatgtcgtaattcctataccgaacaagagctgaagcccctcactctggaagcactcgggcacctgggtaatgatgactcagctgactaccaacacttcctccaggactgtgtggatggcctgtttaaagaagtcaaagagaagtttaaaggctgggtcagctactccacttcggagcaggctgagctgtcctataagaaggtgagcgaaggaccccctctgaggctttggaggtcagtcattgaagtccctgctgtgccagaggaaatcttaaagcgcctacttaaagaacagcacctctgggatgtagacctgttggattcaaaagtgatcgaaattctggacagccaaactgaaatttaccagtatgtccaaaacagtatggcacctcatcctgctcgagactacgttgttttaagaacctggaggactaatttacccaaaggagcctgtgcccttttactaacctctgtggatcacgatcgcgcacctgtggtgggtgtgagggttaatgtgctcttgtccaggtatttgattgaaccctgtgggccaggaaaatccaaactcacctacatgtgcagagttgacttaaggggccacatgccagaatggtacacaaaatcttttggacatttgtgtgcagctgaagttgtaaagatccgggattccttcagtaaccagaacactgaaaccaaagacaccaaatctaggtgatcactgaagcaacgcaaccgcttccaccaccatggtgtttgtttctagaacttttgccagtccttgaagaatgggttctgtgtctaatcctgaaacaaagaaaactacaagctggagtgtaggaattgactatagcaatttgatacatttttaaagctgcttcctgtttgttgagggtctgtattcatagaccttgactggaatatgtaagactgtgcaaaaaaaaaaaaaaaatttatgtgtattcttattcagattgcttctgagaagcaaaactctttaaatacattatggaagataatgaagatacttcattctcttgtgatatcagtgtatgcgtacctgtgtcgctttatttgcagtgtgttgagggactggtgtatccactggaatagttggtactcttggatgtgttttctcaccaagatgagcaaagaaaggtttgcacagaggagtgtgaatgtgtgtttgttgctggctgaatggcaatagatgtctaaggtggattcagtgtctggcacactgagacacctccaagaaggagattgatgcatcaggttcagtttaacctggaatatctgactacccctgaatccacccagaaagggggcccaacacccttgtccatttatgggtattttttttcgaagttattaagcatattccttttccacgaacctcttctgtactttgattgtaataggttggctcttacacccattccaaatgcagtttatttttagacccgattgcaaatagtgatgtagttttaaccagtatggattagttcagggatgaactgctccctccagccttactggctctgatccacagggttttgttttgttttgttttgttttttgtttaagtcgagatataaaaactgaacacgataacacttactcttaaatcaagcatcaacactttttccctgttagaattctttgcatttttgtgtttgtaacagaaacgccttaagacactatgtttgggaatataggaaactatgtgtgtcccaaggaaatccctgtaaatttaactcacctacaaaaggctttttccccgcctttggttgttaacggcattcctgaaagccacatgtgtttattcattgggcttgttcttatcagcaaataggttttctggttttatgactttttgtcttattttatttttcctacatttctttttttttttttttcctttagaatgccctggaaatatatttaagtggtaatgaaaaatagtaatcatagtaaaacgcaacaagaagaaaaccaacccaaaccagtgaagttttttagaacctttagaagggtggtctttattcaggttttactgtaatggtaaggattgactcaagagacagtattagtaaatttattgtgtatggatcaaaagtgaataatgtatgaatgagagctgtaagaaggatttttattttgttataatttagttaccattttcagtgttatttcaaaggttctttgaagaattttggggcagggcatcagattagagttttaaaatttgagtattttggatatcagtgttcctcatgaagatatacatggatattcaattttgatggcttccagatttgtaagattgtatgttgtatataccattctattaagaaacatgtccactgtgctttcaaacatagataaagcatgataaagattattatttaagatatacttgtatttatacctcagatattcttttgggttttgtacctcaaggcttttttcttcttattgtaaatacactttacgtgaatacagtctaagtgaagaaaataaataaaaggaagaggtttataacttgctctatatctgtacagattataatcaataagtgcactattattaaatgtttaaagtaagggaaaagtctgggctgccttccttaatattgcatctcactcccacccttaaaaccacagattgcaaagcatagcattttagcatcaactacaatcaaaagagcgatttgctgaaggaaaaatcggactgcaaatcattccaaggccaaactgcaactgagccacccactcccaaacaggaaaccctggtgaaggttcaggaagcacggagattctctccaacaaaggtccagttaggaaacgacgctgagaggatgacgacaacgtgcaacagcagaaagatgcttgcaagcagagtcagggtcaccagtgaatgccacaaaagttctctttcccactgtttaatttgacaagagaagaatttgaaggatatgaacattttcaagaactctgctgaggtcacttagagcgccatcacaacttatttgtgtgactaattgcctagattgtaagctctttgagggcagggcttgtctcttacacatctttataatcccctgcagcggctttcagtattttgtacttgtaggcacctaataaatttattatttgctatactgaa

SEQ ID NO: 295594 - DNA, 6074 bp, Homo sapiens
tatgggctcgagcggccgcccgggcaggtgcccgagcgagggcgcttcgctcccagccaggacatggccgcacctctccgcatcaggagcgccggctcacggacttctcgcccaactccctgagcgctccctcgtttcgatctttagaaaaccccgctttctttctggggccgtgacgaggggcagggagcggcgagcaaggatgcgttgaggaccgcgagggcgcgcgtctcgggtgccgccgtgggtcccgacgcggaagccgagccgcctccgcctgcctcgacttccccacagcgcttccgccgccgcctgccgtgcttgatgtgcagaaagaagccggacaccatgatcctaacacaaattgaagccaaggaagcttgtgattggctacgggcaactggtttcccccagtatgcacagctttatgaagatttcctgttccccatcgatatttccttggtcaagagagagcatgattttttggacagagatgccattgaggctctatgcaggcgtctaaatactttaaacaaatgtgcggtgatgaagctagaaattagtcctcatcggaaacgaagtgacgattcagacgaggatgagccttgtgccatcagtggcaaatggactttccaaagggacagcaagaggtggtcccggcttgaagagtttgatgtcttttctccaaaacaagacctggtccctgggtccccagacgactcccacccgaaggacggccccagccccggaggcacgctgatggacctcagcgagcgccaggaggtgtcttccgtccgcagcctcagcagcactggcagcctccccagccacgcgccccccagcgaggatgctgccaccccccggactaactccgtcatcagcgtttgctcctccagcaacttggcaggcaatgacgactctttcggcagcctgccctctcccaaggaactgtccagcttcagcttcagcatgaaaggccacgaaaaaactgccaagtccaagacgcgcagtctgctgaaacggatggagagcctgaagctcaagagctcccatcacagcaagcacaaagcgccctcaaagctggggttgatcatcagcgggcccatcttgcaagaggggatggatgaggagaagctgaagcagctcaactgcgtggagatctccgccctcaatggcaaccgcatcaacgtccccatggtacgaaagaggagcgtttccaactccacgcagaccagcagcagcagcagccagtcggagaccagcagcgcggtcagcacgcccagccctgttacgaggacccggagcctcagtgcgtgcaacaagcgggtgggcatgtacttagagggcttcgatcctttcaatcagtcaacatttaacaacgtggtggagcagaactttaagaaccgcgagagctacccagaggacacggtgttctacatccctgaagatcacaagcctggcactttccccaaagctctcaccaatggcagtttctccccctcggggaataacggctctgtgaactggaggacgggaagcttccacggccctggccacatcagcctcaggagggaaaacagtagcgacagccccaaggaactgaagagacgcaattcttccagctccatgagcagccgcctgagcatctacgacaacgtgccgggctccatcctctactccagttcaggggacctggcggatctggagaacgaggacatcttccccgagctggacgacatcctctaccacgtgaaggggatgcagcggatagtcaatcagtggtcggagaagttttctgatgagggagattcggactcagccctggactcggtctctccctgcccgtcctctccaaaacagatacacctggatgtggacaacgaccgaaccacacccagcgacctggacagcacaggcaactccctgaatgaaccggaagagccctccgagatcccggaaagaagggattctggggttggggcttccctaaccaggtccaacaggcaccgactgagatggcacagtttccagagctcacatcggccaagcctcaactctgtatcactacagattaactgccagtctgtggcccagatgaacctgctgcagaaatactcactcctaaagctaacggccctgctggagaaatacacaccttctaacaagcatggttttagctgggccgtgcccaagttcatgaagaggatcaaggttccagactacaaggaccggagtgtgtttggggtcccactgacggtcaacgtgcagcgcacaggacaaccgttgcctcagagcatccagcaggccatgcgatacctccggaaccattgtttggatcaggttgggctcttcagaaaatcgggggtcaagtcccggattcaggctctgcgccagatgaatgaaggtgccatagactgtgtcaactacgaaggacagtctgcttatgacgtggcagacatgctgaagcagtattttcgagatcttcctgagccactaatgacgaacaaactctcggaaacctttctacagatctaccaatatgtgcccaaggaccagcgcctgcaggccatcaaggctgccatcatgctgctgcctgacgagaaccgggaggttctgcagaccctgctttatttcctgagcgatgtcacagcagccgtaaaagaaaaccagatgaccccaaccaacctggccgtgtgcttagcgccttccctcttccatctcaacaccctgaagagagagaattcctctcccagggtaatgcaaagaaaacaaagtttgggcaaaccagatcagaaagatttgaatgaaaacctagctgccactcaagggctggcccatatgatcgccgagtgcaagaagcttttccaggttcccgaggaaatgagccgatgtcgtaattcctataccgaacaagagctgaagcccctcactctggaagcactcgggcacctgggtaatgatgactcagctgactaccaacacttcctccaggactgtgtggatggcctgtttaaagaagtcaaagagaagtttaaaggctgggtcagctactccacttcggagcaggctgagctgtcctataagaaggtgagcgaaggaccccctctgaggctttggaggtcagtcattgaagtccctgctgtgccagaggaaatcttaaagcgcctacttaaagaacagcacctctgggatgtagacctgttggattcaaaagtgatcgaaattctggacagccaaactgaaatttaccagtatgtccaaaacagtatggcacctcatcctgctcgagactacgttgttttaagaacctggaggactaatttacccaaaggagcctgtgcccttttactaacctctgtggatcacgatcgcgcacctgtggtgggtgtgagggttaatgtgctcttgtccaggtatttgattgaaccctgtgggccaggaaaatccaaactcacctacatgtgcagagttgacttaaggggccacatgccagaatggtacacaaaatcttttggacatttgtgtgcagctgaagttgtaaagatccgggattccttcagtaaccagaacactgaaaccaaagacaccaaatctaggtgatcactgaagcaacgcaaccgcttccaccaccatggtgtttgtttctagaacttttgccagtccttgaagaatgggttctgtgtctaatcctgaaacaaagaaaactacaagctggagtgtaggaattgactatagcaatttgatacatttttaaagctgcttcctgtttgttgagggtctgtattcatagaccttgactggaatatgtaagactgtgcaaaaaaaaaaaaaaaatttatgtgtattcttattcagattgcttctgagaagcaaaactctttaaatacattatggaagataatgaagatacttcattctcttgtgatatcagtgtatgcgtacctgtgtcgctttatttgcagtgtgttgagggactggtgtatccactggaatagttggtactcttggatgtgttttctcaccaagatgagcaaagaaaggtttgcacagaggagtgtgaatgtgtgtttgttgctggctgaatggcaatagatgtctaaggtggattcagtgtctggcacactgagacacctccaagaaggagattgatgcatcaggttcagtttaacctggaatatctgactacccctgaatccacccagaaagggggcccaacacccttgtccatttatgggtattttttttcgaagttattaagcatattccttttccacgaacctcttctgtactttgattgtaataggttggctcttacacccattccaaatgcagtttatttttagacccgattgcaaatagtgatgtagttttaaccagtatggattagttcagggatgaactgctccctccagccttactggctctgatccacagggttttgttttgttttgttttgttttttgtttaagtcgagatataaaaactgaacacgataacacttactcttaaatcaagcatcaacactttttccctgttagaattctttgcatttttgtgtttgtaacagaaacgccttaagacactatgtttgggaatataggaaactatgtgtgtcccaaggaaatccctgtaaatttaactcacctacaaaaggctttttccccgcctttggttgttaacggcattcctgaaagccacatgtgtttattcattgggcttgttcttatcagcaaataggttttctggttttatgactttttgtcttattttatttttcctacatttctttttttttttttttcctttagaatgccctggaaatatatttaagtggtaatgaaaaatagtaatcatagtaaaacgcaacaagaagaaaaccaacccaaaccagtgaagttttttagaacctttagaagggtggtctttattcaggttttactgtaatggtaaggattgactcaagagacagtattagtaaatttattgtgtatggatcaaaagtgaataatgtatgaatgagagctgtaagaaggatttttattttgttataatttagttaccattttcagtgttatttcaaaggttctttgaagaattttggggcagggcatcagattagagttttaaaatttgagtattttggatatcagtgttcctcatgaagatatacatggatattcaattttgatggcttccagatttgtaagattgtatgttgtatataccattctattaagaaacatgtccactgtgctttcaaacatagataaagcatgataaagattattatttaagatatacttgtatttatacctcagatattcttttgggttttgtacctcaaggcttttttcttcttattgtaaatacactttacgtgaatacagtctaagtgaagaaaataaataaaaggaagaggtttataacttgctctatatctgtacagattataatcaataagtgcactattattaaatgtttaaagtaagggaaaagtctgggctgccttccttaatattgcatctcactcccacccttaaaaccacagattgcaaagcatagcattttagcatcaactacaatcaaaagagcgatttgctgaaggaaaaatcggactgcaaatcattccaaggccaaactgcaactgagccacccactcccaaacaggaaaccctggtgaaggttcaggaagcacggagattctctccaacaaaggtccagttaggaaacgacgctgagaggatgacgacaacgtgcaacagcagaaagatgcttgcaagcagagtcagggtcaccagtgaatgccacaaaagttctctttcccactgtttaatttgacaagagaagaatttgaaggatatgaacattttcaagaactctgctgaggtcacttagagcgccatcacaacttatttgtgtgactaattgcctagattgtaagctctttgagggcagggcttgtctcttacacatctttataatcccctgcagcggctttcagtattttgtacttgtaggcacctaataaatttattatttgctatactgaaaaatattattaaaattttaaaaaa

SEQ ID NO: 295595 - DNA, 5996 bp, Homo sapiens
tatgggctcgagcggccgcccgggcaggtgcccgagcgagggcgcttcgctcccagccaggacatggccgcacctctccgcatcaggagcgccggctcacggacttctcgcccaactccctgagcgctccctcgtttcgatctttagaaaaccccgctttctttctggggccgtgacgaggggcagggagcggcgagcaaggatgcgttgaggaccgcgagggcgcgcgtctcgggtgccgccgtgggtcccgacgcggaagccgagccgcctccgcctgcctcgacttccccacagcgcttccgccgccgcctgccgtgcttgatgtgcagaaagaagccggacaccatgatcctaacacaaattgaagccaaggaagcttgtgattggctacgggcaactggtttcccccagtatgcacagctttatgaagatttcctgttccccatcgatatttccttggtcaagagagagcatgattttttggacagagatgccattgaggctctatgcaggcgtctaaatactttaaacaaatgtgcggtgatgaagctagaaattagtcctcatcggaaacgaagtgacgattcagacgaggatgagccttgtgccatcagtggcaaatggactttccaaagggacagcaagaggtggtcccggcttgaagagtttgatgtcttttctccaaaacaagacctggtccctgggtccccagacgactcccacccgaaggacggccccagccccggaggcacgctgatggacctcagcgagcgccaggaggtgtcttccgtccgcagcctcagcagcactggcagcctccccagccacgcgccccccagcgaggatgctgccaccccccggactaactccgtcatcagcgtttgctcctccagcaacttggcaggcaatgacgactctttcggcagcctgccctctcccaaggaactgtccagcttcagcttcagcatgaaaggccacgaaaaaactgccaagtccaagacgcgcagtctgctgaaacggatggagagcctgaagctcaagagctcccatcacagcaagcacaaagcgccctcaaagctggggttgatcatcagcgggcccatcttgcaagaggggatggatgaggagaagctgaagcagctcaactgcgtggagatctccgccctcaatggcaaccgcatcaacgtccccatggtacgaaagaggagcgtttccaactccacgcagaccagcagcagcagcagccagtcggagaccagcagcgcggtcagcacgcccagccctgttacgaggacccggagcctcagtgcgtgcaacaagcgggtgggcatgtacttagagggcttcgatcctttcaatcagtcaacatttaacaacgtggtggagcagaactttaagaaccgcgagagctacccagaggacacggtgttctacatccctgaagatcacaagcctggcactttccccaaagctctcaccaatggcagtttctccccctcggggaataacggctctgtgaactggaggacgggaagcttccacggccctggccacatcagcctcaggagggaaaacagtagcgacagccccaaggaactgaagagacgcaattcttccagctccatgagcagccgcctgagcatctacgacaacgtgccgggctccatcctctactccagttcaggggacctggcggatctggagaacgaggacatcttccccgagctggacgacatcctctaccacgtgaaggggatgcagcggatagtcaatcagtggtcggagaagttttctgatgagggagattcggactcagccctggactcggtctctccctgcccgtcctctccaaaacagatacacctggatgtggacaacgaccgaaccacacccagcgacctggacagcacaggcaactccctgaatgaaccggaagagccctccgagatcccggaaagaagggattctggggttggggcttccctaaccaggtccaacaggcaccgactgagatggcacagtttccagagctcacatcggccaagcctcaactctgtatcactacagattaactgccagtctgtggcccagatgaacctgctgcagaaatactcactcctaaagctaacggccctgctggagaaatacacaccttctaacaagcatggttttagctgggccgtgcccaagttcatgaagaggatcaaggttccagactacaaggaccggagtgtgtttggggtcccactgacggtcaacgtgcagcgcacaggacaaccgttgcctcagagcatccagcaggccatgcgatacctccggaaccattgtttggatcaggttgggctcttcagaaaatcgggggtcaagtcccggattcaggctctgcgccagatgaatgaaggtgccatagactgtgtcaactacgaaggacagtctgcttatgacgtggcagacatgctgaagcagtattttcgagatcttcctgagccactaatgacgaacaaactctcggaaacctttctacagatctaccaatatgtgcccaaggaccagcgcctgcaggccatcaaggctgccatcatgctgctgcctgacgagaaccgggaggttctgcagaccctgctttatttcctgagcgatgtcacagcagccgtaaaagaaaaccagatgaccccaaccaacctggccgtgtgcttagcgccttccctcttccatctcaacaccctgaagagagagaattcctctcccagggtaatgcaaagaaaacaaagtttgggcaaaccagatcagaaagatttgaatgaaaacctagctgccactcaagggctggcccatatgatcgccgagtgcaagaagcttttccaggttcccgaggaaatgagccgatgtcgtaattcctataccgaacaagagctgaagcccctcactctggaagcactcgggcacctgggtaatgatgactcagctgactaccaacacttcctccaggactgtgtggatggcctgtttaaagaagtcaaagagaagtttaaaggctgggtcagctactccacttcggagcaggctgagctgtcctataagaaggtgagcgaaggaccccctctgaggctttggaggtcagtcattgaagtccctgctgtgccagaggaaatcttaaagcgcctacttaaagaacagcacctctgggatgtagacctgttggattcaaaagtgatcgaaattctggacagccaaactgaaatttaccagtatgtccaaaacagtatggcacctcatcctgctcgagactacgttgttttaagaacctggaggactaatttacccaaaggagcctgtgcccttttactaacctctgtggatcacgatcgcgcacctgtggtgggtgtgagggttaatgtgctcttgtccaggtatttgattgaaccctgtgggccaggaaaatccaaactcacctacatgtgcagagttgacttaaggggccacatgccagaatggtacacaaaatcttttggacatttgtgtgcagctgaagttgtaaagatccgggattccttcagtaaccagaacactgaaaccaaagacaccaaatctaggtgatcactgaagcaacgcaaccgcttccaccaccatggtgtttgtttctagaacttttgccagtccttgaagaatgggttctgtgtctaatcctgaaacaaagaaaactacaagctggagtgtaggaattgactatagcaatttgatacatttttaaagctgcttcctgtttgttgagggtctgtattcatagaccttgactggaatatgtaagactgtgcaaaaaaaaaaaaaaaatttatgtgtattcttattcagattgcttctgagaagcaaaactctttaaatacattatggaagataatgaagatacttcattctcttgtgatatcagtgtatgcgtacctgtgtcgctttatttgcagtgtgttgagggactggtgtatccactggaatagttggtactcttggatgtgttttctcaccaagatgagcaaagaaaggtttgcacagaggagtgtgaatgtgtgtttgttgctggctgaatggcaatagatgtctaaggtggattcagtgtctggcacactgagacacctccaagaaggagattgatgcatcaggttcagtttaacctggaatatctgactacccctgaatccacccagaaagggggcccaacacccttgtccatttatgggtattttttttcgaagttattaagcatattccttttccacgaacctcttctgtactttgattgtaataggttggctcttacacccattccaaatgcagtttatttttagacccgattgcaaatagtgatgtagttttaaccagtatggattagttcagggatgaactgctccctccagccttactggctctgatccacagggttttgttttgttttgttttgttttttgtttaagtcgagatataaaaactgaacacgataacacttactcttaaatcaagcatcaacactttttccctgttagaattctttgcatttttgtgtttgtaacagaaacgccttaagacactatgtttgggaatataggaaactatgtgtgtcccaaggaaatccctgtaaatttaactcacctacaaaaggctttttccccgcctttggttgttaacggcattcctgaaagccacatgtgtttattcattgggcttgttcttatcagcaaataggttttctggttttatgactttttgtcttattttatttttcctacatttctttttttttttttttcctttagaatgccctggaaatatatttaagtggtaatgaaaaatagtaatcatagtaaaacgcaacaagaagaaaaccaacccaaaccagtgaagttttttagaacctttagaagggtggtctttattcaggttttactgtaatggtaaggattgactcaagagacagtattagtaaatttattgtgtatggatcaaaagtgaataatgtatgaatgagagctgtaagaaggatttttattttgttataatttagttaccattttcagtgttatttcaaaggttctttgaagaattttggggcagggcatcagattagagttttaaaatttgagtattttggatatcagtgttcctcatgaagatatacatggatattcaattttgatggcttccagatttgtaagattgtatgttgtatataccattctattaagaaacatgtccactgtgctttcaaacatagataaagcatgataaagattattatttaagatatacttgtatttatacctcagatattcttttgggttttgtacctcaaggcttttttcttcttattgtaaatacactttacgtgaatacagtctaagtgaagaaaataaataaaaggaagaggtttataacttgctctatatctgtacagattataatcaataagtgcactattattaaatgtttaaagtaagggaaaagtctgggctgccttccttaatattgcatctcactcccacccttaaaaccacagattgcaaagcatagcattttagcatcaactacaatcaaaagagcgatttgctgaaggacaaacaggaaaccctggtgaaggttcaggaagcacggagattctctccaacaaaggtccagttaggaaacgacgctgagaggatgacgacaacgtgcaacagcagaaagatgcttgcaagcagagtcagggtcaccagtgaatgccacaaaagttctctttcccactgtttaatttgacaagagaagaatttgaaggatatgaacattttcaagaactctgctgaggtcacttagagcgccatcacaacttatttgtgtgactaattgcctagattgtaagctctttgagggcagggcttgtctcttacacatctttataatcccctgcagcggctttcagtattttgtacttgtaggcacctaataaatttattatttgctatactgaa

SEQ ID NO: 295596 - DNA, 4222 bp, Homo sapiens
  misc_feature (320)..(320): n is a, c, g, or t
gctgttgcatatagtgctggggtggacctggtttcaggacaccagggagcctggggtcggctcacaaaacccccattgttccttttccatcttcctttagaaacctaaagatgtaatgttctccgggtcatcagcagcagattttattttgacttcaggtcattcactgttgagctctggagttggctcccattgtgttaggctctcattgctgttttcccatcatgtgttatctgcgccttttgaccctaaatgctttcgatctcatcaagaactcagaagtgattcttacccttttttcaagacaaaagggaccttgnttttcacactctatcagatgcacctaattaggggccgtgcccaagttcatgaagaggatcaaggttccagactacaaggaccggagtgtgtttggggtcccactgacggtcaacgtgcagcgcacaggacaaccgttgcctcagagcatccagcaggccatgcgatacctccggaaccattgtttggatcaggttgggctcttcagaaaatcgggggtcaagtcccggattcaggctctgcgccagatgaatgaaggtgccatagactgtgtcaactacgaaggacagtctgcttatgacgtggcagacatgctgaagcagtattttcgagatcttcctgagccactaatgacgaacaaactctcggaaacctttctacagatctaccaatatgtgcccaaggaccagcgcctgcaggccatcaaggctgccatcatgctgctgcctgacgagaaccgggaggttctgcagaccctgctttatttcctgagcgatgtcacagcagccgtaaaagaaaaccagatgaccccaaccaacctggccgtgtgcttagcgccttccctcttccatctcaacaccctgaagagagagaattcctctcccagggtaatgcaaagaaaacaaagtttgggcaaaccagatcagaaagatttgaatgaaaacctagctgccactcaagggctggcccatatgatcgccgagtgcaagaagcttttccaggttcccgaggaaatgagccgatgtcgtaattcctataccgaacaagagctgaagcccctcactctggaagcactcgggcacctgggtaatgatgactcagctgactaccaacacttcctccaggactgtgtggatggcctgtttaaagaagtcaaagagaagtttaaaggctgggtcagctactccacttcggagcaggctgagctgtcctataagaaggtgagcgaaggaccccctctgaggctttggaggtcagtcattgaagtccctgctgtgccagaggaaatcttaaagcgcctacttaaagaacagcacctctgggatgtagacctgttggattcaaaagtgatcgaaattctggacagccaaactgaaatttaccagtatgtccaaaacagtatggcacctcatcctgctcgagactacgttgttttaagaacctggaggactaatttacccaaaggagcctgtgcccttttactaacctctgtggatcacgatcgcgcacctgtggtgggtgtgagggttaatgtgctcttgtccaggtatttgattgaaccctgtgggccaggaaaatccaaactcacctacatgtgcagagttgacttaaggggccacatgccagaatggtacacaaaatcttttggacatttgtgtgcagctgaagttgtaaagatccgggattccttcagtaaccagaacactgaaaccaaagacaccaaatctaggtgatcactgaagcaacgcaaccgcttccaccaccatggtgtttgtttctagaacttttgccagtccttgaagaatgggttctgtgtctaatcctgaaacaaagaaaactacaagctggagtgtaggaattgactatagcaatttgatacatttttaaagctgcttcctgtttgttgagggtctgtattcatagaccttgactggaatatgtaagactgtgcaaaaaaaaaaaaaaaatttatgtgtattcttattcagattgcttctgagaagcaaaactctttaaatacattatggaagataatgaagatacttcattctcttgtgatatcagtgtatgcgtacctgtgtcgctttatttgcagtgtgttgagggactggtgtatccactggaatagttggtactcttggatgtgttttctcaccaagatgagcaaagaaaggtttgcacagaggagtgtgaatgtgtgtttgttgctggctgaatggcaatagatgtctaaggtggattcagtgtctggcacactgagacacctccaagaaggagattgatgcatcaggttcagtttaacctggaatatctgactacccctgaatccacccagaaagggggcccaacacccttgtccatttatgggtattttttttcgaagttattaagcatattccttttccacgaacctcttctgtactttgattgtaataggttggctcttacacccattccaaatgcagtttatttttagacccgattgcaaatagtgatgtagttttaaccagtatggattagttcagggatgaactgctccctccagccttactggctctgatccacagggttttgttttgttttgttttgttttttgtttaagtcgagatataaaaactgaacacgataacacttactcttaaatcaagcatcaacactttttccctgttagaattctttgcatttttgtgtttgtaacagaaacgccttaagacactatgtttgggaatataggaaactatgtgtgtcccaaggaaatccctgtaaatttaactcacctacaaaaggctttttccccgcctttggttgttaacggcattcctgaaagccacatgtgtttattcattgggcttgttcttatcagcaaataggttttctggttttatgactttttgtcttattttatttttcctacatttctttttttttttttttcctttagaatgccctggaaatatatttaagtggtaatgaaaaatagtaatcatagtaaaacgcaacaagaagaaaaccaacccaaaccagtgaagttttttagaacctttagaagggtggtctttattcaggttttactgtaatggtaaggattgactcaagagacagtattagtaaatttattgtgtatggatcaaaagtgaataatgtatgaatgagagctgtaagaaggatttttattttgttataatttagttaccattttcagtgttatttcaaaggttctttgaagaattttggggcagggcatcagattagagttttaaaatttgagtattttggatatcagtgttcctcatgaagatatacatggatattcaattttgatggcttccagatttgtaagattgtatgttgtatataccattctattaagaaacatgtccactgtgctttcaaacatagataaagcatgataaagattattatttaagatatacttgtatttatacctcagatattcttttgggttttgtacctcaaggcttttttcttcttattgtaaatacactttacgtgaatacagtctaagtgaagaaaataaataaaaggaagaggtttataacttgctctatatctgtacagattataatcaataagtgcactattattaaatgtttaaagtaagggaaaagtctgggctgccttccttaatattgcatctcactcccacccttaaaaccacagattgcaaagcatagcattttagcatcaactacaatcaaaagagcgatttgctgaaggaaaaatcggactgcaaatcattccaaggccaaactgcaactgagccacccactcccaaacaggaaaccctggtgaaggttcaggaagcacggagattctctccaacaaaggtccagttaggaaacgacgctgagaggatgacgacaacgtgcaacagcagaaagatgcttgcaagcagagtcagggtcaccagtgaatgccacaaaagttctctttcccactgtttaatttgacaagagaagaatttgaaggatatgaacattttcaagaactctgctgaggtcacttagagcgccatcacaacttatttgtgtgactaattgcctagattgtaagctctttgagggcagggcttgtctcttacacatctttataatcccctgcagcggctttcagtattttgtacttgtaggcacctaataaatttattatttgctatactgaa

SEQ ID NO: 295597 - DNA, 6101 bp, Homo sapiens
tgacttggttatctgtgggttcctgggtggccagggtctcctttaattgtaaacactgcatgccaagtcagacttcgtaagagaaaggaaataagagaagatcgagatagggcgcggctggactccatggtgctgctgattatgaaactggaccagcttgatcaggacatagaaaatgccctcagcaccagctcctctccatcaggcacaccaacaaacctgcggcggcacgttcctgatctggaatcaggatctgaaagtggagcagataccatttcagtaaatcagacacgagtaaatttgtcttctgacactgagtccacggacctcccatcttccactccagtagccaattctggaaccaaacccaagactacggctattcaaggtatttcagagaaggaaaaggctgaaattgaagccaaggaagcttgtgattggctacgggcaactggtttcccccagtatgcacagctttatgaagatttcctgttccccatcgatatttccttggtcaagagagagcatgattttttggacagagatgccattgaggctctatgcaggcgtctaaatactttaaacaaatgtgcggtgatgaagctagaaattagtcctcatcggaaacgaagtgacgattcagacgaggatgagccttgtgccatcagtggcaaatggactttccaaagggacagcaagaggtggtcccggcttgaagagtttgatgtcttttctccaaaacaagacctggtccctgggtccccagacgactcccacccgaaggacggccccagccccggaggcacgctgatggacctcagcgagcgccaggaggtgtcttccgtccgcagcctcagcagcactggcagcctccccagccacgcgccccccagcgaggatgctgccaccccccggactaactccgtcatcagcgtttgctcctccagcaacttggcaggcaatgacgactctttcggcagcctgccctctcccaaggaactgtccagcttcagcttcagcatgaaaggccacgaaaaaactgccaagtccaagacgcgcagtctgctgaaacggatggagagcctgaagctcaagagctcccatcacagcaagcacaaagcgccctcaaagctggggttgatcatcagcgggcccatcttgcaagaggggatggatgaggagaagctgaagcagctcaactgcgtggagatctccgccctcaatggcaaccgcatcaacgtccccatggtacgaaagaggagcgtttccaactccacgcagaccagcagcagcagcagccagtcggagaccagcagcgcggtcagcacgcccagccctgttacgaggacccggagcctcagtgcgtgcaacaagcgggtgggcatgtacttagagggcttcgatcctttcaatcagtcaacatttaacaacgtggtggagcagaactttaagaaccgcgagagctacccagaggacacggtgttctacatccctgaagatcacaagcctggcactttccccaaagctctcaccaatggcagtttctccccctcggggaataacggctctgtgaactggaggacgggaagcttccacggccctggccacatcagcctcaggagggaaaacagtagcgacagccccaaggaactgaagagacgcaattcttccagctccatgagcagccgcctgagcatctacgacaacgtgccgggctccatcctctactccagttcaggggacctggcggatctggagaacgaggacatcttccccgagctggacgacatcctctaccacgtgaaggggatgcagcggatagtcaatcagtggtcggagaagttttctgatgagggagattcggactcagccctggactcggtctctccctgcccgtcctctccaaaacagatacacctggatgtggacaacgaccgaaccacacccagcgacctggacagcacaggcaactccctgaatgaaccggaagagccctccgagatcccggaaagaagggattctggggttggggcttccctaaccaggtccaacaggcaccgactgagatggcacagtttccagagctcacatcggccaagcctcaactctgtatcactacagattaactgccagtctgtggcccagatgaacctgctgcagaaatactcactcctaaagctaacggccctgctggagaaatacacaccttctaacaagcatggttttagctgggccgtgcccaagttcatgaagaggatcaaggttccagactacaaggaccggagtgtgtttggggtcccactgacggtcaacgtgcagcgcacaggacaaccgttgcctcagagcatccagcaggccatgcgatacctccggaaccattgtttggatcaggttgggctcttcagaaaatcgggggtcaagtcccggattcaggctctgcgccagatgaatgaaggtgccatagactgtgtcaactacgaaggacagtctgcttatgacgtggcagacatgctgaagcagtattttcgagatcttcctgagccactaatgacgaacaaactctcggaaacctttctacagatctaccaatatgtgcccaaggaccagcgcctgcaggccatcaaggctgccatcatgctgctgcctgacgagaaccgggaggttctgcagaccctgctttatttcctgagcgatgtcacagcagccgtaaaagaaaaccagatgaccccaaccaacctggccgtgtgcttagcgccttccctcttccatctcaacaccctgaagagagagaattcctctcccagggtaatgcaaagaaaacaaagtttgggcaaaccagatcagaaagatttgaatgaaaacctagctgccactcaagggctggcccatatgatcgccgagtgcaagaagcttttccaggttcccgaggaaatgagccgatgtcgtaattcctataccgaacaagagctgaagcccctcactctggaagcactcgggcacctgggtaatgatgactcagctgactaccaacacttcctccaggactgtgtggatggcctgtttaaagaagtcaaagagaagtttaaaggctgggtcagctactccacttcggagcaggctgagctgtcctataagaaggtgagcgaaggaccccctctgaggctttggaggtcagtcattgaagtccctgctgtgccagaggaaatcttaaagcgcctacttaaagaacagcacctctgggatgtagacctgttggattcaaaagtgatcgaaattctggacagccaaactgaaatttaccagtatgtccaaaacagtatggcacctcatcctgctcgagactacgttgttttaagaacctggaggactaatttacccaaaggagcctgtgcccttttactaacctctgtggatcacgatcgcgcacctgtggtgggtgtgagggttaatgtgctcttgtccaggtatttgattgaaccctgtgggccaggaaaatccaaactcacctacatgtgcagagttgacttaaggggccacatgccagaatggtacacaaaatcttttggacatttgtgtgcagctgaagttgtaaagatccgggattccttcagtaaccagaacactgaaaccaaagacaccaaatctaggtgatcactgaagcaacgcaaccgcttccaccaccatggtgtttgtttctagaacttttgccagtccttgaagaatgggttctgtgtctaatcctgaaacaaagaaaactacaagctggagtgtaggaattgactatagcaatttgatacatttttaaagctgcttcctgtttgttgagggtctgtattcatagaccttgactggaatatgtaagactgtgcaaaaaaaaaaaaaaaatttatgtgtattcttattcagattgcttctgagaagcaaaactctttaaatacattatggaagataatgaagatacttcattctcttgtgatatcagtgtatgcgtacctgtgtcgctttatttgcagtgtgttgagggactggtgtatccactggaatagttggtactcttggatgtgttttctcaccaagatgagcaaagaaaggtttgcacagaggagtgtgaatgtgtgtttgttgctggctgaatggcaatagatgtctaaggtggattcagtgtctggcacactgagacacctccaagaaggagattgatgcatcaggttcagtttaacctggaatatctgactacccctgaatccacccagaaagggggcccaacacccttgtccatttatgggtattttttttcgaagttattaagcatattccttttccacgaacctcttctgtactttgattgtaataggttggctcttacacccattccaaatgcagtttatttttagacccgattgcaaatagtgatgtagttttaaccagtatggattagttcagggatgaactgctccctccagccttactggctctgatccacagggttttgttttgttttgttttgttttttgtttaagtcgagatataaaaactgaacacgataacacttactcttaaatcaagcatcaacactttttccctgttagaattctttgcatttttgtgtttgtaacagaaacgccttaagacactatgtttgggaatataggaaactatgtgtgtcccaaggaaatccctgtaaatttaactcacctacaaaaggctttttccccgcctttggttgttaacggcattcctgaaagccacatgtgtttattcattgggcttgttcttatcagcaaataggttttctggttttatgactttttgtcttattttatttttcctacatttctttttttttttttttcctttagaatgccctggaaatatatttaagtggtaatgaaaaatagtaatcatagtaaaacgcaacaagaagaaaaccaacccaaaccagtgaagttttttagaacctttagaagggtggtctttattcaggttttactgtaatggtaaggattgactcaagagacagtattagtaaatttattgtgtatggatcaaaagtgaataatgtatgaatgagagctgtaagaaggatttttattttgttataatttagttaccattttcagtgttatttcaaaggttctttgaagaattttggggcagggcatcagattagagttttaaaatttgagtattttggatatcagtgttcctcatgaagatatacatggatattcaattttgatggcttccagatttgtaagattgtatgttgtatataccattctattaagaaacatgtccactgtgctttcaaacatagataaagcatgataaagattattatttaagatatacttgtatttatacctcagatattcttttgggttttgtacctcaaggcttttttcttcttattgtaaatacactttacgtgaatacagtctaagtgaagaaaataaataaaaggaagaggtttataacttgctctatatctgtacagattataatcaataagtgcactattattaaatgtttaaagtaagggaaaagtctgggctgccttccttaatattgcatctcactcccacccttaaaaccacagattgcaaagcatagcattttagcatcaactacaatcaaaagagcgatttgctgaaggaaaaatcggactgcaaatcattccaaggccaaactgcaactgagccacccactcccaaacaggaaaccctggtgaaggttcaggaagcacggagattctctccaacaaaggtccagttaggaaacgacgctgagaggatgacgacaacgtgcaacagcagaaagatgcttgcaagcagagtcagggtcaccagtgaatgccacaaaagttctctttcccactgtttaatttgacaagagaagaatttgaaggatatgaacattttcaagaactctgctgaggtcacttagagcgccatcacaacttatttgtgtgactaattgcctagattgtaagctctttgagggcagggcttgtctcttacacatctttataatcccctgcagcggctttcagtattttgtacttgtaggcacctaataaatttattatttgctatactgaa

SEQ ID NO: 295598 - DNA, 3960 bp, Homo sapiens
tatgggctcgagcggccgcccgggcaggtgcccgagcgagggcgcttcgctcccagccaggacatggccgcacctctccgcatcaggagcgccggctcacggacttctcgcccaactccctgagcgctccctcgtttcgatctttagaaaaccccgctttctttctggggccgtgacgaggggcagggagcggcgagcaaggatgcgttgaggaccgcgagggcgcgcgtctcgggtgccgccgtgggtcccgacgcggaagccgagccgcctccgcctgcctcgacttccccacagcgcttccgccgccgcctgccgtgcttgatgtgcagaaagaagccggacaccatgatcctaacacaaattgaagccaaggaagcttgtgattggctacgggcaactggtttcccccagtatgcacagctttatgaagatttcctgttccccatcgatatttccttggtcaagagagagcatgattttttggacagagatgccattgaggctctatgcaggcgtctaaatactttaaacaaatgtgcggtgatgaagctagaaattagtcctcatcggaaacgaagtgacgattcagacgaggatgagccttgtgccatcagtggcaaatggactttccaaagggacagcaagaggtggtcccggcttgaagagtttgatgtcttttctccaaaacaagacctggtccctgggtccccagacgactcccacccgaaggacggccccagccccggaggcacgctgatggacctcagcgagcgccaggaggtgtcttccgtccgcagcctcagcagcactggcagcctccccagccacgcgccccccagcgaggatgctgccaccccccggactaactccgtcatcagcgtttgctcctccagcaacttggcaggcaatgacgactctttcggcagcctgccctctcccaaggaactgtccagcttcagcttcagcatgaaaggccacgaaaaaactgccaagtccaagacgcgcagtctgctgaaacggatggagagcctgaagctcaagagctcccatcacagcaagcacaaagcgccctcaaagctggggttgatcatcagcgggcccatcttgcaagaggggatggatgaggagaagctgaagcagctcaactgcgtggagatctccgccctcaatggcaaccgcatcaacgtccccatggtacgaaagaggagcgtttccaactccacgcagaccagcagcagcagcagccagtcggagaccagcagcgcggtcagcacgcccagccctgttacgaggacccggagcctcagtgcgtgcaacaagcgggtgggcatgtacttagagggcttcgatcctttcaatcagtcaacatttaacaacgtggtggagcagaactttaagaaccgcgagagctacccagaggacacggtgttctacatccctgaagatcacaagcctggcactttccccaaagctctcaccaatggcagtttctccccctcggggaataacggctctgtgaactggaggacgggaagcttccacggccctggccacatcagcctcaggagggaaaacagtagcgacagccccaaggaactgaagagacgcaattcttccagctccatgagcagccgcctgagcatctacgacaacgtgccgggctccatcctctactccagttcaggggacctggcggatctggagaacgaggacatcttccccgagctggacgacatcctctaccacgtgaaggggatgcagcggatagtcaatcagtggtcggagaagttttctgatgagggagattcggactcagccctggactcggtctctccctgcccgtcctctccaaaacagatacacctggatgtggacaacgaccgaaccacacccagcgacctggacagcacaggcaactccctgaatgaaccggaagagccctccgagatcccggaaagaagggattctggggttggggcttccctaaccaggtccaacaggcaccgactgagatggcacagtttccagagctcacatcggccaagcctcaactctgtatcactacagattaactgccagtctgtggcccagatgaacctgctgcagaaatactcactcctaaagctaacggccctgctggagaaatacacaccttctaacaagcatggttttagctgggccgtgcccaagttcatgaagaggatcaaggttccagactacaaggaccggagtgtgtttggggtcccactgacggtcaacgtgcagcgcacaggacaaccgttgcctcagagcatccagcaggccatgcgatacctccggaaccattgtttggatcaggttgggctcttcagaaaatcgggggtcaagtcccggattcaggctctgcgccagatgaatgaaggtgccatagactgtgtcaactacgaaggacagtctgcttatgacgtggcagacatgctgaagcagtattttcgagatcttcctgagccactaatgacgaacaaactctcggaaacctttctacagatctaccaatatgtgcccaaggaccagcgcctgcaggccatcaaggctgccatcatgctgctgcctgacgagaaccgggaggttctgcagaccctgctttatttcctgagcgatgtcacagcagccgtaaaagaaaaccagatgaccccaaccaacctggccgtgtgcttagcgccttccctcttccatctcaacaccctgaagagagagaattcctctcccagggtaatgcaaagaaaacaaagtttgggcaaaccagatcagaaagatttgaatgaaaacctagctgccactcaagggctggcccatatgatcgccgagtgcaagaagcttttccaggttcccgaggaaatgagccgatgtcgtaattcctataccgaacaagagctgaagcccctcactctggaagcactcgggcacctgggtaatgatgactcagctgactaccaacacttcctccaggactgtgtggatggcctgtttaaagaagtcaaagagaagtttaaaggctgggtcagctactccacttcggagcaggctgagctgtcctataagaaggtgagcgaaggaccccctctgaggctttggaggtcagtcattgaagtccctgctgtgccagaggaaatcttaaagcgcctacttaaagaacagcacctctgggatgtagacctgttggattcaaaagtgatcgaaattctggacagccaaactgaaatttaccagtatgtccaaaacagtatggcacctcatcctgctcgagactacgttgttttaagaacctggaggactaatttacccaaaggagcctgtgcccttttactaacctctgtggatcacgatcgcgcacctgtggtgggtgtgagggttaatgtgctcttgtccaggtatttgattgaaccctgtgggccaggaaaatccaaactcacctacatgtgcagagttgacttaaggggccacatgccagaatggtacacaaaatcttttggacatttgtgtgcagctgaagttgtaaagatccgggattccttcagtaaccagaacactgaaaccaaagacaccaaatctaggtgatcactgaagcaacgcaaccgcttccaccaccatggtgtttgtttctagaacttttgccagtccttgaagaatgggttctgtgtctaatcctgaaacaaagaaaactacaagctggagtgtaggaattgactatagcaatttgatacatttttaaagctgcttcctgtttgttgagggtctgtattcatagaccttgactggaatatgtaagactgtgcaaaaaaaaaaaaaaaaaaattttgtggggctcggccgcgaaaggttttaaacacttgttggggggggccgtggaaggaacgggcaaagggtcaggatcgggcggaaggggggtttcaaaaaagggggggcgggttgaattct

SEQ ID NO: 295599 - DNA, 3000 bp, Homo sapiens
gattgccttggcactgaaaaatacatcctctttccaggtgagcgaaggaccccctctgaggctttggaggtcagtcattgaagtccctgctgtgccagaggaaatcttaaagcgcctacttaaagaacagcacctctgggatgtagacctgttggattcaaaagtgatcgaaattctggacagccaaactgaaatttaccagtatgtccaaaacagtatggcacctcatcctgctcgagactacgttgttttaagaacctggaggactaatttacccaaaggagcctgtgcccttttactaacctctgtggatcacgatcgcgcacctgtggtgggtgtgagggttaatgtgctcttgtccaggtatttgattgaaccctgtgggccaggaaaatccaaactcacctacatgtgcagagttgacttaaggggccacatgccagaatggtacacaaaatcttttggacatttgtgtgcagctgaagttgtaaagatccgggattccttcagtaaccagaacactgaaaccaaagacaccaaatctaggtgatcactgaagcaacgcaaccgcttccaccaccatggtgtttgtttctagaacttttgccagtccttgaagaatgggttctgtgtctaatcctgaaacaaagaaaactacaagctggagtgtaggaattgactatagcaatttgatacatttttaaagctgcttcctgtttgttgagggtctgtattcatagaccttgactggaatatgtaagactgtgcaaaaaaaaaaaaaaaatttatgtgtattcttattcagattgcttctgagaagcaaaactctttaaatacattatggaagataatgaagatacttcattctcttgtgatatcagtgtatgcgtacctgtgtcgctttatttgcagtgtgttgagggactggtgtatccactggaatagttggtactcttggatgtgttttctcaccaagatgagcaaagaaaggtttgcacagaggagtgtgaatgtgtgtttgttgctggctgaatggcaatagatgtctaaggtggattcagtgtctggcacactgagacacctccaagaaggagattgatgcatcaggttcagtttaacctggaatatctgactacccctgaatccacccagaaagggggcccaacacccttgtccatttatgggtattttttttcgaagttattaagcatattccttttccacgaacctcttctgtactttgattgtaataggttggctcttacacccattccaaatgcagtttatttttagacccgattgcaaatagtgatgtagttttaaccagtatggattagttcagggatgaactgctccctccagccttactggctctgatccacagggttttgttttgttttgttttgttttttgtttaagtcgagatataaaaactgaacacgataacacttactcttaaatcaagcatcaacactttttccctgttagaattctttgcatttttgtgtttgtaacagaaacgccttaagacactatgtttgggaatataggaaactatgtgtgtcccaaggaaatccctgtaaatttaactcacctacaaaaggctttttccccgcctttggttgttaacggcattcctgaaagccacatgtgtttattcattgggcttgttcttatcagcaaataggttttctggttttatgactttttgtcttattttatttttcctacatttctttttttttttttttcctttagaatgccctggaaatatatttaagtggtaatgaaaaatagtaatcatagtaaaacgcaacaagaagaaaaccaacccaaaccagtgaagttttttagaacctttagaagggtggtctttattcaggttttactgtaatggtaaggattgactcaagagacagtattagtaaatttattgtgtatggatcaaaagtgaataatgtatgaatgagagctgtaagaaggatttttattttgttataatttagttaccattttcagtgttatttcaaaggttctttgaagaattttggggcagggcatcagattagagttttaaaatttgagtattttggatatcagtgttcctcatgaagatatacatggatattcaattttgatggcttccagatttgtaagattgtatgttgtatataccattctattaagaaacatgtccactgtgctttcaaacatagataaagcatgataaagattattatttaagatatacttgtatttatacctcagatattcttttgggttttgtacctcaaggcttttttcttcttattgtaaatacactttacgtgaatacagtctaagtgaagaaaataaataaaaggaagaggtttataacttgctctatatctgtacagattataatcaataagtgcactattattaaatgtttaaagtaagggaaaagtctgggctgccttccttaatattgcatctcactcccacccttaaaaccacagattgcaaagcatagcattttagcatcaactacaatcaaaagagcgatttgctgaaggaaaaatcggactgcaaatcattccaaggccaaactgcaactgagccacccactcccaaacaggaaaccctggtgaaggttcaggaagcacggagattctctccaacaaaggtccagttaggaaacgacgctgagaggatgacgacaacgtgcaacagcagaaagatgcttgcaagcagagtcagggtcaccagtgaatgccacaaaagttctctttcccactgtttaatttgacaagagaagaatttgaaggatatgaacattttcaagaactctgctgaggtcacttagagcgccatcacaacttatttgtgtgactaattgcctagattgtaagctctttgagggcagggcttgtctcttacacatctttataatcccctgcagcggctttcagtattttgtacttgtaggcacctaataaatttattatttgctatactgaa

SEQ ID NO: 295600 - DNA, 2673 bp, Homo sapiens
atagattttatgcatttgaactagcaaacagatgtttctcattttatttccatgctttctaacttaaataattcatcagcttttctttcttttctctgataggggccacatgccagaatggtacacaaaatcttttggacatttgtgtgcagctgaagttgtaaagatccgggattccttcagtaaccagaacactgaaaccaaagacaccaaatctaggtgatcactgaagcaacgcaaccgcttccaccaccatggtgtttgtttctagaacttttgccagtccttgaagaatgggttctgtgtctaatcctgaaacaaagaaaactacaagctggagtgtaggaattgactatagcaatttgatacatttttaaagctgcttcctgtttgttgagggtctgtattcatagaccttgactggaatatgtaagactgtgcaaaaaaaaaaaaaaaatttatgtgtattcttattcagattgcttctgagaagcaaaactctttaaatacattatggaagataatgaagatacttcattctcttgtgatatcagtgtatgcgtacctgtgtcgctttatttgcagtgtgttgagggactggtgtatccactggaatagttggtactcttggatgtgttttctcaccaagatgagcaaagaaaggtttgcacagaggagtgtgaatgtgtgtttgttgctggctgaatggcaatagatgtctaaggtggattcagtgtctggcacactgagacacctccaagaaggagattgatgcatcaggttcagtttaacctggaatatctgactacccctgaatccacccagaaagggggcccaacacccttgtccatttatgggtattttttttcgaagttattaagcatattccttttccacgaacctcttctgtactttgattgtaataggttggctcttacacccattccaaatgcagtttatttttagacccgattgcaaatagtgatgtagttttaaccagtatggattagttcagggatgaactgctccctccagccttactggctctgatccacagggttttgttttgttttgttttgttttttgtttaagtcgagatataaaaactgaacacgataacacttactcttaaatcaagcatcaacactttttccctgttagaattctttgcatttttgtgtttgtaacagaaacgccttaagacactatgtttgggaatataggaaactatgtgtgtcccaaggaaatccctgtaaatttaactcacctacaaaaggctttttccccgcctttggttgttaacggcattcctgaaagccacatgtgtttattcattgggcttgttcttatcagcaaataggttttctggttttatgactttttgtcttattttatttttcctacatttctttttttttttttttcctttagaatgccctggaaatatatttaagtggtaatgaaaaatagtaatcatagtaaaacgcaacaagaagaaaaccaacccaaaccagtgaagttttttagaacctttagaagggtggtctttattcaggttttactgtaatggtaaggattgactcaagagacagtattagtaaatttattgtgtatggatcaaaagtgaataatgtatgaatgagagctgtaagaaggatttttattttgttataatttagttaccattttcagtgttatttcaaaggttctttgaagaattttggggcagggcatcagattagagttttaaaatttgagtattttggatatcagtgttcctcatgaagatatacatggatattcaattttgatggcttccagatttgtaagattgtatgttgtatataccattctattaagaaacatgtccactgtgctttcaaacatagataaagcatgataaagattattatttaagatatacttgtatttatacctcagatattcttttgggttttgtacctcaaggcttttttcttcttattgtaaatacactttacgtgaatacagtctaagtgaagaaaataaataaaaggaagaggtttataacttgctctatatctgtacagattataatcaataagtgcactattattaaatgtttaaagtaagggaaaagtctgggctgccttccttaatattgcatctcactcccacccttaaaaccacagattgcaaagcatagcattttagcatcaactacaatcaaaagagcgatttgctgaaggaaaaatcggactgcaaatcattccaaggccaaactgcaactgagccacccactcccaaacaggaaaccctggtgaaggttcaggaagcacggagattctctccaacaaaggtccagttaggaaacgacgctgagaggatgacgacaacgtgcaacagcagaaagatgcttgcaagcagagtcagggtcaccagtgaatgccacaaaagttctctttcccactgtttaatttgacaagagaagaatttgaaggatatgaacattttcaagaactctgctgaggtcacttagagcgccatcacaacttatttgtgtgactaattgcctagattgtaagctctttgagggcagggcttgtctcttacacatctttataatcccctgcagcggctttcagtattttgtacttgtaggcacctaataaatttattatttgctatactgaa

SEQ ID NO: 295601 - DNA, 1733 bp, Homo sapiens
ttgtcttaatgctctcccttcccttgcccccacccgccaacaggccccagtgtgtgatgttcccctccctgtgtccatgtgttctcattgttcaactcccacttatgagtgagaatatgcagtgtttggttttgttttgttttttgtttaagtcgagatataaaaactgaacacgataacacttactcttaaatcaagcatcaacactttttccctgttagaattctttgcatttttgtgtttgtaacagaaacgccttaagacactatgtttgggaatataggaaactatgtgtgtcccaaggaaatccctgtaaatttaactcacctacaaaaggctttttccccgcctttggttgttaacggcattcctgaaagccacatgtgtttattcattgggcttgttcttatcagcaaataggttttctggttttatgactttttgtcttattttatttttcctacatttctttttttttttttttcctttagaatgccctggaaatatatttaagtggtaatgaaaaatagtaatcatagtaaaacgcaacaagaagaaaaccaacccaaaccagtgaagttttttagaacctttagaagggtggtctttattcaggttttactgtaatggtaaggattgactcaagagacagtattagtaaatttattgtgtatggatcaaaagtgaataatgtatgaatgagagctgtaagaaggatttttattttgttataatttagttaccattttcagtgttatttcaaaggttctttgaagaattttggggcagggcatcagattagagttttaaaatttgagtattttggatatcagtgttcctcatgaagatatacatggatattcaattttgatggcttccagatttgtaagattgtatgttgtatataccattctattaagaaacatgtccactgtgctttcaaacatagataaagcatgataaagattattatttaagatatacttgtatttatacctcagatattcttttgggttttgtacctcaaggcttttttcttcttattgtaaatacactttacgtgaatacagtctaagtgaagaaaataaataaaaggaagaggtttataacttgctctatatctgtacagattataatcaataagtgcactattattaaatgtttaaagtaagggaaaagtctgggctgccttccttaatattgcatctcactcccacccttaaaaccacagattgcaaagcatagcattttagcatcaactacaatcaaaagagcgatttgctgaaggaaaaatcggactgcaaatcattccaaggccaaactgcaactgagccacccactcccaaacaggaaaccctggtgaaggttcaggaagcacggagattctctccaacaaaggtccagttaggaaacgacgctgagaggatgacgacaacgtgcaacagcagaaagatgcttgcaagcagagtcagggtcaccagtgaatgccacaaaagttctctttcccactgtttaatttgacaagagaagaatttgaaggatatgaacattttcaagaactctgctgaggtcacttagagcgccatcacaacttatttgtgtgactaattgcctagattgtaagctctttgagggcagggcttgtctcttacacatctttataatcccctgcagcggctttcagtattttgtacttgtaggcacctaataaatttattatttgctatactgaa

SEQ ID NO: 295602 - DNA, 494 bp, Homo sapiens
ggcattaatccagctcccattaggccccacctcccaacactgttgtattgggcattcactttccatcacatgctttttggggaacacatgtacaccatagcaagtagtttagaggatgccatttacctaggcctgggtcacacagcatggccactgagcctgacccgtcaccacactgcaaatagtgaagagtgaagcacgattttaaacttggcttctatgaaattccatcatttctgcctctggttttgtctctacagaacctggaggactaatttacccaaaggagcctgtgcccttttactaacctctgtggatcacgatcgcgcacctgtggtgggtgtgagggttaatgtgctcttgtccaggtatttgattgaaccctgtgggccaggaaaatccaaactcacctacatgtgcagagttgacttaaggtatgttctgattctgatttttttatatggtgagggtcatgaaggaaattctgacttttt

SEQ ID NO: 295603 - DNA, 2149 bp, Homo sapiens
atataaccgcgtggcccgcgcgcgcgcttccctcccggcgcagtcaccggcgcggtctatggctgcgacttctctaatgtctgctttggctgcccggctgctgcagcccgcgcacagctgctcccttcgccttcgccctttccacctcgcggcagttcgaaatgaagctgttgtcatttctggaaggaaactggcccagcagatcaagcaggaagtgcggcaggaggtagaagagtgggtggcctcaggcaacaaacggccacacctgagtgtgatcctggttggcgagaatcctgcaagtcactcctatgtcctcaacaaaaccagggcagctgcagttgtgggaatcaacagtgagacaattatgaaaccagcttcaatttcagaggaagaattgttgaatttaatcaataaactgaataatgatgataatgtagatggcctccttgttcagttgcctcttccagagcatattgatgagagaaggatctgcaatgctgtttctccagacaaggatgttgatggctttcatgtaattaatgtaggacgaatgtgtttggatcagtattccatgttaccggctactccatggggtgtgtgggaaataatcaagcgaactggcattccaaccctagggaagaatgtggttgtggctggaaggtcaaaaaacgttggaatgcccattgcaatgttactgcacacagatggggcgcatgaacgtcccggaggtgatgccactgttacaatatctcatcgatatactcccaaagagcagttgaagaaacatacaattcttgcagatattgtaatatctgctgcaggtattccaaatctgatcacagcagatatgatcaaggaaggagcagcagtcattgatgtgggaataaatagagttcacgatcctgtaactgccaaacccaagttggttggagatgtggattttgaaggagtcagacaaaaagctgggtatatcactccagttcctggaggtgttggccccatgacagtggcaatgctaatgaagaataccattattgctgcaaaaaaggtgctgaggcttgaagagcgagaagtgctgaagtctaaagagcttggggtagccactaattaactactgtgtcttctgtgtcacaaacagcactccaggccagctcaagaagcaaagcaggccaatagaaatgcaatatttttaatttattctactgaaatggtttaaaatgatgccttgtatttattgaaagcttaaatgggtgggtgtttctgcacatacctctgcagtacctcaccagggagcattccagtatcatgcagggtcctgtgatctagccaggagcagccattaacctagtgattaatatgggagacattaccatatggaggatggatgcttcactttgtcaagcacctcagttacacattcgccttttctaggattgcatttcccaagtgctattgcaataacagttgatactcattttaggtaccaaaccttttgagttcaactgatcaaaccaaaggaaaagtgttgctagagaaaattagggaaaaggtgaaaaagaaaaaatggtagtaattgagcagaaaaaaattaatttatatatgtattgattggcaaccagatttatctaagtagaactgaattggctaggaaaaaagaaaaactgcatgttaatcattttcctaagctgtccttttgaggcttagtcagtttattgggaaaatgtttaggattattccttgctattagtactcattttatgtatgttacccttcagtaagttctccccattttagttttctaggactgaaaggattcttttctacattatacatgtgtgttgtcatatttggcttttgctatatactttaacttcattgttaaatttttgtattgtatagtttctttggtgtatcttaaaacctatttttgaaaaacaaacttggcttgataatcatttgggcagcttgggtaagtacgcaacttacttttccaccaaagaactgtcagcagctgcctgcttttctgtgatgtatgtatcctgttgacttttccagaaattttttaagagtttgagttactattgaatttaatcagactttctgattaaagggttttctttcttttttaataaaacacatctgtctggta

SEQ ID NO: 295604 - DNA, 2625 bp, Homo sapiens
atataaccgcgtggcccgcgcgcgcgcttccctcccggcgcagtcaccggcgcggtctatggctgcgacttctctaatgtctgctttggctgcccggctgctgcagcccgcgcacagctgctcccttcgccttcgccctttccacctcgcggcagttcggggaatctctccctaggtcaggttggagtgcagtgctgcaatcacggcttactgcagccttgacctcctgggctcaagtgatcctcccacctcagcttaaatgaagctgttgtcatttctggaaggaaactggcccagcagatcaagcaggaagtgcggcaggaggtagaagagtgggtggcctcaggcaacaaacggccacacctgagtgtgatcctggttggcgagaatcctgcaagtcactcctatgtcctcaacaaaaccagggcagctgcagttgtgggaatcaacagtgagacaattatgaaaccagcttcaatttcagaggaagaattgttgaatttaatcaataaactgaataatgatgataatgtagatggcctccttgttcagttgcctcttccagagcatattgatgagagaaggatctgcaatgctgtttctccagacaaggatgttgatggctttcatgtaattaatgtaggacgaatgtgtttggatcagtattccatgttaccggctactccatggggtgtgtgggaaataatcaagcgaactggcattccaaccctagggaagaatgtggttgtggctggaaggtcaaaaaacgttggaatgcccattgcaatgttactgcacacagatggggcgcatgaacgtcccggaggtgatgccactgttacaatatctcatcgatatactcccaaagagcagttgaagaaacatacaattcttgcagatattgtaatatctgctgcaggtattccaaatctgatcacagcagatatgatcaaggaaggagcagcagtcattgatgtgggaataaatagagttcacgatcctgtaactgccaaacccaagttggttggagatgtggattttgaaggagtcagacaaaaagctgggtatatcactccagttcctggaggtgttggccccatgacagtggcaatgctaatgaagaataccattattgctgcaaaaaaggtgctgaggcttgaagagcgagaagtgctgaagtctaaagagcttggggtagccactaattaactactgtgtcttctgtgtcacaaacagcactccaggccagctcaagaagcaaagcaggccaatagaaatgcaatatttttaatttattctactgaaatggtttaaaatgatgccttgtatttattgaaagcttaaatgggtgggtgtttctgcacatacctctgcagtacctcaccagggagcattccagtatcatgcagggtcctgtgatctagccaggagcagccattaacctagtgattaatatgggagacattaccatatggaggatggatgcttcactttgtcaagcacctcagttacacattcgccttttctaggattgcatttcccaagtgctattgcaataacagttgatactcattttaggtaccaaaccttttgagttcaactgatcaaaccaaaggaaaagtgttgctagagaaaattagggaaaaggtgaaaaagaaaaaatggtagtaattgagcagaaaaaaattaatttatatatgtattgattggcaaccagatttatctaagtagaactgaattggctaggaaaaaagaaaaactgcatgttaatcattttcctaagctgtccttttgaggcttagtcagtttattgggaaaatgtttaggattattccttgctattagtactcattttatgtatgttacccttcagtaagttctccccattttagttttctaggactgaaaggattcttttctacattatacatgtgtgttgtcatatttggcttttgctatatactttaacttcattgttaaatttttgtattgtatagtttctttggtgtatcttaaaacctatttttgaaaaacaaacttggcttgataatcatttgggcagcttgggtaagtacgcaacttacttttccaccaaagaactgtcagcagctgcctgcttttctgtgatgtatgtatcctgttgacttttccagaaattttttaagagtttgagttactattgaatttaatcagactttctgattaaagggttttctttcttttttaataaaacacatctgtctggtactggtgtggtatgaatttctgaaattctgtcttcctatgactcctagttgtgacctaaccagtttttttctcatttaatcaatgtagctattcctatattcagtaacacttacttctatagccttaaatagataattttttttcttctattttttttttttttttgtagagatggggtcttgctatgttgcctgggctggtattgaactccgggcctcaagcaatcaatcctcttgcctcagcttcccagagggctgggatatacaggcctgggccacccacacccaaacagaggtttaaagagctttggagaaaccagcctcgtcctccagtctcttggttgtttgttttgagactgagtcttgctctgttgcccag

SEQ ID NO: 295605 - DNA, 686 bp, Homo sapiens
atataaccgcgtggcccgcgcgcgcgcttccctcccggcgcagtcaccggcgcggtctatggctgcgacttctctaatgtctgctttggctgcccggctgctgcagcccgcgcacagctgctcccttcgccttcgccctttccacctcgcggcagttcgaaatgaagctgttgtcatttctggaaggaaactggcccagcagatcaagcaggaagtgcggcaggaggtagaagagtgggtggcctcaggcaacaaacggccacacctgagtgtgatcctggttggcgagaatcctgcaagtcactcctatgtcctcaacaaaaccagggcagctgcagttgtgggaatcaacagtgagacaattatgaaaccagcttcaatttcagaggaagaattgttgaatttaatcaataaactgaataatgatgataatgtagatggcctccttgttcagttgcctcttccagagcatattgatgagagaaggatctgcaatgctgtttctccagacaaggatgttgatggctttcatgtaattaatgtaggacgaatgtgtttggatcagtattccatgttaccggctactccatggggtgtgtgggaaataatcaagcgaactgccagccgactggctttccaacctaaggaatggggtcttggctgggtcaccgtgggatgcccatgct

SEQ ID NO: 295606 - DNA, 2127 bp, Homo sapiens
gggatggtaatcggccgagggtcaccggcgcggtctatggctgcgacttctctaatgtctgctttggctgcccggctgctgcagcccgcgcacagctgctcccttcgccttcgccctttccacctcgcggcagttcgaaatgaagctgttgtcatttctggaaggaaactggcccagcagatcaagcaggaagtgcggcaggaggtagaagagtgggtggcctcaggcaacaaacggccacacctgagtgtgatcctggttggcgagaatcctgcaagtcactcctatgtcctcaacaaaaccagggcagctgcagttgtgggaatcaacagtgagacaattatgaaaccagcttcaatttcagaggaagaattgttgaatttaatcaataaactgaataatgatgataatgtagatggcctccttgttcagttgcctcttccagagcatattgatgagagaaggatctgcaatgctgtttctccagacaaggatgttgatggctttcatgtaattaatgtaggacgaatgtgtttggatcagtattccatgttaccggctactccatggggtgtgtgggaaataatcaagcgaactggcattccaaccctagggaagaatgtggttgtggctggaaggtcaaaaaacgttggaatgcccattgcaatgttactgcacacagatggggcgcatgaacgtcccggaggtgatgccactgttacaatatctcatcgatatactcccaaagagcagttgaagaaacatacaattcttgcagatattgtaatatctgctgcaggtattccaaatctgatcacagcagatatgatcaaggaaggagcagcagtcattgatgtgggaataaatagagttcacgatcctgtaactgccaaacccaagttggttggagatgtggattttgaaggagtcagacaaaaagctgggtatatcactccagttcctggaggtgttggccccatgacagtggcaatgctaatgaagaataccattattgctgcaaaaaaggtgctgaggcttgaagagcgagaagtgctgaagtctaaagagcttggggtagccactaattaactactgtgtcttctgtgtcacaaacagcactccaggccagctcaagaagcaaagcaggccaatagaaatgcaatatttttaatttattctactgaaatggtttaaaatgatgccttgtatttattgaaagcttaaatgggtgggtgtttctgcacatacctctgcagtacctcaccagggagcattccagtatcatgcagggtcctgtgatctagccaggagcagccattaacctagtgattaatatgggagacattaccatatggaggatggatgcttcactttgtcaagcacctcagttacacattcgccttttctaggattgcatttcccaagtgctattgcaataacagttgatactcattttaggtaccaaaccttttgagttcaactgatcaaaccaaaggaaaagtgttgctagagaaaattagggaaaaggtgaaaaagaaaaaatggtagtaattgagcagaaaaaaattaatttatatatgtattgattggcaaccagatttatctaagtagaactgaattggctaggaaaaaagaaaaactgcatgttaatcattttcctaagctgtccttttgaggcttagtcagtttattgggaaaatgtttaggattattccttgctattagtactcattttatgtatgttacccttcagtaagttctccccattttagttttctaggactgaaaggattcttttctacattatacatgtgtgttgtcatatttggcttttgctatatactttaacttcattgttaaatttttgtattgtatagtttctttggtgtatcttaaaacctatttttgaaaaacaaacttggcttgataatcatttgggcagcttgggtaagtacgcaacttacttttccaccaaagaactgtcagcagctgcctgcttttctgtgatgtatgtatcctgttgacttttccagaaattttttaagagtttgagttactattgaatttaatcagactttctgattaaagggttttctttcttttttaataaaacacatctgtctggta

SEQ ID NO: 295607 - DNA, 2527 bp, Homo sapiens
atataaccgcgtggcccgcgcgcgcgcttccctcccggcgcagtcaccggcgcggtctatggctgcgacttctctaatgtctgctttggctgcccggctgctgcagcccgcgcacagctgctcccttcgccttcgccctttccacctcgcggcagttcgaaatgaagctgttgtcatttctggaaggaaactggcccagcagatcaagcaggaagtgcggcaggaggtagaagagtgggtggcctcaggcaacaaacggccacacctgagtgtgatcctggttggcgagaatcctgcaagtcactcctatgtcctcaacaaaaccagggcagctgcagttgtgggaatcaacagtgagacaattatgaaaccagcttcaatttcagaggaagaattgttgaatttaatcaataaactgaataatgatgataatgtagatggcctccttgttcagttgcctcttccagagcatattgatgagagaaggatctgcaatgctgtttctccagacaaggatgttgatggctttcatgtaattaatgtaggacgaatgtgtttggatcagtattccatgttaccggctactccatggggtgtgtgggaaataatcaagcgaactggcattccaaccctagggaagaatgtggttgtggctggaaggtcaaaaaacgttggaatgcccattgcaatgttactgcacacagatggggcgcatgaacgtcccggaggtgatgccactgttacaatatctcatcgatatactcccaaagagcagttgaagaaacatacaattcttgcagatattgtaatatctgctgcaggtattccaaatctgatcacagcagatatgatcaaggaaggagcagcagtcattgatgtgggaataaatagagttcacgatcctgtaactgccaaacccaagttggttggagatgtggattttgaaggagtcagacaaaaagctgggtatatcactccagttcctggaggtgttggccccatgacagtggcaatgctaatgaagaataccattattgctgcaaaaaaggtgctgaggcttgaagagcgagaagtgctgaagtctaaagagcttggggtagccactaattaactactgtgtcttctgtgtcacaaacagcactccaggccagctcaagaagcaaagcaggccaatagaaatgcaatatttttaatttattctactgaaatggtttaaaatgatgccttgtatttattgaaagcttaaatgggtgggtgtttctgcacatacctctgcagtacctcaccagggagcattccagtatcatgcagggtcctgtgatctagccaggagcagccattaacctagtgattaatatgggagacattaccatatggaggatggatgcttcactttgtcaagcacctcagttacacattcgccttttctaggattgcatttcccaagtgctattgcaataacagttgatactcattttaggtaccaaaccttttgagttcaactgatcaaaccaaaggaaaagtgttgctagagaaaattagggaaaaggtgaaaaagaaaaaatggtagtaattgagcagaaaaaaattaatttatatatgtattgattggcaaccagatttatctaagtagaactgaattggctaggaaaaaagaaaaactgcatgttaatcattttcctaagctgtccttttgaggcttagtcagtttattgggaaaatgtttaggattattccttgctattagtactcattttatgtatgttacccttcagtaagttctccccattttagttttctaggactgaaaggattcttttctacattatacatgtgtgttgtcatatttggcttttgctatatactttaacttcattgttaaatttttgtattgtatagtttctttggtgtatcttaaaacctatttttgaaaaacaaacttggcttgataatcatttgggcagcttgggtaagtacgcaacttacttttccaccaaagaactgtcagcagctgcctgcttttctgtgatgtatgtatcctgttgacttttccagaaattttttaagagtttgagttactattgaatttaatcagactttctgattaaagggttttctttcttttttaataaaacacatctgtctggtactggtgtggtatgaatttctgaaattctgtcttcctatgactcctagttgtgacctaaccagtttttttctcatttaatcaatgtagctattcctatattcagtaacacttacttctatagccttaaatagataattttttttcttctattttttttttttttttgtagagatggggtcttgctatgttgcctgggctggtattgaactccgggcctcaagcaatcaatcctcttgcctcagcttcccagagggctgggatatacaggcctgggccacccacacccaaacagaggtttaaagagctttggagaaaccagcctcgtcctccagtctcttggttgtttgttttgagactgagtcttgctctgttgcccag

SEQ ID NO: 295608 - DNA, 2410 bp, Homo sapiens
  misc_feature (2220)..(2220): n is a, c, g, or t
  misc_feature (2281)..(2282): n is a, c, g, or t
atataaccgcgtggcccgcgcgcgcgcttccctcccggcgcagtcaccggcgcggtctatggctgcgacttctctaatgtctgctttggctgcccggctgctgcagcccgcgcacagctgctcccttcgccttcgccctttccacctcgcggcagttcgaaatgaagctgttgtcatttctggaaggaaactggcccagcagatcaagcaggaagtgcggcaggaggtagaagagtgggtggcctcaggcaacaaacggccacacctgagtgtgatcctggttggcgagaatcctgcaagtcactcctatgtcctcaacaaaaccagggcagctgcagttgtgggaatcaacagtgagacaattatgaaaccagcttcaatttcagaggaagaattgttgaatttaatcaataaactgaataatgatgataatgtagatggcctccttgttcagttgcctcttccagagcatattgatgagagaaggatctgcaatgctgtttctccagacaaggatgttgatggctttcatgtaattaatgtaggacgaatgtgtttggatcagtattccatgttaccggctactccatggggtgtgtgggaaataatcaagcgaactggcattccaaccctagggaagaatgtggttgtggctggaaggtcaaaaaacgttggaatgcccattgcaatgttactgcacacagatggggcgcatgaacgtcccggaggtgatgccactgttacaatatctcatcgatatactcccaaagagcagttgaagaaacatacaattcttgcagatattgtaatatctgctgcaggtattccaaatctgatcacagcagatatgatcaaggaaggagcagcagtcattgatgtgggaataaatagagttcacgatcctgtaactgccaaacccaagttggttggagatgtggattttgaaggagtcagacaaaaagctgggtatatcactccagttcctggaggtgttggccccatgacagtggcaatgctaatgaagaataccattattgctgcaaaaaaggtgctgaggcttgaagagcgagaagtgctgaagtctaaagagcttggggtagccactaattaactactgtgtcttctgtgtcacaaacagcactccaggccagctcaagaagcaaagcaggccaatagaaatgcaatatttttaatttattctactgaaatggtttaaaatgatgccttgtatttattgaaagcttaaatgggtgggtgtttctgcacatacctctgcagtacctcaccagggagcattccagtatcatgcagggtcctgtgatctagccaggagcagccattaacctagtgattaatatgggagacattaccatatggaggatggatgcttcactttgtcaagcacctcagttacacattcgccttttctaggattgcatttcccaagtgctattgcaataacagttgatactcattttaggtaccaaaccttttgagttcaactgatcaaaccaaaggaaaagtgttgctagagaaaattagggaaaaggtgaaaaagaaaaaatggtagtaattgagcagaaaaaaattaatttatatatgtattgattggcaaccagatttatctaagtagaactgaattggctaggaaaaaagaaaaactgcatgttaatcattttcctaagctgtccttttgaggcttagtcagtttattgggaaaatgtttaggattattccttgctattagtactcattttatgtatgttacccttcagtaagttctccccattttagttttctaggactgaaaggattcttttctacattatacatgtgtgttgtcatatttggcttttgctatatactttaacttcattgttaaatttttgtattgtatagtttctttggtgtatcttaaaacctatttttgaaaaacaaacttggcttgataatcatttgggcagcttgggtaagtacgcaacttacttttccaccaaagaactgtcagcagctgcctgcttttctgtgatgtatgtatcctgttgacttttccagaaattttttaagagtttgagttactattgaatttaatcagactttctgattaaagggttttctttcttttttaataaaacacatctgtctggtaaaaaaaaaaaaaaaaaaaaaaaaaaaaaaaaaaaaaaaaaaaaaaaaaaaaaaaaaaaaaaaaaaaaaaanaaaaataaaaaaaaacaaaaaaaaaacaaacaaaaaaaaaaaaaaaaaaaaaaactttttnncccttttccccacattttttaaattctgcaaatttttttcgcgccccaatttgggccttttggcaaatcccctataggggggggttaattccgtggcccgtttaaccggtgggttgggcccttggttc

SEQ ID NO: 295609 - DNA, 2325 bp, Homo sapiens
  misc_feature (2196)..(2197): n is a, c, g, or t
atataaccgcgtggcccgcgcgcgcgcttccctcccggcgcagtcaccggcgcggtctatggctgcgacttctctaatgtctgctttggctgcccggctgctgcagcccgcgcacagctgctcccttcgccttcgccctttccacctcgcggcagttcgaaatgaagctgttgtcatttctggaaggaaactggcccagcagatcaagcaggaagtgcggcaggaggtagaagagtgggtggcctcaggcaacaaacggccacacctgagtgtgatcctggttggcgagaatcctgcaagtcactcctatgtcctcaacaaaaccagggcagctgcagttgtgggaatcaacagtgagacaattatgaaaccagcttcaatttcagaggaagaattgttgaatttaatcaataaactgaataatgatgataatgtagatggcctccttgttcagttgcctcttccagagcatattgatgagagaaggatctgcaatgctgtttctccagacaaggatgttgatggctttcatgtaattaatgtaggacgaatgtgtttggatcagtattccatgttaccggctactccatggggtgtgtgggaaataatcaagcgaactggcattccaaccctagggaagaatgtggttgtggctggaaggtcaaaaaacgttggaatgcccattgcaatgttactgcacacagatggggcgcatgaacgtcccggaggtgatgccactgttacaatatctcatcgatatactcccaaagagcagttgaagaaacatacaattcttgcagatattgtaatatctgctgcaggtattccaaatctgatcacagcagatatgatcaaggaaggagcagcagtcattgatgtgggaataaatagagttcacgatcctgtaactgccaaacccaagttggttggagatgtggattttgaaggagtcagacaaaaagctgggtatatcactccagttcctggaggtgttggccccatgacagtggcaatgctaatgaagaataccattattgctgcaaaaaaggtgctgaggcttgaagagcgagaagtgctgaagtctaaagagcttggggtagccactaattaactactgtgtcttctgtgtcacaaacagcactccaggccagctcaagaagcaaagcaggccaatagaaatgcaatatttttaatttattctactgaaatggtttaaaatgatgccttgtatttattgaaagcttaaatgggtgggtgtttctgcacatacctctgcagtacctcaccagggagcattccagtatcatgcagggtcctgtgatctagccaggagcagccattaacctagtgattaatatgggagacattaccatatggaggatggatgcttcactttgtcaagcacctcagttacacattcgccttttctaggattgcatttcccaagtgctattgcaataacagttgatactcattttaggtaccaaaccttttgagttcaactgatcaaaccaaaggaaaagtgttgctagagaaaattagggaaaaggtgaaaaagaaaaaatggtagtaattgagcagaaaaaaattaatttatatatgtattgattggcaaccagatttatctaagtagaactgaattggctaggaaaaaagaaaaactgcatgttaatcattttcctaagctgtccttttgaggcttagtcagtttattgggaaaatgtttaggattattccttgctattagtactcattttatgtatgttacccttcagtaagttctccccattttagttttctaggactgaaaggattcttttctacattatacatgtgtgttgtcatatttggcttttgctatatactttaacttcattgttaaatttttgtattgtatagtttctttggtgtatcttaaaacctatttttgaaaaacaaacttggcttgataatcatttgggcagcttgggtaagtacgcaacttacttttccaccaaagaactgtcagcagctgcctgcttttctgtgatgtatgtatcctgttgacttttccagaaattttttaagagtttgagttactattgaatttaatcagactttctgattaaagggttttctttcttttttaataaaacacatctgtctggtaacaaaaaaaaaacaaacaaaaaaaaaaaaaaaaaaaaaaactttttnncccttttccccacattttttaaattctgcaaatttttttcgcgccccaatttgggccttttggcaaatcccctataggggggggttaattccgtggcccgtttaaccggtgggttgggcccttggttc

SEQ ID NO: 295610 - DNA, 2247 bp, Homo sapiens
atataaccgcgtggcccgcgcgcgcgcttccctcccggcgcagtcaccggcgcggtctatggctgcgacttctctaatgtctgctttggctgcccggctgctgcagcccgcgcacagctgctcccttcgccttcgccctttccacctcgcggcagttcggggaatctctccctaggtcaggttggagtgcagtgctgcaatcacggcttactgcagccttgacctcctgggctcaagtgatcctcccacctcagcttaaatgaagctgttgtcatttctggaaggaaactggcccagcagatcaagcaggaagtgcggcaggaggtagaagagtgggtggcctcaggcaacaaacggccacacctgagtgtgatcctggttggcgagaatcctgcaagtcactcctatgtcctcaacaaaaccagggcagctgcagttgtgggaatcaacagtgagacaattatgaaaccagcttcaatttcagaggaagaattgttgaatttaatcaataaactgaataatgatgataatgtagatggcctccttgttcagttgcctcttccagagcatattgatgagagaaggatctgcaatgctgtttctccagacaaggatgttgatggctttcatgtaattaatgtaggacgaatgtgtttggatcagtattccatgttaccggctactccatggggtgtgtgggaaataatcaagcgaactggcattccaaccctagggaagaatgtggttgtggctggaaggtcaaaaaacgttggaatgcccattgcaatgttactgcacacagatggggcgcatgaacgtcccggaggtgatgccactgttacaatatctcatcgatatactcccaaagagcagttgaagaaacatacaattcttgcagatattgtaatatctgctgcaggtattccaaatctgatcacagcagatatgatcaaggaaggagcagcagtcattgatgtgggaataaatagagttcacgatcctgtaactgccaaacccaagttggttggagatgtggattttgaaggagtcagacaaaaagctgggtatatcactccagttcctggaggtgttggccccatgacagtggcaatgctaatgaagaataccattattgctgcaaaaaaggtgctgaggcttgaagagcgagaagtgctgaagtctaaagagcttggggtagccactaattaactactgtgtcttctgtgtcacaaacagcactccaggccagctcaagaagcaaagcaggccaatagaaatgcaatatttttaatttattctactgaaatggtttaaaatgatgccttgtatttattgaaagcttaaatgggtgggtgtttctgcacatacctctgcagtacctcaccagggagcattccagtatcatgcagggtcctgtgatctagccaggagcagccattaacctagtgattaatatgggagacattaccatatggaggatggatgcttcactttgtcaagcacctcagttacacattcgccttttctaggattgcatttcccaagtgctattgcaataacagttgatactcattttaggtaccaaaccttttgagttcaactgatcaaaccaaaggaaaagtgttgctagagaaaattagggaaaaggtgaaaaagaaaaaatggtagtaattgagcagaaaaaaattaatttatatatgtattgattggcaaccagatttatctaagtagaactgaattggctaggaaaaaagaaaaactgcatgttaatcattttcctaagctgtccttttgaggcttagtcagtttattgggaaaatgtttaggattattccttgctattagtactcattttatgtatgttacccttcagtaagttctccccattttagttttctaggactgaaaggattcttttctacattatacatgtgtgttgtcatatttggcttttgctatatactttaacttcattgttaaatttttgtattgtatagtttctttggtgtatcttaaaacctatttttgaaaaacaaacttggcttgataatcatttgggcagcttgggtaagtacgcaacttacttttccaccaaagaactgtcagcagctgcctgcttttctgtgatgtatgtatcctgttgacttttccagaaattttttaagagtttgagttactattgaatttaatcagactttctgattaaagggttttctttcttttttaataaaacacatctgtctggta

SEQ ID NO: 295611 - DNA, 1964 bp, Homo sapiens
atataaccgcgtggcccgcgcgcgcgcttccctcccggcgcagtcaccggcgcggtctatggctgcgacttctctaatgtctgctttggctgcccggctgctgcagcccgcgcacagctgctcccttcgccttcgccctttccacctcgcggcagttcggaatcaacagtgagacaattatgaaaccagcttcaatttcagaggaagaattgttgaatttaatcaataaactgaataatgatgataatgtagatggcctccttgttcagttgcctcttccagagcatattgatgagagaaggatctgcaatgctgtttctccagacaaggatgttgatggctttcatgtaattaatgtaggacgaatgtgtttggatcagtattccatgttaccggctactccatggggtgtgtgggaaataatcaagcgaactggcattccaaccctagggaagaatgtggttgtggctggaaggtcaaaaaacgttggaatgcccattgcaatgttactgcacacagatggggcgcatgaacgtcccggaggtgatgccactgttacaatatctcatcgatatactcccaaagagcagttgaagaaacatacaattcttgcagatattgtaatatctgctgcaggtattccaaatctgatcacagcagatatgatcaaggaaggagcagcagtcattgatgtgggaataaatagagttcacgatcctgtaactgccaaacccaagttggttggagatgtggattttgaaggagtcagacaaaaagctgggtatatcactccagttcctggaggtgttggccccatgacagtggcaatgctaatgaagaataccattattgctgcaaaaaaggtgctgaggcttgaagagcgagaagtgctgaagtctaaagagcttggggtagccactaattaactactgtgtcttctgtgtcacaaacagcactccaggccagctcaagaagcaaagcaggccaatagaaatgcaatatttttaatttattctactgaaatggtttaaaatgatgccttgtatttattgaaagcttaaatgggtgggtgtttctgcacatacctctgcagtacctcaccagggagcattccagtatcatgcagggtcctgtgatctagccaggagcagccattaacctagtgattaatatgggagacattaccatatggaggatggatgcttcactttgtcaagcacctcagttacacattcgccttttctaggattgcatttcccaagtgctattgcaataacagttgatactcattttaggtaccaaaccttttgagttcaactgatcaaaccaaaggaaaagtgttgctagagaaaattagggaaaaggtgaaaaagaaaaaatggtagtaattgagcagaaaaaaattaatttatatatgtattgattggcaaccagatttatctaagtagaactgaattggctaggaaaaaagaaaaactgcatgttaatcattttcctaagctgtccttttgaggcttagtcagtttattgggaaaatgtttaggattattccttgctattagtactcattttatgtatgttacccttcagtaagttctccccattttagttttctaggactgaaaggattcttttctacattatacatgtgtgttgtcatatttggcttttgctatatactttaacttcattgttaaatttttgtattgtatagtttctttggtgtatcttaaaacctatttttgaaaaacaaacttggcttgataatcatttgggcagcttgggtaagtacgcaacttacttttccaccaaagaactgtcagcagctgcctgcttttctgtgatgtatgtatcctgttgacttttccagaaattttttaagagtttgagttactattgaatttaatcagactttctgattaaagggttttctttcttttttaataaaacacatctgtctggta

SEQ ID NO: 295612 - DNA, 2091 bp, Homo sapiens
atataaccgcgtggcccgcgcgcgcgcttccctcccggcgcagtcaccggcgcggtctatggctgcgacttctctaatgtctgctttggctgcccggctgctgcagcccgcgcacagctgctcccttcgccttcgccctttccacctcgcggcagttcgaaatgaagctgttgtcatttctggaaggaaactggcccagcagatcaagcaggaagtgcggcaggaggtagaagagtgggtggcctcaggcaacaaacggccacacctgagtgtgatcctggttggcgagaatcctgcaagtcactcctatgtcctcaacaaaaccagggcagctgcagttgtgggaatcaacagtgagacaattatgaaaccagcttcaatttcagaggaagaattgttgaatttaatcaataaactgaataatgatgataatgtagatggcctccttgttcagttgcctcttccagagcatattgatgagagaaggatctgcaatgctgtttctccagacaaggatgttgatggctttcatgtaattaatgtaggacgaatgtgtttggatcagtattccatgttaccggctactccatggggtgtgtgggaaataatcaagcgaactggcattccaaccctagggaagaatgtggttgtggctggaaggtcaaaaaacgtgatgccactgttacaatatctcatcgatatactcccaaagagcagttgaagaaacatacaattcttgcagatattgtaatatctgctgcaggtattccaaatctgatcacagcagatatgatcaaggaaggagcagcagtcattgatgtgggaataaatagagttcacgatcctgtaactgccaaacccaagttggttggagatgtggattttgaaggagtcagacaaaaagctgggtatatcactccagttcctggaggtgttggccccatgacagtggcaatgctaatgaagaataccattattgctgcaaaaaaggtgctgaggcttgaagagcgagaagtgctgaagtctaaagagcttggggtagccactaattaactactgtgtcttctgtgtcacaaacagcactccaggccagctcaagaagcaaagcaggccaatagaaatgcaatatttttaatttattctactgaaatggtttaaaatgatgccttgtatttattgaaagcttaaatgggtgggtgtttctgcacatacctctgcagtacctcaccagggagcattccagtatcatgcagggtcctgtgatctagccaggagcagccattaacctagtgattaatatgggagacattaccatatggaggatggatgcttcactttgtcaagcacctcagttacacattcgccttttctaggattgcatttcccaagtgctattgcaataacagttgatactcattttaggtaccaaaccttttgagttcaactgatcaaaccaaaggaaaagtgttgctagagaaaattagggaaaaggtgaaaaagaaaaaatggtagtaattgagcagaaaaaaattaatttatatatgtattgattggcaaccagatttatctaagtagaactgaattggctaggaaaaaagaaaaactgcatgttaatcattttcctaagctgtccttttgaggcttagtcagtttattgggaaaatgtttaggattattccttgctattagtactcattttatgtatgttacccttcagtaagttctccccattttagttttctaggactgaaaggattcttttctacattatacatgtgtgttgtcatatttggcttttgctatatactttaacttcattgttaaatttttgtattgtatagtttctttggtgtatcttaaaacctatttttgaaaaacaaacttggcttgataatcatttgggcagcttgggtaagtacgcaacttacttttccaccaaagaactgtcagcagctgcctgcttttctgtgatgtatgtatcctgttgacttttccagaaattttttaagagtttgagttactattgaatttaatcagactttctgattaaagggttttctttcttttttaataaaacacatctgtctggta

SEQ ID NO: 295613 - DNA, 1634 bp, Homo sapiens
ggacgcgtgggtcgacccacgcgtcggtaggacgaatgtgtttggatcagtattccatgttaccggctactccatggggtgtgtgggaaataatcaagcgaactggcattccaaccctagggaagaatgtggttgtggctggaaggtcaaaaaacgttggaatgcccattgcaatgttactgcacacagatggggcgcatgaacgtcccggaggtgatgccactgttacaatatctcatcgatatactcccaaagagcagttgaagaaacatacaattcttgcagatattgtaatatctgctgcaggtattccaaatctgatcacagcagatatgatcaaggaaggagcagcagtcattgatgtgggaataaatagagttcacgatcctgtaactgccaaacccaagttggttggagatgtggattttgaaggagtcagacaaaaagctgggtatatcactccagttcctggaggtgttggccccatgacagtggcaatgctaatgaagaataccattattgctgcaaaaaaggtgctgaggcttgaagagcgagaagtgctgaagtctaaagagcttggggtagccactaattaactactgtgtcttctgtgtcacaaacagcactccaggccagctcaagaagcaaagcaggccaatagaaatgcaatatttttaatttattctactgaaatggtttaaaatgatgccttgtatttattgaaagcttaaatgggtgggtgtttctgcacatacctctgcagtacctcaccagggagcattccagtatcatgcagggtcctgtgatctagccaggagcagccattaacctagtgattaatatgggagacattaccatatggaggatggatgcttcactttgtcaagcacctcagttacacattcgccttttctaggattgcatttcccaagtgctattgcaataacagttgatactcattttaggtaccaaaccttttgagttcaactgatcaaaccaaaggaaaagtgttgctagagaaaattagggaaaaggtgaaaaagaaaaaatggtagtaattgagcagaaaaaaattaatttatatatgtattgattggcaaccagatttatctaagtagaactgaattggctaggaaaaaagaaaaactgcatgttaatcattttcctaagctgtccttttgaggcttagtcagtttattgggaaaatgtttaggattattccttgctattagtactcattttatgtatgttacccttcagtaagttctccccattttagttttctaggactgaaaggattcttttctacattatacatgtgtgttgtcatatttggcttttgctatatactttaacttcattgttaaatttttgtattgtatagtttctttggtgtatcttaaaacctatttttgaaaaacaaacttggcttgataatcatttgggcagcttgggtaagtacgcaacttacttttccaccaaagaactgtcagcagctgcctgcttttctgtgatgtatgtatcctgttgacttttccagaaattttttaagagtttgagttactattgaatttaatcagactttctgattaaagggttttctttcttttttaataaaacacatctgtctggta

SEQ ID NO: 295614 - DNA, 1556 bp, Homo sapiens
aaaaaaaaaaaaaaaaaaaaaaaaaaagcattccaaccctagggaagaatgtggttgtggctggaaggtcaaaaaacgttggaatgcccattgcaatgttactgcacacagatggggcgcatgaacgtcccggaggtgatgccactgttacaatatctcatcgatatactcccaaagagcagttgaagaaacatacaattcttgcagatattgtaatatctgctgcaggtattccaaatctgatcacagcagatatgatcaaggaaggagcagcagtcattgatgtgggaataaatagagttcacgatcctgtaactgccaaacccaagttggttggagatgtggattttgaaggagtcagacaaaaagctgggtatatcactccagttcctggaggtgttggccccatgacagtggcaatgctaatgaagaataccattattgctgcaaaaaaggtgctgaggcttgaagagcgagaagtgctgaagtctaaagagcttggggtagccactaattaactactgtgtcttctgtgtcacaaacagcactccaggccagctcaagaagcaaagcaggccaatagaaatgcaatatttttaatttattctactgaaatggtttaaaatgatgccttgtatttattgaaagcttaaatgggtgggtgtttctgcacatacctctgcagtacctcaccagggagcattccagtatcatgcagggtcctgtgatctagccaggagcagccattaacctagtgattaatatgggagacattaccatatggaggatggatgcttcactttgtcaagcacctcagttacacattcgccttttctaggattgcatttcccaagtgctattgcaataacagttgatactcattttaggtaccaaaccttttgagttcaactgatcaaaccaaaggaaaagtgttgctagagaaaattagggaaaaggtgaaaaagaaaaaatggtagtaattgagcagaaaaaaattaatttatatatgtattgattggcaaccagatttatctaagtagaactgaattggctaggaaaaaagaaaaactgcatgttaatcattttcctaagctgtccttttgaggcttagtcagtttattgggaaaatgtttaggattattccttgctattagtactcattttatgtatgttacccttcagtaagttctccccattttagttttctaggactgaaaggattcttttctacattatacatgtgtgttgtcatatttggcttttgctatatactttaacttcattgttaaatttttgtattgtatagtttctttggtgtatcttaaaacctatttttgaaaaacaaacttggcttgataatcatttgggcagcttgggtaagtacgcaacttacttttccaccaaagaactgtcagcagctgcctgcttttctgtgatgtatgtatcctgttgacttttccagaaattttttaagagtttgagttactattgaatttaatcagactttctgattaaagggttttctttcttttttaataaaacacatctgtctggta

SEQ ID NO: 295615 - DNA, 1368 bp, Homo sapiens
gaaggagcagcagtcattgatgtgggaatatctgctgcaggtattccaaatctgatcacagcagatatgatcaaggaaggagcagcagtcattgatgtgggaataaatagagttcacgatcctgtaactgccaaacccaagttggttggagatgtggattttgaaggagtcagacaaaaagctgggtatatcactccagttcctggaggtgttggccccatgacagtggcaatgctaatgaagaataccattattgctgcaaaaaaggtgctgaggcttgaagagcgagaagtgctgaagtctaaagagcttggggtagccactaattaactactgtgtcttctgtgtcacaaacagcactccaggccagctcaagaagcaaagcaggccaatagaaatgcaatatttttaatttattctactgaaatggtttaaaatgatgccttgtatttattgaaagcttaaatgggtgggtgtttctgcacatacctctgcagtacctcaccagggagcattccagtatcatgcagggtcctgtgatctagccaggagcagccattaacctagtgattaatatgggagacattaccatatggaggatggatgcttcactttgtcaagcacctcagttacacattcgccttttctaggattgcatttcccaagtgctattgcaataacagttgatactcattttaggtaccaaaccttttgagttcaactgatcaaaccaaaggaaaagtgttgctagagaaaattagggaaaaggtgaaaaagaaaaaatggtagtaattgagcagaaaaaaattaatttatatatgtattgattggcaaccagatttatctaagtagaactgaattggctaggaaaaaagaaaaactgcatgttaatcattttcctaagctgtccttttgaggcttagtcagtttattgggaaaatgtttaggattattccttgctattagtactcattttatgtatgttacccttcagtaagttctccccattttagttttctaggactgaaaggattcttttctacattatacatgtgtgttgtcatatttggcttttgctatatactttaacttcattgttaaatttttgtattgtatagtttctttggtgtatcttaaaacctatttttgaaaaacaaacttggcttgataatcatttgggcagcttgggtaagtacgcaacttacttttccaccaaagaactgtcagcagctgcctgcttttctgtgatgtatgtatcctgttgacttttccagaaattttttaagagtttgagttactattgaatttaatcagactttctgattaaagggttttctttcttttttaataaaacacatctgtctggta

SEQ ID NO: 295616 - DNA, 1224 bp, Homo sapiens
atataaccgcgtggcccgcgcgcgcgcttccctcccggcgcagtcaccggcgcggtctatggctgcgacttctctaatgtctgctttggctgcccggctgctgcagcccgcgcacagctgctcccttcgccttcgccctttccacctcgcggcagttcgaaatgaagctgttgtcatttctggaaggaaactggcccagcagatcaagcaggaagtgcggcaggaggtagaagagtgggtggcctcaggcaacaaacggccacacctgagtgtgatcctggttggcgagaatcctgcaagtcactcctatgtcctcaacaaaaccagggcagctgcagttgtgggaatcaacagtgagacaattatgaaaccagcttcaatttcagaggaagaattgttgaatttaatcaataaactgaataatgatgataatgtagatggcctccttgttcagttgcctcttccagagcatattgatgagagaaggatctgcaatgctgtttctccagacaaggatgttgatggctttcatgtaattaatgtaggacgaatgtgtttggatcagtattccatgttaccggctactccatggggtgtgtgggaaataatcaagcgaactggcattccaaccctagggaagaatgtggttgtggctggaaggtcaaaaaacgttggaatgcccattgcaatgttactgcacacagatggggcgcatgaacgtcccggaggtgatgccactgttacaatatctcatcgatatactcccaaagagcagttgaagaaacatacaattcttgcagatattgtaatatctgctgcaggtattccaaatctgatcacagcagatatgatcaaggaaggagcagcagtcattgatgtgggaataaatagagttcacgatcctgtaactgccaaacccaagttggttggagatgtggattttgaaggagtcagacaaaaagctgggtatatcactccagttcctggaggtgttggccccatgacagtggcaatgctaatgaagaataccattattgctgcagcccgcgcacagctgctcccttcgccttcgccctttccacctcgcggcagttcgaaatgaagctgttgtcatttctggaaggaaactggcccagcagatcaagcaggaagtgcggcaggaggtagaagagtgggtgcctcaggcaacaaacggccacacctgagtgtgatccagctatcttc

SEQ ID NO: 295617 - DNA, 955 bp, Homo sapiens
gctgaggtcgttccagaggataccctgttagactataaagttgaaagcttaaatgggtgggtgtttctgcacatacctctgcagtacctcaccagggagcattccagtatcatgcagggtcctgtgatctagccaggagcagccattaacctagtgattaatatgggagacattaccatatggaggatggatgcttcactttgtcaagcacctcagttacacattcgccttttctaggattgcatttcccaagtgctattgcaataacagttgatactcattttaggtaccaaaccttttgagttcaactgatcaaaccaaaggaaaagtgttgctagagaaaattagggaaaaggtgaaaaagaaaaaatggtagtaattgagcagaaaaaaattaatttatatatgtattgattggcaaccagatttatctaagtagaactgaattggctaggaaaaaagaaaaactgcatgttaatcattttcctaagctgtccttttgaggcttagtcagtttattgggaaaatgtttaggattattccttgctattagtactcattttatgtatgttacccttcagtaagttctccccattttagttttctaggactgaaaggattcttttctacattatacatgtgtgttgtcatatttggcttttgctatatactttaacttcattgttaaatttttgtattgtatagtttctttggtgtatcttaaaacctatttttgaaaaacaaacttggcttgataatcatttgggcagcttgggtaagtacgcaacttacttttccaccaaagaactgtcagcagctgcctgcttttctgtgatgtatgtatcctgttgacttttccagaaattttttaagagtttgagttactattgaatttaatcagactttctgattaaagggttttctttcttttttaataaaacacatctgtctggta

SEQ ID NO: 295618 - DNA, 1109 bp, Homo sapiens
atataaccgcgtggcccgcgcgcgcgcttccctcccggcgcagtcaccggcgcggtctatggctgcgacttctctaatgtctgctttggctgcccggctgctgcagcccgcgcacagctgctcccttcgccttcgccctttccacctcgcggcagttcgaaatgaagctgttgtcatttctggaaggaaactggcccagcagatcaagcaggaagtgcggcaggaggtagaagagtgggtggcctcaggcaacaaacggccacacctgagtgtgatcctggttggcgagaatcctgcaagtcactcctatgtcctcaacaaaaccagggcagctgcagttgtgggaatcaacagtgagacaattatgaaaccagcttcaatttcagaggaagaattgttgaatttaatcaataaactgaataatgatgataatgtagatggcctccttgttcagttgcctcttccagagcatattgatgagagaaggatctgcaatgctgtttctccagacaaggatgttgatggctttcatgtaattaatgtaggacgaatgtgtttggatcagtattccatgttaccggctactccatggggtgtgtgggaaataatcaagcgaactggcattccaaccctagggaagaatgtggttgtggctggaaggtcaaaaaacgttggaatgcccattgcaatgttactgcacacagatggggcgcatgaacgtcccggaggtgatgccactgttacaatatctcatcgatatactcccaaagagcagttgaagaaacatacaattcttgcagatattgtaatatctgctgcaggtattccaaatctgatcacagcagatatgatcaaggaaggagcagcagtcattgatgtgggaataaatagagttcacgatcctgtaactgccaaacccaagttggttggagatgtggattttgaagatgggagtctcactctgttgcccaggctggagtgcagtggcgcgatctcggctcactgcaacctctgcctcctgggttcaagctattcttctgcctcagcctcccgagtagctgggactcccaaagtgttgggattataggtgtgagccactgcgcccagtc

SEQ ID NO: 295619 - DNA, 782 bp, Homo sapiens
cctagttttagaagtttcaatagcactttgtcaagcacctcagttacacattcgccttttctaggattgcatttcccaagtgctattgcaataacagttgatactcattttaggtaccaaaccttttgagttcaactgatcaaaccaaaggaaaagtgttgctagagaaaattagggaaaaggtgaaaaagaaaaaatggtagtaattgagcagaaaaaaattaatttatatatgtattgattggcaaccagatttatctaagtagaactgaattggctaggaaaaaagaaaaactgcatgttaatcattttcctaagctgtccttttgaggcttagtcagtttattgggaaaatgtttaggattattccttgctattagtactcattttatgtatgttacccttcagtaagttctccccattttagttttctaggactgaaaggattcttttctacattatacatgtgtgttgtcatatttggcttttgctatatactttaacttcattgttaaatttttgtattgtatagtttctttggtgtatcttaaaacctatttttgaaaaacaaacttggcttgataatcatttgggcagcttgggtaagtacgcaacttacttttccaccaaagaactgtcagcagctgcctgcttttctgtgatgtatgtatcctgttgacttttccagaaattttttaagagtttgagttactattgaatttaatcagactttctgattaaagggttttctttcttttttaataaaacacatctgtctggta

SEQ ID NO: 295620 - DNA, 656 bp, Homo sapiens
atataaccgcgtggcccgcgcgcgcgcttccctcccggcgcagtcaccggcgcggtctatggctgcgacttctctaatgtctgctttggctgcccggctgctgcagcccgcgcacagctgctcccttcgccttcgccctttccacctcgcggcagttcgaaatgaagctgttgtcatttctggaaggaaactggcccagcagatcaagcaggaagtgcggcaggaggtagaagagtgggtggcctcaggcaacaaacggccacacctgagtgtgatcctggttggcgagaatcctgcaagtcactcctatgtcctcaacaaaaccagggcagctgcagttgtgggaatcaacagtgagacaattatgaaaccagcttcaatttcagaggaagaattgttgaatttaatcaataaactgaataatgatgataatgtagatggcctccttgttcagttgcctcttccagagcatattgatgagagaaggatctgcaatgctgtttctccagacaaggatgttgatggctttcatgtaattaatgtaggacgaatgtgtttggatcagtattccatgttaccggctactccatggggtgtgtgggaaataatcaagcgaactgattccaccctagggagagtcagcgttgtgtaccgcc

SEQ ID NO: 295621 - DNA, 763 bp, Homo sapiens
atataaccgcgtggcccgcgcgcgcgcttccctcccggcgcagtcaccggcgcggtctatggctgcgacttctctaatgtctgctttggctgcccggctgctgcagcccgcgcacagctgctcccttcgccttcgccctttccacctcgcggcagttcgaaatgaagctgttgtcatttctggaaggaaactggcccagcagatcaagcaggaagtgcggcaggaggtagaagagtgggtggcctcaggcaacaaacggccacacctgagtgtgatcctggttggcgagaatcctgcaagtcactcctatgtcctcaacaaaaccagggcagctgcagttgtgggaaacccaagcagaggaggctaatgtgattgaactgtatcccaaaactttgtcataggaaatcagactatatctttcggggtttatacagtaggacaggagatactggaatcaacagtgagacaattatgaaaccagcttcaatttcagaggaagaattgttgaatttaatcaataaactgaataatgatgataatgtagatggcctccttgttcagttgcctcttccagagcatattgatgagagaaggatctgcaatgctgtttctccagacaaggatgttgatggctttcatgtaattaatgtaggacgaatgtgtttggatcagtattccatgttaccggctactccatggggtgtgtgggaaataatcaagcgaactgattccaccctagggagagtcagcgttgtgtaccgcc

SEQ ID NO: 295622 - DNA, 949 bp, Homo sapiens
acaaaaggaaatactgccttctgtaaaagaacataatttctggataagtaaaactatttctttaaaaagtatgttctcaaatgagaacatcaaaatactgggaatattctgaataatacaagtactctttaagtagatttgttaatttttttttcccccaggaaaaaaatgttcattttgtgctgtgtcttacctctactaggaagaggaaagtttgagattggaagattttggactaagttttaaatagtaccaccagggaaaaattaggcagttggttcatacgagcaacaaacttcagctaaaactcatggcctctggaacatgcttcttatctaatgcttctgataatttagatctgtgataagccatttaattcatgatttctcaaaaggacattttgcaaaaacgttattctcaatgataatttcttaaaaattttcagtgatttcagaggacgagtacgttgaaccaagagtacaccagcacagtctaagttgtagagatggattgtgagcatgtgactggttttcttgttcttccaaggtcgccagagaaccttccagttaaaacctaacttccacgtaacttgcctacagagagagggacaacagacttgagtgtctgatcacttgacagttacagttttcattgtaacatagtaatttgatgttgaggtttatacagttaaattacagaaatacttaagttatatcctttcctccagtattaactaaagatacatatatgtaaacagtcatagtataggagaagataagggaaagctgacaggactcatgcagtggctcacagctgtaagcttaactactcaggaggctgagacttggaggatcgcttatatccaggagttggaggctgccgttagctatggttgcatcactggactctagcctaaactatagagtgaggctctgtttcaagaaaaaaa

SEQ ID NO: 295623 - DNA, 1949 bp, Homo sapiens
gccctcccaggagaagctgaaggactttcctgtgtgcgtgagcaccaagccggagcccgaggacgatgcagaagagggacttgggggtcttcccagcaacatcagctctgtcagctccttgctgctcttcaacaccaccgagaacctgtacaagaagtatgtcttcctggaccccctggctggtgctgtaacaaagacccatgtgatgctgggggcagagacagaggagaagctgtttgatgcccccttgtccatcagcaagagagagcagctggaacagcaggtcccagagaactacttctatgtgccagacctgggccaggtgcctgagattgatgttccatcctacctgcctgacctgcccggcattgccaacgacctcatgtacattgccgacctgggccccggcattgccccctctgcccctggcaccattccagaactgcccaccttccacactgaggtagccgagcctctcaagacctacaagatggggtactaacaccacccccaccgcccccaccaccacccccagctcctgaggtgctggccagtgcacccccactcccaccctcaaccgcggcccctgtaggccaaggcgccaggcaggacgacagcagcagcagcgcatctccttcaggtgggagcagctctttgaggccacctgatttctggcgtgctcagtgcactcgggtggattttctgtgggtttgttaagtggtcagaaattctcaattttttgaatagtttccatttcaaatatcttgttctacttggttcataaaatagtggctttcaaactgtagagctctggacttctcacttctagggcagagggagcctgaacaagtgaggctctgggttcctcattcctaattaaaccaatggaaagaaggggtctaataacaaactacagcaacacatttttcatttcagcttcactgctgtatctcccagtgtaaccctagcatccagaagtggcacaaaacccctctgctggctcatgtgtgcaactgagactgtcagagcatggctagctcaggggtccagctctgcagggtgagggctagagaggaagcagggagtatctgcacacaggatgcccgcgctcaggtggttgccgaagtcagtgcccgggccccacacagtctccaaaggtccggcctccccagcgcggggctcctcgtttgaggggaggtgacttccctcccagcaggctcttggacacagtaagcttccccagccctgcctgagcagcctttcctccttgccctgttccccacctcccggctccagtccagggagctcccagggaagtggtcgacccctccggtggctgggccactctgctagagtccatccgccaagctgggggcatcggcaaggccaagctgcgcagcatgaaggagcgaaagctggagaagcagcagcagaaggagcaggagcaagtgagagccacgagccaaggtgggcacttgatgtcggatctcttcaacaagctggtcatgaggcgcaagggcatctctgggaaaggacctggggctggtgaggggcccggaggagcctttgcccgcgtgtcagactccatccctcctctgccgccaccgcagcagccacaggcagaggaggacgaggacgactgggaatcgtagggggctccatgacaccttcccccccagacccagacttgggccattgctctgacatggacacagccaggacaagctgctcagacctgcttccctgggtgggggtgacggaaccagcactgtgcggagaccagcttcaaggagcggaaggctggcctgaggccacacagctggggcggggacttctgtctgcctgtgctccatggggggacggctccacccagcctgcgccactgtgttcttctctaaagaggcttccagagaaaatggcacaccaatcaataaagaactgagcagaaa

SEQ ID NO: 295624 - DNA, 1835 bp, Homo sapiens
cccccgcaggtatccccgaggaaacagtatgccatgattcaaaatcgagctgggtaccgtgggtgatacagatggcacaaagacccatgtgatgctgggggcagagacagaggagaagctgtttgatgcccccttgtccatcagcaagagagagcagctggaacagcaggtcccagagaactacttctatgtgccagacctgggccaggtgcctgagattgatgttccatcctacctgcctgacctgcccggcattgccaacgacctcatgtacattgccgacctgggccccggcattgccccctctgcccctggcaccattccagaactgcccaccttccacactgaggtagccgagcctctcaagacctacaagatggggtactaacaccacccccaccgcccccaccaccacccccagctcctgaggtgctggccagtgcacccccactcccaccctcaaccgcggcccctgtaggccaaggcgccaggcaggacgacagcagcagcagcgcatctccttcaggtgggagcagctctttgaggccacctgatttctggcgtgctcagtgcactcgggtggattttctgtgggtttgttaagtggtcagaaattctcaattttttgaatagtttccatttcaaatatcttgttctacttggttcataaaatagtggctttcaaactgtagagctctggacttctcacttctagggcagagggagcctgaacaagtgaggctctgggttcctcattcctaattaaaccaatggaaagaaggggtctaataacaaactacagcaacacatttttcatttcagcttcactgctgtatctcccagtgtaaccctagcatccagaagtggcacaaaacccctctgctggctcatgtgtgcaactgagactgtcagagcatggctagctcaggggtccagctctgcagggtgagggctagagaggaagcagggagtatctgcacacaggatgcccgcgctcaggtggttgccgaagtcagtgcccgggccccacacagtctccaaaggtccggcctccccagcgcggggctcctcgtttgaggggaggtgacttccctcccagcaggctcttggacacagtaagcttccccagccctgcctgagcagcctttcctccttgccctgttccccacctcccggctccagtccagggagctcccagggaagtggtcgacccctccggtggctgggccactctgctagagtccatccgccaagctgggggcatcggcaaggccaagctgcgcagcatgaaggagcgaaagctggagaagcagcagcagaaggagcaggagcaagtgagagccacgagccaaggtgggcacttgatgtcggatctcttcaacaagctggtcatgaggcgcaagggcatctctgggaaaggacctggggctggtgaggggcccggaggagcctttgcccgcgtgtcagactccatccctcctctgccgccaccgcagcagccacaggcagaggaggacgaggacgactgggaatcgtagggggctccatgacaccttcccccccagacccagacttgggccattgctctgacatggacacagccaggacaagctgctcagacctgcttccctgggtgggggtgacggaaccagcactgtgcggagaccagcttcaaggagcggaaggctggcctgaggccacacagctggggcggggacttctgtctgcctgtgctccatggggggacggctccacccagcctgcgccactgtgttcttctctaaagaggcttccagagaaaatggcacaccaatcaataaagaactgagcagaaa

SEQ ID NO: 295625 - DNA, 1293 bp, Homo sapiens
gccctcccaggagaagctgaaggactttcctgtgtgcgtgagcaccaagccggagcccgaggacgatgcagaagagggacttgggggtcttcccagcaacatcagctctgtcagctccttgctgctcttcaacaccaccgagaacctgtacaagaagtatgtcttcctggaccccctggctggtgctgtaacaaagacccatgtgatgctgggggcagagacagaggagaagctgtttgatgcccccttgtccatcagcaagagagagcagctggaacagcaggtcccagagaactacttctatgtgccagacctgggccaggtgcctgagattgatgttccatcctacctgcctgacctgcccggcattgccaacgacctcatgtacattgccgacctgggccccggcattgccccctctgcccctggcaccattccagaactgcccaccttccacactgaggtagccgagcctctcaagacctacaagatggggtactaacaccacccccaccgcccccaccaccacccccagctcctgaggtgctggccagtgcacccccactcccaccctcaaccgcggcccctgtaggccaaggcgccaggcaggacgacagcagcagcagcgcatctccttcagtccagggagctcccagggaagtggtcgacccctccggtggctgggccactctgctagagtccatccgccaagctgggggcatcggcaaggccaagctgcgcagcatgaaggagcgaaagctggagaagcagcagcagaaggagcaggagcaagtgagagccacgagccaaggtgggcacttgatgtcggatctcttcaacaagctggtcatgaggcgcaagggcatctctgggaaaggacctggggctggtgaggggcccggaggagcctttgcccgcgtgtcagactccatccctcctctgccgccaccgcagcagccacaggcagaggaggacgaggacgactgggaatcgtagggggctccatgacaccttcccccccagacccagacttgggccattgctctgacatggacacagccaggacaagctgctcagacctgcttccctgggtgggggtgacggaaccagcactgtgcggagaccagcttcaaggagcggaaggctggcctgaggccacacagctggggcggggacttctgtctgcctgtgctccatggggggacggctccacccagcctgcgccactgtgttcttctctaaagaggcttccagagaaaatggcacaccaatcaataaagaactgagcagaaa

SEQ ID NO: 295626 - DNA, 1972 bp, Homo sapiens
gccctcccaggagaagctgaaggactttcctgtgtgcgtgagcaccaagccggagcccgaggacgatgcagaagagggacttgggggtcttcccagcaacatcagctctgtcagctccttgctgctcttcaacaccaccgagaacctgtacaagaagtatgtcttcctggaccccctggctggtgctgtaacaaagacccatgtgatgctgggggcagagacagaggagaagctgtttgatgcccccttgtccatcagcaagagagagcagctggaacagcaggtcccagagaactacttctatgtgccagacctgggccaggtgcctgagattgatgttccatcctacctgcctgacctgcccggcattgccaacgacctcatgtacattgccgacctgggccccggcattgccccctctgcccctggcaccattccagaactgcccaccttccacactgaggtagccgagcctctcaagacaccccacactttgtgtttcagacctacaagatggggtactaacaccacccccaccgcccccaccaccacccccagctcctgaggtgctggccagtgcacccccactcccaccctcaaccgcggcccctgtaggccaaggcgccaggcaggacgacagcagcagcagcgcatctccttcaggtgggagcagctctttgaggccacctgatttctggcgtgctcagtgcactcgggtggattttctgtgggtttgttaagtggtcagaaattctcaattttttgaatagtttccatttcaaatatcttgttctacttggttcataaaatagtggctttcaaactgtagagctctggacttctcacttctagggcagagggagcctgaacaagtgaggctctgggttcctcattcctaattaaaccaatggaaagaaggggtctaataacaaactacagcaacacatttttcatttcagcttcactgctgtatctcccagtgtaaccctagcatccagaagtggcacaaaacccctctgctggctcatgtgtgcaactgagactgtcagagcatggctagctcaggggtccagctctgcagggtgagggctagagaggaagcagggagtatctgcacacaggatgcccgcgctcaggtggttgccgaagtcagtgcccgggccccacacagtctccaaaggtccggcctccccagcgcggggctcctcgtttgaggggaggtgacttccctcccagcaggctcttggacacagtaagcttccccagccctgcctgagcagcctttcctccttgccctgttccccacctcccggctccagtccagggagctcccagggaagtggtcgacccctccggtggctgggccactctgctagagtccatccgccaagctgggggcatcggcaaggccaagctgcgcagcatgaaggagcgaaagctggagaagcagcagcagaaggagcaggagcaagtgagagccacgagccaaggtgggcacttgatgtcggatctcttcaacaagctggtcatgaggcgcaagggcatctctgggaaaggacctggggctggtgaggggcccggaggagcctttgcccgcgtgtcagactccatccctcctctgccgccaccgcagcagccacaggcagaggaggacgaggacgactgggaatcgtagggggctccatgacaccttcccccccagacccagacttgggccattgctctgacatggacacagccaggacaagctgctcagacctgcttccctgggtgggggtgacggaaccagcactgtgcggagaccagcttcaaggagcggaaggctggcctgaggccacacagctggggcggggacttctgtctgcctgtgctccatggggggacggctccacccagcctgcgccactgtgttcttctctaaagaggcttccagagaaaatggcacaccaatcaataaagaactgagcagaaa

SEQ ID NO: 295627 - DNA, 1813 bp, Homo sapiens
gccctcccaggagaagctgaaggactttcctgtgtgcgtgagcaccaagccggagcccgaggacgatgcagaagagggacttgggggtcttcccagcaacatcagctctgtcagctccttgctgctcttcaacaccaccgagaacctgtcccagagaactacttctatgtgccagacctgggccaggtgcctgagattgatgttccatcctacctgcctgacctgcccggcattgccaacgacctcatgtacattgccgacctgggccccggcattgccccctctgcccctggcaccattccagaactgcccaccttccacactgaggtagccgagcctctcaagacctacaagatggggtactaacaccacccccaccgcccccaccaccacccccagctcctgaggtgctggccagtgcacccccactcccaccctcaaccgcggcccctgtaggccaaggcgccaggcaggacgacagcagcagcagcgcatctccttcaggtgggagcagctctttgaggccacctgatttctggcgtgctcagtgcactcgggtggattttctgtgggtttgttaagtggtcagaaattctcaattttttgaatagtttccatttcaaatatcttgttctacttggttcataaaatagtggctttcaaactgtagagctctggacttctcacttctagggcagagggagcctgaacaagtgaggctctgggttcctcattcctaattaaaccaatggaaagaaggggtctaataacaaactacagcaacacatttttcatttcagcttcactgctgtatctcccagtgtaaccctagcatccagaagtggcacaaaacccctctgctggctcatgtgtgcaactgagactgtcagagcatggctagctcaggggtccagctctgcagggtgagggctagagaggaagcagggagtatctgcacacaggatgcccgcgctcaggtggttgccgaagtcagtgcccgggccccacacagtctccaaaggtccggcctccccagcgcggggctcctcgtttgaggggaggtgacttccctcccagcaggctcttggacacagtaagcttccccagccctgcctgagcagcctttcctccttgccctgttccccacctcccggctccagtccagggagctcccagggaagtggtcgacccctccggtggctgggccactctgctagagtccatccgccaagctgggggcatcggcaaggccaagctgcgcagcatgaaggagcgaaagctggagaagcagcagcagaaggagcaggagcaagtgagagccacgagccaaggtgggcacttgatgtcggatctcttcaacaagctggtcatgaggcgcaagggcatctctgggaaaggacctggggctggtgaggggcccggaggagcctttgcccgcgtgtcagactccatccctcctctgccgccaccgcagcagccacaggcagaggaggacgaggacgactgggaatcgtagggggctccatgacaccttcccccccagacccagacttgggccattgctctgacatggacacagccaggacaagctgctcagacctgcttccctgggtgggggtgacggaaccagcactgtgcggagaccagcttcaaggagcggaaggctggcctgaggccacacagctggggcggggacttctgtctgcctgtgctccatggggggacggctccacccagcctgcgccactgtgttcttctctaaagaggcttccagagaaaatggcacaccaatcaataaagaactgagcagaaa

SEQ ID NO: 295628 - DNA, 1892 bp, Homo sapiens
ctaagttgtggctgcgccataggtgtttccttacctacgttgtttgctttaagtgcaggttttcattctttagggccctctattttcctttctctacttttttcccttctccatgtcatcgtcttttctgtgctgttattccacccatgggaggtgcacacaaggtcttgttggctgcccctgcaggtccctgtcacctctcacatgtccctgcctaatcttgcaggtcccagagaactacttctatgtgccagacctgggccaggtgcctgagattgatgttccatcctacctgcctgacctgcccggcattgccaacgacctcatgtacattgccgacctgggccccggcattgccccctctgcccctggcaccattccagaactgcccaccttccacactgaggtagccgagcctctcaagacctacaagatggggtactaacaccacccccaccgcccccaccaccacccccagctcctgaggtgctggccagtgcacccccactcccaccctcaaccgcggcccctgtaggccaaggcgccaggcaggacgacagcagcagcagcgcatctccttcaggtgggagcagctctttgaggccacctgatttctggcgtgctcagtgcactcgggtggattttctgtgggtttgttaagtggtcagaaattctcaattttttgaatagtttccatttcaaatatcttgttctacttggttcataaaatagtggctttcaaactgtagagctctggacttctcacttctagggcagagggagcctgaacaagtgaggctctgggttcctcattcctaattaaaccaatggaaagaaggggtctaataacaaactacagcaacacatttttcatttcagcttcactgctgtatctcccagtgtaaccctagcatccagaagtggcacaaaacccctctgctggctcatgtgtgcaactgagactgtcagagcatggctagctcaggggtccagctctgcagggtgagggctagagaggaagcagggagtatctgcacacaggatgcccgcgctcaggtggttgccgaagtcagtgcccgggccccacacagtctccaaaggtccggcctccccagcgcggggctcctcgtttgaggggaggtgacttccctcccagcaggctcttggacacagtaagcttccccagccctgcctgagcagcctttcctccttgccctgttccccacctcccggctccagtccagggagctcccagggaagtggtcgacccctccggtggctgggccactctgctagagtccatccgccaagctgggggcatcggcaaggccaagctgcgcagcatgaaggagcgaaagctggagaagcagcagcagaaggagcaggagcaagtgagagccacgagccaaggtgggcacttgatgtcggatctcttcaacaagctggtcatgaggcgcaagggcatctctgggaaaggacctggggctggtgaggggcccggaggagcctttgcccgcgtgtcagactccatccctcctctgccgccaccgcagcagccacaggcagaggaggacgaggacgactgggaatcgtagggggctccatgacaccttcccccccagacccagacttgggccattgctctgacatggacacagccaggacaagctgctcagacctgcttccctgggtgggggtgacggaaccagcactgtgcggagaccagcttcaaggagcggaaggctggcctgaggccacacagctggggcggggacttctgtctgcctgtgctccatggggggacggctccacccagcctgcgccactgtgttcttctctaaagaggcttccagagaaaatggcacaccaatcaataaagaactgagcagaaa

SEQ ID NO: 295629 - DNA, 1989 bp, Homo sapiens
gccctcccaggagaagctgaaggactttcctgtgtgcgtgagcaccaagccggagcccgaggacgatgcagaagagggacttgggggtcttcccagcaacatcagctctgtcagctccttgctgctcttcaacaccaccgagaacctgtacaagaagtatgtcttcctggaccccctggctggtgctgtaacaaagacccatgtgatgctgggggcagagacagaggagaagctgtttgatgcccccttgtccatcagcaagagagagcagctggaacagcaggtcccagagaactacttctatgtgccagacctgggccaggtgcctgagattgatgttccatcctacctgcctgacctgcccggcattgccaacgacctcatgtacattgccgacctgggccccggcattgccccctctgcccctggcaccattccagaactgcccaccttccacactgaggtagccgagcctctcaagacctacaagatggggtactaacaccacccccaccgcccccaccaccacccccagctcctgaggtgctggccagtgcacccccactcccaccctcaaccgcggcccctgtaggccaaggcgccaggcaggacgacagcagcagcagcgcatctccttcaggtgggagcagctctttgaggccacctgatttctggcgtgctcagtgcactcgggtggattttctgtgggtttgttaagtggtcagaaattctcaattttttgaatagtttccatttcaaatatcttgttctacttggttcataaaatagtggctttcaaactgtagagctctggacttctcacttctagggcagagggagcctgaacaagtgaggctctgggttcctcattcctaattaaaccaatggaaagaaggggtctaataacaaactacagcaacacatttttcatttcagcttcactgctgtatctcccagtgtaaccctagcatccagaagtggcacaaaacccctctgctggctcatgtgtgcaactgagactgtcagagcatggctagctcaggggtccagctctgcagggtgagggctagagaggaagcagggagtatctgcacacaggatgcccgcgctcaggtggttgccgaagtcagtgcccgggccccacacagtctccaaaggtccggcctccccagcgcggggctcctcgtttgaggggaggtgacttccctcccagcaggctcttggacacagtaagcttccccagccctgcctgagcagcctttcctccttgccctgttccccacctcccggctccagtccagggagctcccagggaagtggtcgacccctccggtggctgggccactctgctagagtccatccgccaagctgggggcatcggcaaggccaagctgcgcagcatgaaggagcgaaagctggagaagcagcagcagaaggagcaggagcaagtgagagccacgagccaaggtgggcacttgatgtcggatctcttcaacaagctggtcatgaggcgcaagggtaggaggcagggccgctgcccaccctgggccggcacattgcatctctgggaaaggacctggggctggtgaggggcccggaggagcctttgcccgcgtgtcagactccatccctcctctgccgccaccgcagcagccacaggcagaggaggacgaggacgactgggaatcgtagggggctccatgacaccttcccccccagacccagacttgggccattgctctgacatggacacagccaggacaagctgctcagacctgcttccctgggtgggggtgacggaaccagcactgtgcggagaccagcttcaaggagcggaaggctggcctgaggccacacagctggggcggggacttctgtctgcctgtgctccatggggggacggctccacccagcctgcgccactgtgttcttctctaaagaggcttccagagaaaatggcacaccaatcaataaagaactgagcagaaa

SEQ ID NO: 295630 - DNA, 2089 bp, Homo sapiens
gccctcccaggagaagctgaaggactttcctgtgtgcgtgagcaccaagccggagcccgaggacgatgcagaagagggacttgggggtcttcccagcaacatcagctctgtcagctccttgctgctcttcaacaccaccgagaacctgtacaagaagtatgtcttcctggaccccctggctggtgctgtaacaaagacccatgtgatgctgggggcagagacagaggagaagctgtttgatgcccccttgtccatcagcaagagagagcagctggaacagcaggtcccagagaactacttctatgtgccagacctgggccaggtgcctgagattgatgttccatcctacctgcctgacctgcccggcattgccaacgacctcatgtacattgccgacctgggccccggcattgccccctctgcccctggcaccattccagaactgcccaccttccacactgaggtagccgagcctctcaagacctacaagatggggtactaacaccacccccaccgcccccaccaccacccccagctcctgaggtgctggccagtgcacccccactcccaccctcaaccgcggcccctgtaggccaaggcgccaggcaggacgacagcagcagcagcgcatctccttcaggtgggagcagctctttgaggccacctgatttctggcgtgctcagtgcactcgggtggattttctgtgggtttgttaagtggtcagaaattctcaattttttgaatagtttccatttcaaatatcttgttctacttggttcataaaatagtggctttcaaactgtagagctctggacttctcacttctagggcagagggagcctgaacaagtgaggctctgggttcctcattcctaattaaaccaatggaaagaaggggtctaataacaaactacagcaacacatttttcatttcagcttcactgctgtatctcccagtgtaaccctagcatccagaagtggcacaaaacccctctgctggctcatgtgtgcaactgagactgtcagagcatggctagctcaggggtccagctctgcagggtgagggctagagaggaagcagggagtatctgcacacaggatgcccgcgctcaggtggttgccgaagtcagtgcccgggccccacacagtctccaaaggtccggcctccccagcgcggggctcctcgtttgaggggaggtgacttccctcccagcaggctcttggacacagtaagcttccccagccctgcctgagcagcctttcctccttgccctgttccccacctcccggctccagtccagggagctcccagggaagtggtcgacccctccggtggctgggccactctgctagagtccatccgccaagctgggggcatcggcaaggccaagctgcgcagcatgaaggagcgaaagctggagaagcagcagcagaaggagcaggagcaagtgagagccacgagccaaggtgggcacttgatgtcggatctcttcaacaagctggtcatgaggcgcaagggtaggaggcagggccgctgcccaccctgggccggcacattgtaattctgtcctgcctttttcttcctgtatttaagtctccgggggctgggggaaccagggtttcccaccaaccaccctcactcagccttttccctccaggcatctctgggaaaggacctggggctggtgaggggcccggaggagcctttgcccgcgtgtcagactccatccctcctctgccgccaccgcagcagccacaggcagaggaggacgaggacgactgggaatcgtagggggctccatgacaccttcccccccagacccagacttgggccattgctctgacatggacacagccaggacaagctgctcagacctgcttccctgggtgggggtgacggaaccagcactgtgcggagaccagcttcaaggagcggaaggctggcctgaggccacacagctggggcggggacttctgtctgcctgtgctccatggggggacggctccacccagcctgcgccactgtgttcttctctaaagaggcttccagagaaaatggcacaccaatcaataaagaactgagcagaaa

SEQ ID NO: 295631 - DNA, 814 bp, Homo sapiens
gcttgtacccagcgctgcttttgccttgctctgtgaccccaggcaagctgcctcacctctctgggccagtttccccatcgtacagtggtgctgcacaccctggccctgtccccgaggtggctgggaggtggctcctcaaacagccgctttctcatcagtgcccggtgctgggtcaggcatcgactgaggctctgagctaactaggaaacacagtggccttggagggctggggagtgtcatgggggtggggacagggagccaccggtcgcatgtgactgaactcttcaccccagtctgtggctttcccgttgcagtgagagccacgagccaaggtgggcacttgatgtcggatctcttcaacaagctggtcatgaggcgcaagggcatctctgggaaaggacctggggctggtgaggggcccggaggagcctttgcccgcgtgtcagactccatccctcctctgccgccaccgcagcagccacaggcagaggaggacgaggacgactgggaatcgtagggggctccatgacaccttcccccccagacccagacttgggccattgctctgacatggacacagccaggacaagctgctcagacctgcttccctgggtgggggtgacggaaccagcactgtgcggagaccagcttcaaggagcggaaggctggcctgaggccacacagctggggcggggacttctgtctgcctgtgctccatggggggacggctccacccagcctgcgccactgtgttcttctctaaagaggcttccagagaaaatggcacaccaatcaataaagaactgagcagaaa

SEQ ID NO: 295632 - DNA, 954 bp, Homo sapiens
gcttgtacccagcgctgcttttgccttgctctgtgaccccaggcaagctgcctcacctctctgggccagtttccccatcgtacagtggtgctgcacaccctggccctgtccccgaggtggctgggaggtggctcctcaaacagccgctttctcatcagtgcccggtgctgggtcaggcatcgactgaggctctgagctaactaggaaacacagtggccttggagggctggggagtgtcatgggggtggggacagggagccaccggtcgcatgtgactgaactcttcaccccagtctgtggctttcccgttgcagtgagagccacgagccaaggtgggcacttgatgtcggatctcttcaacaagctggtcatgaggcgcaagggtaggaggcagggccgctgcccaccctgggccggcacattgtaattctgtcctgcctttttcttcctgtatttaagtctccgggggctgggggaaccagggtttcccaccaaccaccctcactcagccttttccctccaggcatctctgggaaaggacctggggctggtgaggggcccggaggagcctttgcccgcgtgtcagactccatccctcctctgccgccaccgcagcagccacaggcagaggaggacgaggacgactgggaatcgtagggggctccatgacaccttcccccccagacccagacttgggccattgctctgacatggacacagccaggacaagctgctcagacctgcttccctgggtgggggtgacggaaccagcactgtgcggagaccagcttcaaggagcggaaggctggcctgaggccacacagctggggcggggacttctgtctgcctgtgctccatggggggacggctccacccagcctgcgccactgtgttcttctctaaagaggcttccagagaaaatggcacaccaatcaataaagaactgagcagaaa

SEQ ID NO: 295633 - DNA, 2315 bp, Homo sapiens
gccctcccaggagaagctgaaggactttcctgtgtgcgtgagcaccaagccggagcccgaggacgatgcagaagagggacttgggggtcttcccagcaacatcagctctgtcagctccttgctgctcttcaacaccaccgagaacctgtacaagaagtatgtcttcctggaccccctggctggtgctgtaacaaagacccatgtgatgctgggggcagagacagaggagaagctgtttgatgcccccttgtccatcagcaagagagagcagctggaacagcaggtcccagagaactacttctatgtgccagacctgggccaggtgcctgagattgatgttccatcctacctgcctgacctgcccggcattgccaacgacctcatgtacattgccgacctgggccccggcattgccccctctgcccctggcaccattccagaactgcccaccttccacactgaggtagccgagcctctcaagacctacaagatggggtactaacaccacccccaccgcccccaccaccacccccagctcctgaggtgctggccagtgcacccccactcccaccctcaaccgcggcccctgtaggccaaggcgccaggcaggacgacagcagcagcagcgcatctccttcaggtgggagcagctctttgaggccacctgatttctggcgtgctcagtgcactcgggtggattttctgtgggtttgttaagtggtcagaaattctcaattttttgaatagtttccatttcaaatatcttgttctacttggttcataaaatagtggctttcaaactgtagagctctggacttctcacttctagggcagagggagcctgaacaagtgaggctctgggttcctcattcctaattaaaccaatggaaagaaggggtctaataacaaactacagcaacacatttttcatttcagcttcactgctgtatctcccagtgtaaccctagcatccagaagtggcacaaaacccctctgctggctcatgtgtgcaactgagactgtcagagcatggctagctcaggggtccagctctgcagggtgagggctagagaggaagcagggagtatctgcacacaggatgcccgcgctcaggtggttgccgaagtcagtgcccgggccccacacagtctccaaaggtccggcctccccagcgcggggctcctcgtttgaggggaggtgacttccctcccagcaggctcttggacacagtaagcttccccagccctgcctgagcagcctttcctccttgccctgttccccacctcccggctccagtccagggagctcccagggaagtggtcgacccctccggtggctgggccactctgctagagtccatccgccaagctgggggcatcggcaaggccaagctgcgcagcatgaaggagcgaaagctggagaagcagcagcagaaggagcaggagcaagtgagagccacgagccaaggtgggcacttgatgtcggatctcttcaacaagctggtcatgaggcgcaagggcatctctgggaaaggacctggggctggtgaggggcccggaggagcctttgcccgcgtgtcagactccatccctcctctgccgccaccgcagcagccacaggcagaggaggacgaggacgactgggaatcgtagggggctccatgacaccttcccccccagacccagacttgggccattgctctgacatggacacagccaggacaagctgctcagacctgcttccctgggtgggggtgacggaaccagcactgtgcggagaccagcttcaaggagcggaaggctggcctgaggccacacagctggggcggggacttctgtctgcctgtgctccatggggggacggctccacccagcctgcgccactgtgttcttctctaaagaggcttccagagaaaatggcacaccaatcaataaagaactgagcagaaaaacaacaaaacaacaacaaacaaagatagaaacgaaaaacacgaaaggggtggagcgaacaaacagatcacgcgcagggcaccacgacagaagtacacgggaacaaagaaaaaggggcctaacaacgcggccatatcagcacacgacaacgcgcgaaaaatacaacacggaccacggaacacgcgaaaaaggaacactgcgacgaccacaccaccgggcgagcaaccaaaggacgaaccaccgaaccgaacacaacgctaagagcaaacagcacctgacacgaggaaacggaacacacagccccaacgcacccggccacaagacagcccaacacgcaccccggacccttcacggaaggtacgaaca

SEQ ID NO: 295634 - DNA, 2167 bp, Homo sapiens
gccctcccaggagaagctgaaggactttcctgtgtgcgtgagcaccaagccggagcccgaggacgatgcagaagagggacttgggggtcttcccagcaacatcagctctgtcagctccttgctgctcttcaacaccaccgagaacctgtacaagaagtatgtcttcctggaccccctggctggtgctgtaacaaagacccatgtgatgctgggggcagagacagaggagaagctgtttgatgcccccttgtccatcagcaagagagagcagctggaacagcaggtcccagagaactacttctatgtgccagacctgggccaggtgcctgagattgatgttccatcctacctgcctgacctgcccggcattgccaacgacctcatgtacattgccgacctgggccccggcattgccccctctgcccctggcaccattccagaactgcccaccttccacactgaggtagccgagcctctcaagacctacaagatggggtactaacaccacccccaccgcccccaccaccacccccagctcctgaggtgctggccagtgcacccccactcccaccctcaaccgcggcccctgtaggccaaggcgccaggcaggacgacagcagcagcagcgcatctccttcaggtgggagcagctctttgaggccacctgatttctggcgtgctcagtgcactcgggtggattttctgtgggtttgttaagtggtcagaaattctcaattttttgaatagtttccatttcaaatatcttgttctacttggttcataaaatagtggctttcaaactgtagagctctggacttctcacttctagggcagagggagcctgaacaagtgaggctctgggttcctcattcctaattaaaccaatggaaagaaggggtctaataacaaactacagcaacacatttttcatttcagcttcactgctgtatctcccagtgtaaccctagcatccagaagtggcacaaaacccctctgctggctcatgtgtgcaactgagactgtcagagcatggctagctcaggggtccagctctgcagggtgagggctagagaggaagcagggagtatctgcacacaggatgcccgcgctcaggtggttgccgaagtcagtgcccgggccccacacagtctccaaaggtccggcctccccagcgcggggctcctcgtttgaggggaggtgacttccctcccagcaggctcttggacacagtaagcttccccagccctgcctgagcagcctttcctccttgccctgttccccacctcccggctccagtccagggagctcccagggaagtggtcgacccctccggtggctgggccactctgctagagtccatccgccaagctgggggcatcggcaaggccaagctgcgcagcatgaaggagcgaaagctggagaagcagcagcagaaggagcaggagcaagtgagagccacgagccaaggtgggcacttgatgtcggatctcttcaacaagctggtcatgaggcgcaagggcatctctgggaaaggacctggggctggtgaggggcccggaggagcctttgcccgcgtgtcagactccatccctcctctgccgccaccgcagcagccacaggcagaggaggacgaggacgactgggaatcgtagggggctccatgacaccttcccccccagacccagacttgggccattgctctgacatggacacagccaggacaagctgctcagacctgcttccctgggtgggggtgacggaaccagcactgtgcggagaccagcttcaaggagcggaaggctggcctgaggccacacagctggggcggggacttctgtctgcctgtgctccatggggggacggctccacccagcctgcgccactgtgttcttctctaaagaggcttccagagaaaatggcacaccaatcaataaagaactgagcagaaaaaaaatagataaaaaaaacaaaaaaaaaccttgtgttgggccgccccgccccctggaagaaggttcctataaacccaaatccgtgtgtgggcccccgcggccccccatgactagagctcgtcggacagtgtgccgccaataacgcgggtcccccaagggaacaactcctgggcacaagaacacaagggccgcgggaaacccccccccaatagaaaaaa

SEQ ID NO: 295635 - DNA, 2289 bp, Homo sapiens
gccctcccaggagaagctgaaggactttcctgtgtgcgtgagcaccaagccggagcccgaggacgatgcagaagagggacttgggggtcttcccagcaacatcagctctgtcagctccttgctgctcttcaacaccaccgagaacctgtacaagaagtatgtcttcctggaccccctggctggtgctgtaacaaagacccatgtgatgctgggggcagagacagaggagaagctgtttgatgcccccttgtccatcagcaagagagagcagctggaacagcaggtcccagagaactacttctatgtgccagacctgggccaggtgcctgagattgatgttccatcctacctgcctgacctgcccggcattgccaacgacctcatgtacattgccgacctgggccccggcattgccccctctgcccctggcaccattccagaactgcccaccttccacactgaggtagccgagcctctcaagacctacaagatggggtactaacaccacccccaccgcccccaccaccacccccagctcctgaggtgctggccagtgcacccccactcccaccctcaaccgcggcccctgtaggccaaggcgccaggcaggacgacagcagcagcagcgcatctccttcaggtgggagcagctctttgaggccacctgatttctggcgtgctcagtgcactcgggtggattttctgtgggtttgttaagtggtcagaaattctcaattttttgaatagtttccatttcaaatatcttgttctacttggttcataaaatagtggctttcaaactgtagagctctggacttctcacttctagggcagagggagcctgaacaagtgaggctctgggttcctcattcctaattaaaccaatggaaagaaggggtctaataacaaactacagcaacacatttttcatttcagcttcactgctgtatctcccagtgtaaccctagcatccagaagtggcacaaaacccctctgctggctcatgtgtgcaactgagactgtcagagcatggctagctcaggggtccagctctgcagggtgagggctagagaggaagcagggagtatctgcacacaggatgcccgcgctcaggtggttgccgaagtcagtgcccgggccccacacagtctccaaaggtccggcctccccagcgcggggctcctcgtttgaggggaggtgacttccctcccagcaggctcttggacacagtaagcttccccagccctgcctgagcagcctttcctccttgccctgttccccacctcccggctccagtccagggagctcccagggaagtggtcgacccctccggtggctgggccactctgctagagtccatccgccaagctgggggcatcggcaaggccaagctgcgcagcatgaaggagcgaaagctggagaagcagcagcagaaggagcaggagcaagtgagagccacgagccaaggtgggcacttgatgtcggatctcttcaacaagctggtcatgaggcgcaagggtaggaggcagggccgctgcccaccctgggccggcacattgtaattctgtcctgcctttttcttcctgtatttaagtctccgggggctgggggaaccagggtttcccaccaaccaccctcactcagccttttccctccaggcatctctgggaaaggacctggggctggtgaggggcccggaggagcctttgcccgcgtgtcagactccatccctcctctgccgccaccgcagcagccacaggcagaggaggacgaggacgactgggaatcgtagggggctccatgacaccttcccccccagacccagacttgggccattgctctgacatggacacagccaggacaagctgctcagacctgcttccctgggtgggggtgacggaaccagcactgtgcggagaccagcttcaaggagcggaaggctggcctgaggccacacagctggggcggggacttctgtctgcctgtgctccatggggggacggctccacccagcctgcgccactgtgttcttctctaaagaggcttccagagaaaatggcacaccaatcaataaagaactgagcagaaaaaaaaaaacaaaaacaaaaaataaaaaacaaacacacaaaaaaaaaaaaaacccgcgggagcaccattagtagcggggggggcaaagacaagagacagacacgaggggcgaaggtgtcactcaaggctgacgcgacacacggatttgttggaccacgggggaaaacgggggagcccccagagggcgcgcataaagaaaag

SEQ ID NO: 295636 - DNA, 1830 bp, Homo sapiens
gccctcccaggagaagctgaaggactttcctgtgtgcgtgagcaccaagccggagcccgaggacgatgcagaagagggacttgggggtcttcccagcaacatcagctctgtcagctccttgctgctcttcaacaccaccgagaacctgtacaagaagtatgtcttcctggaccccctggctggtgctgtaacaaagacccatgtgatgctgggggcagagacagaggagaagctgtttgatgcccccttgtccatcagcaagagagagcagctggaacagcaggtcccagagaactacttctatgtgccagacctgggccaggtgcctgagattgatgttccatcctacctgcctgacctgcccggcattgccaacgacctcatgtacattgccgacctgggccccggcattgccccctctgcccctggcaccattccagaactgcccaccttccacactgaggtagccgagcctctcaagacctacaagatggggtactaacaccacccccaccgcccccaccaccacccccagctcctgaggtgctggccagtgcacccccactcccaccctcaaccgcggcccctgtaggccaaggcgccaggcaggacgacagcagcagcagcgcatctccttcaggtgggagcagctctttgaggccacctgatttctggcgtgctcagtgcactcgggtggattttctgtgggtttgttaagtggtcagaaattctcaattttttgaatagtttccatttcaaatatcttgttctacttggttcataaaatagtggctttcaaactgtagagctctggacttctcacttctagggcagagggagcctgaacaagtgaggctctgggttcctcattcctaattaaaccaatggaaagaaggggtctaataacaaactacagcaacacatttttcatttcagcttcactgctgtatctcccagtgtaaccctagcatccagaagtggcacaaaacccctctgctggctcatgtgtgcaactgagactgtcagagcatggctagctcaggggtccagctctgcagggtgagggctagagaggaagcagggagtatctgcacacaggatgcccgcgctcaggtggttgccgaagtcagtgcccgggccccacacagtctccaaaggtccggcctccccagcgcggggctcctcgtttgaggggaggtgacttccctcccagcaggctcttggacacagtaagcttccccagccctgcctgagcagcctttcctccttgccctgttccccacctcccggctccagtccagggagctcccagggaagtggtcgacccctccggtggctgggccactctgctagagtccatccgccaagctgggggcatcggcaaggccaagctgcgcagcatgaaggagcgaaagctggagaagcagcagcagaaggagcaggagcaaggagcgggccctggagcctgcggtcggagggcctttgggcaagatcgcctcctcccctccagccctgagtccaccgggtgctttctgcccaccccctgctcctgccagctggcccctgcttcccctagggcacatgctggaagccctgggccgccaccagaggtcctcagccctcctgcctgggctatggctccttcctggtttgggagccatagtggagctttcctctctaagctcacccagctcaaactgtgacaggagaatcttcttcgactgccaagagcggtccaaggcaatggtcagccactgcagcctcctgagatatttttagagactggacctgaggcctctggaggctactgatgatgcctgctgtgaacgc

SEQ ID NO: 295637 - DNA, 964 bp, Homo sapiens
gccctcccaggagaagctgaaggactttcctgtgtgcgtgagcaccaagccggagcccgaggacgatgcagaagagggacttgggggtcttcccagcaacatcagctctgtcagctccttgctgctcttcaacaccaccgagaacctgtacaagaagtatgtcttcctggaccccctggctggtgctgtaacaaagacccatgtgatgctgggggcagagacagaggagaagctgtttgatgcccccttgtccatcagcaagagagagcagctggaacagcaggtcccagagaactacttctatgtgccagacctgggccaggtgcctgagattgatgttccatcctacctgcctgacctgcccggcattgccaacgacctcatgtacattgccgacctgggccccggcattgccccctctgcccctggcaccattccagaactgcccaccttccacactgaggtagccgagcctctcaagacctacaagatggggtactaacaccacccccaccgcccccaccaccacccccagctcctgaggtgctggccagtgcacccccactcccaccctcaaccgcggcccctgtaggccaaggcgccaggcaggacgacagcagcagcagcgcatctccttcagtccagggagctcccagggaagtggtcgacccctccggtggctgggccactctgctagagtccatccgccaagctgggggcatcggcaaggccaagctgcgcagcatgaaggagcgaaagctggagaagcagcagcagaaggagcaggagcaagaccagcttcaaggagcggaaggctggcctgaggccacacagctggggcggggacttctgtctgcctgtgctccatggggggacggctccacccagcctgcgccactgtgttcttctctaaagaggcttccagagaaaatggcacaccaatcaataaagaactgagcagaaa

SEQ ID NO: 295638 - DNA, 566 bp, Homo sapiens
gccctcccaggagaagctgaaggactttcctgtgtgcgtgagcaccaagccggagcccgaggacgatgcagaagagggacttgggggtcttcccagcaacatcagctctgtcagctccttgctgctcttcaacaccaccgagaacctgtacaagaagtatgtcttcctggaccccctggctggtgctgtaacaaagacccatgtgatgctgggggcagagacagaggagaagctgtttgatgcccccttgtccatcagcaagagagagcagctggaacagcaggtcccagagaactacttctatgtgccagacctgggccaggtgcctgagattgatgttccatcctacctgcctgacctgcccggcattgccaacgacctcatgtacattgccgacctgggccccggcattgccccctctgcccctggcaccattccagaactgcccaccttccacactgaggtagccgagcctctcaagacctgagcaagccaggcctggcttgctcaggtcttatttcttgtattctgtcgcgatgggcctggcttgctcaggtctaggggcc

SEQ ID NO: 295639 - DNA, 219 bp, Homo sapiens
cttgctcagttctttattgagttggtgtgccgttttctctggaagcctcttaagaacacagtggcgcaggctggcctgaggccacacagctggggcggggacttctgtctgcctgtgctccatggggggacggctccacccagcctgcgccactgtgttcttctctaaagaggcttccagagaaaatggcacaccaatcaataaagaactgagcagaaa

SEQ ID NO: 295640 - DNA, 383 bp, Homo sapiens
agcagccacaggcagaggaggacgaggacgactgggaatcgtagggggctccatgacaccttcccccccagacccagacttgggccattgctctgacatggacacagccaggacaagctgctcagacctgcttccctgggtgggggtgacggaaccagcactgtgcggagaccagcttcaaggagcggaaggctggcctgaggccacacagctggggcggggacttctgtctgcctgtgctccatggggggacggctccacccagcctgcgccactgtgttcttctctaaagaggcttccagagaaaatggcacaccaatcaataaagaactgagcagaaaccaacagtgtgcttttaataaaggacctctagctgtgcagga

SEQ ID NO: 295641 - DNA, 313 bp, Homo sapiens
tgcctcagcctccccagtagctaggattacaggcatgcaccaccaatcctggctaatttttgtattgtttgtagagacagagtttcaccatgttgcccaggctggtcttgaactcctggactcaaatgatccacctaccttggcctcacaaagtgctgggattacaggcatgagctactatacctggcccaatttcagtttttaactcaacaaagttttaaatcttacttcagttcaatgtattcttacattaaaatattgatttaaaaatatgtgaacttccaatttcagctttgacctgcaaagagcttgg

SEQ ID NO: 295642 - DNA, 2427 bp, Homo sapiens
gcagtccgactcatcccggccccgggatggcgtccccacgggaattgacacagaaccccctgaagaagatctggatgccatacagcaatgggcggcccgctctgcacgcttgccagcgcggtgtgtgcatgaccaactgcccaactctcattgtcatggtgggcctgcccgccaggggcaagacctacatctccaagaagctgactcgatacctgaactggattggtgtgcccactcgggagttcaatgttggccagtatcgccgggacgtggtcaagacctacaaatcttttgaattttttctccccgacaatgaagagggcctgaaaatcaggaagcagtgtgccctggcagccctccgtgacgtccggcggttccttagtgaggaggggggacatgtggcggtttttgatgccacaaacaccacccgagaacggagagcgaccatctttaattttggagaacagaatggctacaagaccttttttgtcgagtccatctgtgtggatcctgaggtcatagctgccaacatcgtgcaagtgaaactgggcagccctgactatgtcaaccgcgacagtgatgaggctacggaggacttcatgaggcgcattgagtgctatgagaactcctacgagtcgctagatgaggacctggatagggacctgtcctatatcaagatcatggatgtgggccagagctacgtggtgaaccgtgtggctgaccacatccagagccgcatcgtatattacctcatgaacatccacgtgaccccccgctccatctacctctgccggcacggggagagcgagctcaacctcaagggccggattggcggggacccaggactgtcccctcggggcagggagtttgccaagagtctagcccagttcatcagtgaccaaaatatcaaggatctgaaggtctggacaagccagatgaagaggacaatccagacggctgaggcactgggtgtgccctatgaacagtggaaggtcctcaacgagatcgatgcgggcgtctgtgaggaaatgacctacgaggaaattcaggataattatccactggagttcgccctgcgggaccaggacaagtaccggtaccggtaccctaaaggggagtcctacgaggacctggtccagagactggagcctgtcatcatggagctggagaggcaagagaatgtgctggtcatctgccaccaggctgtgatgcgctgcctgctggcctacttcctcgacaaggcagcagaacagctgccctacctcaagtgtccgctgcacacagtcctgaagctgactcctgtggcatatggttgtaaagtggagtccatattcctgaacgtggctgctgtgaacacgcaccgggacaggcctcagaacgtggacatctcaagacctccagaggaagcccttgtcacggtgcctgctcaccagtgaccatgttcatccactgtgaccactaggcaggcactgctctctgcagagggggtcattccaggccctccagtgtgtgtgatagtcaccatgccatgcagggatattcttgaagccacacatggctggcggaacccagagcccccaccccagcccacctggctctttgttgacagtcggcgacaaggttgtgcgtggctcctgacctgctgctaagagtcacttgaccagactgcatctgcatgggctgcgcggaggttgcccagccccagtttcttccggcgcagctcttaggtgttcactctcgccagctcagttggctttgtgaagtgtgaaaccctacaatgtgaaaggaaagtgcttgctgtgatgttcctactgtggcccagctgcccagcatggacctggtgactctccacagggcctctaccatcctctctgtggccacttcctgagccagaggccaggtcttcatggggccctgagcttctgctgcctctggtgagagggagagcccttcccatccttacccaccaggaactagagccccaaccacagcagatgcttcctgggcagccactggccaggccgttgtatccatgtcacccttagttgtgggcattcatgaaagcaatgcgcttgcttcagcacattgggatgcacagaaacgtgagggcaggggggcagttgtggtcgcccctccccagttgtgcatgtacccggctacttaggtatgcttaggggagctggtggccaggggtgccccttcaggcctgctctcacagtgaaaccacttcaagacagggcaggaagttaccttcctggtgcacacaccgaagtgctcgagggagaggctgccgccccctctccccttccctggctgtggacactggcagccaatggggaggcggcctctcccctgttgctgcccgtgtccacacaggaatgtacactggtggcagaaacatgcatttgccataaataattcagaaac

SEQ ID NO: 295643 - DNA, 470 bp, Homo sapiens
ctcctcctcctgggttcacgccactctcctgcctcagcgtcctgagtagctgggactacaagcccccgccactgtgcccggctaattttttgtatttttagtagagatggggtttcaccatggtctcgatctcctgacctcgtgatccgcctgcctctgccaccccggcgcttctggtcctgccgcagaccttttttgtcgagtccatctgtgtggatcctgaggtcatagctgccaacatcgtggtgagtagtgcatctgaccttgtcagaaggtcgtgtgtgacagggacatcccttttcaggttttggctaaccttaatttgatcttgaaccttgtgggggtagggaggaagtgtaacttcaaatgctgggtcaggtatgcctcgccctctgtggatcactgtggaaggctgggtggctggtggacattcactcaccccacctccccctcgtaaccacctggacact

SEQ ID NO: 295644 - DNA, 379 bp, Homo sapiens
gcctggtctcagaggcctgccagcctgggtgtgtggttcatctccaccccttcccagctatgcagcccaggccttagtcccttcctcaggtgtggagtgggcagtgccatgtagggcaggccttcaacctggagacctttggctccctgctctccattcttgtctttccccttcccaggggtggagaattcggaagggcagggcctgaggtgggggatctgcggagttaggctttcctgggacccctgtagacagtgtgcggtcccctggcattcccaggccagctcctttcccagcgagttgtcagccctttccggggcgctcaaatggctggggagttggggagaccatggcaggcctgggactcgggtctcagctc

SEQ ID NO: 295645 - DNA, 3501 bp, Homo sapiens
  misc_feature (3411)..(3411): n is a, c, g, or t
  misc_feature (3440)..(3441): n is a, c, g, or t
gcagtccgactcatcccggccccgggatggcgtccccacgggaattgacacagaaccccctgaagaagatctggatgccatacagcaatgggcggcccgctctgcacgcttgccagcgcggtgtgtgcatgaccaactgcccaactctcattgtcatggtgggcctgcccgccaggggcaagacctacatctccaagaagctgactcgatacctgaactggattggtgtgcccactcgggagttcaatgttggccagtatcgccgggacgtggtcaagacctacaaatcttttgaattttttctccccgacaatgaagagggcctgaaaatcaggaagcagtgtgccctggcagccctccgtgacgtccggcggttccttagtgaggaggggggacatgtggcggtttttgatgccacaaacaccacccgagaacggagagcgaccatctttaattttggagaacagaatggctacaagaccttttttgtcgagtccatctgtgtggatcctgaggtcatagctgccaacatcgtgcaagtgaaactgggcagccctgactatgtcaaccgcgacagtgatgaggctacggaggacttcatgaggcgcattgagtgctatgagaactcctacgagtcgctagatgaggacctggatagggacctgtcctatatcaagatcatggatgtgggccagagctacgtggtgaaccgtgtggctgaccacatccagagccgcatcgtatattacctcatgaacatccacgtgaccccccgctccatctacctctgccggcacggggagagcgagctcaacctcaagggccggattggcggggacccaggactgtcccctcggggcagggagtttgccaagagtctagcccagttcatcagtgaccaaaatatcaaggatctgaaggtctggacaagccagatgaagaggacaatccagacggctgaggcactgggtgtgccctatgaacagtggaaggtcctcaacgagatcgatgcgggcgtctgtgaggaaatgacctacgaggaaattcaggataattatccactggagttcgccctgcgggaccaggacaagtaccggtaccggtaccctaaaggggagtcctacgaggacctggtccagagactggagcctgtcatcatggagctggagaggcaagagaatgtgctggtcatctgccaccaggctgtgatgcgctgcctgctggcctacttcctcgacaaggcagcagaacagctgccctacctcaagtgtccgctgcacacagtcctgaagctgactcctgtggcatatggttgtaaagtggagtccatattcctgaacgtggctgctgtgaacacgcaccgggacaggcctcagaacgtggacatctcaagacctccagaggaagcccttgtcacggtgcctgctcaccagtgaccatgttcatccactgtgaccactaggcaggcactgctctctgcagagggggtcattccaggccctccagtgtgtgtgatagtcaccatgccatgcagggatattcttgaagccacacatggctggcggaacccagagcccccaccccagcccacctggctctttgttgacagtcggcgacaaggttgtgcgtggctcctgacctgctgctaagagtcacttgaccagactgcatctgcatgggctgcgcggaggttgcccagccccagtttcttccggcgcagctcttaggtgttcactctcgccagctcagttggctttgtgaagtgtgaaaccctacaatgtgaaaggaaagtgcttgctgtgatgttcctactgtggcccagctgcccagcatggacctggtgactctccacagggcctctaccatcctctctgtggccacttcctgagccagaggccaggtcttcatggggccctgagcttctgctgcctctggtgagagggagagcccttcccatccttacccaccaggaactagagccccaaccacagcagatgcttcctgggcagccactggccaggccgttgtatccatgtcacccttagttgtgggcattcatgaaagcaatgcgcttgcttcagcacattgggatgcacagaaacgtgagggcaggggggcagttgtggtcgcccctccccagttgtgcatgtacccggctacttaggtatgcttaggggagctggtggccaggggtgccccttcaggcctgctctcacagtgaaaccacttcaagacagggcaggaagttaccttcctggtgcacacaccgaagtgctcgagggagaggctgccgccccctctccccttccctggctgtggacactggcagccaatggggaggcggcctctcccctgttgctgcccgtgtccacacaggaatgtacactggtggcagaaacatgcatttgccataaataattcagaaacacttgtatggtcctgtaaaacttctctggtgtttgttgacttctgcctgtgggtctgaggaagggagaaggcagaacccataggcagtccctgggcaagggaggattttcccggccgcagcacagccttccattcatgtgcacgtgagtctggtgaaaatggccttgtgaagtccagtgtctgtcatgcccctgagttcttttggtcccagagaggcagcctgggcagtctgtttacagctggcaaacagactggctggcaagttgtggggctgggtcagaaagtgtctggacttgtaatcgggtgccctgctgtccacaggtggactctggggaagccaggcccctggatcccaagtcctttgtgtccggagcctttcctggcctgtgcctggagggtagcacatctttccagcctcccagggctttgcagcctgcagatgccacctgtccctgagagaagttagcgtccctggccctggccggtggtctctcatccttgtgtgctgctctgctaagagatgtccaaggcggagccggggcaagatccttccagactcatctgtcagagccccaagccctttagacccagagcccaaggaccatgcctttgggacattaggactgcagcctttgcttctgtgtattttggagttttggtgacttttgtcacctggacacactcatttgttagccatagtgggttcccttggtcagcaacagtgcatgtacctctggatgtcatctgaggtgagaccaccgaggccttttctctctgtgtacagaggggagttaggagttgctggactggatgcattacgaggactggggacagggtagagggacatccagggatcagggcatgagtgggggcaacccccggctctgccctggcatggtctccgcatgggctgaggtgtagctgattggtgccacatttcggccatgctggctggcgtgcccatgttgcagatatttcccgagntccccagaatggatggtattgaatctcanncacatgcaacactgtgtccagcattctttgcaataaatactcttaaaaaacaaaaaacaa

SEQ ID NO: 295646 - DNA, 3443 bp, Homo sapiens
  misc_feature (3353)..(3353): n is a, c, g, or t
  misc_feature (3382)..(3383): n is a, c, g, or t
gatggacagaggctcgttaggaggcagctccctgaccgacctggggccggggagcagcaggcgggtgtgcatgaccaactgcccaactctcattgtcatggtgggcctgcccgccaggggcaagacctacatctccaagaagctgactcgatacctgaactggattggtgtgcccactcgggagttcaatgttggccagtatcgccgggacgtggtcaagacctacaaatcttttgaattttttctccccgacaatgaagagggcctgaaaatcaggaagcagtgtgccctggcagccctccgtgacgtccggcggttccttagtgaggaggggggacatgtggcggtttttgatgccacaaacaccacccgagaacggagagcgaccatctttaattttggagaacagaatggctacaagaccttttttgtcgagtccatctgtgtggatcctgaggtcatagctgccaacatcgtgcaagtgaaactgggcagccctgactatgtcaaccgcgacagtgatgaggctacggaggacttcatgaggcgcattgagtgctatgagaactcctacgagtcgctagatgaggacctggatagggacctgtcctatatcaagatcatggatgtgggccagagctacgtggtgaaccgtgtggctgaccacatccagagccgcatcgtatattacctcatgaacatccacgtgaccccccgctccatctacctctgccggcacggggagagcgagctcaacctcaagggccggattggcggggacccaggactgtcccctcggggcagggagtttgccaagagtctagcccagttcatcagtgaccaaaatatcaaggatctgaaggtctggacaagccagatgaagaggacaatccagacggctgaggcactgggtgtgccctatgaacagtggaaggtcctcaacgagatcgatgcgggcgtctgtgaggaaatgacctacgaggaaattcaggataattatccactggagttcgccctgcgggaccaggacaagtaccggtaccggtaccctaaaggggagtcctacgaggacctggtccagagactggagcctgtcatcatggagctggagaggcaagagaatgtgctggtcatctgccaccaggctgtgatgcgctgcctgctggcctacttcctcgacaaggcagcagaacagctgccctacctcaagtgtccgctgcacacagtcctgaagctgactcctgtggcatatggttgtaaagtggagtccatattcctgaacgtggctgctgtgaacacgcaccgggacaggcctcagaacgtggacatctcaagacctccagaggaagcccttgtcacggtgcctgctcaccagtgaccatgttcatccactgtgaccactaggcaggcactgctctctgcagagggggtcattccaggccctccagtgtgtgtgatagtcaccatgccatgcagggatattcttgaagccacacatggctggcggaacccagagcccccaccccagcccacctggctctttgttgacagtcggcgacaaggttgtgcgtggctcctgacctgctgctaagagtcacttgaccagactgcatctgcatgggctgcgcggaggttgcccagccccagtttcttccggcgcagctcttaggtgttcactctcgccagctcagttggctttgtgaagtgtgaaaccctacaatgtgaaaggaaagtgcttgctgtgatgttcctactgtggcccagctgcccagcatggacctggtgactctccacagggcctctaccatcctctctgtggccacttcctgagccagaggccaggtcttcatggggccctgagcttctgctgcctctggtgagagggagagcccttcccatccttacccaccaggaactagagccccaaccacagcagatgcttcctgggcagccactggccaggccgttgtatccatgtcacccttagttgtgggcattcatgaaagcaatgcgcttgcttcagcacattgggatgcacagaaacgtgagggcaggggggcagttgtggtcgcccctccccagttgtgcatgtacccggctacttaggtatgcttaggggagctggtggccaggggtgccccttcaggcctgctctcacagtgaaaccacttcaagacagggcaggaagttaccttcctggtgcacacaccgaagtgctcgagggagaggctgccgccccctctccccttccctggctgtggacactggcagccaatggggaggcggcctctcccctgttgctgcccgtgtccacacaggaatgtacactggtggcagaaacatgcatttgccataaataattcagaaacacttgtatggtcctgtaaaacttctctggtgtttgttgacttctgcctgtgggtctgaggaagggagaaggcagaacccataggcagtccctgggcaagggaggattttcccggccgcagcacagccttccattcatgtgcacgtgagtctggtgaaaatggccttgtgaagtccagtgtctgtcatgcccctgagttcttttggtcccagagaggcagcctgggcagtctgtttacagctggcaaacagactggctggcaagttgtggggctgggtcagaaagtgtctggacttgtaatcgggtgccctgctgtccacaggtggactctggggaagccaggcccctggatcccaagtcctttgtgtccggagcctttcctggcctgtgcctggagggtagcacatctttccagcctcccagggctttgcagcctgcagatgccacctgtccctgagagaagttagcgtccctggccctggccggtggtctctcatccttgtgtgctgctctgctaagagatgtccaaggcggagccggggcaagatccttccagactcatctgtcagagccccaagccctttagacccagagcccaaggaccatgcctttgggacattaggactgcagcctttgcttctgtgtattttggagttttggtgacttttgtcacctggacacactcatttgttagccatagtgggttcccttggtcagcaacagtgcatgtacctctggatgtcatctgaggtgagaccaccgaggccttttctctctgtgtacagaggggagttaggagttgctggactggatgcattacgaggactggggacagggtagagggacatccagggatcagggcatgagtgggggcaacccccggctctgccctggcatggtctccgcatgggctgaggtgtagctgattggtgccacatttcggccatgctggctggcgtgcccatgttgcagatatttcccgagntccccagaatggatggtattgaatctcanncacatgcaacactgtgtccagcattctttgcaataaatactcttaaaaaacaaaaaacaa

SEQ ID NO: 295647 - DNA, 3733 bp, Homo sapiens
  misc_feature (3643)..(3643): n is a, c, g, or t
  misc_feature (3672)..(3673): n is a, c, g, or t
gggactgggaagagtttgagctttgagaactggccaccacatggcttctaggctgggacactgggaggaagtccagtggtcagtgcagagggcaccctgggagccaaccagggtcaggccagccaggttcatggtgggcagaggctgagcagaacatgttcacacgtgtgtacagacatcccagcatacttcccacgcctgggacagaacagctggctcactttcggatatactgaggaggaaaaagccatgagggccagagattctaccgggcatccgctgatgctgagagagcagacgctgggacagcatctccatggagaggacacaggggagtgggagcacacatgtgaagtgtgcatgaccaactgcccaactctcattgtcatggtgggcctgcccgccaggggcaagacctacatctccaagaagctgactcgatacctgaactggattggtgtgcccactcgggagttcaatgttggccagtatcgccgggacgtggtcaagacctacaaatcttttgaattttttctccccgacaatgaagagggcctgaaaatcaggaagcagtgtgccctggcagccctccgtgacgtccggcggttccttagtgaggaggggggacatgtggcggtttttgatgccacaaacaccacccgagaacggagagcgaccatctttaattttggagaacagaatggctacaagaccttttttgtcgagtccatctgtgtggatcctgaggtcatagctgccaacatcgtgcaagtgaaactgggcagccctgactatgtcaaccgcgacagtgatgaggctacggaggacttcatgaggcgcattgagtgctatgagaactcctacgagtcgctagatgaggacctggatagggacctgtcctatatcaagatcatggatgtgggccagagctacgtggtgaaccgtgtggctgaccacatccagagccgcatcgtatattacctcatgaacatccacgtgaccccccgctccatctacctctgccggcacggggagagcgagctcaacctcaagggccggattggcggggacccaggactgtcccctcggggcagggagtttgccaagagtctagcccagttcatcagtgaccaaaatatcaaggatctgaaggtctggacaagccagatgaagaggacaatccagacggctgaggcactgggtgtgccctatgaacagtggaaggtcctcaacgagatcgatgcgggcgtctgtgaggaaatgacctacgaggaaattcaggataattatccactggagttcgccctgcgggaccaggacaagtaccggtaccggtaccctaaaggggagtcctacgaggacctggtccagagactggagcctgtcatcatggagctggagaggcaagagaatgtgctggtcatctgccaccaggctgtgatgcgctgcctgctggcctacttcctcgacaaggcagcagaacagctgccctacctcaagtgtccgctgcacacagtcctgaagctgactcctgtggcatatggttgtaaagtggagtccatattcctgaacgtggctgctgtgaacacgcaccgggacaggcctcagaacgtggacatctcaagacctccagaggaagcccttgtcacggtgcctgctcaccagtgaccatgttcatccactgtgaccactaggcaggcactgctctctgcagagggggtcattccaggccctccagtgtgtgtgatagtcaccatgccatgcagggatattcttgaagccacacatggctggcggaacccagagcccccaccccagcccacctggctctttgttgacagtcggcgacaaggttgtgcgtggctcctgacctgctgctaagagtcacttgaccagactgcatctgcatgggctgcgcggaggttgcccagccccagtttcttccggcgcagctcttaggtgttcactctcgccagctcagttggctttgtgaagtgtgaaaccctacaatgtgaaaggaaagtgcttgctgtgatgttcctactgtggcccagctgcccagcatggacctggtgactctccacagggcctctaccatcctctctgtggccacttcctgagccagaggccaggtcttcatggggccctgagcttctgctgcctctggtgagagggagagcccttcccatccttacccaccaggaactagagccccaaccacagcagatgcttcctgggcagccactggccaggccgttgtatccatgtcacccttagttgtgggcattcatgaaagcaatgcgcttgcttcagcacattgggatgcacagaaacgtgagggcaggggggcagttgtggtcgcccctccccagttgtgcatgtacccggctacttaggtatgcttaggggagctggtggccaggggtgccccttcaggcctgctctcacagtgaaaccacttcaagacagggcaggaagttaccttcctggtgcacacaccgaagtgctcgagggagaggctgccgccccctctccccttccctggctgtggacactggcagccaatggggaggcggcctctcccctgttgctgcccgtgtccacacaggaatgtacactggtggcagaaacatgcatttgccataaataattcagaaacacttgtatggtcctgtaaaacttctctggtgtttgttgacttctgcctgtgggtctgaggaagggagaaggcagaacccataggcagtccctgggcaagggaggattttcccggccgcagcacagccttccattcatgtgcacgtgagtctggtgaaaatggccttgtgaagtccagtgtctgtcatgcccctgagttcttttggtcccagagaggcagcctgggcagtctgtttacagctggcaaacagactggctggcaagttgtggggctgggtcagaaagtgtctggacttgtaatcgggtgccctgctgtccacaggtggactctggggaagccaggcccctggatcccaagtcctttgtgtccggagcctttcctggcctgtgcctggagggtagcacatctttccagcctcccagggctttgcagcctgcagatgccacctgtccctgagagaagttagcgtccctggccctggccggtggtctctcatccttgtgtgctgctctgctaagagatgtccaaggcggagccggggcaagatccttccagactcatctgtcagagccccaagccctttagacccagagcccaaggaccatgcctttgggacattaggactgcagcctttgcttctgtgtattttggagttttggtgacttttgtcacctggacacactcatttgttagccatagtgggttcccttggtcagcaacagtgcatgtacctctggatgtcatctgaggtgagaccaccgaggccttttctctctgtgtacagaggggagttaggagttgctggactggatgcattacgaggactggggacagggtagagggacatccagggatcagggcatgagtgggggcaacccccggctctgccctggcatggtctccgcatgggctgaggtgtagctgattggtgccacatttcggccatgctggctggcgtgcccatgttgcagatatttcccgagntccccagaatggatggtattgaatctcanncacatgcaacactgtgtccagcattctttgcaataaatactcttaaaaaacaaaaaacaa

SEQ ID NO: 295648 - DNA, 2435 bp, Homo sapiens
  misc_feature (2345)..(2345): n is a, c, g, or t
  misc_feature (2374)..(2375): n is a, c, g, or t
cgctagtacgagccggttgaatcggacgaggcggtacggtacctaaagggagtcctacgaggacctggtccagagactggagcctgtcatcatggagctggagaggcaagagaatgtgctggtcatctgccaccaggctgtgatgcgctgcctgctggcctacttcctcgacaaggcagcagaacagctgccctacctcaagtgtccgctgcacacagtcctgaagctgactcctgtggcatatggttgtaaagtggagtccatattcctgaacgtggctgctgtgaacacgcaccgggacaggcctcagaacgtggacatctcaagacctccagaggaagcccttgtcacggtgcctgctcaccagtgaccatgttcatccactgtgaccactaggcaggcactgctctctgcagagggggtcattccaggccctccagtgtgtgtgatagtcaccatgccatgcagggatattcttgaagccacacatggctggcggaacccagagcccccaccccagcccacctggctctttgttgacagtcggcgacaaggttgtgcgtggctcctgacctgctgctaagagtcacttgaccagactgcatctgcatgggctgcgcggaggttgcccagccccagtttcttccggcgcagctcttaggtgttcactctcgccagctcagttggctttgtgaagtgtgaaaccctacaatgtgaaaggaaagtgcttgctgtgatgttcctactgtggcccagctgcccagcatggacctggtgactctccacagggcctctaccatcctctctgtggccacttcctgagccagaggccaggtcttcatggggccctgagcttctgctgcctctggtgagagggagagcccttcccatccttacccaccaggaactagagccccaaccacagcagatgcttcctgggcagccactggccaggccgttgtatccatgtcacccttagttgtgggcattcatgaaagcaatgcgcttgcttcagcacattgggatgcacagaaacgtgagggcaggggggcagttgtggtcgcccctccccagttgtgcatgtacccggctacttaggtatgcttaggggagctggtggccaggggtgccccttcaggcctgctctcacagtgaaaccacttcaagacagggcaggaagttaccttcctggtgcacacaccgaagtgctcgagggagaggctgccgccccctctccccttccctggctgtggacactggcagccaatggggaggcggcctctcccctgttgctgcccgtgtccacacaggaatgtacactggtggcagaaacatgcatttgccataaataattcagaaacacttgtatggtcctgtaaaacttctctggtgtttgttgacttctgcctgtgggtctgaggaagggagaaggcagaacccataggcagtccctgggcaagggaggattttcccggccgcagcacagccttccattcatgtgcacgtgagtctggtgaaaatggccttgtgaagtccagtgtctgtcatgcccctgagttcttttggtcccagagaggcagcctgggcagtctgtttacagctggcaaacagactggctggcaagttgtggggctgggtcagaaagtgtctggacttgtaatcgggtgccctgctgtccacaggtggactctggggaagccaggcccctggatcccaagtcctttgtgtccggagcctttcctggcctgtgcctggagggtagcacatctttccagcctcccagggctttgcagcctgcagatgccacctgtccctgagagaagttagcgtccctggccctggccggtggtctctcatccttgtgtgctgctctgctaagagatgtccaaggcggagccggggcaagatccttccagactcatctgtcagagccccaagccctttagacccagagcccaaggaccatgcctttgggacattaggactgcagcctttgcttctgtgtattttggagttttggtgacttttgtcacctggacacactcatttgttagccatagtgggttcccttggtcagcaacagtgcatgtacctctggatgtcatctgaggtgagaccaccgaggccttttctctctgtgtacagaggggagttaggagttgctggactggatgcattacgaggactggggacagggtagagggacatccagggatcagggcatgagtgggggcaacccccggctctgccctggcatggtctccgcatgggctgaggtgtagctgattggtgccacatttcggccatgctggctggcgtgcccatgttgcagatatttcccgagntccccagaatggatggtattgaatctcanncacatgcaacactgtgtccagcattctttgcaataaatactcttaaaaaacaaaaaacaa

SEQ ID NO: 295649 - DNA, 881 bp, Homo sapiens
gatggacagaggctcgttaggaggcagctccctgaccgacctggggccggggagcagcaggcgggtgtgcatgaccaactgcccaactctcattgtcatggtgggcctgcccgccaggggcaagacctacatctccaagaagctgactcgatacctgaactggattggtgtgcccactcgggagttcaatgttggccagtatcgccgggacgtggtcaagacctacaaatcttttgaattttttctccccgacaatgaagagggcctgaaaatcaggaaatgaggaaactgaggctcagacaggccaggagtctcgcacaaaatagcaagtttacatcagcgcccagacttgaatctaagcccatccaccgctaaaaagtgtccatcattccaatattcctcaataggttcaagcaattcttctgcctcagccaacaaccccaagctgtggacgctgatagcctactgtctgatcttcccagcagcttctgtggtgggcggtgcctcacttttccagatgctgggaccaaggccagaaagtgatgggggtgccttgggtcactcagggtttgaatttgaagtccgtcctgcctgaatccatagtgtttgtggggagagtctgccagctgttccactctggctgtccccctaaggtagggatatttgggattaattcaaatgaagagacctagactcagagaggttgggaagctagtccaaggtcaccctgcaacagaagctggggacaggctcattgctgcctttctgcaggcataccctctggctgccctagaaaccctctctgctgtatccgaatcctggctctggctgggccacagggccatctcctattaatcagcccaaaatttcccaattagcaa

SEQ ID NO: 295650 - DNA, 447 bp, Homo sapiens
caaggaaccaccaatgatcagtgttcctagaggtcctcccctccttagacaggtttctgttcccttcacccaggaaatgcccgtgaacttggtctcttctgcttgatgctgcctcaccccacatgtccccaaggctcatcttctgggcctgtaggaggtgtgatgactgtggtatctccctagggcgtctgtgaggaaatgacctacgaggaaattcaggataattatccactggagttcgccctgcgggaccaggacaagtaccggtaccggtaccctaaaggggaggtaggtgggatttggggcttagtcccagccacctactgcccgcctgggagtaccacctgtggctgagggcctgtggggctctgcaggggctgcgtgggtagcagaaggggcctggtctcagaggcctgccagcctgggtgtgtggttcatctccacccc

SEQ ID NO: 295651 - DNA, 856 bp, Homo sapiens
gaaaatcttgggccacacactgtggcttacacctgtaatcttagcactttgggaagctgagacgggaggatcacttgaggttgggagtttgagcccagactggccaaatggtgaaaccctatctctactaaaaatataaatattagccttgtgtgggggcgcacacgtgtagtctcagccactagggaggctgaggcaggagaatcacttgaacccaggaggcggaggttgcagcgagccaagatcgtgccattgcacttcagcttgggtgacagagcaagactctgtctcaaaaaaaacaaagtcttatgacctctttggcatgtactttagagaggaaatcttacccaagccagaaagtctcagtctaggcattttttttattgtgcaagcatataaaattctagtaattctggggctaatcctgtgatagggagaattcaaggaaaggtggtggtgacccagtgctgccgttttctccttaggtgacgcatccaaagaagacattgacactgctatgaaattaggagccggttaccccatgggcccatttgagcttctagattatgtcggactggatactacgaagttcatcgtggatgggtggcatgaaatggatgcagagaacccattacatcagcccagcccatccttaaataagctggtagcagagaacaagttcggcaagaagactggagaaggattttacaaatacaagtgatgtgcagcttctccggctctgagaagaacacctgagagcgctttccagccagtgccccgagtgcctgtgggaatgctctttggtcagacattccctcacacagtacagtttaataaatgtgcattttgattgtaa

SEQ ID NO: 295652 - DNA, 740 bp, Homo sapiens
gaaaatcttgggccacacactgtggcttacacctgtaatcttagcactttgggaagctgagacgggaggatcacttgaggttgggagtttgagcccagactggccaaatggtgaaaccctatctctactaaaaatataaatattagccttgtgtgggggcgcacacgtgtagtctcagccactagggaggctgaggcaggagaatcacttgaacccaggaggcggaggttgcagcgagccaagatcgtgccattgcacttcagcttgggtgacagagcaagactctgtctcaaaaaaaacaaagtcttatgacctctttggcatgtactttagagaggaaatcttacccaagccagaaagtctcagtctaggcattttttttattgtgcaagcatataaaattctagtaattctggggctaatcctgtgatagggagaattcaaggaaaggtggtggtgacccagtgctgccgttttctccttaggtgacgcatccaaagaagacattgacactgctatgaaattaggagccggttaccccatgggcccatttgagcttctagattatgtcggactggatactacgaagttcatcgtggatgggtggcatgaaatggatgcagagaacccattacatcagcccagcccatccttaaataagctggtagcagagaacaaaaaacgcccacagggctgtaccacacggaccacaccaaaaacagttttctcctgaaaaacgt

SEQ ID NO: 295653 - DNA, 408 bp, Homo sapiens
aaaaatatatcttctttatcgatgtttaagtagtttctctctgagtgtcttaacatttttccctctttagctttgatctgattgacttcttaatgctttggaacaaaattctagatagccacctgttgcagactattctacttttctgatttcaaagaaagggaacagattgttctccataaaggcctcttggggccaaaggacatagtaaatttccaagggaaaagcacattgatccttgtcgtagtctactcaacagacttccaaacgtgtggtgattctaactcgggtttgggcttttctttaaaaggtatcttgactaaaaggtttgtgtgaaatgtgatgccaggggaatactccttacttgtaaaacccaaaaaactgggggaaagaatacatacaataact

SEQ ID NO: 295654 - DNA, 1978 bp, Homo sapiens
cgtgtatacccgctcaacgctgggacgttacagccagggccaatgggcagagcgggactcgaggccccgcccccgccttgtggcgtcacggggacgccgggggcgcgcgggctgcagggccgcgtaggtccccgcccccagagtctggctttccgcggctgcccgcctcgcgcgtcttccctgcccgggtctcctcgctgtcgccgccgctgccacaccatggccttcgtcaccaggcagttcatgcgttccgtgtcctcctcgtccaccgcctcggcctcggccaagaagataatcgtcaagcacgtgacggtcatcggcggcgggctgatgggcgccggcattgcccaggttgctgcagcaactggtcacacagtagtgttggtagaccagacagaggacatcctggcaaaatccaaaaagggaattgaggaaagccttaggaaagtggcaaagaagaagtttgcagaaaaccctaaggccggcgatgaatttgtggagaagaccctgagcaccatagcgaccagcacggatgcagcctccgttgtccacagcacagacttggtggtggaagccatcgtggagaatctgaaggtgaaaaacgagctcttcaaaaggctggacaagtttgctgctgaacatacaatctttgccagcaacacttcctccttgcagattacaagcatagctaatgccaccaccagacaagaccgattcgctggcctccatttcttcaacccagtgcctgtcatgaaacttgtggaggtcattaaaacaccaatgaccagccagaagacatttgaatctttggtagactttagcaaagccctaggaaagcatcctgtttcttgcaaggacactcctgggtttattgtgaaccgcctcctggttccatacctcatggaagcaatcaggctgtatgaacgaggtgacgcatccaaagaagacattgacactgctatgaaattaggagccggttaccccatgggcccatttgagcttctagattatgtcggactggatactacgaagttcatcgtggatgggtggcatgaaatggatgcagagaacccattacatcagcccagcccatccttaaataagctggtagcagagaacaagttcggcaagaagactggagaaggattttacaaatacaagtgatgtgcagcttctccggctctgagaagaacacctgagagcgctttccagccagtgccccgagtgcctgtgggaatgctctttggtcagacattccctcacacagtacagtttaataaatgtgcattttgattgtaatctatcgaagtgattattacaccagttacagcagtaatagattctccattaagaaataattcccttttttagtctgttcatttctgtgtattttctaaacagctttacacccttggtgccttggagcaaacatgttttttgaaccttgtcatttttgtgaagaattgcctagattccttctctcatcaacgggaaagtacttcctctgagagtgcgagtgcaccatgctcactgttgctgcgtgggagagtcacaagccactggcaagcaagtggtatagtctgtgaagcactgcagcgagcagcacctggatcttgcctttataagaacattttactacctgcagctttgagtcttgccctacattttgggcatgacataagatgtgtctttattcagctcgtcgtgaagatgctgctgctgaatgggtcagcatatctctgtttgcatggtttgcaggaggtcggttttcatggtcattcagttccacagatctgaatgattactgtctgtctgtgtcttttttccatgagaaatcactgttgcaaattgcctataaattgactctactaaaataacaatgtttcagtctgaaaatttgaattgaaaaaaatgtataatataaaattgtaatacactcaaatgattataaaagtaaaagttggtaatttaggcagaa

SEQ ID NO: 295655 - DNA, 2123 bp, Homo sapiens
cgtgtatacccgctcaacgctgggacgttacagccagggccaatgggcagagcgggactcgaggccccgcccccgccttgtggcgtcacggggacgccgggggcgcgcgggctgcagggccgcgtaggtccccgcccccagagtctggctttccgcggctgcccgcctcgcgcgtcttccctgcccgggtctcctcgctgtcgccgccgctgccacaccatggccttcgtcaccaggcagttcatgcgttccgtgtcctcctcgtccaccgcctcggcctcggccaagaagataatcgtcaagcacgtgacggtcatcggcggcgggctgatgggcgccggcattgcccaggttgctgcagcaactggtcacacagtagtgttggtagaccagacagaggacatcctggcaaaatccaaaaagggaattgaggaaagccttaggaaagtggcaaagaagaagtttgcagaaaaccctaaggccggcgatgaatttgtggagaagaccctgagcaccatagcgaccagcacggatgcagcctccgttgtccacagcacagacttggtggtggaagccatcgtggagaatctgaaggtgaaaaacgagctcttcaaaaggctggacaagtttgctgctgaacatacaatctttgccagcaacacttcctccttgcagattacaagcatagctaatgccaccaccagacaagaccgattcgctggcctccatttcttcaacccagtgcctgtcatgaaacttgtggaggtcattaaaacaccaatgaccagccagaagacatttgaatctttggtagactttagcaaagccctaggaaagcatcctgtttcttgcaaggacactcctgggtttattgtgaaccgcctcctggttccatacctcatggaagcaatcaggctgtatgaacgaggtgacgcatccaaagaagacattgacactgctatgaaattaggagccggttaccccatgggcccatttgagcttctagattatgtcggactggatactacgaagttcatcgtggatgggtggcatgaaatggatgcagagaacccattacatcagcccagcccatccttaaataagctggtagcagagaacaagttcggcaagaagactggagaaggattttacaaatacaagtgatgtgcagcttctccggctctgagaagaacacctgagagcgctttccagccagtgccccgagtgcctgtgggaatgctctttggtcagacattccctcacacagtacagtttaataaatgtgcattttgattgtaatctatcgaagtgattattacaccagttacagcagtaatagattctccattaagaaataattcccttttttagtctgttcatttctgtgtattttctaaacagctttacacccttggtgccttggagcaaacatgttttttgaaccttgtcatttttgtgaagaattgcctagattccttctctcatcaacgggaaagtacttcctctgagagtgcgagtgcaccatgctcactgttgctgcgtgggagagtcacaagccactggcaagcaagtggtatagtctgtgaagcactgcagcgagcagcacctggatcttgcctttataagaacattttactacctgcagctttgagtcttgccctacattttgggcatgacataagatgtgtctttattcagctcgtcgtgaagatgctgctgctgaatgggtcagcatatctctgtttgcatggtttgcaggaggtcggttttcatggtcattcagttccacagatctgaatgattactgtctgtctgtgtcttttttccatgagaaatcactgttgcaaattgcctataaattgactctactaaaataacaatgtttcagtctgaaaatttgaattgaaaaaaatgtataatataaaattgtaatacactcaaatgattataaaagtaaaagttggtaatttaggcagaaaaaaaaaagcggacgcgtgggtttgaatcttaaactgtatttttctcttagtattgctaatgagtaaagaaaagtctcataaggtagccaaatgaaaaagaatgaaagggaaagtgaaaaattaaggggacaaaagatgggatgt

SEQ ID NO: 295656 - DNA, 2318 bp, Homo sapiens
cgtgtatacccgctcaacgctgggacgttacagccagggccaatgggcagagcgggactcgaggccccgcccccgccttgtggcgtcacggggacgccgggggcgcgcgggctgcagggccgcgtaggtccccgcccccagagtctggctttccgcggctgcccgcctcgcgcgtcttccctgcccgggtctcctcgctgtcgccgccgctgccacaccatggccttcgtcaccaggcagttcatgcgttccgtgtcctcctcgtccaccgcctcggcctcggccaagaagataatcgtcaagcacgtgacggtcatcggcggcgggctgatgggcgccggcattgcccaggttgctgcagcaactggtcacacagtagtgttggtagaccagacagaggacatcctggcaaaatccaaaaagggaattgaggaaagccttaggaaagtggcaaagaagaagtttgcagaaaaccctaaggccggcgatgaatttgtggagaagaccctgagcaccatagcgaccagcacggatgcagcctccgttgtccacagcacagacttggtggtggaagccatcgtggagaatctgaaggtgaaaaacgagctcttcaaaaggctggacaagtttgctgctgaacatacaatctttgccagcaacacttcctccttgcagattacaagcatagctaatgccaccaccagacaagaccgattcgctggcctccatttcttcaacccagtgcctgtcatgaaacttgtggaggtcattaaaacaccaatgaccagccagaagacatttgaatctttggtagactttagcaaagccctaggaaagcatcctgtttcttgcaaggacactcctgggtttattgtgaaccgcctcctggttccatacctcatggaagcaatcaggctgtatgaacgaggtgacgcatccaaagaagacattgacactgctatgaaattaggagccggttaccccatgggcccatttgagcttctagattatgtcggactggatactacgaagttcatcgtggatgggtggcatgaaatggatgcagagaacccattacatcagcccagcccatccttaaataagctggtagcagagaacaagttcggcaagaagactggagaaggattttacaaatacaagtgatgtgcagcttctccggctctgagaagaacacctgagagcgctttccagccagtgccccgagtgcctgtgggaatgctctttggtcagacattccctcacacagtacagtttaataaatgtgcattttgattgtaatctatcgaagtgattattacaccagttacagcagtaatagattctccattaagaaataattcccttttttagtctgttcatttctgtgtattttctaaacagctttacacccttggtgccttggagcaaacatgttttttgaaccttgtcatttttgtgaagaattgcctagattccttctctcatcaacgggaaagtacttcctctgagagtgcgagtgcaccatgctcactgttgctgcgtgggagagtcacaagccactggcaagcaagtggtatagtctgtgaagcactgcagcgagcagcacctggatcttgcctttataagaacattttactacctgcagctttgagtcttgccctacattttgggcatgacataagatgtgtctttattcagctcgtcgtgaagatgctgctgctgaatgggtcagcatatctctgtttgcatggtttgcaggaggtcggttttcatggtcattcagttccacagatctgaatgattactgtctgtctgtgtcttttttccatgagaaatcactgttgcaaattgcctataaattgactctactaaaataacaatgtttcagtctgaaaatttgaattgaaaaaaatgtataatataaaattgtaatacactcaaatgattataaaagtaaaagttggtaatttaggcagaaaaaaaaaaaaaaaaaaaaaaaaaaaaaaaaaaaaaaaaaaaaaaaaaaaccatgcagaccgcttggacccaaccaattttaaactcgaccaggttaatgcttgcggccgaatttcaagctaattgggccaattggccttatagggagccggtttacaattaattggccgccgtttaacaacgtcgggactggaaaacccttgcggttccccaattaaatggctttgaagaacatcccctttttgcagttgcggaataaccaaaaagccccgaccgaatggcctttccaacaattggccaacctgaatgccaattgaaaaatgtaggcgtaataatttgga

SEQ ID NO: 295657 - DNA, 1299 bp, Homo sapiens
cgtgtatacccgctcaacgctgggacgttacagccagggccaatgggcagagcgggactcgaggccccgcccccgccttgtggcgtcacggggacgccgggggcgcgcgggctgcagggccgcgtaggtccccgcccccagagtctggctttccgcggctgcccgcctcgcgcgtcttccctgcccgggtctcctcgctgtcgccgccgctgccacaccatggccttcgtcaccaggcagttcatgcgttccgtgtcctcctcgtccaccgcctcggcctcggccaagaagataatcgtcaagcacgtgacggtcatcggcggcgggctgatgggcgccggcattgcccaggttgctgcagcaactggtcacacagtagtgttggtagaccagacagaggacatcctggcaaaatccaaaaagggaattgaggaaagccttaggaaagtggcaaagaagaagtttgcagaaaaccctaaggccggcgatgaatttgtggagaagaccctgagcaccatagcgaccagcacggatgcagcctccgttgtccacagcacagacttggtggtggaagccatcgtggagaatctgaaggtgaaaaacgagctcttcaaaaggctggacaagtttgctgctgaacatacaatctttgccagcaacacttcctccttgcagattacaagcatagctaatgccaccaccagacaagaccgattcgctggcctccatttcttcaacccagtgcctgtcatgaaacttgtggaggtcattaaaacaccaatgaccagccagaagacatttgaatctttggtagactttagcaaagccctaggaaagcatcctgtttcttgcaaggacactcctgggtttattgtgaaccgcctcctggttccatacctcatggaagcaatcaggctgtatgaacgaggtgacgcatccaaagaagacattgacactgctatgaaattaggagccggttaccccatgggcccatttgagcttctagattatgtcggactggatactacgaagttcatcgtggatgggtggcatgaaatggatgcagagaacccattacatcagcccagcccatccttaaataagctggtagcagagaacaagttcggcaagaagactggagaaggattttacaaatacaagtgatgtgcagcttctccggctctgagaagaacacctgagagcgctttccagccagtgccccgagtgcctgtgggaatgctctttggtcagacattccctcacacagtacagtttaataaatgtgcattttgattgtaa

SEQ ID NO: 295658 - DNA, 2029 bp, Homo sapiens
cgtgtatacccgctcaacgctgggacgttacagccagggccaatgggcagagcgggactcgaggccccgcccccgccttgtggcgtcacggggacgccgggggcgcgcgggctgcagggccgcgtaggtccccgcccccagagtctggctttccgcggctgcccgcctcgcgcgtcttccctgcccgggtctcctcgctgtcgccgccgctgccacaccatggccttcgtcaccaggcagttcatgcgttccgtgtcctcctcgtccaccgcctcggcctcggccaagaagataatcgtcaagcacgtgacggtcatcggcggcgggctgatgggcgccggcattgcccaggttgctgcagcaactggtcacacagtagtgttggtagaccagacagaggacatcctggcaaaatccaaaaagggaattgaggaaagccttaggaaagtggcaaagaagaagtttgcagaaaaccctaaggccggcgatgaatttgtggagaagaccctgagcaccatagcgaccagcacggatgcagcctccgttgtccacagcacagacttggtggtggaagccatcgtggagaatctgaaggtgaaaaacgagctcttcaaaaggctggacaagtttgctgctgaacatacaatctttgccagcaacacttcctccttgcagattacaagcatagctaatgccaccaccagacaagaccgattcgctggcctccatttcttcaacccagtgcctgtcatgaaacttgtggaggtcattaaaacaccaatgaccagccagaagacatttgaatctttggtagactttagcaaagccctaggaaagcatcctgtttcttgcaaggacactcctgggtttattgtgaaccgcctcctggttccatacctcatggaagcaatcaggctgtatgaacgagacttccaaacgtgtggtgattctaactcgggtttgggcttttctttaaaaggtgacgcatccaaagaagacattgacactgctatgaaattaggagccggttaccccatgggcccatttgagcttctagattatgtcggactggatactacgaagttcatcgtggatgggtggcatgaaatggatgcagagaacccattacatcagcccagcccatccttaaataagctggtagcagagaacaagttcggcaagaagactggagaaggattttacaaatacaagtgatgtgcagcttctccggctctgagaagaacacctgagagcgctttccagccagtgccccgagtgcctgtgggaatgctctttggtcagacattccctcacacagtacagtttaataaatgtgcattttgattgtaatctatcgaagtgattattacaccagttacagcagtaatagattctccattaagaaataattcccttttttagtctgttcatttctgtgtattttctaaacagctttacacccttggtgccttggagcaaacatgttttttgaaccttgtcatttttgtgaagaattgcctagattccttctctcatcaacgggaaagtacttcctctgagagtgcgagtgcaccatgctcactgttgctgcgtgggagagtcacaagccactggcaagcaagtggtatagtctgtgaagcactgcagcgagcagcacctggatcttgcctttataagaacattttactacctgcagctttgagtcttgccctacattttgggcatgacataagatgtgtctttattcagctcgtcgtgaagatgctgctgctgaatgggtcagcatatctctgtttgcatggtttgcaggaggtcggttttcatggtcattcagttccacagatctgaatgattactgtctgtctgtgtcttttttccatgagaaatcactgttgcaaattgcctataaattgactctactaaaataacaatgtttcagtctgaaaatttgaattgaaaaaaatgtataatataaaattgtaatacactcaaatgattataaaagtaaaagttggtaatttaggcagaa

SEQ ID NO: 295659 - DNA, 2231 bp, Homo sapiens
cgtgtatacccgctcaacgctgggacgttacagccagggccaatgggcagagcgggactcgaggccccgcccccgccttgtggcgtcacggggacgccgggggcgcgcgggctgcagggccgcgtaggtccccgcccccagagtctggctttccgcggctgcccgcctcgcgcgtcttccctgcccgggtctcctcgctgtcgccgccgctgccacaccatggccttcgtcaccaggcagttcatgcgttccgtgtcctcctcgtccaccgcctcggcctcggccaagaagataatcgtcaagcacgtgacggtcatcggcggcgggctgatgggcgccggcattgcccaggaaagaggttggcctcagcagcaatgagggataattctttcaagaaaggaatgaagagagaagttagatggaaaagagatttttaaggtcaaaagaagcagctgaagaacatgtgtaggacagccttaggagttactacacttcaagacctgggtgtctgctggaggaaggaacatgaccctgcggagatgttaagggttgggagagctgagcttggaggctggaagcccagctgggaggctatgttaaagaggttgctgcagcaactggtcacacagtagtgttggtagaccagacagaggacatcctggcaaaatccaaaaagggaattgaggaaagccttaggaaagtggcaaagaagaagtttgcagaaaaccctaaggccggcgatgaatttgtggagaagaccctgagcaccatagcgaccagcacggatgcagcctccgttgtccacagcacagacttggtggtggaagccatcgtggagaatctgaaggtgaaaaacgagctcttcaaaaggctggacaagtttgctgctgaacatacaatctttgccagcaacacttcctccttgcagattacaagcatagctaatgccaccaccagacaagaccgattcgctggcctccatttcttcaacccagtgcctgtcatgaaacttgtggaggtcattaaaacaccaatgaccagccagaagacatttgaatctttggtagactttagcaaagccctaggaaagcatcctgtttcttgcaaggacactcctgggtttattgtgaaccgcctcctggttccatacctcatggaagcaatcaggctgtatgaacgaggtgacgcatccaaagaagacattgacactgctatgaaattaggagccggttaccccatgggcccatttgagcttctagattatgtcggactggatactacgaagttcatcgtggatgggtggcatgaaatggatgcagagaacccattacatcagcccagcccatccttaaataagctggtagcagagaacaagttcggcaagaagactggagaaggattttacaaatacaagtgatgtgcagcttctccggctctgagaagaacacctgagagcgctttccagccagtgccccgagtgcctgtgggaatgctctttggtcagacattccctcacacagtacagtttaataaatgtgcattttgattgtaatctatcgaagtgattattacaccagttacagcagtaatagattctccattaagaaataattcccttttttagtctgttcatttctgtgtattttctaaacagctttacacccttggtgccttggagcaaacatgttttttgaaccttgtcatttttgtgaagaattgcctagattccttctctcatcaacgggaaagtacttcctctgagagtgcgagtgcaccatgctcactgttgctgcgtgggagagtcacaagccactggcaagcaagtggtatagtctgtgaagcactgcagcgagcagcacctggatcttgcctttataagaacattttactacctgcagctttgagtcttgccctacattttgggcatgacataagatgtgtctttattcagctcgtcgtgaagatgctgctgctgaatgggtcagcatatctctgtttgcatggtttgcaggaggtcggttttcatggtcattcagttccacagatctgaatgattactgtctgtctgtgtcttttttccatgagaaatcactgttgcaaattgcctataaattgactctactaaaataacaatgtttcagtctgaaaatttgaattgaaaaaaatgtataatataaaattgtaatacactcaaatgattataaaagtaaaagttggtaatttaggcagaa

SEQ ID NO: 295660 - DNA, 2441 bp, Homo sapiens
cgtgtatacccgctcaacgctgggacgttacagccagggccaatgggcagagcgggactcgaggccccgcccccgccttgtggcgtcacggggacgccgggggcgcgcgggctgcagggccgcgtaggtccccgcccccagagtctggctttccgcggctgcccgcctcgcgcgtcttccctgcccgggtctcctcgctgtcgccgccgctgccacaccatggccttcgtcaccaggcagttcatgcgttccgtgtcctcctcgtccaccgcctcggcctcggccaagaagataatcgtcaagcacgtgacggtcatcggcggcgggctgatgggcgccggcattgcccaggttgctgcagcaactggtcacacagtagtgttggtagaccagacagaggacatcctggcaaaatccaaaaagggaattgaggaaagccttaggaaagtggcaaagaagaagtttgcagaaaaccctaaggccggcgatgaatttgtggagaagaccctgagcaccatagcgaccagcacggatgcagcctccgttgtccacagcacagacttggtggtggaagccatcgtggagaatctgaaggtgaaaaacgagctcttcaaaaggctggacaagtttgctgctgaacatacaatctttgccagcaacacttcctccttgcagattacaagcatagctaatgccaccaccagacaagaccgattcgctggcctccatttcttcaacccagtgcctgtcatgaaacttgtggaggtcattaaaacaccaatgaccagccagaagacatttgaatctttggtagactttagcaaagccctaggaaagcatcctgtttcttgcaaggacactcctgggtttattgtgaaccgcctcctggttccatacctcatggaagcaatcaggctgtatgaacgaggtgacgcatccaaagaagacattgacactgctatgaaattaggagccggttaccccatgggcccatttgagcttctagattatgtcggactggatactacgaagttcatcgtggatgggtggcatgaaatggatgcagagaacccattacatcagcccagcccatccttaaataagctggtagcagagaacaagttcggcaagaagactggagaaggattttacaaatacaagtgatgtgcagcttctccggctctgagaagaacacctgagagcgctttccagccagtgccccgagtgcctgtgggaatgctctttggtcagacattccctcacacagtacagtttaataaatgtgcattttgattgtaaaaaaaaaaaaaaaaaaaaaaaaaaaaaaaaaaaagggggggccccccaaaatatttcccccggggggccccaatttcgccgtatccccaagtttttgtggttccaaagggtgccccatttaagagggagcgcatatatataaacgcatagggcactgggcccgccggtttaacaaacgcgctgcacacggggaacaacctgggataccctgggacacccttgggagaagggacccattatatcccgggggggggacacaatatatttggcggaacaaactctcccatcacaagaagatttaaaagaggcctcaagggggcaacattaatcaaccaattttcaacagggggttatcacacagggcggtgtaaacccacaccggtggccaatagtgacgcgacgggcctgagaacaagtttggcgacacaacaggagactattgcattgttgtgagaccaatcttttttaatcccgcgagggaccctggtgttcaacaaaaacacagatacggagacagagagaagacgatggatgacgacgagaggaaagacagcagagaagaacataccaacggacagagcagaagaagaagacaaaaggtaaaagaaatacaagagaaagacgtcagacaggggagatagcatacagagaagaagtgagcagaacgaaagagacacagcgaagagcacaacacaagagaagaatcgagcaagtaaccaggaggagatgagagagcaaaggaagagggagcccaacgcagcagaaaagaacgacacgaagagcagacagtgaaggaagagacagagagagagggaaagacaagagaaggaggcagaggagcggcgagagagaacaagaatgacgaaagaatggacggaaaaatcgtaagcggaactagaagggaagaaaagagagtaagagaaagagagaagtacgaggatagagagagcgaggcgagcgaggagaatgagaagagtacaacgaagaaataaaacaaggaggagtagaagaagaacgaccagcagctgtaagggaaggaaagacaggaagaaagaccgaacaaagcaagagcaagcggaggggtagcaagacgcaacgaaaggaacagggactgacagacgagacaagagctagggaagaag

SEQ ID NO: 295661 - DNA, 1917 bp, Homo sapiens
cgtgtatacccgctcaacgctgggacgttacagccagggccaatgggcagagcgggactcgaggccccgcccccgccttgtggcgtcacggggacgccgggggcgcgcgggctgcagggccgcgtaggtccccgcccccagagtctggctttccgcggctgcccgcctcgcgcgtcttccctgcccgggtctcctcgctgtcgccgccgctgccacaccatggccttcgtcaccaggcagttcatgcgttccgtgtcctcctcgtccaccgcctcggcctcggccaagaagataatcgtcaagcacgtgacggtcatcggcggcgggctgatgggcgccggcattgcccaggttgctgcagcaactggtcacacagtagtgttggtagaccagacagaggacatcctggcaaaatccaaaaagggaattgaggaaagccttaggaaagtggcaaagaagaagtttgcagaaaaccctaaggccggcgatgaatttgtggagaagaccctgagcaccatagcgaccagcacggatgcagcctccgttgtccacagcacagacttggtggtggaagccatcgtggagaatctgaaggtgaaaaacgagctcttcaaaaggctggacaagtttgctgctgaacatacaatctttgccagcaacacttcctccttgcagattacaagcatagctaatgccaccaccagacaagaccgattcgctggcctccatttcttcaacccagtgcctgtcatgaaacttgtggagccctaggaaagcatcctgtttcttgcaaggacactcctgggtttattgtgaaccgcctcctggttccatacctcatggaagcaatcaggctgtatgaacgaggtgacgcatccaaagaagacattgacactgctatgaaattaggagccggttaccccatgggcccatttgagcttctagattatgtcggactggatactacgaagttcatcgtggatgggtggcatgaaatggatgcagagaacccattacatcagcccagcccatccttaaataagctggtagcagagaacaagttcggcaagaagactggagaaggattttacaaatacaagtgatgtgcagcttctccggctctgagaagaacacctgagagcgctttccagccagtgccccgagtgcctgtgggaatgctctttggtcagacattccctcacacagtacagtttaataaatgtgcattttgattgtaatctatcgaagtgattattacaccagttacagcagtaatagattctccattaagaaataattcccttttttagtctgttcatttctgtgtattttctaaacagctttacacccttggtgccttggagcaaacatgttttttgaaccttgtcatttttgtgaagaattgcctagattccttctctcatcaacgggaaagtacttcctctgagagtgcgagtgcaccatgctcactgttgctgcgtgggagagtcacaagccactggcaagcaagtggtatagtctgtgaagcactgcagcgagcagcacctggatcttgcctttataagaacattttactacctgcagctttgagtcttgccctacattttgggcatgacataagatgtgtctttattcagctcgtcgtgaagatgctgctgctgaatgggtcagcatatctctgtttgcatggtttgcaggaggtcggttttcatggtcattcagttccacagatctgaatgattactgtctgtctgtgtcttttttccatgagaaatcactgttgcaaattgcctataaattgactctactaaaataacaatgtttcagtctgaaaatttgaattgaaaaaaatgtataatataaaattgtaatacactcaaatgattataaaagtaaaagttggtaatttaggcagaa

SEQ ID NO: 295662 - DNA, 1535 bp, Homo sapiens
gaaaatcttgggccacacactgtggcttacacctgtaatcttagcactttgggaagctgagacgggaggatcacttgaggttgggagtttgagcccagactggccaaatggtgaaaccctatctctactaaaaatataaatattagccttgtgtgggggcgcacacgtgtagtctcagccactagggaggctgaggcaggagaatcacttgaacccaggaggcggaggttgcagcgagccaagatcgtgccattgcacttcagcttgggtgacagagcaagactctgtctcaaaaaaaacaaagtcttatgacctctttggcatgtactttagagaggaaatcttacccaagccagaaagtctcagtctaggcattttttttattgtgcaagcatataaaattctagtaattctggggctaatcctgtgatagggagaattcaaggaaaggtggtggtgacccagtgctgccgttttctccttaggtgacgcatccaaagaagacattgacactgctatgaaattaggagccggttaccccatgggcccatttgagcttctagattatgtcggactggatactacgaagttcatcgtggatgggtggcatgaaatggatgcagagaacccattacatcagcccagcccatccttaaataagctggtagcagagaacaagttcggcaagaagactggagaaggattttacaaatacaagtgatgtgcagcttctccggctctgagaagaacacctgagagcgctttccagccagtgccccgagtgcctgtgggaatgctctttggtcagacattccctcacacagtacagtttaataaatgtgcattttgattgtaatctatcgaagtgattattacaccagttacagcagtaatagattctccattaagaaataattcccttttttagtctgttcatttctgtgtattttctaaacagctttacacccttggtgccttggagcaaacatgttttttgaaccttgtcatttttgtgaagaattgcctagattccttctctcatcaacgggaaagtacttcctctgagagtgcgagtgcaccatgctcactgttgctgcgtgggagagtcacaagccactggcaagcaagtggtatagtctgtgaagcactgcagcgagcagcacctggatcttgcctttataagaacattttactacctgcagctttgagtcttgccctacattttgggcatgacataagatgtgtctttattcagctcgtcgtgaagatgctgctgctgaatgggtcagcatatctctgtttgcatggtttgcaggaggtcggttttcatggtcattcagttccacagatctgaatgattactgtctgtctgtgtcttttttccatgagaaatcactgttgcaaattgcctataaattgactctactaaaataacaatgtttcagtctgaaaatttgaattgaaaaaaatgtataatataaaattgtaatacactcaaatgattataaaagtaaaagttggtaatttaggcagaa

SEQ ID NO: 295663 - DNA, 1142 bp, Homo sapiens
gctgcaggaattggcacgaggtctcagtctaggcattttttttattgtgcaagcatagtggtggtgacccagtgctgccgttttctccttaggtgacgcatccaaagaagacattgacactgctatgaaattaggagccggttaccccatgggcccatttgagcttctagattatgtcggactggatactacgaagttcatcgtggatgggtggcatgaaatggatgcagagaacccattacatcagcccagcccatccttaaataagctggtagcagagaacaagttcggcaagaagactggagaaggattttacaaatacaagtgatgtgcagcttctccggctctgagaagaacacctgagagcgctttccagccagtgccccgagtgcctgtgggaatgctctttggtcagacattccctcacacagtacagtttaataaatgtgcattttgattgtaatctatcgaagtgattattacaccagttacagcagtaatagattctccattaagaaataattcccttttttagtctgttcatttctgtgtattttctaaacagctttacacccttggtgccttggagcaaacatgttttttgaaccttgtcatttttgtgaagaattgcctagattccttctctcatcaacgggaaagtacttcctctgagagtgcgagtgcaccatgctcactgttgctgcgtgggagagtcacaagccactggcaagcaagtggtatagtctgtgaagcactgcagcgagcagcacctggatcttgcctttataagaacattttactacctgcagctttgagtcttgccctacattttgggcatgacataagatgtgtctttattcagctcgtcgtgaagatgctgctgctgaatgggtcagcatatctctgtttgcatggtttgcaggaggtcggttttcatggtcattcagttccacagatctgaatgattactgtctgtctgtgtcttttttccatgagaaatcactgttgcaaattgcctataaattgactctactaaaataacaatgtttcagtctgaaaatttgaattgaaaaaaatgtataatataaaattgtaatacactcaaatgattataaaagtaaaagttggtaatttaggcagaa

SEQ ID NO: 295664 - DNA, 1360 bp, Homo sapiens
aaaaatatatcttctttatcgatgtttaagtagtttctctctgagtgtcttaacatttttccctctttagctttgatctgattgacttcttaatgctttggaacaaaattctagatagccacctgttgcagactattctacttttctgatttcaaagaaagggaacagattgttctccataaaggcctcttggggccaaaggacatagtaaatttccaagggaaaagcacattgatccttgtcgtagtctactcaacagacttccaaacgtgtggtgattctaactcgggtttgggcttttctttaaaaggtgacgcatccaaagaagacattgacactgctatgaaattaggagccggttaccccatgggcccatttgagcttctagattatgtcggactggatactacgaagttcatcgtggatgggtggcatgaaatggatgcagagaacccattacatcagcccagcccatccttaaataagctggtagcagagaacaagttcggcaagaagactggagaaggattttacaaatacaagtgatgtgcagcttctccggctctgagaagaacacctgagagcgctttccagccagtgccccgagtgcctgtgggaatgctctttggtcagacattccctcacacagtacagtttaataaatgtgcattttgattgtaatctatcgaagtgattattacaccagttacagcagtaatagattctccattaagaaataattcccttttttagtctgttcatttctgtgtattttctaaacagctttacacccttggtgccttggagcaaacatgttttttgaaccttgtcatttttgtgaagaattgcctagattccttctctcatcaacgggaaagtacttcctctgagagtgcgagtgcaccatgctcactgttgctgcgtgggagagtcacaagccactggcaagcaagtggtatagtctgtgaagcactgcagcgagcagcacctggatcttgcctttataagaacattttactacctgcagctttgagtcttgccctacattttgggcatgacataagatgtgtctttattcagctcgtcgtgaagatgctgctgctgaatgggtcagcatatctctgtttgcatggtttgcaggaggtcggttttcatggtcattcagttccacagatctgaatgattactgtctgtctgtgtcttttttccatgagaaatcactgttgcaaattgcctataaattgactctactaaaataacaatgtttcagtctgaaaatttgaattgaaaaaaatgtataatataaaattgtaatacactcaaatgattataaaagtaaaagttggtaatttaggcagaa

SEQ ID NO: 295665 - DNA, 1608 bp, Homo sapiens
cgtgtatacccgctcaacgctgggacgttacagccagggccaatgggcagagcgggactcgaggccccgcccccgccttgtggcgtcacggggacgccgggggcgcgcgggctgcagggccgcgtaggtccccgcccccagagtctggctttccgcggctgcccgcctcgcgcgtcttccctgcccgggtctcctcgctgtcgccgccgctgccacaccatggccttcgtcaccaggcagttcatgcgttccgtgtcctcctcgtccaccgcctcggcctcggccaagaagataatcgtcaagcacgtgacggtcatcggcggcgggctgatgggcgccggcattgcccaggttgctgcagcaactggtcacacagtagtgttggtagaccagacagaggacatcctggcaaaatccaaaaagggaattgaggaaagccttaggaaagtggcaaagaagaagtttgcagaaaaccctaaggccggcgatgaatttgtggagaagaccctgagcaccatagcgaccagcacggatgcagcctccgttgtccacagcacagacttggtggtggaagccatcgtggagaatctgaaggtgaaaaacgagctcttcaaaaggctggacaagtttgctgctgaacatacaatctttgccagcaacacttcctccttgcagattacaagcatagctaatgccaccaccagacaagaccgattcgctggcctccatttcttcaacccagtgcctgtcatgaaacttgtggaggtcattaaaacaccaatgaccagccagaagacatttgaatctttggtagactttagcaaagccctaggaaagcatcctgtttcttgcaaggacactcctgggtttattgtgaaccgcctcctggttccatacctcatggaagcaatcaggctgtatgaacgaggtatccttctgacccaggccaggagcagcagacctcagctcctggcgccactgtctggaattctcagtgtctctaggaggggtcgggccgtgcacaatggaggaagcagtgtctgttttctagctttgtgagctcagctgcaccctgagccctggtacctttttcactgttttcccagggcctcctggcttccctgtgggcctctgagaaaggtttctggaactcccaccacccccactacagtcccagccagagcaattgcatggccggcccagattgatatcctggatctctgcttttgattaaaaggtgacgcatccaaagaagacattgacactgctatgaaattaggagccggttaccccatgggcccatttgagcttctagattatgtcggactggatactacgaagttcatcgtggatgggtggcatgaaatggatgcagagaacccattacatcagcccagcccatccttaaataagctggtagcagagaacaagttcggcaagaagactggagaaggattttacaaatacaagtgatgtgcagcttctccggctctgagaagaacacctgagagcgctttccagccagtgccccgagtgcctgtgggaatgctctttggtcagacattccctcacacagtacagtttaataaatgtgcattttgattgtaa

SEQ ID NO: 295666 - DNA, 1144 bp, Homo sapiens
  misc_feature (931)..(931): n is a, c, g, or t
  misc_feature (973)..(973): n is a, c, g, or t
  misc_feature (983)..(983): n is a, c, g, or t
  misc_feature (986)..(986): n is a, c, g, or t
  misc_feature (990)..(990): n is a, c, g, or t
cgtgtatacccgctcaacgctgggacgttacagccagggccaatgggcagagcgggactcgaggccccgcccccgccttgtggcgtcacggggacgccgggggcgcgcgggctgcagggccgcgtaggtccccgcccccagagtctggctttccgcggctgcccgcctcgcgcgtcttccctgcccgggtctcctcgctgtcgccgccgctgccacaccatggccttcgtcaccaggcagttcatgcgttccgtgtcctcctcgtccaccgcctcggcctcggccaagaagataatcgtcaagcacgtgacggtcatcggcggcgggctgatgggcgccggcattgcccaggttgctgcagcaactggtcacacagtagtgttggtagaccagacagaggacatcctggcaaaatccaaaaagggaattgaggaaagccttaggaaagtggcaaagaagaagtttgcagaaaaccctaaggccggcgatgaatttgtggagaagaccctgagcaccatagcgaccagcacggatgcagcctccgttgtccacagcacagacttggtggtggaagccatcgtggagaatctgaaggtgaaaaacgagctcttcaaaaggctggacaagtttgctgctgaacatacaatctttgccagcaacacttcctccttgcagattacaagcatagctaatgccaccaccagacaagaccgattcgctggcctccatttcttcaacccagtgcctgtcatgaaacttgtggaggtcattaaaacaccaatgaccagccagaagacatttgaatctttggtagactttagcaaagccctaggaaagcatcctgtttcttgcaaggacactcctgggtttattgtgaaccgcctcctggttccatacctcatggaagcaatcaggctgtatgaacgaggcntccaagaagaaattgcctgtttgaatagagccggtaccccangggcccttgnggntttnaatattttggcgggaaaccacacacactcggggggggagaaggagtggaaccatatatgccgcccttataatgtggggaagtgggacaggagggtaaacaatgggttcggggaaaaaggacaacacgcgggtgcctcccccattgaaaaggacc

SEQ ID NO: 295667 - DNA, 1350 bp, Homo sapiens
cgtgtatacccgctcaacgctgggacgttacagccagggccaatgggcagagcgggactcgaggccccgcccccgccttgtggcgtcacggggacgccgggggcgcgcgggctgcagggccgcgtaggtccccgcccccagagtctggctttccgcggctgcccgcctcgcgcgtcttccctgcccgggtctcctcgctgtcgccgccgctgccacaccatggccttcgtcaccaggcagttcatgcgttccgtgtcctcctcgtccaccgcctcggcctcggccaagaagataatcgtcaagcacgtgacggtcatcggcggcgggctgatgggcgccggcattgcccaggttgctgcagcaactggtcacacagtagtgttggtagaccagacagaggacatcctggcaaaatccaaaaagggaattgaggaaagccttaggaaagtggcaaagaagaagtttgcagaaaaccctaaggccggcgatgaatttgtggagaagaccctgagcaccatagcgaccagcacggatgcagcctccgttgtccacagcacagacttggtggtggaagccatcgtggagaatctgaaggtgaaaaacgagctcttcaaaaggctggacaagtttgctgctgaacatacaatctttgccagcaacacttcctccttgcagattacaagcatagctaatgccaccaccagacaagaccgattcgctggcctccatttcttcaacccagtgcctgtcatgaaacttgtggaggtcattaaaacaccaatgaccagccagaagacatttgaatctttggtagactttagcaaagccctaggaaagcatcctgtttcttgcaaggacactcctgggtttattgtgaaccgcctcctggttccatacctcatggaagcaatcaggctgtatgaacgagacttccaaacgtgtggtgattctaactcgggtttgggcttttctttaaaaggtgacgcatccaaagaagacattgacactgctatgaaattaggagccggttaccccatgggcccatttgagcttctagattatgtcggactggatactacgaagttcatcgtggatgggtggcatgaaatggatgcagagaacccattacatcagcccagcccatccttaaataagctggtagcagagaacaagttcggcaagaagactggagaaggattttacaaatacaagtgatgtgcagcttctccggctctgagaagaacacctgagagcgctttccagccagtgccccgagtgcctgtgggaatgctctttggtcagacattccctcacacagtacagtttaataaatgtgcattttgattgtaa

SEQ ID NO: 295668 - DNA, 801 bp, Homo sapiens
ggccgggggcgaaggcgagggtcgggcggcggccaggggcagacactggccattctggctgcctcacagctatcctgccttaattcatatttgattgcctggacagaaccacctagaatgtccagacgactgccacccctcagccatgggcctgagatcctgccctgacccctttcttcagaccccaggaggacccacaatctccctgatccccaccttccccaaagtagtctctaggaaaaaagcagagctggctaaggcctgagacagagccatttcttccccttgggcaaacgaggtagaccctcccagagaccaatgccggagaggcccggatccgagctccctttatatggcctcccccatcacggatcccgtgggaaaacctgacacacaatggcgcggctgctccgggcaccctcaacccagcgccctgcggcaaggcctggagcagcctggtggtcttggtgcgctccctttgccctccccgcaaccctctgcgagcactcgtcccaggagagagaccctggctagggtggaggttgcctcccgcaaagggcgctgttgctggggcctcccctcccccattctcttgtttttctgcttctgagactcgggagggaggcggcaggcgcctccgcagccgatagagcagctattgtgaccttcccttgcagagcgggaacccagccgagtgtgtaccgccggcggtggcgggggaggaggcgactgtgtgtgcaaacctcagtcggagagggggtggcgctgggaaataaaggtttgcaacctcaaacagttggg

SEQ ID NO: 295669 - DNA, 2240 bp, Homo sapiens
acgtttgtgccgcgcgcccgccagaccgcccaggaggcggcggctattgttccccgcaggggcccggggcgccctgaaacagggtccacgtcagcccgctcccgagcgtgtcctcaggtctaaggacgggtggggcttcctttgtgtgttctctggaaggggctgggatggcgtcgttgctgccccaaggggtaaccgagggggattgagggaagatggtaccagcgccctagagctcagctcaccagacctactcttccgctcgacccttgcagaggaggtggggacggatatggtatttgtagggcagcgctgtgaacaatggagccatcaaaaaggccttctcccagcctcctcaccaaccacggacattcctggcccaacaagacctcctggccaggttttgagccctgcttcccagatctggggacccttcacctgcctctactactgcaaatgattggatattcgtctgacttggctcttccctaatgtgtggaactaattttgttcactctgtttcatgctggacctggcctgaaaatgggcccttatattgtctttgcactttccaacttgccaagtttctgaaagaaggaccaaagtaatgccaagaactcccagatgaagaggaccttccttagacctataacagattcactacttgacttcagagggaagtttcagctaattctcaggaaaaggtcaaaacaggcctgtgactgtcccttgaatactgaaggtataaacaagcttctggctcctccaggtcaagcagaggaacacttttattagaatgaagggttacttctttgttattcaaacacacacccacacacatcctctgtagtctccctaatgaaaaacctcaacagatggagagcctgagctcccaagtccgcaggctgagaagatgcacttcactcaagggccagtgggctggtacagactagggaagagaaaagggacaaaggctgctagtataggtaatcactatcttttaatactcctaacacatagaaattcgaaaaatcttgttcagcaatgttagcagcctgtgagcctcggaaactaatttggctgatgtgtctctgatagggagcttggggctgcaccaaggggaaacattctcctcctgtattctctcctctctctcgtttgaaagcctgtacaaagaaatggtacaaatggatggttaacttaatgattccatcagaggcagatttttctctgtcaggtccctggataaggtggaggtctgaaagccaggagacagaatatgtacttaatcgccctttctgacctgcttaccagtgaccaggactactctccaggcctttcttctgccacttccccattcttcctggctagttcagttgggtctcagcacttcaactcctggctggatcctgagtttttcttggttgcagggaaagctctcactgtctgcatctccttccccacccccacctcccgttttgcagctggccattctggctgcctcacagctatcctgccttaattcatatttgattgcctggacagaaccacctagaatgtccagacgactgccacccctcagccatgggcctgagatcctgccctgacccctttcttcagaccccaggaggacccacaatctccctgatccccaccttccccaaagtagtctctaggaaaaaagcagagctggctaaggcctgagacagagccatttcttccccttgggcaaacgaggtagaccctcccagagaccaatgccggagaggcccggatccgagctccctttatatggcctcccccatcacggatcccgtgggaaaacctgacacacaatggcgcggctgctccgggcaccctcaacccagcgccctgcggcaaggcctggagcagcctggtggtcttggtgcgctccctttgccctccccgcaaccctctgcgagcactcgtcccaggagagagaccctggctagggtggaggttgcctcccgcaaagggcgctgttgctggggcctcccctcccccattctcttgtttttctgcttctgagactcgggagggaggcggcaggcgcctccgcagccgatagagcagctattgtgaccttcccttgcagagcgggaacccagccgagtgtgtaccgccggcggtggcgggggaggaggcgactgtgtgtgcaaacctcagtcggagagggggtggcgctgggaaataaaggtttgcaacctcaaacagttggg

SEQ ID NO: 295670 - DNA, 1924 bp, Homo sapiens
gcagggccgccgcccagcgcccccgagccccgaggagagccgtcgcgaccgggggctgcctgggcaagggcggggcgagagggcagaacgcctgctctcggacagatctggggacccttcacctgcctctactactgcaaatgattggatattcgtctgacttggctcttccctaatgtgtggaactaattttgttcactctgtttcatgctggacctggcctgaaaatgggcccttatattgtctttgcactttccaacttgccaagtttctgaaagaaggaccaaagtaatgccaagaactcccagatgaagaggaccttccttagacctataacagattcactacttgacttcagagggaagtttcagctaattctcaggaaaaggtcaaaacaggcctgtgactgtcccttgaatactgaaggtataaacaagcttctggctcctccaggtcaagcagaggaacacttttattagaatgaagggttacttctttgttattcaaacacacacccacacacatcctctgtagtctccctaatgaaaaacctcaacagatggagagcctgagctcccaagtccgcaggctgagaagatgcacttcactcaagggccagtgggctggtacagactagggaagagaaaagggacaaaggctgctagtataggtaatcactatcttttaatactcctaacacatagaaattcgaaaaatcttgttcagcaatgttagcagcctgtgagcctcggaaactaatttggctgatgtgtctctgatagggagcttggggctgcaccaaggggaaacattctcctcctgtattctctcctctctctcgtttgaaagcctgtacaaagaaatggtacaaatggatggttaacttaatgattccatcagaggcagatttttctctgtcaggtccctggataaggtggaggtctgaaagccaggagacagaatatgtacttaatcgccctttctgacctgcttaccagtgaccaggactactctccaggcctttcttctgccacttccccattcttcctggctagttcagttgggtctcagcacttcaactcctggctggatcctgagtttttcttggttgcagggaaagctctcactgtctgcatctccttccccacccccacctcccgttttgcagctggccattctggctgcctcacagctatcctgccttaattcatatttgattgcctggacagaaccacctagaatgtccagacgactgccacccctcagccatgggcctgagatcctgccctgacccctttcttcagaccccaggaggacccacaatctccctgatccccaccttccccaaagtagtctctaggaaaaaagcagagctggctaaggcctgagacagagccatttcttccccttgggcaaacgaggtagaccctcccagagaccaatgccggagaggcccggatccgagctccctttatatggcctcccccatcacggatcccgtgggaaaacctgacacacaatggcgcggctgctccgggcaccctcaacccagcgccctgcggcaaggcctggagcagcctggtggtcttggtgcgctccctttgccctccccgcaaccctctgcgagcactcgtcccaggagagagaccctggctagggtggaggttgcctcccgcaaagggcgctgttgctggggcctcccctcccccattctcttgtttttctgcttctgagactcgggagggaggcggcaggcgcctccgcagccgatagagcagctattgtgaccttcccttgcagagcgggaacccagccgagtgtgtaccgccggcggtggcgggggaggaggcgactgtgtgtgcaaacctcagtcggagagggggtggcgctgggaaataaaggtttgcaacctcaaacagttggg

SEQ ID NO: 295671 - DNA, 1802 bp, Homo sapiens
acgtttgtgccgcgcgcccgccagaccgcccaggaggcggcggctattgttccccgcaggggcccggggcgccctgaaacagggtccacgtcagcccgctcccgagcgtgtcctcaggtctaaggacgggtggggcttcctttgtgtgttctctggaaggggctgggatggcgtcgttgctgccccaaggggtaaccgagggggattgagggaagatggtaccagcgccctagagctcagctcaccagacctactcttccgctcgacccttgcagaggaggtggggacggatatggtatttgtagggcagcgctgtgaacaatggagccatcaaaaaggccttctcccagcctcctcaccaaccacggacattcctggcccaacaagacctcctggccaggttttgagccctgcttcccagatctggggacccttcacctgcctctactactgcaaatgattggatattcgtctgacttggctcttccctaatgtgtggaactaattttgttcactctgtttcatgctggacctggcctgaaaatgggcccttatattgtctttgcactttccaacttgccaagtttctgaaagaaggaccaaagtaatgccaagaactcccagatgaagaggaccttccttagacctataacagattcactacttgacttcagagggaagtttcagctaattctcaggaaaaggtcaaaacaggcctgtgactgtcccttgaatactgaaggtataaacaagcttctggctcctccaggtcaagcagaggaacacttttattagaatgaagggttacttctttgttattcaaacacacacccacacacatcctctgtagtctccctaatgaaaaacctcaacagatggagagcctgagctcccaagtccgcaggctgagaagatgcacttcactcaagggccagtgggctggtacagactagggaagagaaaagggacaaaggctgctagtataggtaatcactatcttttaatactcctaacacatagaaattcgaaaaatcttgttcagcaatgttagcagcctgtgagcctcggaaactaatttggctgatgtgtctctgatagggagcttggggctgcaccaaggggaaacattctcctcctgtattctctcctctctctcgtttgaaagcctgtacaaagaaatggtacaaatggatggttaacttaatgattccatcagaggcagatttttctctgtcaggtccctggataaggtggaggtctgaaagccaggagacagaatatgtacttaatcgccctttctgacctgcttaccaagaccaatgccggagaggcccggatccgagctccctttatatggcctcccccatcacggatcccgtgggaaaacctgacacacaatggcgcggctgctccgggcaccctcaacccagcgccctgcggcaaggcctggagcagcctggtggtcttggtgcgctccctttgccctccccgcaaccctctgcgagcactcgtcccaggagagagaccctggctagggtggaggttgcctcccgcaaagggcgctgttgctggggcctcccctcccccattctcttgtttttctgcttctgagactcgggagggaggcggcaggcgcctccgcagccgatagagcagctattgtgaccttcccttgcagagcgggaacccagccgagtgtgtaccgccggcggtggcgggggaggaggcgactgtgtgtgcaaacctcagtcggagagggggtggcgctgggaaataaaggtttgcaacctcaaacagttggg

SEQ ID NO: 295672 - DNA, 2156 bp, Homo sapiens
acgtttgtgccgcgcgcccgccagaccgcccaggaggcggcggctattgttccccgcaggggcccggggcgccctgaaacagggtccacgtcagcccgctcccgagcgtgtcctcaggtctaaggacgggtggggcttcctttgtgtgttctctggaaggggctgggatggcgtcgttgctgccccaagggaggaggtggggacggatatggtatttgtagggcagcgctgtgaacaatggagccatcaaaaaggccttctcccagcctcctcaccaaccacggacattcctggcccaacaagacctcctggccaggttttgagccctgcttcccagatctggggacccttcacctgcctctactactgcaaatgattggatattcgtctgacttggctcttccctaatgtgtggaactaattttgttcactctgtttcatgctggacctggcctgaaaatgggcccttatattgtctttgcactttccaacttgccaagtttctgaaagaaggaccaaagtaatgccaagaactcccagatgaagaggaccttccttagacctataacagattcactacttgacttcagagggaagtttcagctaattctcaggaaaaggtcaaaacaggcctgtgactgtcccttgaatactgaaggtataaacaagcttctggctcctccaggtcaagcagaggaacacttttattagaatgaagggttacttctttgttattcaaacacacacccacacacatcctctgtagtctccctaatgaaaaacctcaacagatggagagcctgagctcccaagtccgcaggctgagaagatgcacttcactcaagggccagtgggctggtacagactagggaagagaaaagggacaaaggctgctagtataggtaatcactatcttttaatactcctaacacatagaaattcgaaaaatcttgttcagcaatgttagcagcctgtgagcctcggaaactaatttggctgatgtgtctctgatagggagcttggggctgcaccaaggggaaacattctcctcctgtattctctcctctctctcgtttgaaagcctgtacaaagaaatggtacaaatggatggttaacttaatgattccatcagaggcagatttttctctgtcaggtccctggataaggtggaggtctgaaagccaggagacagaatatgtacttaatcgccctttctgacctgcttaccagtgaccaggactactctccaggcctttcttctgccacttccccattcttcctggctagttcagttgggtctcagcacttcaactcctggctggatcctgagtttttcttggttgcagggaaagctctcactgtctgcatctccttccccacccccacctcccgttttgcagctggccattctggctgcctcacagctatcctgccttaattcatatttgattgcctggacagaaccacctagaatgtccagacgactgccacccctcagccatgggcctgagatcctgccctgacccctttcttcagaccccaggaggacccacaatctccctgatccccaccttccccaaagtagtctctaggaaaaaagcagagctggctaaggcctgagacagagccatttcttccccttgggcaaacgaggtagaccctcccagagaccaatgccggagaggcccggatccgagctccctttatatggcctcccccatcacggatcccgtgggaaaacctgacacacaatggcgcggctgctccgggcaccctcaacccagcgccctgcggcaaggcctggagcagcctggtggtcttggtgcgctccctttgccctccccgcaaccctctgcgagcactcgtcccaggagagagaccctggctagggtggaggttgcctcccgcaaagggcgctgttgctggggcctcccctcccccattctcttgtttttctgcttctgagactcgggagggaggcggcaggcgcctccgcagccgatagagcagctattgtgaccttcccttgcagagcgggaacccagccgagtgtgtaccgccggcggtggcgggggaggaggcgactgtgtgtgcaaacctcagtcggagagggggtggcgctgggaaataaaggtttgcaacctcaaacagttggg

SEQ ID NO: 295673 - DNA, 1967 bp, Homo sapiens
atactggagtgtttcctccacactggaaagagggcagcgctgtgaacaatggagccatcaaaaaggccttctcccagcctcctcaccaaccacggacattcctggcccaacaagacctcctggccaggttttgagccctgcttcccagatctggggacccttcacctgcctctactactgcaaatgattggatattcgtctgacttggctcttccctaatgtgtggaactaattttgttcactctgtttcatgctggacctggcctgaaaatgggcccttatattgtctttgcactttccaacttgccaagtttctgaaagaaggaccaaagtaatgccaagaactcccagatgaagaggaccttccttagacctataacagattcactacttgacttcagagggaagtttcagctaattctcaggaaaaggtcaaaacaggcctgtgactgtcccttgaatactgaaggtataaacaagcttctggctcctccaggtcaagcagaggaacacttttattagaatgaagggttacttctttgttattcaaacacacacccacacacatcctctgtagtctccctaatgaaaaacctcaacagatggagagcctgagctcccaagtccgcaggctgagaagatgcacttcactcaagggccagtgggctggtacagactagggaagagaaaagggacaaaggctgctagtataggtaatcactatcttttaatactcctaacacatagaaattcgaaaaatcttgttcagcaatgttagcagcctgtgagcctcggaaactaatttggctgatgtgtctctgatagggagcttggggctgcaccaaggggaaacattctcctcctgtattctctcctctctctcgtttgaaagcctgtacaaagaaatggtacaaatggatggttaacttaatgattccatcagaggcagatttttctctgtcaggtccctggataaggtggaggtctgaaagccaggagacagaatatgtacttaatcgccctttctgacctgcttaccagtgaccaggactactctccaggcctttcttctgccacttccccattcttcctggctagttcagttgggtctcagcacttcaactcctggctggatcctgagtttttcttggttgcagggaaagctctcactgtctgcatctccttccccacccccacctcccgttttgcagctggccattctggctgcctcacagctatcctgccttaattcatatttgattgcctggacagaaccacctagaatgtccagacgactgccacccctcagccatgggcctgagatcctgccctgacccctttcttcagaccccaggaggacccacaatctccctgatccccaccttccccaaagtagtctctaggaaaaaagcagagctggctaaggcctgagacagagccatttcttccccttgggcaaacgaggtagaccctcccagagaccaatgccggagaggcccggatccgagctccctttatatggcctcccccatcacggatcccgtgggaaaacctgacacacaatggcgcggctgctccgggcaccctcaacccagcgccctgcggcaaggcctggagcagcctggtggtcttggtgcgctccctttgccctccccgcaaccctctgcgagcactcgtcccaggagagagaccctggctagggtggaggttgcctcccgcaaagggcgctgttgctggggcctcccctcccccattctcttgtttttctgcttctgagactcgggagggaggcggcaggcgcctccgcagccgatagagcagctattgtgaccttcccttgcagagcgggaacccagccgagtgtgtaccgccggcggtggcgggggaggaggcgactgtgtgtgcaaacctcagtcggagagggggtggcgctgggaaataaaggtttgcaacctcaaacagttggg

SEQ ID NO: 295674 - DNA, 2077 bp, Homo sapiens
acgtttgtgccgcgcgcccgccagaccgcccaggaggcggcggctattgttccccgcaggggcccggggcgccctgaaacagggtccacgtcagcccgctcccgagcgtgtcctcaggtctaaggacgggtggggcttcctttgtgtgttctctggaaggggctgggatggcgtcgttgctgccccaaggggtaaccgagggggattgagggaagatggtaccagcgccctagagctcagctcaccagacctactcttccgctcgacccttgcagaggaggtggggacggatatggtatttgtagggcagcgctgtgaacaatggagccatcaaaaaggccttctcccagcctcctcaccaaccacggacattcctggcccaacaagacctcctggccaggttttgagccctgcttcccagtttctgaaagaaggaccaaagtaatgccaagaactcccagatgaagaggaccttccttagacctataacagattcactacttgacttcagagggaagtttcagctaattctcaggaaaaggtcaaaacaggcctgtgactgtcccttgaatactgaaggtataaacaagcttctggctcctccaggtcaagcagaggaacacttttattagaatgaagggttacttctttgttattcaaacacacacccacacacatcctctgtagtctccctaatgaaaaacctcaacagatggagagcctgagctcccaagtccgcaggctgagaagatgcacttcactcaagggccagtgggctggtacagactagggaagagaaaagggacaaaggctgctagtataggtaatcactatcttttaatactcctaacacatagaaattcgaaaaatcttgttcagcaatgttagcagcctgtgagcctcggaaactaatttggctgatgtgtctctgatagggagcttggggctgcaccaaggggaaacattctcctcctgtattctctcctctctctcgtttgaaagcctgtacaaagaaatggtacaaatggatggttaacttaatgattccatcagaggcagatttttctctgtcaggtccctggataaggtggaggtctgaaagccaggagacagaatatgtacttaatcgccctttctgacctgcttaccagtgaccaggactactctccaggcctttcttctgccacttccccattcttcctggctagttcagttgggtctcagcacttcaactcctggctggatcctgagtttttcttggttgcagggaaagctctcactgtctgcatctccttccccacccccacctcccgttttgcagctggccattctggctgcctcacagctatcctgccttaattcatatttgattgcctggacagaaccacctagaatgtccagacgactgccacccctcagccatgggcctgagatcctgccctgacccctttcttcagaccccaggaggacccacaatctccctgatccccaccttccccaaagtagtctctaggaaaaaagcagagctggctaaggcctgagacagagccatttcttccccttgggcaaacgaggtagaccctcccagagaccaatgccggagaggcccggatccgagctccctttatatggcctcccccatcacggatcccgtgggaaaacctgacacacaatggcgcggctgctccgggcaccctcaacccagcgccctgcggcaaggcctggagcagcctggtggtcttggtgcgctccctttgccctccccgcaaccctctgcgagcactcgtcccaggagagagaccctggctagggtggaggttgcctcccgcaaagggcgctgttgctggggcctcccctcccccattctcttgtttttctgcttctgagactcgggagggaggcggcaggcgcctccgcagccgatagagcagctattgtgaccttcccttgcagagcgggaacccagccgagtgtgtaccgccggcggtggcgggggaggaggcgactgtgtgtgcaaacctcagtcggagagggggtggcgctgggaaataaaggtttgcaacctcaaacagttggg

SEQ ID NO: 295675 - DNA, 1147 bp, Homo sapiens
cgtgtaaaactggtgtggtatttaatacatggcgtgagtgcccaagtatatggggggagtacccgcagaccttttgggtgaaagcccgaatctccccaaggtggaaaatttttgccccgcccaagaggtgttttgaaaggggcctgttctttcgggggctttgggaattgtgccgtgttgttgaggttgattgatttgtgggcccgttggggcccgatcccgcccgttgtgggaccgttaggcccccgttgccgcctttgggtgaggtttaacccaggagtagttttggcggaaattgttcttcttatgctttgaccccaatccttgggccaaagggagtaataacttacgatcaaaaattttggcggttcgcgaactagcctatggcttacgtgagtgcggtaagaagtttaatggatagatagttaattatttctgtactacctagaagtgtgtactcaggcgcctactgaagaagttgttgccagagacatattttatttgtattgttgaggcataaaatgctaatttgtcatttattttggtctgtttctgaattataaatagtaatagttcattctgtttacctttcagatcgtttgaaaaatgaaaaagaaccaatggtgttgaaacttaaggactggccaccaggagaagattttagagatatgatgccttccaggtatgattatgaaggtggggagagatgattctgtccttcacttggtaggataaattcttttttgaggtagtgagaaaacagttttcaagaaaataacaaaagttctgtaattatactgccactgatttttcatttctagtctgtagtcattggaggcatgtttatttttagatgagatgaagaagtgattggcttttaggcctggctgactaatggaacaccacagattttccatggtaggccctgctagagaagaggctcactttttcttacaaggctgatttggaggcagttgtggaatctgacctgtcagggtcaggacaatgtagtcacagcactgagttagacaagaagacatctactgggtagatctattttcctgactgagcttgaaactttgaaaagggtgtcacaactaatcaatgatatatctctaagaataactttttgtctagaatttattgc

SEQ ID NO: 295676 - DNA, 519 bp, Homo sapiens
ggctgatctagaggaccccaagcagttatacatactcagctttcatttttacatatttcctttcgttcccgtggccacatagtttgtgtgtttcattttcatagttgcagttgtagggcatatgcaattttgtagtttttccctttactgtacctaattttacattgtaaaatctttacatgttacttaatagtctttagatgacttttaatggtgtgtgatacatcattgagagaatgtacttttattagtgatttcagtgtccggacatttaggtcaatctgctggcattctagctgtcttaacatctgctacaattaaatgcagtgtcctgtgttgttgagtagaagttagttacttaggattcaaagtaccctttgagttggacttttattcttttgacatgactcaatactcactgtctaacaaggaggatgcctgggataaagattggtttctccatttaccagagctttctttcatcatcattataactgagatcttcgtcagttttacaca

SEQ ID NO: 295677 - DNA, 364 bp, Homo sapiens
gaacaagtgcggccagtgatttttttttaaatcattatgacactcagaacctttttctgttagatcttttcaaagacagatgaattctgattgtgctccctaatagaagtattgatgtgaaaggattgtctgggaacaagcagtgaggaagccattgtaccaacaaagactcctttgtgcgaaaataactgaaaaaaggttcctaacaaagactccaaagtggtgataacttgaaggaagcttgtcagaacagaagatatttccaccctgcctagtagatgtgtttcagaatcttcacttggccatcatctttgctttttcttaaactatgttcaaataaaggcagcaagttttagcattggca

SEQ ID NO: 295678 - DNA, 346 bp, Homo sapiens
caaataacccaaggatttctatcagtgcatttgaaaggaacctggggatagctatcaagtggaaagagagagagaaagaattcatacagttcatgtgacagttcagagacccgttctgacttttcacattactttcgtagactctactgtggcctcttgtagtaggttttacatttttgtttcttgaagaagcacaaagttctaaagtagtctacctaataagtagctgtcgaatttgtaaagggtttaaaaaaattttttgtgtattttgcagaattaaaattattaagataagctttaacatttttaaaattactaaatatattttgcctgtgtttatgcagag

SEQ ID NO: 295679 - DNA, 4727 bp, Homo sapiens
  misc_feature (1082)..(1082): n is a, c, g, or t
agcggctccgaggggggcgggtccgggaggctgtgcgtgtcttgtgagagctcttgaaccaagtcagcgctggagtcggctaggcggctggaaacggcggctgccgccggtgactcagggaggcgggaggcgggggaggagctcttcctgcaggcgtggaaaccatggtgctcacgctcggagaaagttggccggtattggtggggaggaggtttctcagtctgtccgcagccgacggcagcgatggcagccacgacagctgggacgtggagcgcgtcgccgagtggccctggctctccgggaccattcgagctgtttcccacaccgacgttaccaagaaggatctgaaggtgtgtgtggaatttgatggggaatcttggaggaaaagaagatggatagaagtctacagccttctaaggagagcatttttagtagaacataatttggttttagctgaacgaaagtcacctgaaatttctgaacgaattgtacagtggcctgcaataacgtacaaacctctgttggacaaagctggtttgggatccataacttctgttcgctttctgggagatcaacaaagagtatttctttctaaagaccttttgaagcctatacaggatgtaaacagtcttcgactttctcttacggataatcagattgtcagtaaagaatttcaagctttgattgtgaagcatttagatgaaagccatcttttaaaaggtgacaaaaacttagttggttcagaagtaaaaatttatagcttggacccatctactcagtggttttcagcaaccgttgtaaatggaaacccagcatcaaaaactcttcaagtcaactgtgaggagattccagcactgaaaattgttgatccgtcactgattcatgttgaagttgtacacgataaccttgtgacatgtggtaattctgcaagaattggagctgtaaaacgcaagtcttctgagaataatggaaccctggtttccaaacaagcaaaatcttgctctgaggcctctcccagtatgtgtcctgtgcagtctgtacctacaacagtttttaaggagatactgcttggctgtactgcngcaactccacctagtaaggacccaagacagcaaagtactccccaggctgccaactctccacctaaccttggagcaaaaattcctcaaggatgtcataaacaaagtttaccagaggaaatttcttcctgtctaaatacaaagtctgaagctctgagaacaaaaccagatgtctgcaaagcagggttgctctcaaagtcctctcagattggaactggagacttgaaaattctgactgagccaaaaggcagctgtactcagcctaagacaaacactgatcaggaaaacagattggagtctgttccacaagcattgactggccttcctaaggagtgcttacctacaaaggcttcttctaaggcagaattggaaattgccaatcctcctgaactgcagaagcacctagaacatgcaccttccccatcggatgtttcaaatgcaccagaagtgaaagcaggtgtcaatagtgatagccctaataactgttcaggaaaaaaggtagaaccttcagctttagcttgccgatcacagaatttaaaggaatcttcagtaaaagtagataatgaaagctgttgttcaagaagcaacaataaaatccagaatgccccatccaggaagtcggttttgacagacccagctaaactcaaaaagctgcaacagagtggcgaggccttcgtacaggatgattcttgtgtgaacatcgtggcacagttgcctaaatgccgagagtgtcgcttggacagtctccgcaaggataaggagcaacagaaggactcacctgtgttttgccgcttctttcacttcaggaggttacaattcaacaaacatggtgtgttgcgggtagaaggcttcttaacaccaaacaagtatgacaatgaagcaattggcttgtggttacctttaaccaaaaacgttgtggggattgatttggacacagcaaagtacatcttggccaacattggagaccacttctgtcaaatggtgatttctgaaaaggaagctatgtcaactattgagccacacagacaggttgcttggaagcgagctgtcaaaggtgttcgagaaatgtgtgatgtgtgcgacaccaccatcttcaacctgcactgggtgtgtcctcggtgtgggtttggagtatgtgtggactgctaccggatgaagagaaagaattgccaacagggtgctgcttacaagactttctcttggctaaaatgtgtgaagagtcagatacatgaaccagagaacttaatgcccacacagatcattcctggaaaagcactctatgatgttggagacattgttcattctgtaagagcgaaatggggaataaaggcaaactgcccttgttcaaacaggcaattcaaactcttttcaaagccagcctcaaaggaagacctaaaacagacttctttagctggagaaaaaccgactcttggtgcagtgctccagcagaatccctcagtgttggagccagcagctgtgggtggggaagcagcctccaagccagccggcagcatgaagcctgcctgtccagccagcacatctcctctaaactggctggccgacctaaccagcgggaatgtcaacaaggaaaacaaggaaaaacaaccaacaatgccaattttaaagaatgaaatcaaatgccttccacccctcccacctttaagcaaatccagcacagtcctccatacgtttaacagcacaattttgacacccgtaagcaacaacaattctggtttcctccggaatctcttgaattcttctacaggaaagacagaaaatggactcaagaatacaccaaaaatccttgatgacatctttgcctctttggtgcaaaataagacgacttctgatttatctaagaggcctcaaggactaaccatcaagcccagcattctgggctttgacactcctcactattggctttgtgataatcgcttgctgtgcttgcaagaccccaacaataagagcaactggaatgtgtttagggagtgctggaaacaagggcagccagtgatggtgtctggagtgcatcataaattgaactctgaactttggaaacctgaatccttcaggaaagagtttggtgagcaggaagtagacctagttaattgtaggaccaatgaaatcatcacaggagccacagtaggagacttctgggatggatttgaagatgttccaaatcgtttgaaaaatgaaaaagaaccaatggtgttgaaacttaaggactggccaccaggagaagattttagagatatgatgccttccaggtttgatgatctgatggccaacattccactgcccgagtacacaaggcgagatggcaaactgaatttggcctctaggctgccaaactactttgttcggccagatctgggccccaagatgtataatgcttatggattaatcactcctgaagatcggaaatatggaacaacaaatcttcacttagatgtatctgatgcagctaatgtcatggtctatgtgggaattcccaaaggacagtgtgagcaagaagaagaagtccttaagaccatccaagatggagattctgacgaactcacaataaagcgatttattgaaggaaaagagaagccaggagcactgtggcacatatatgctgcaaaggacacggagaagataagggaatttcttaaaaaggtatcagaagagcaaggtcaagaaaacccagcagaccacgatcctattcatgatcaaagctggtatttagaccgatcattaagaaaacgtcttcatcaagagtatggagttcaaggctgggctattgtacagtttcttggggatgtggtgtttatcccggcaggagctccacatcaggttcataacttatatagctgcatcaaagtggctgaagattttgtttctccagagcatgttaaacactgcttctggcttactcaggaattccgatatctgtcacagactcataccaatcacgaagataaattacaggtgaagaatgttatctaccatgcagtgaaagatgcagttgctatgctgaaagccagtgaatccagttttggcaaaccttaatctccctgcacattggaaatgaattacaggcagctgttcaaactcttcaggcaggattcctgtggactttgagattcatgttacctcatcttcttttttaaactgtacccaacttgtgagggtactctgtctaatgtatatttctagtgtttacagacagtaaatgtgtatatgtagtaactatttacagaacatgcatccttaaactgtgacttctcacctagtgcagaacttttaccaggctgtaaaagcaaaacctcgtatcagctctggaacaatacctgcagttattcttcagctgtttggacaacttagattgggtttataactattaggaatcactgcacagtttatttgggttgtgttttgtgtctgagtcccctccctcatcccttagggtccagaagagcaatggaggaagtgacagctaatgttgcagttcttattgtatggcataggactggcattatatagcagaaatcaactactgtacaatttcttggggttaaccatctttagttaaatggaattttaatttaaatgacgctttgctaattttaagtgttaagcattttgcattaaaatattcatataata

SEQ ID NO: 295680 - DNA, 4858 bp, Homo sapiens
  misc_feature (1082)..(1082): n is a, c, g, or t
agcggctccgaggggggcgggtccgggaggctgtgcgtgtcttgtgagagctcttgaaccaagtcagcgctggagtcggctaggcggctggaaacggcggctgccgccggtgactcagggaggcgggaggcgggggaggagctcttcctgcaggcgtggaaaccatggtgctcacgctcggagaaagttggccggtattggtggggaggaggtttctcagtctgtccgcagccgacggcagcgatggcagccacgacagctgggacgtggagcgcgtcgccgagtggccctggctctccgggaccattcgagctgtttcccacaccgacgttaccaagaaggatctgaaggtgtgtgtggaatttgatggggaatcttggaggaaaagaagatggatagaagtctacagccttctaaggagagcatttttagtagaacataatttggttttagctgaacgaaagtcacctgaaatttctgaacgaattgtacagtggcctgcaataacgtacaaacctctgttggacaaagctggtttgggatccataacttctgttcgctttctgggagatcaacaaagagtatttctttctaaagaccttttgaagcctatacaggatgtaaacagtcttcgactttctcttacggataatcagattgtcagtaaagaatttcaagctttgattgtgaagcatttagatgaaagccatcttttaaaaggtgacaaaaacttagttggttcagaagtaaaaatttatagcttggacccatctactcagtggttttcagcaaccgttgtaaatggaaacccagcatcaaaaactcttcaagtcaactgtgaggagattccagcactgaaaattgttgatccgtcactgattcatgttgaagttgtacacgataaccttgtgacatgtggtaattctgcaagaattggagctgtaaaacgcaagtcttctgagaataatggaaccctggtttccaaacaagcaaaatcttgctctgaggcctctcccagtatgtgtcctgtgcagtctgtacctacaacagtttttaaggagatactgcttggctgtactgcngcaactccacctagtaaggacccaagacagcaaagtactccccaggctgccaactctccacctaaccttggagcaaaaattcctcaaggatgtcataaacaaagtttaccagaggaaatttcttcctgtctaaatacaaagtctgaagctctgagaacaaaaccagatgtctgcaaagcagggttgctctcaaagtcctctcagattggaactggagacttgaaaattctgactgagccaaaaggcagctgtactcagcctaagacaaacactgatcaggaaaacagattggagtctgttccacaagcattgactggccttcctaaggagtgcttacctacaaaggcttcttctaaggcagaattggaaattgccaatcctcctgaactgcagaagcacctagaacatgcaccttccccatcggatgtttcaaatgcaccagaagtgaaagcaggtgtcaatagtgatagccctaataactgttcaggaaaaaaggtagaaccttcagctttagcttgccgatcacagaatttaaaggaatcttcagtaaaagtagataatgaaagctgttgttcaagaagcaacaataaaatccagaatgccccatccaggaagtcggttttgacagacccagctaaactcaaaaagctgcaacagagtggcgaggccttcgtacaggatgattcttgtgtgaacatcgtggcacagttgcctaaatgccgagagtgtcgcttggacagtctccgcaaggataaggagcaacagaaggactcacctgtgttttgccgcttctttcacttcaggaggttacaattcaacaaacatggtgtgttgcgggtagaaggcttcttaacaccaaacaagtatgacaatgaagcaattggcttgtggttacctttaaccaaaaacgttgtggggattgatttggacacagcaaagtacatcttggccaacattggagaccacttctgtcaaatggtgatttctgaaaaggaagctatgtcaactattgagccacacagacaggttgcttggaagcgagctgtcaaaggtgttcgagaaatgtgtgatgtgtgcgacaccaccatcttcaacctgcactgggtgtgtcctcggtgtgggtttggagtatgtgtggactgctaccggatgaagagaaagaattgccaacagggtgctgcttacaagactttctcttggctaaaatgtgtgaagagtcagatacatgaaccagagaacttaatgcccacacagatcattcctggaaaagcactctatgatgttggagacattgttcattctgtaagagcgaaatggggaataaaggcaaactgcccttgttcaaacaggcaattcaaactcttttcaaagccagcctcaaaggaagacctaaaacagacttctttagctggagaaaaaccgactcttggtgcagtgctccagcagaatccctcagtgttggagccagcagctgtgggtggggaagcagcctccaagccagccggcagcatgaagcctgcctgtccagccagcacatctcctctaaactggctggccgacctaaccagcgggaatgtcaacaaggaaaacaaggaaaaacaaccaacaatgccaattttaaagaatgaaatcaaatgccttccacccctcccacctttaagcaaatccagcacagtcctccatacgtttaacagcacaattttgacacccgtaagcaacaacaattctggtttcctccggaatctcttgaattcttctacaggaaagacagaaaatggactcaagaatacaccaaaaatccttgatgacatctttgcctctttggtgcaaaataagacgacttctgatttatctaagaggcctcaaggactaaccatcaagcccagcattctgggctttgacactcctcactattggctttgtgataatcgcttgctgtgcttgcaagaccccaacaataagagcaactggaatgtgtttagggagtgctggaaacaagggcagccagtgatggtgtctggagtgcatcataaattgaactctgaactttggaaacctgaatccttcaggaaagagtttggtgagcaggaagtagacctagttaattgtaggaccaatgaaatcatcacaggagccacagtaggagacttctgggatggatttgaagatgttccaaatcgtttgaaaaatgaaaaagaaccaatggtgttgaaacttaaggactggccaccaggagaagattttagagatatgatgccttccaggtttgatgatctgatggccaacattccactgcccgagtacacaaggcgagatggcaaactgaatttggcctctaggctgccaaactactttgttcggccagatctgggccccaagatgtataatgcttatggattaatcactcctgaagatcggaaatatggaacaacaaatcttcacttagatgtatctgatgcagctaatgtcatggtctatgtgggaattcccaaaggacagtgtgagcaagaagaaggtagggtgctgagcataaaaggagggcttactctttgagccagggcttgtggtctgatatctgctttctcttcttgctctagaagtccttaagaccatccaagatggagattctgacgaactcacaataaagcgatttattgaaggaaaagagaagccaggagcactgtggcacatatatgctgcaaaggacacggagaagataagggaatttcttaaaaaggtatcagaagagcaaggtcaagaaaacccagcagaccacgatcctattcatgatcaaagctggtatttagaccgatcattaagaaaacgtcttcatcaagagtatggagttcaaggctgggctattgtacagtttcttggggatgtggtgtttatcccggcaggagctccacatcaggttcataacttatatagctgcatcaaagtggctgaagattttgtttctccagagcatgttaaacactgcttctggcttactcaggaattccgatatctgtcacagactcataccaatcacgaagataaattacaggtgaagaatgttatctaccatgcagtgaaagatgcagttgctatgctgaaagccagtgaatccagttttggcaaaccttaatctccctgcacattggaaatgaattacaggcagctgttcaaactcttcaggcaggattcctgtggactttgagattcatgttacctcatcttcttttttaaactgtacccaacttgtgagggtactctgtctaatgtatatttctagtgtttacagacagtaaatgtgtatatgtagtaactatttacagaacatgcatccttaaactgtgacttctcacctagtgcagaacttttaccaggctgtaaaagcaaaacctcgtatcagctctggaacaatacctgcagttattcttcagctgtttggacaacttagattgggtttataactattaggaatcactgcacagtttatttgggttgtgttttgtgtctgagtcccctccctcatcccttagggtccagaagagcaatggaggaagtgacagctaatgttgcagttcttattgtatggcataggactggcattatatagcagaaatcaactactgtacaatttcttggggttaaccatctttagttaaatggaattttaatttaaatgacgctttgctaattttaagtgttaagcattttgcattaaaatattcatataataaaaaaaaaaaaaattcactggccgccggtttacaacgtgtggactggga

SEQ ID NO: 295681 - DNA, 2664 bp, Homo sapiens
gtctgaatagggattctgcttggagttcattctcctagagggaggacaggttgcttggaagcgagctgtcaaaggtgttcgagaaatgtgtgatgtgtgcgacaccaccatcttcaacctgcactgggtgtgtcctcggtgtgggtttggagtatgtgtggactgctaccggatgaagagaaagaattgccaacagggtgctgcttacaagactttctcttggctaaaatgtgtgaagagtcagatacatgaaccagagaacttaatgcccacacagatcattcctggaaaagcactctatgatgttggagacattgttcattctgtaagagcgaaatggggaataaaggcaaactgcccttgttcaaacaggcaattcaaactcttttcaaagccagcctcaaaggaagacctaaaacagacttctttagctggagaaaaaccgactcttggtgcagtgctccagcagaatccctcagtgttggagccagcagctgtgggtggggaagcagcctccaagccagccggcagcatgaagcctgcctgtccagccagcacatctcctctaaactggctggccgacctaaccagcgggaatgtcaacaaggaaaacaaggctcccacctttaagcaaatccagcacagtcctccatacgtttaacagcacaattttgacacccgtaagcaacaacaattctggtttcctccggaatctcttgaattcttctacaggaaagacagaaaatggactcaagaatacaccaaaaatccttgatgacatctttgcctctttggtgcaaaataagacgacttctgatttatctaagaggcctcaaggactaaccatcaagcccagcattctgggctttgacactcctcactattggctttgtgataatcgcttgctgtgcttgcaagaccccaacaataagagcaactggaatgtgtttagggagtgctggaaacaagggcagccagtgatggtgtctggagtgcatcataaattgaactctgaactttggaaacctgaatccttcaggaaagagtttggtgagcaggaagtagacctagttaattgtaggaccaatgaaatcatcacaggagccacagtaggagacttctgggatggatttgaagatgttccaaatcgtttgaaaaatgaaaaagaaccaatggtgttgaaacttaaggactggccaccaggagaagattttagagatatgatgccttccaggtttgatgatctgatggccaacattccactgcccgagtacacaaggcgagatggcaaactgaatttggcctctaggctgccaaactactttgttcggccagatctgggccccaagatgtataatgcttatggattaatcactcctgaagatcggaaatatggaacaacaaatcttcacttagatgtatctgatgcagctaatgtcatggtctatgtgggaattcccaaaggacagtgtgagcaagaagaagaagtccttaagaccatccaagatggagattctgacgaactcacaataaagcgatttattgaaggaaaagagaagccaggagcactgtggcacatatatgctgcaaaggacacggagaagataagggaatttcttaaaaaggtatcagaagagcaaggtcaagaaaacccagcagaccacgatcctattcatgatcaaagctggtatttagaccgatcattaagaaaacgtcttcatcaagagtatggagttcaaggctgggctattgtacagtttcttggggatgtggtgtttatcccggcaggagctccacatcaggttcataacttatatagctgcatcaaagtggctgaagattttgtttctccagagcatgttaaacactgcttctggcttactcaggaattccgatatctgtcacagactcataccaatcacgaagataaattacaggtgaagaatgttatctaccatgcagtgaaagatgcagttgctatgctgaaagccagtgaatccagttttggcaaaccttaatctccctgcacattggaaatgaattacaggcagctgttcaaactcttcaggcaggattcctgtggactttgagattcatgttacctcatcttcttttttaaactgtacccaacttgtgagggtactctgtctaatgtatatttctagtgtttacagacagtaaatgtgtatatgtagtaactatttacagaacatgcatccttaaactgtgacttctcacctagtgcagaacttttaccaggctgtaaaagcaaaacctcgtatcagctctggaacaatacctgcagttattcttcagctgtttggacaacttagattgggtttataactattaggaatcactgcacagtttatttgggttgtgttttgtgtctgagtcccctccctcatcccttagggtccagaagagcaatggaggaagtgacagctaatgttgcagttcttattgtatggcataggactggcattatatagcagaaatcaactactgtacaatttcttggggttaaccatctttagttaaatggaattttaatttaaatgacgctttgctaattttaagtgttaagcattttgcattaaaatattcatataataaaaaaaaaaaaaattcactggccgccggtttacaacgtgtggactggga

SEQ ID NO: 295682 - DNA, 1556 bp, Homo sapiens
tggtgatctttattttgctgcaccttgctgcctcctggatcgtttgaaaaatgaaaaagaaccaatggtgttgaaacttaaggactggccaccaggagaagattttagagatatgatgccttccaggtttgatgatctgatggccaacattccactgcccgagtacacaaggcgagatggcaaactgaatttggcctctaggctgccaaactactttgttcggccagatctgggccccaagatgtataatgcttatggattaatcactcctgaagatcggaaatatggaacaacaaatcttcacttagatgtatctgatgcagctaatgtcatggtctatgtgggaattcccaaaggacagtgtgagcaagaagaagaagtccttaagaccatccaagatggagattctgacgaactcacaataaagcgatttattgaaggaaaagagaagccaggagcactgtggcacatatatgctgcaaaggacacggagaagataagggaatttcttaaaaaggtatcagaagagcaaggtcaagaaaacccagcagaccacgatcctattcatgatcaaagctggtatttagaccgatcattaagaaaacgtcttcatcaagagtatggagttcaaggctgggctattgtacagtttcttggggatgtggtgtttatcccggcaggagctccacatcaggttcataacttatatagctgcatcaaagtggctgaagattttgtttctccagagcatgttaaacactgcttctggcttactcaggaattccgatatctgtcacagactcataccaatcacgaagataaattacaggtgaagaatgttatctaccatgcagtgaaagatgcagttgctatgctgaaagccagtgaatccagttttggcaaaccttaatctccctgcacattggaaatgaattacaggcagctgttcaaactcttcaggcaggattcctgtggactttgagattcatgttacctcatcttcttttttaaactgtacccaacttgtgagggtactctgtctaatgtatatttctagtgtttacagacagtaaatgtgtatatgtagtaactatttacagaacatgcatccttaaactgtgacttctcacctagtgcagaacttttaccaggctgtaaaagcaaaacctcgtatcagctctggaacaatacctgcagttattcttcagctgtttggacaacttagattgggtttataactattaggaatcactgcacagtttatttgggttgtgttttgtgtctgagtcccctccctcatcccttagggtccagaagagcaatggaggaagtgacagctaatgttgcagttcttattgtatggcataggactggcattatatagcagaaatcaactactgtacaatttcttggggttaaccatctttagttaaatggaattttaatttaaatgacgctttgctaattttaagtgttaagcattttgcattaaaatattcatataataaaaaaaaaaaaaattcactggccgccggtttacaacgtgtggactggga

SEQ ID NO: 295683 - DNA, 3884 bp, Homo sapiens
  misc_feature (1082)..(1082): n is a, c, g, or t
agcggctccgaggggggcgggtccgggaggctgtgcgtgtcttgtgagagctcttgaaccaagtcagcgctggagtcggctaggcggctggaaacggcggctgccgccggtgactcagggaggcgggaggcgggggaggagctcttcctgcaggcgtggaaaccatggtgctcacgctcggagaaagttggccggtattggtggggaggaggtttctcagtctgtccgcagccgacggcagcgatggcagccacgacagctgggacgtggagcgcgtcgccgagtggccctggctctccgggaccattcgagctgtttcccacaccgacgttaccaagaaggatctgaaggtgtgtgtggaatttgatggggaatcttggaggaaaagaagatggatagaagtctacagccttctaaggagagcatttttagtagaacataatttggttttagctgaacgaaagtcacctgaaatttctgaacgaattgtacagtggcctgcaataacgtacaaacctctgttggacaaagctggtttgggatccataacttctgttcgctttctgggagatcaacaaagagtatttctttctaaagaccttttgaagcctatacaggatgtaaacagtcttcgactttctcttacggataatcagattgtcagtaaagaatttcaagctttgattgtgaagcatttagatgaaagccatcttttaaaaggtgacaaaaacttagttggttcagaagtaaaaatttatagcttggacccatctactcagtggttttcagcaaccgttgtaaatggaaacccagcatcaaaaactcttcaagtcaactgtgaggagattccagcactgaaaattgttgatccgtcactgattcatgttgaagttgtacacgataaccttgtgacatgtggtaattctgcaagaattggagctgtaaaacgcaagtcttctgagaataatggaaccctggtttccaaacaagcaaaatcttgctctgaggcctctcccagtatgtgtcctgtgcagtctgtacctacaacagtttttaaggagatactgcttggctgtactgcngcaactccacctagtaaggacccaagacagcaaagtactccccaggctgccaactctccacctaaccttggagcaaaaattcctcaaggatgtcataaacaaagtttaccagaggaaatttcttcctgtctaaatacaaagtctgaagctctgagaacaaaaccagatgtctgcaaagcagggttgctctcaaagtcctctcagattggaactggagacttgaaaattctgactgagccaaaaggcagctgtactcagcctaagacaaacactgatcaggaaaacagattggagtctgttccacaagcattgactggccttcctaaggagtgcttacctacaaaggcttcttctaaggcagaattggaaattgccaatcctcctgaactgcagaagcacctagaacatgcaccttccccatcggatgtttcaaatgcaccagaagtgaaagcaggtgtcaatagtgatagccctaataactgttcaggaaaaaaggtagaaccttcagctttagcttgccgatcacagaatttaaaggaatcttcagtaaaagtagataatgaaagctgttgttcaagaagcaacaataaaatccagaatgccccatccaggaagtcggttttgacagacccagctaaactcaaaaagctgcaacagagtggcgaggccttcgtacaggatgattcttgtgtgaacatcgtggcacagttgcctaaatgccgagagtgtcgcttggacagtctccgcaaggataaggagcaacagaaggactcacctgtgttttgccgcttctttcacttcaggaggttacaattcaacaaacatggtgtgttgcgggtagaaggcttcttaacaccaaacaagtatgacaatgaagcaattggcttgtggttacctttaaccaaaaacgttgtggggattgatttggacacagcaaagtacatcttggccaacattggagaccacttctgtcaaatggtgatttctgaaaaggaagctatgtcaactattgagccacacagacaggttgcttggaagcgagctgtcaaaggtgttcgagaaatgtgtgatgtgtgcgacaccaccatcttcaacctgcactgggtgtgtcctcggtgtgggtttggagtatgtgtggactgctaccggatgaagagaaagaattgccaacagggtgctgcttacaagactttctcttggctaaaatgtgtgaagagtcagatacatgaaccagagaacttaatgcccacacagatcattcctggaaaagcactctatgatgttggagacattgttcattctgtaagagcgaaatggggaataaaggcaaactgcccttgttcaaacaggcaattcaaactcttttcaaagccagcctcaaaggaagacctaaaacagacttctttagctggagaaaaaccgactcttggtgcagtgctccagcagaatccctcagtgttggagccagcagctgtgggtggggaagcagcctccaagccagccggcagcatgaagcctgcctgtccagccagcacatctcctctaaactggctggccgacctaaccagcgggaatgtcaacaaggaaaacaaggaaaaacaaccaacaatgccaattttaaagaatgaaatcaaatgccttccacccctcccacctttaagcaaatccagcacagtcctccatacgtttaacagcacaattttgacacccgtaagcaacaacaattctggtttcctccggaatctcttgaattcttctacaggaaagacagaaaatggactcaagaatacaccaaaaatccttgatgacatctttgcctctttggtgcaaaataagacgacttctgatttatctaagaggcctcaaggactaaccatcaagcccagcattctgggctttgacactcctcactattggctttgtgataatcgcttgctgtgcttgcaagaccccaacaataagagcaactggaatgtgtttagggagtgctggaaacaagggcagccagtgatggtgtctggagtgcatcataaattgaactctgaactttggaaacctgaatccttcaggaaagagtttggtgagcaggaagtagacctagttaattgtaggaccaatgaaatcatcacaggagccacagtaggagacttctgggatggatttgaagatgttccaaatcgtttgaaaaatgaaaaagaaccaatggtgttgaaacttaaggactggccaccaggagaagattttagagatatgatgccttccaggtttgatgatctgatggccaacattccactgcccgagtacacaaggcgagatggcaaactgaatttggcctctaggctgccaaactactttgttcggccagatctgggccccaagatgtataatgcttatggattaatcactcctgaagatcggaaatatggaacaacaaatcttcacttagatgtatctgatgcagctaatgtcatggtctatgtgggaattcccaaaggacagtgtgagcaagaagaagaagtccttaagaccatccaagatggagattctgacgaactcacaataaagcgatttattgaaggaaaagagaagccaggagcactgtggcacatatatgctgcaaaggacacggagaagataagggaatttcttaaaaaggtgtgctgcttatggcatgtgtgaacagaggcataaggaatagcaatattatgttactacatgtggtgaactgactggcttggctaggggaattgtcacaacctgaaaagttaaatctgtacctgtcagattgaataggctgaaggt

SEQ ID NO: 295684 - DNA, 3811 bp, Homo sapiens
  misc_feature (1082)..(1082): n is a, c, g, or t
agcggctccgaggggggcgggtccgggaggctgtgcgtgtcttgtgagagctcttgaaccaagtcagcgctggagtcggctaggcggctggaaacggcggctgccgccggtgactcagggaggcgggaggcgggggaggagctcttcctgcaggcgtggaaaccatggtgctcacgctcggagaaagttggccggtattggtggggaggaggtttctcagtctgtccgcagccgacggcagcgatggcagccacgacagctgggacgtggagcgcgtcgccgagtggccctggctctccgggaccattcgagctgtttcccacaccgacgttaccaagaaggatctgaaggtgtgtgtggaatttgatggggaatcttggaggaaaagaagatggatagaagtctacagccttctaaggagagcatttttagtagaacataatttggttttagctgaacgaaagtcacctgaaatttctgaacgaattgtacagtggcctgcaataacgtacaaacctctgttggacaaagctggtttgggatccataacttctgttcgctttctgggagatcaacaaagagtatttctttctaaagaccttttgaagcctatacaggatgtaaacagtcttcgactttctcttacggataatcagattgtcagtaaagaatttcaagctttgattgtgaagcatttagatgaaagccatcttttaaaaggtgacaaaaacttagttggttcagaagtaaaaatttatagcttggacccatctactcagtggttttcagcaaccgttgtaaatggaaacccagcatcaaaaactcttcaagtcaactgtgaggagattccagcactgaaaattgttgatccgtcactgattcatgttgaagttgtacacgataaccttgtgacatgtggtaattctgcaagaattggagctgtaaaacgcaagtcttctgagaataatggaaccctggtttccaaacaagcaaaatcttgctctgaggcctctcccagtatgtgtcctgtgcagtctgtacctacaacagtttttaaggagatactgcttggctgtactgcngcaactccacctagtaaggacccaagacagcaaagtactccccaggctgccaactctccacctaaccttggagcaaaaattcctcaaggatgtcataaacaaagtttaccagaggaaatttcttcctgtctaaatacaaagtctgaagctctgagaacaaaaccagatgtctgcaaagcagggttgctctcaaagtcctctcagattggaactggagacttgaaaattctgactgagccaaaaggcagctgtactcagcctaagacaaacactgatcaggaaaacagattggagtctgttccacaagcattgactggccttcctaaggagtgcttacctacaaaggcttcttctaaggcagaattggaaattgccaatcctcctgaactgcagaagcacctagaacatgcaccttccccatcggatgtttcaaatgcaccagaagtgaaagcaggtgtcaatagtgatagccctaataactgttcaggaaaaaaggtagaaccttcagctttagcttgccgatcacagaatttaaaggaatcttcagtaaaagtagataatgaaagctgttgttcaagaagcaacaataaaatccagaatgccccatccaggaagtcggttttgacagacccagctaaactcaaaaagctgcaacagagtggcgaggccttcgtacaggatgattcttgtgtgaacatcgtggcacagttgcctaaatgccgagagtgtcgcttggacagtctccgcaaggataaggagcaacagaaggactcacctgtgttttgccgcttctttcacttcaggaggttacaattcaacaaacatggtgtgttgcgggtagaaggcttcttaacaccaaacaagtatgacaatgaagcaattggcttgtggttacctttaaccaaaaacgttgtggggattgatttggacacagcaaagtacatcttggccaacattggagaccacttctgtcaaatggtgatttctgaaaaggaagctatgtcaactattgagccacacagacaggttgcttggaagcgagctgtcaaaggtgttcgagaaatgtgtgatgtgtgcgacaccaccatcttcaacctgcactgggtgtgtcctcggtgtgggtttggagtatgtgtggactgctaccggatgaagagaaagaattgccaacagggtgctgcttacaagactttctcttggctaaaatgtgtgaagagtcagatacatgaaccagagaacttaatgcccacacagatcattcctggaaaagcactctatgatgttggagacattgttcattctgtaagagcgaaatggggaataaaggcaaactgcccttgttcaaacaggcaattcaaactcttttcaaagccagcctcaaaggaagacctaaaacagacttctttagctggagaaaaaccgactcttggtgcagtgctccagcagaatccctcagtgttggagccagcagctgtgggtggggaagcagcctccaagccagccggcagcatgaagcctgcctgtccagccagcacatctcctctaaactggctggccgacctaaccagcgggaatgtcaacaaggaaaacaaggaaaaacaaccaacaatgccaattttaaagaatgaaatcaaatgccttccacccctcccacctttaagcaaatccagcacagtcctccatacgtttaacagcacaattttgacacccgtaagcaacaacaattctggtttcctccggaatctcttgaattcttctacaggaaagacagaaaatggactcaagaatacaccaaaaatccttgatgacatctttgcctctttggtgcaaaataagacgacttctgatttatctaagaggcctcaaggactaaccatcaagcccagcattctgggctttgacactcctcactattggctttgtgataatcgcttgctgtgcttgcaagaccccaacaataagagcaactggaatgtgtttagggagtgctggaaacaagggcagccagtgatggtgtctggagtgcatcataaattgaactctgaactttggaaacctgaatccttcaggaaagagtttggtgagcaggaagtagacctagttaattgtaggaccaatgaaatcatcacaggagccacagtaggagacttctgggatggatttgaagatgttccaaatcgtttgaaaaatgaaaaagaaccaatggtgttgaaacttaaggactggccaccaggagaagattttagagatatgatgccttccaggtatgattatgaaggtggggagagatgattctgtccttcacttggtaggataaattcttttttgaggtagtgagaaaacagttttcaagaaaataacaaaagttctgtaattatactgccactgatttttcatttctagtctgtagtcattggaggcatgtttatttttagatgagatgaagaagtgattggcttttaggcctggctgactaatggaacaccacagattttccatggtaggccctgctagagaagaggctcactttttcttacaaggctgatttggaggcagttgtggaatctgacctgtcagggtcaggacaatgtagtcacagcactgagttagacaagaagacatctactgggtagatctattttcctgactgagcttgaaactttgaaaagggtgtcacaactaatcaatgatatatctctaagaataactttttgtctagaatttattgc

SEQ ID NO: 295685 - DNA, 462 bp, Homo sapiens
tccttatctctttatccttaatctctctatccttaatcctctatccttaatctctctcatgcatccttaaactgtgacttctcacctagtgcagaacttttaccaggctgtaaaagcaaaacctcgtatcagctctggaacaatacctgcagttattcttcagctgtttggacaacttagattgggtttataactattaggaatcactgcacagtttatttgggttgtgttttgtgtctgagtcccctccctcatcccttagggtccagaagagcaatggaggaagtgacagctaatgttgcagttcttattgtatggcataggactggcattatatagcagaaatcaactactgtacaatttcttggggttaaccatctttagttaaatggaattttaatttaaatgacgctttgctaattttaagtgttaagcattttgcattaaaatattcatataata

SEQ ID NO: 295686 - DNA, 1063 bp, Homo sapiens
agcggctccgaggggggcgggtccgggaggctgtgcgtgtcttgtgagagctcttgaaccaagtcagcgctggagtcggctaggcggctggaaacggcggctgccgccggtgactcagggaggcgggaggcgggggaggagctcttcctgcaggcgtggaaaccatggtgctcacgctcggagaaagttggccggtattggtggggaggaggtttctcagtctgtccgcagccgacggcagcgatggcagccacgacagctgggacgtggagcgcgtcgccgagtggccctggctctccgggaccattcgagctgtttcccacaccgacgttaccaagaaggatctgaaggtgtgtgtggaatttgatggggaatcttggaggaaaagaagatggatagaagtctacagccttctaaggagagcatttttagtagaacataatttggttttagctgaacgaaagtcacctgaaatttctgaacgaattgtacagtggcctgcaataacgtacaaacctctgttggacaaagctggtttgggatccataacttctgttcgctttctgggagatcaacaaagagtatttctttctaaagaccttttgaagcctatacaggatgtaaacagtcttcgactttctcttacggataatcagattgtcagtaaagaatttcaagctttgattgtgaagcatttagatgaaagccatcttttaaaaggtgacaaaaacttagttggttcagaagtaaaaatttatagcttggacccatctactcagtggttttcagcaaccgttgtaaatggaaacccagcatcaaaaactcttcaagtcaactgtgaggaggtaaagacaacaataactctttgtaagataactcgacaaagcatgataactatacaaagcatttatgattttctaggcactaaatacctttattattttatagggtagaaataattacagttgttttaaaaagaaattattcataagaagctcctattgttatgttaatgaacctgattttcagtatgttcttgagcattttttattttccggtatct

SEQ ID NO: 295687 - DNA, 651 bp, Homo sapiens
agcggctccgaggggggcgggtccgggaggctgtgcgtgtcttgtgagagctcttgaaccaagtcagcgctggagtcggctaggcggctggaaacggcggctgccgccggtgactcagggaggcgggaggcgggggaggagctcttcctgcaggcgtggaaaccatggtgctcacgctcggagaaagttggccggtattggtggggaggaggtttctcagtctgtccgcagccgacggcagcgatggcagccacgacagctgggacgtggagcgcgtcgccgagtggccctggctctccgggaccattcgagctgtttcccacaccgacgttaccaagaaggatctgaagatcttttcaaagacagatgaattctgattgtgctccctaatagaagtattgatgtgaaaggattgtctgggaacaagcagtgaggaagccattgtaccaacaaagactcctttgtgcgaaaataactgaaaaaaggttcctaacaaagactccaaagtggtgataacttgaaggaagcttgtcagaacagaagatatttccaccctgcctagtagatgtgtttcagaatcttcacttggccatcatctttgctttttcttaaactatgttcaaataaaggcagcaagttttagcattggca

SEQ ID NO: 295688 - DNA, 516 bp, Homo sapiens
ttcgtttattgttatttttagaatggttagcttttgcattgtacttttaaaaacacaccttaaaccagtcttttttgaatttggaaagtgacagaatggacatctactaagtcaggcctctgcagaagtgagcctcgagatcgagtttgaattaaatgtctgatttgaaaacatcctaaaatgtagagttgtgaatagaagtatacattaactttgaattgtgagtctggctgtttaatttggggttttatgttgccaaatggattgagcaaataagaattgttttataaagagagtaaaactttcccagttattctgatagttgtcttctgttgagccatttttagaaattacaattgaaccaggaattgagaagggagttctctttaagggaatattgggtttttgaatagaattcagtcatatatgaatgtgatttttaaaaatttgaggtcctgtctccttaatcttttgttttcctagccccatccaggaagtcggttttgacagacccag

SEQ ID NO: 295689 - DNA, 141 bp, Homo sapiens
ataccaatagcagtgtgaagagggactgccttcgggagtggggacagagctggcagagttcagactaaagttttccttctcttcatttagccagtgatggtgtctggagtgcatcataaattgaactctgaactttggaaa

SEQ ID NO: 295690 - DNA, 453 bp, Homo sapiens
tgcgtggtgggcactcaagtcatgccaaagtgaatgcatgtgaagctgccaccatttaaaactgtcacttaaaagttcacctctgcgttgcattagtaaagtaattgccacctgactgttttcctggcacagtggttcagaggtctgaaaaagataagcttgtgatcctttgtaggaagacataagttttgtgaaaagctggagtgattacttacagtcttaaagccctgaattgtatagtttatcacttgtttcactttcctgtttctttttatttggcaatggtattatgtttgtttagtattaagcaaatgatcttaaatttggtagcattttattatttcctaactagggacttccttttaatatctgttggtttggtatcttctaggcctctcccagtatgtgtcctgtgcagtctgtacctacaacagtttttaaggagatactgct

SEQ ID NO: 295691 - DNA, 295 bp, Homo sapiens
cactggaggatgggttttatgggactatagttctgagctgggccactttctcctgttacctcacttctatgagttgtcaagtggggacaggggacgtacctttttgcctgggggtcctggcttggaatcttctggatatgtaatctatactcattatgggaatggagtttcttgatggtaagggaatgacatatttgagacttttgttctttctccaattcagacagaaaatggactcaagaatacaccaaaaatccttgatgacatctttgcctctttggtgcaaaataagacg

SEQ ID NO: 295692 - DNA, 460 bp, Homo sapiens
ctgttttcactctttattaagcattgtactggaagtcctggtcagtgcattcagggaaaaaaaatgtgtaaagagaatgctgccaatatttgtagacagtacatgcaaaaaatccaaaagaatctacatttactaaacatttgtcagggttgctagatacaaaggtcaatttacaaaattccattgtactggatagttattgtttttaacatcagtgaggaatcgtctaagtaaatcatatcattcatacttactccctaaagtattttttttgtttcagtaaatagaaagcaagttctaaagtaattctgctagtagaatactaataagggatttgcctttcagaatgttttttcatctggatgttttggttttattttagaaaaacaaccaacaatgccaattttaaagaatgaaatcaaatgccttccacccctcccacctttaagcaaatccagca

SEQ ID NO: 295693 - DNA, 416 bp, Homo sapiens
gacattgttcattctgtaagagcgaaatggggaataaaggcaaactgcccttgttcaaacaggcaattcaaactcttttcaaagccagcctcaaaggaagacctaaaacaggtatttactgcttatgttaaattcaacatctcttgtaattgtcatttgtctgtttttcaaataacccaaggatttctatcagtgcatttgaaaggaacctggggatagctatcaagtggaaagagagagagaaagaattcatacagttcatgtgacagttcagagacccgttctgacttttcacattactttcgtagactctactgtggcctcttgtagtaggttttacatttttgtttcttgaagaagcacaaagttctaaagtagtctacctaataagtagctgtcgaatttgtaaagggttt

SEQ ID NO: 295694 - DNA, 4776 bp, Homo sapiens
  misc_feature (1082)..(1082): n is a, c, g, or t
agcggctccgaggggggcgggtccgggaggctgtgcgtgtcttgtgagagctcttgaaccaagtcagcgctggagtcggctaggcggctggaaacggcggctgccgccggtgactcagggaggcgggaggcgggggaggagctcttcctgcaggcgtggaaaccatggtgctcacgctcggagaaagttggccggtattggtggggaggaggtttctcagtctgtccgcagccgacggcagcgatggcagccacgacagctgggacgtggagcgcgtcgccgagtggccctggctctccgggaccattcgagctgtttcccacaccgacgttaccaagaaggatctgaaggtgtgtgtggaatttgatggggaatcttggaggaaaagaagatggatagaagtctacagccttctaaggagagcatttttagtagaacataatttggttttagctgaacgaaagtcacctgaaatttctgaacgaattgtacagtggcctgcaataacgtacaaacctctgttggacaaagctggtttgggatccataacttctgttcgctttctgggagatcaacaaagagtatttctttctaaagaccttttgaagcctatacaggatgtaaacagtcttcgactttctcttacggataatcagattgtcagtaaagaatttcaagctttgattgtgaagcatttagatgaaagccatcttttaaaaggtgacaaaaacttagttggttcagaagtaaaaatttatagcttggacccatctactcagtggttttcagcaaccgttgtaaatggaaacccagcatcaaaaactcttcaagtcaactgtgaggagattccagcactgaaaattgttgatccgtcactgattcatgttgaagttgtacacgataaccttgtgacatgtggtaattctgcaagaattggagctgtaaaacgcaagtcttctgagaataatggaaccctggtttccaaacaagcaaaatcttgctctgaggcctctcccagtatgtgtcctgtgcagtctgtacctacaacagtttttaaggagatactgcttggctgtactgcngcaactccacctagtaaggacccaagacagcaaagtactccccaggctgccaactctccacctaaccttggagcaaaaattcctcaaggatgtcataaacaaagtttaccagaggaaatttcttcctgtctaaatacaaagtctgaagctctgagaacaaaaccagatgtctgcaaagcagggttgctctcaaagtcctctcagattggaactggagacttgaaaattctgactgagccaaaaggcagctgtactcagcctaagacaaacactgatcaggaaaacagattggagtctgttccacaagcattgactggccttcctaaggagtgcttacctacaaaggcttcttctaaggcagaattggaaattgccaatcctcctgaactgcagaagcacctagaacatgcaccttccccatcggatgtttcaaatgcaccagaagtgaaagcaggtgtcaatagtgatagccctaataactgttcaggaaaaaaggtagaaccttcagctttagcttgccgatcacagaatttaaaggaatcttcagtaaaagtagataatgaaagctgttgttcaagaagcaacaataaaatccagaatgccccatccaggaagtcggttttgacagacccagctaaactcaaaaagctgcaacagagtggcgaggccttcgtacaggatgattcttgtgtgaacatcgtggcacagttgcctaaatgccgagagtgtcgcttggacagtctccgcaaggataaggagcaacagaaggactcacctgtgttttgccgcttctttcacttcaggaggttacaattcaacaaacatggtgtgttgcgggtagaaggcttcttaacaccaaacaagtatgacaatgaagcaattggcttgtggttacctttaaccaaaaacgttgtggggattgatttggacacagcaaagtacatcttggccaacattggagaccacttctgtcaaatggtgatttctgaaaaggaagctatgtcaactattgagccacacagacaggttgcttggaagcgagctgtcaaaggtgttcgagaaatgtgtgatgtgtgcgacaccaccatcttcaacctgcactgggtgtgtcctcggtgtgggtttggagtatgtgtggactgctaccggatgaagagaaagaattgccaacagggtgctgcttacaagactttctcttggctaaaatgtgtgaagagtcagatacatgaaccagagaacttaatgcccacacagatcattcctggaaaagcactctatgatgttggagacattgttcattctgtaagagcgaaatggggaataaaggcaaactgcccttgttcaaacaggcaattcaaactcttttcaaagccagcctcaaaggaagacctaaaacagacttctttagctggagaaaaaccgactcttggtgcagtgctccagcagaatccctcagtgttggagccagcagctgtgggtggggaagcagcctccaagccagccggcagcatgaagcctgcctgtccagccagcacatctcctctaaactggctggccgacctaaccagcgggaatgtcaacaaggaaaacaaggaaaaacaaccaacaatgccaattttaaagaatgaaatcaaatgccttccacccctcccacctttaagcaaatccagcacagtcctccatacgtttaacagcacaattttgacacccgtaagcaacaacaattctggtttcctccggaatctcttgaattcttctacaggaaagacagaaaatggactcaagaatacaccaaaaatccttgatgacatctttgcctctttggtgcaaaataagacgacttctgatttatctaagaggcctcaaggactaaccatcaagcccagcattctgggctttgacactcctcactattggctttgtgataatcgcttgctgtgcttgcaagaccccaacaataagagcaactggaatgtgtttagggagtgctggaaacaagggcagccagtgatggtgtctggagtgcatcataaattgaactctgaactttggaaacctgaatccttcaggaaagagtttggtgagcaggaagtagacctagttaattgtaggaccaatgaaatcatcacaggagccacagtaggagacttctgggatggatttgaagatgttccaaatcgtttgaaaaatgaaaaagaaccaatggtgttgaaacttaaggactggccaccaggagaagattttagagatatgatgccttccaggtttgatgatctgatggccaacattccactgcccgagtacacaaggcgagatggcaaactgaatttggcctctaggctgccaaactactttgttcggccagatctgggccccaagatgtataatgcttatggattaatcactcctgaagatcggaaatatggaacaacaaatcttcacttagatgtatctgatgcagctaatgtcatggtctatgtgggaattcccaaaggacagtgtgagcaagaagaagaagtccttaagaccatccaagatggagattctgacgaactcacaataaagcgatttattgaaggaaaagagaagccaggagcactgtggcacatatatgctgcaaaggacacggagaagataagggaatttcttaaaaaggtatcagaagagcaaggtcaagaaaacccagcagaccacgatcctattcatgatcaaagctggtatttagaccgatcattaagaaaacgtcttcatcaagagtatggagttcaaggctgggctattgtacagtttcttggggatgtggtgtttatcccggcaggagctccacatcaggttcataacttatatagctgcatcaaagtggctgaagattttgtttctccagagcatgttaaacactgcttctggcttactcaggaattccgatatctgtcacagactcataccaatcacgaagataaattacaggtgaagaatgttatctaccatgcagtgaaagatgcagttgctatgctgaaagccagtgaatccagttttggcaaaccttaatctccctgcacattggaaatgaattacaggcagctgttcaaactcttcaggcaggattcctgtggactttgagattcatgttacctcatcttcttttttaaactgtacccaacttgtgagggtactctgtctaatgtatatttctagtgtttacagacagtaaatgtgtatatgtagtaactatttacagaacatgcatccttaaactgtgacttctcacctagtgcagaacttttaccaggctgtaaaagcaaaacctcgtatcagctctggaacaatacctgcagttattcttcagctgtttggacaacttagattgggtttataactattaggaatcactgcacagtttatttgggttgtgttttgtgtctgagtcccctccctcatcccttagggtccagaagagcaatggaggaagtgacagctaatgttgcagttcttattgtatggcataggactggcattatatagcagaaatcaactactgtacaatttcttggggttaaccatctttagttaaatggaattttaatttaaatgacgctttgctaattttaagtgttaagcattttgcattaaaatattcatataataaaaaaaaaaaaaattcactggccgccggtttacaacgtgtggactggga

SEQ ID NO: 295695 - DNA, 2529 bp, Homo sapiens
ggtgcggggggtaataccttgctgtgtttaagttgctgacatctctcctaccttttagttattctctactagtgcgggattactgcagctgtggggatacccagggctaactattaggtggttttgttctggatatttatcttacttgttggtcggctattaggagagaagaaaagaaaaggaagctgtcattcttcagcttatgtaaaatcgtcctttaatgcttaacacagacttctttagctggagaaaaaccgactcttggtgcagtgctccagcagaatccctcagtgttggagccagcagctgtgggtggggaagcagcctccaagccagccggcagcatgaagcctgcctgtccagccagcacatctcctctaaactggctggccgacctaaccagcgggaatgtcaacaaggaaaacaaggaaaaacaaccaacaatgccaattttaaagaatgaaatcaaatgccttccacccctcccacctttaagcaaatccagcacagtcctccatacgtttaacagcacaattttgacacccgtaagcaacaacaattctggtttcctccggaatctcttgaattcttctacaggaaagacagaaaatggactcaagaatacaccaaaaatccttgatgacatctttgcctctttggtgcaaaataagacgacttctgatttatctaagaggcctcaaggactaaccatcaagcccagcattctgggctttgacactcctcactattggctttgtgataatcgcttgctgtgcttgcaagaccccaacaataagagcaactggaatgtgtttagggagtgctggaaacaagggcagccagtgatggtgtctggagtgcatcataaattgaactctgaactttggaaacctgaatccttcaggaaagagtttggtgagcaggaagtagacctagttaattgtaggaccaatgaaatcatcacaggagccacagtaggagacttctgggatggatttgaagatgttccaaatcgtttgaaaaatgaaaaagaaccaatggtgttgaaacttaaggactggccaccaggagaagattttagagatatgatgccttccaggtttgatgatctgatggccaacattccactgcccgagtacacaaggcgagatggcaaactgaatttggcctctaggctgccaaactactttgttcggccagatctgggccccaagatgtataatgcttatggattaatcactcctgaagatcggaaatatggaacaacaaatcttcacttagatgtatctgatgcagctaatgtcatggtctatgtgggaattcccaaaggacagtgtgagcaagaagaagaagtccttaagaccatccaagatggagattctgacgaactcacaataaagcgatttattgaaggaaaagagaagccaggagcactgtggcacatatatgctgcaaaggacacggagaagataagggaatttcttaaaaaggtatcagaagagcaaggtcaagaaaacccagcagaccacgatcctattcatgatcaaagctggtatttagaccgatcattaagaaaacgtcttcatcaagagtatggagttcaaggctgggctattgtacagtttcttggggatgtggtgtttatcccggcaggagctccacatcaggttcataacttatatagctgcatcaaagtggctgaagattttgtttctccagagcatgttaaacactgcttctggcttactcaggaattccgatatctgtcacagactcataccaatcacgaagataaattacaggtgaagaatgttatctaccatgcagtgaaagatgcagttgctatgctgaaagccagtgaatccagttttggcaaaccttaatctccctgcacattggaaatgaattacaggcagctgttcaaactcttcaggcaggattcctgtggactttgagattcatgttacctcatcttcttttttaaactgtacccaacttgtgagggtactctgtctaatgtatatttctagtgtttacagacagtaaatgtgtatatgtagtaactatttacagaacatgcatccttaaactgtgacttctcacctagtgcagaacttttaccaggctgtaaaagcaaaacctcgtatcagctctggaacaatacctgcagttattcttcagctgtttggacaacttagattgggtttataactattaggaatcactgcacagtttatttgggttgtgttttgtgtctgagtcccctccctcatcccttagggtccagaagagcaatggaggaagtgacagctaatgttgcagttcttattgtatggcataggactggcattatatagcagaaatcaactactgtacaatttcttggggttaaccatctttagttaaatggaattttaatttaaatgacgctttgctaattttaagtgttaagcattttgcattaaaatattcatataataaaaaaaaaaaaaattcactggccgccggtttacaacgtgtggactggga

SEQ ID NO: 295696 - DNA, 1447 bp, Homo sapiens
aaagaatttttttgcaataatttgatccagaatttttattctcagcagaagagtcaatcagggacctaccatcccccaggtaggtagtggaaagactgtggcagcctttgttgtcttttgtaaaacttaaggcactttgtttttgcaggattaatcactcctgaagatcggaaatatggaacaacaaatcttcacttagatgtatctgatgcagctaatgtcatggtctatgtgggaattcccaaaggacagtgtgagcaagaagaagaagtccttaagaccatccaagatggagattctgacgaactcacaataaagcgatttattgaaggaaaagagaagccaggagcactgtggcacatatatgctgcaaaggacacggagaagataagggaatttcttaaaaaggtatcagaagagcaaggtcaagaaaacccagcagaccacgatcctattcatgatcaaagctggtatttagaccgatcattaagaaaacgtcttcatcaagagtatggagttcaaggctgggctattgtacagtttcttggggatgtggtgtttatcccggcaggagctccacatcaggttcataacttatatagctgcatcaaagtggctgaagattttgtttctccagagcatgttaaacactgcttctggcttactcaggaattccgatatctgtcacagactcataccaatcacgaagataaattacaggtgaagaatgttatctaccatgcagtgaaagatgcagttgctatgctgaaagccagtgaatccagttttggcaaaccttaatctccctgcacattggaaatgaattacaggcagctgttcaaactcttcaggcaggattcctgtggactttgagattcatgttacctcatcttcttttttaaactgtacccaacttgtgagggtactctgtctaatgtatatttctagtgtttacagacagtaaatgtgtatatgtagtaactatttacagaacatgcatccttaaactgtgacttctcacctagtgcagaacttttaccaggctgtaaaagcaaaacctcgtatcagctctggaacaatacctgcagttattcttcagctgtttggacaacttagattgggtttataactattaggaatcactgcacagtttatttgggttgtgttttgtgtctgagtcccctccctcatcccttagggtccagaagagcaatggaggaagtgacagctaatgttgcagttcttattgtatggcataggactggcattatatagcagaaatcaactactgtacaatttcttggggttaaccatctttagttaaatggaattttaatttaaatgacgctttgctaattttaagtgttaagcattttgcattaaaatattcatataataaaaaaaaaaaaaattcactggccgccggtttacaacgtgtggactggga

SEQ ID NO: 295697 - DNA, 2185 bp, Homo sapiens
  misc_feature (1082)..(1082): n is a, c, g, or t
  misc_feature (2183)..(2185): n is a, c, g, or t
agcggctccgaggggggcgggtccgggaggctgtgcgtgtcttgtgagagctcttgaaccaagtcagcgctggagtcggctaggcggctggaaacggcggctgccgccggtgactcagggaggcgggaggcgggggaggagctcttcctgcaggcgtggaaaccatggtgctcacgctcggagaaagttggccggtattggtggggaggaggtttctcagtctgtccgcagccgacggcagcgatggcagccacgacagctgggacgtggagcgcgtcgccgagtggccctggctctccgggaccattcgagctgtttcccacaccgacgttaccaagaaggatctgaaggtgtgtgtggaatttgatggggaatcttggaggaaaagaagatggatagaagtctacagccttctaaggagagcatttttagtagaacataatttggttttagctgaacgaaagtcacctgaaatttctgaacgaattgtacagtggcctgcaataacgtacaaacctctgttggacaaagctggtttgggatccataacttctgttcgctttctgggagatcaacaaagagtatttctttctaaagaccttttgaagcctatacaggatgtaaacagtcttcgactttctcttacggataatcagattgtcagtaaagaatttcaagctttgattgtgaagcatttagatgaaagccatcttttaaaaggtgacaaaaacttagttggttcagaagtaaaaatttatagcttggacccatctactcagtggttttcagcaaccgttgtaaatggaaacccagcatcaaaaactcttcaagtcaactgtgaggagattccagcactgaaaattgttgatccgtcactgattcatgttgaagttgtacacgataaccttgtgacatgtggtaattctgcaagaattggagctgtaaaacgcaagtcttctgagaataatggaaccctggtttccaaacaagcaaaatcttgctctgaggcctctcccagtatgtgtcctgtgcagtctgtacctacaacagtttttaaggagatactgcttggctgtactgcngcaactccacctagtaaggacccaagacagcaaagtactccccaggctgccaactctccacctaaccttggagcaaaaattcctcaaggatgtcataaacaaagtttaccagaggaaatttcttcctgtctaaatacaaagtctgaagctctgagaacaaaaccagatgtctgcaaagcagggttgctctcaaagtcctctcagattggaactggagacttgaaaattctgactgagccaaaaggcagctgtactcagcctaagacaaacactgatcaggaaaacagattggagtctgttccacaagcattgactggccttcctaaggagtgcttacctacaaaggcttcttctaaggcagaattggaaattgccaatcctcctgaactgcagaagcacctagaacatgcaccttccccatcggatgtttcaaatgcaccagaagtgaaagcaggtgtcaatagtgatagccctaataactgttcaggaaaaaaggtagaaccttcagctttagcttgccgatcacagaatttaaaggaatcttcagtaaaagtagataatgaaagctgttgttcaagaagcaacaataaaatccagaatgccccatccaggaagtcggttttgacagacccagctaaactcaaaaagctgcaacagagtggcgaggccttcgtacaggatgattcttgtgtgaacatcgtggcacagttgcctaaatgccgagagtgtcgcttggacagtctccgcaaggataaggagcaacagaaggactcacctgtgttttgccgcttctttcacttcaggaggttacaattcaacaaacatggtgtgttgcgggtagaaggcttcttaacaccaaacaagtatgacaatgaagatggtggggtccttaacaaaagtgggggctgcttggccagcaagtaatctggcaaatgggacatctgtaagggatctgaaggaatattaattgacaagaggtgtgaacgctgtaggtcgaaggtggtggaaccacttacgagagttccgggtggatttgtgagaacaataagggtaactgaatggaaaaaagacaggagatgatagagtaccctagcactccgnnn

SEQ ID NO: 295698 - DNA, 599 bp, Homo sapiens
agcggctccgaggggggcgggtccgggaggctgtgcgtgtcttgtgagagctcttgaaccaagtcagcgctggagtcggctaggcggctggaaacggcggctgccgccggtgactcagggaggcgggaggcgggggaggagctcttcctgcaggcgtggaaaccatggtgctcacgctcggagaaagttggccggtattggtggggaggaggtttctcagtctgtccgcagccgacggcagcgatggcagccacgacagctgggacgtggagcgcgtcgccgagtggccctggctctccgggaccattcgagctgtttcccacaccgacgttaccaagaaggatctgaaggtacaggcggctccgggcctctgccaccggacgtttcgcagttaccgtggtaacgcgaccatcggttccctccttccgttttctgaaaacggagaccagaaagttggcatatgatctgaaggtgcaggaagctagatcttgaaagtctttggaatggttgtatagagccgagttgtgtttggcccacagctcctggctgcctggctttaataatgggcttagggttgttcagacacgcttcattaatgc

SEQ ID NO: 295699 - DNA, 450 bp, Homo sapiens
gtttgatgatctgatggccaacattccactgcccgagtacacaaggcgagatggcaaactgaatttggcctctaggctgccaaactactttgttcggccagatctgggccccaagatgtataatgcttatggtaaggaggagatggctaactttaaaatggaaataaaacaattcaaaatgtttggaaaattgattttgtgggagggagaggtggaaaacacccataatcctaatgcgtaatacagccacagctttcatttttacatatttcctttcgttcccgtggccacatagtttgtgtgtttcattttcatagttgcagttgtagggcatatgcaattttgtagtttttccctttactgtacctaattttacattgtaaaatctttacatgttacttaatagtctttagatgacttttaatggtgtgtgatacatcattgagagaa

SEQ ID NO: 295700 - DNA, 2556 bp, Homo sapiens
  misc_feature (1150)..(1150): n is a, c, g, or t
  misc_feature (1280)..(1280): n is a, c, g, or t
  misc_feature (1755)..(1755): n is a, c, g, or t
  misc_feature (2048)..(2048): n is a, c, g, or t
  misc_feature (2334)..(2334): n is a, c, g, or t
  misc_feature (2533)..(2533): n is a, c, g, or t
catgagtcagaaattcaagccaccagatgctttccaactaacagggaccaaatgggaccgttctaagatatcctaaaagatttgggagttagaggaggtaaactaagataattatattacaaagggtacaagaccacaagacaacaaccgactccggaattcttggacctccgccttccgtacaaggtgctgggcctgggaacttgggatgggggagggggacacattgcgcggtggccctgaggtgacggggagacgcagggcgagccgtgtccctcaatctaaggggagaaataggagcgcacacatgggtcacccaacgaagcaaggcgtccctgtgaactgtgcggctggctcttgggggcaacaccagggctgacctgaggaaagggcaaccagtactcccagcgatgacttcgggtcggcggaaggaaaagacctgagcgctaagagcttgggatacgggtcaggcccatccttaggggaaaccggctgggaagcgagggggggcgcaggccgagccggaacgagacacagaccgggtaggtcaagggagggggggtgtccggctggggcagttacaagcacgggaatcggcgaggctcagcagcccgcttcccgtcttgggtcatccttctgctagcggctgctccgactgttccaggcccagccgccccgtccactgccaccaccaacgccgccgccatcttacactggccagcggccgccaccaccaccgcctccgctctctgcgcttgcgcctgcgctgccacgctttccggccccgtttgcgacgatgtgctcgagaagactgagggaagagtggtcgcgcgagctcacggctcgcaaccctcctcgaaggacgcacaaggggcggggcttaaggccaacggaaaacagagcgagaggcgcctgcgcattaccgaagaggcaaagttgtttttgtagtttcttcgggcttgcttatcttgtgatactcaaaacaaatgcgagttaggggctacccagagttgtgatagaaataaactaaatttccagcggattggcaggccacttcctggatgatggccagttttgccgtttttgaacactggaacgagcaatgattgccacaaggatttcttctgaaaatccccgtttcctttcaggnctttgtttccttaagtggtttctatactatcgaggcccattttcccctgagagtccccatttacgtatttttaaagaaggggctcagtagcttgaggtgtagctattccagaagctcttttctgaagagnggtggtgtgggtaaaggttcccaagagtgggccgggtgatgtggggtgacttttgtactctgtttcgttatgacacctacagtaaccctgcagaggattactcccagctgccaggctggggtattttttttttttttcttaccagaagcccagggtgcaaaaatctgaccctttctcacctcccctaccgctactctcctattccaagtcattacatattacttaagactaccgcaatagaaacttacctcgtttgtctacttccattattgccattacagttaaacataaggcagccagagtgctttttaaaaatgtaaggtctggccgggcgcggtggctcatgcctgtaatcctagcactttgggaggcggatgtgggcggatcacttgaggtcaggagttcgaaactcgtttgaaaccaggccaacatggtgaaacccgtctctacgaaaaatacaaaaaaaaaaaaaaanaaaaaaaaagtaatgtcgtattatttccccagtccccaccctgctcaaaacctccaattcccatcacataataaaagtcaaaagtatgatagccttagaggccatcaaaaaatgaattgcctctaaggaggaccctacatgatctgatctagcacctgcctatttatctgattcatctcctcccacactgcctagctctgctctagcctcactagccttactgtcactccagtcaaagcatgtcccagccctagggtttttttccttttcttggaatgtccatctactagatntttactagacttgaggtgtctattgaaatcctacttcctaacacaggcagctcttgactattgtaactaaaatggaacctcatgtcatcctcctctatccccttactctgcactgtttttttaataacattttttacctataacatttaatctaaaattatgtttgtgatccagctatactactagaatataaattcttgagggcaaggactgtgtttttatcatctttgtaatctcaacacctagaagagggctacagcacaaagtagctatttaatgccccacngtcctattcattctttcattcattcagtcaacaactattgaattcctgctctggaaggccctgttctatgtgctggggctgcaacagtgaatagaaccaagattcttgcattcatggaacttattagtgcaagggttgggagcataggaggaggggagagacacacagataataaagttataaagagtactgtaaaggnaaataaagcagaataaaaatggg

SEQ ID NO: 295701 - DNA, 2078 bp, Homo sapiens
  misc_feature (672)..(672): n is a, c, g, or t
  misc_feature (802)..(802): n is a, c, g, or t
  misc_feature (1277)..(1277): n is a, c, g, or t
  misc_feature (1570)..(1570): n is a, c, g, or t
  misc_feature (1856)..(1856): n is a, c, g, or t
  misc_feature (2055)..(2055): n is a, c, g, or t
catgagtcagaaattcaagccaccagatgctttccaactaacagggaccaaatgggaccgttctaagatatcctaaaagatttgggagttagaggaggtaaactaagataattatattacaaagggtacaagaccacaagacaacaaccgactccggaattcttggacctccgccttccgtacaaggcccagccgccccgtccactgccaccaccaacgccgccgccatcttacactggccagcggccgccaccaccaccgcctccgctctctgcgcttgcgcctgcgctgccacgctttccggccccgtttgcgacgatgtgctcgagaagactgagggaagagtggtcgcgcgagctcacggctcgcaaccctcctcgaaggacgcacaaggggcggggcttaaggccaacggaaaacagagcgagaggcgcctgcgcattaccgaagaggcaaagttgtttttgtagtttcttcgggcttgcttatcttgtgatactcaaaacaaatgcgagttaggggctacccagagttgtgatagaaataaactaaatttccagcggattggcaggccacttcctggatgatggccagttttgccgtttttgaacactggaacgagcaatgattgccacaaggatttcttctgaaaatccccgtttcctttcaggnctttgtttccttaagtggtttctatactatcgaggcccattttcccctgagagtccccatttacgtatttttaaagaaggggctcagtagcttgaggtgtagctattccagaagctcttttctgaagagnggtggtgtgggtaaaggttcccaagagtgggccgggtgatgtggggtgacttttgtactctgtttcgttatgacacctacagtaaccctgcagaggattactcccagctgccaggctggggtattttttttttttttcttaccagaagcccagggtgcaaaaatctgaccctttctcacctcccctaccgctactctcctattccaagtcattacatattacttaagactaccgcaatagaaacttacctcgtttgtctacttccattattgccattacagttaaacataaggcagccagagtgctttttaaaaatgtaaggtctggccgggcgcggtggctcatgcctgtaatcctagcactttgggaggcggatgtgggcggatcacttgaggtcaggagttcgaaactcgtttgaaaccaggccaacatggtgaaacccgtctctacgaaaaatacaaaaaaaaaaaaaaanaaaaaaaaagtaatgtcgtattatttccccagtccccaccctgctcaaaacctccaattcccatcacataataaaagtcaaaagtatgatagccttagaggccatcaaaaaatgaattgcctctaaggaggaccctacatgatctgatctagcacctgcctatttatctgattcatctcctcccacactgcctagctctgctctagcctcactagccttactgtcactccagtcaaagcatgtcccagccctagggtttttttccttttcttggaatgtccatctactagatntttactagacttgaggtgtctattgaaatcctacttcctaacacaggcagctcttgactattgtaactaaaatggaacctcatgtcatcctcctctatccccttactctgcactgtttttttaataacattttttacctataacatttaatctaaaattatgtttgtgatccagctatactactagaatataaattcttgagggcaaggactgtgtttttatcatctttgtaatctcaacacctagaagagggctacagcacaaagtagctatttaatgccccacngtcctattcattctttcattcattcagtcaacaactattgaattcctgctctggaaggccctgttctatgtgctggggctgcaacagtgaatagaaccaagattcttgcattcatggaacttattagtgcaagggttgggagcataggaggaggggagagacacacagataataaagttataaagagtactgtaaaggnaaataaagcagaataaaaatggg

SEQ ID NO: 295702 - DNA, 429 bp, Homo sapiens
tactctcctattccaagtcattacatattacttaagactaccgcaatagaaacttacctcgtttgtctacttccattattgccattacagttaaacataaggcagccagagtgctttttaaaaatgtaaggtctggccgggcgcggtggctcatgcctgtaatcctagcactttgggaggcggatgtgggcggatcacttgaggtcaggagttcgaaactcgtttgaaaccaggccaacatggtgaaacccgtctctacgaaaaatacaaaaaaaaaaaaaaattacccggcatggtggagcgcgcctgcaatcccagctacttgggaggctgaggcaggagaattgcttgaacccggaggcggaggttgcagtgagctgagatcgcaccactgcactccaggctgggcaatggaatgagactccgtct

SEQ ID NO: 295703 - DNA, 467 bp, Homo sapiens
atcccaccccacctcccgctgcagattaattactgtaagtgcaactccaatcgggctggtgaccccccaggaaacctctgaagctgtcccaggctgttcccaacatgggacctccactctggcacaccaggacccgaggcccctgacaggctcctcgttcctgcctcgctcaaggctcaggtcccccacctgaaatactccctcccaccagcatctcctgcctcgctcctgctgccaggtccccaaaagctcttgttcatgagctcgcctgccatccacagcccccaccagaacccaagtggctgtggaattcgctgccctgattctctgcccagagcctcggtccagactgtgttccctggcgaattagtgttcagcatttttgtttatttgtttgttctttaacaaaagttgttttggtttgagattcagcaaaaatacacactgcattcagcttcctctccaaa

SEQ ID NO: 295704 - DNA, 5909 bp, Homo sapiens
gcggcgtttcccgcgcgggctacctcagttctcgggcgtacggcgcggcctgtcctactgccgccggcgccgcggccgtcatggggttcctgaaactgattgagattgagaactttaagtcgtacaagggtcgacagattatcggaccatttcagaggttcaccgccatcattggacccaatggctctggtaagtcaaatctcatggatgccatcagctttgtgctaggtgaaaaaaccagcaacctgcgggtaaagaccctgcgggacctgatccatggagctcctgtgggcaagccagctgccaaccgggcctttgtcagcatggtctactctgaggagggtgctgaggaccgtacctttgcccgtgtcattgtaggaggttcttctgagtacaagatcaacaacaaagtggtccaactacatgagtacagtgaggaattagagaagttgggcattctcatcaaagctcgtaacttcctcgttttccagggtgctgtggaatctattgccatgaagaaccccaaagagaggacagctctatttgaagagattagtcgttctggggagctggcgcaggagtatgacaagcgaaagaaggaaatggtgaaggctgaagaggacacacagtttaattaccatcgcaagaaaaatattgcggctgaacgcaaggaagcaaagcaggagaaagaagaggctgaccggtaccagcgcctgaaggatgaggtagtacgggctcaggtacagctgcagctctttaagctttaccataatgaagtggaaattgagaagctcaacaaggaactggcctcaaagaacaaggagatcgagaaggacaagaagcgtatggacaaggtggaggatgaactgaaggagaagaagaaggagctgggcaaaatgatgcgggagcagcagcagattgagaaggagatcaaggagaaggactcagaattgaaccagaagcggcctcagtacatcaaagccaaggagaacacctcccacaaaatcaagaagctggaagcagccaagaagtctctgcagaatgctcagaagcactacaagaagcgtaaaggtgacatggatgagctggagaaggagatgctgtcagtggagaaggctcggcaggagtttgaagaacggatggaagaagagagtcagagtcagggcagagatttgacgttggaggagaatcaggtgaagaaataccaccggttgaaagaagaagccagcaagagagcagctaccctggcccaggagctggagaaattcaatcgagaccagaaagctgaccaggaccgtctggatctggaagaacggaagaaagtagagacagaggccaagatcaagcaaaagctgcgggaaattgaagagaatcagaagcggattgagaaactggaggaatacatcaccactagcaagcagtccctagaagagcagaagaagctagagggggagctgacagaggaggtggagatggccaagcggcgtattgatgaaatcaataaggagctgaaccaggtgatggagcagctaggggatgcccgcatcgaccgccaggagagcagccgccagcagcgaaaggcagagataatggaaagcatcaagcgcctttaccctggctctgtgtacggccgcctcattgacctatgccagcccacacaaaagaagtatcagattgctgtaaccaaggttttgggcaagaacatggatgccattattgtggactcggagaagacaggccgggactgtattcagtatatcaaggagcagcgtggggagcctgagaccttcttgcctcttgactacctggaggtgaagcctacagatgagaaactccgggagctgaagggggccaagctagtgattgatgtgattcgctatgagccacctcatatcaaaaaggccctgcagtatgcttgtggcaatgcccttgtctgtgacaacgtggaagatgcccgccgcattgcctttggaggccaccagcgccacaagacagtggcactggatggaaccctattccagaagtcaggagtgatctctggtggggccagtgacctgaaggccaaggcacggcgctgggatgagaaagcagtagacaagttgaaagagaagaaggagcgcttgacagaggagctgaaagagcagatgaaggcaaaacggaaagaggcagagctgcgtcaggtgcagtctcaggcccatggactgcagatgcggctcaagtactcccagagtgacctagaacagaccaagacacgacatctagccctgaatctgcaggaaaaatccaagctggagagtgagctagccaactttgggcctcgcattaatgatatcaagaggatcattcagagccgagagagggaaatgaaagacttgaaggagaagatgaaccaggtagaggatgaggtgtttgaagagttttgtcgggagattggtgtgcgcaacatccgggagtttgaggaagaaaaggtgaaacggcagaatgaaatcgccaagaagcgtttggagtttgagaatcagaagactcgcttgggcattcagttggattttgaaaagaaccaactgaaggaggaccaagataaagtacacatgtgggagcagacagtgaaaaaagatgaaaatgagatagaaaagctcaaaaaggaggaacaaagacacatgaagatcatagatgagaccatggctcagctacaagacctgaagaatcagcatctggccaagaagtcggaagtgaatgacaagaatcatgagatggaggagattcgtaagaaactcgggggcgccaacaaggaaatgacccatttacagaaggaggtgacagccattgagaccaagcttgaacagaagcgcagtgaccgtcacaacttgctacaggcctgtaagatgcaggacattaagttgccactgtcaaaaggcaccatggatgatattagtcaggaagagggtagctcccagggggaggactcagtgagtggttcacagagaatttccagtatctatgcacgagaggccctcattgagattgactacggtgatctgtgtgaggatctgaaggatgcccaggctgaggaagagatcaagcaagagatgaacacactgcagcagaagctgaatgagcagcagagtgtgcttcagcgtattgccgcccccaacatgaaggccatggaaaagctggaaagtgtccgagacaagttccaggagacctcagatgagtttgaagcagcccgaaagcgagcaaagaaggccaagcaggcattcgaacagatcaagaaggagcgctttgaccgcttcaatgcttgttttgaatctgtggctaccaacattgatgagatctataaggccctgtcccgcaatagcagtgcccaggcattcctgggccctgagaaccctgaagagccctacttggatggcatcaactacaactgtgtggctcctgggaaacgcttccggcctatggacaacttgtcaggcggggagaagacagtggcagctctggccctgctctttgccatccacagctacaagccagcccccttcttcgtcctggatgagattgatgctgccttggataacaccaacattggcaaggtggcaaattacatcaaggagcagtcgacttgcaacttccaggccatcgtcatctctctcaaggaggagttctacaccaaggccgagagcctcattggagtctatcctgagcaaggggactgtgtgatcagcaaagtcctgaccttcgacctcaccaagtacccagatgccaaccccaaccccaatgagcagtagcagtatttttgccctcccgccctgtctggatccctaagctgtccctctcccaatctctggatatttgactcccaaccttccccctacctcctggccctttttggtgtagtcatgggatttaggcactgctaatcaagcatgaagaggaacagaggtgatgttaggtctggagcaaaaattcctgaacgacagggagtattctggcctctgaaaggaggtgctgagctgaacagggccatctgttcatcacacacacccccttcctccccctcatcacccataatcgtgggccccttgggcctcttgcccactgtgtgtgtgggtatgtatgtgtgtatgtatgtatccgcatgtgtgcatgtgagtatgtttgcaaaataataaaggatattggagacctgttttagaaggagcctaggctgaatttgattccaagagagcttaggatgacagcacccctgagctgggcaaaggtactcaggacctcataggagtcttaggcagttacctgaaactgccttcattcactcatttgtgtattcattcatttatgtattcatcagacacataccgaacaccctctatttgtcaggctctgtgcttggaatacagagttgaatcagacatgatctctaccctcctagtaaggagatacagtgggttcatgaatgactatagttagctgaatgtcatatgtactttgaatttgagaagtgggtgatcccctctaggcttcctggaggtcacatttaagctagaccttgacaaattggtaggatttggtcaggcactaggagtggagcatgagctctggggacagacagttatgggttctggtcccactttttatcacttactagttgtttgaccttgggcaagtcatttgaccttctgtgcctcagtttcctcatctgtaaaatggggctaacaatattacctacctcataggatttaatgatgtcaagctcctcactggaggccttatcccttcgtggagcccactaggtgccgacccctcagaatataaccctcatgcctggacccctgagagcttctgatcccagctattagggacagaagaagcctccaaatctggaaggtgctgaatgccctgctgactgggaaagtttcagggcactgatggggtctacctggtaagcggagggcctgaggaaacctgtagcttcaatcatgtctggtaaccgggtgcctgagccccaatctgggttgtgaggaaataggggagaggtatcctgggccacatcccagcctaacacctgtgaggttcattttaggaactaacctcattagctataaggatcatgcagaggcagcaaagccgggtgcgatgagctcagcctttactcattcacatacaccatcacactttaattccaatctgtatattgctttttaaaagttaagtccattctaattacccaaatatgcatgaattcattctccttttgagaagttagattgttaaagatagtctcattcagctaccaaccactccttgatccttcccttcttagtggctgttgtttgttgtacttccgtttagactttgttttaatgcttgtacgtacatatgtgaactcattggaaatattgtgtgtttaatgcaaatgatatattgaattgtttagcaatttgttttctttgcttaacgatgtttttgagatctgtgcatgttacttaatgtagctcaatccatcttctgtaattgctgtatagattgtcatcatatgattaccacattttacttacgcatttcttttgtgatggacattaagactgtttttaggttttgctattacaaaatactacacaggagcatcactatgcctgtgtgaaagtatatgtatgaaagtttacctagggttgattcctagaagtggaattgcaaagtcataggatatttatatattggtttttaataatacttccaaattgccctcctgtactatttactcagtatttttcttgaggttgatctgaggtctaacattgttatcctatatcattttcatcccaagtagtgatatctgtgaaatcacaggtttgatgtgtgctaattatgtattcttctaatacatattaaaagacataactatcaaaacaaaa

SEQ ID NO: 295705 - DNA, 6046 bp, Homo sapiens
gcggcgtttcccgcgcgggctacctcagttctcgggcgtacggcgcggcctgtcctactgccgccggcgccgcggccgtcatggggttcctgaaactgattgagattgagaactttaagtcgtacaagggtcgacagattatcggaccatttcagaggttcaccgccatcattggacccaatggctctggtaagtcaaatctcatggatgccatcagctttgtgctaggtgaaaaaaccagcaacctgcgggtaaagaccctgcgggacctgatccatggagctcctgtgggcaagccagctgccaaccgggcctttgtcagcatggtctactctgaggagggtgctgaggaccgtacctttgcccgtgtcattgtaggaggttcttctgagtacaagatcaacaacaaagtggtccaactacatgagtacagtgaggaattagagaagttgggcattctcatcaaagctcgtaacttcctcgttttccagggtgctgtggaatctattgccatgaagaaccccaaagagaggacagctctatttgaagagattagtcgttctggggagctggcgcaggagtatgacaagcgaaagaaggaaatggtgaaggctgaagaggacacacagtttaattaccatcgcaagaaaaatattgcggctgaacgcaaggaagcaaagcaggagaaagaagaggctgaccggtaccagcgcctgaaggatgaggtagtacgggctcaggtacagctgcagctctttaagctttaccataatgaagtggaaattgagaagctcaacaaggaactggcctcaaagaacaaggagatcgagaaggacaagaagcgtatggacaaggtggaggatgaactgaaggagaagaagaaggagctgggcaaaatgatgcgggagcagcagcagattgagaaggagatcaaggagaaggactcagaattgaaccagaagcggcctcagtacatcaaagccaaggagaacacctcccacaaaatcaagaagctggaagcagccaagaagtctctgcagaatgctcagaagcactacaagaagcgtaaaggtgacatggatgagctggagaaggagatgctgtcagtggagaaggctcggcaggagtttgaagaacggatggaagaagagagtcagagtcagggcagagatttgacgttggaggagaatcaggtgaagaaataccaccggttgaaagaagaagccagcaagagagcagctaccctggcccaggagctggagaaattcaatcgagaccagaaagctgaccaggaccgtctggatctggaagaacggaagaaagtagagacagaggccaagatcaagcaaaagctgcgggaaattgaagagaatcagaagcggattgagaaactggaggaatacatcaccactagcaagcagtccctagaagagcagaagaagctagagggggagctgacagaggaggtggagatggccaagcggcgtattgatgaaatcaataaggagctgaaccaggtgatggagcagctaggggatgcccgcatcgaccgccaggagagcagccgccagcagcgaaaggcagagataatggaaagcatcaagcgcctttaccctggctctgtgtacggccgcctcattgacctatgccagcccacacaaaagaagtatcagattgctgtaaccaaggttttgggcaagaacatggatgccattattgtggactcggagaagacaggccgggactgtattcagtatatcaaggagcagcgtggggagcctgagaccttcttgcctcttgactacctggaggtgaagcctacagatgagaaactccgggagctgaagggggccaagctagtgattgatgtgattcgctatgagccacctcatatcaaaaaggccctgcagtatgcttgtggcaatgcccttgtctgtgacaacgtggaagatgcccgccgcattgcctttggaggccaccagcgccacaagacagtggcactggatggaaccctattccagaagtcaggagtgatctctggtggggccagtgacctgaaggccaaggcacggcgctgggatgagaaagcagtagacaagttgaaagagaagaaggagcgcttgacagaggagctgaaagagcagatgaaggcaaaacggaaagaggcagagctgcgtcaggtgcagtctcaggcccatggactgcagatgcggctcaagtactcccagagtgacctagaacagaccaagacacgacatctagccctgaatctgcaggaaaaatccaagctggagagtgagctagccaactttgggcctcgcattaatgatatcaagaggatcattcagagccgagagagggaaatgaaagacttgaaggagaagatgaaccaggtagaggatgaggtgtttgaagagttttgtcgggagattggtgtgcgcaacatccgggagtttgaggaagaaaaggtgaaacggcagaatgaaatcgccaagaagcgtttggagtttgagaatcagaagactcgcttgggcattcagttggattttgaaaagaaccaactgaaggaggaccaagataaagtacacatgtgggagcagacagtgaaaaaagatgaaaatgagatagaaaagctcaaaaaggaggaacaaagacacatgaagatcatagatgagaccatggctcagctacaagacctgaagaatcagcatctggccaagaagtcggaagtgaatgacaagaatcatgagatggaggagattcgtaagaaactcgggggcgccaacaaggaaatgacccatttacagaaggaggtgacagccattgagaccaagcttgaacagaagcgcagtgaccgtcacaacttgctacaggcctgtaagatgcaggacattaagttgccactgtcaaaaggcaccatggatgatattagtcaggaagagggtagctcccagggggaggactcagtgagtggttcacagagaatttccagtatctatgcacgagaggccctcattgagattgactacggtgatctgtgtgaggatctgaaggatgcccaggctgaggaagagatcaagcaagagatgaacacactgcagcagaagctgaatgagcagcagagtgtgcttcagcgtattgccgcccccaacatgaaggccatggaaaagctggaaagtgtccgagacaagttccaggagacctcagatgagtttgaagcagcccgaaagcgagcaaagaaggccaagcaggcattcgaacagatcaagaaggagcgctttgaccgcttcaatgcttgttttgaatctgtggctaccaacattgatgagatctataaggccctgtcccgcaatagcagtgcccaggcattcctgggccctgagaaccctgaagagccctacttggatggcatcaactacaactgtgtggctcctgggaaacgcttccggcctatggacaacttgtcaggcggggagaagacagtggcagctctggccctgctctttgccatccacagctacaagccagcccccttcttcgtcctggatgagattgatgctgccttggataacaccaacattggcaaggtggcaaattacatcaaggagcagtcgacttgcaacttccaggccatcgtcatctctctcaaggaggagttctacaccaaggccgagagcctcattggagtctatcctgagcaaggggactgtgtgatcagcaaagtcctgaccttcgacctcaccaagtacccagatgccaaccccaaccccaatgagcagtagcagtatttttgccctcccgccctgtctggatccctaagctgtccctctcccaatctctggatatttgactcccaaccttccccctacctcctggccctttttggtgtagtcatgggatttaggcactgctaatcaagcatgaagaggaacagaggtgatgttaggtctggagcaaaaattcctgaacgacagggagtattctggcctctgaaaggaggtgctgagctgaacagggccatctgttcatcacacacacccccttcctccccctcatcacccataatcgtgggccccttgggcctcttgcccactgtgtgtgtgggtatgtatgtgtgtatgtatgtatccgcatgtgtgcatgtgagtatgtttgcaaaataataaaggatattggagacctgttttagaaggagcctaggctgaatttgattccaagagagcttaggatgacagcacccctgagctgggcaaaggtactcaggacctcataggagtcttaggcagttacctgaaactgccttcattcactcatttgtgtattcattcatttatgtattcatcagacacataccgaacaccctctatttgtcaggctctgtgcttggaatacagagttgaatcagacatgatctctaccctcctagtaaggagatacagtgggttcatgaatgactatagttagctgaatgtcatatgtactttgaatttgagaagtgggtgatcccctctaggcttcctggaggtcacatttaagctagaccttgacaaattggtaggatttggtcaggcactaggagtggagcatgagctctggggacagacagttatgggttctggtcccactttttatcacttactagttgtttgaccttgggcaagtcatttgaccttctgtgcctcagtttcctcatctgtaaaatggggctaacaatattacctacctcataggatttaatgatgtcaagctcctcactggaggccttatcccttcgtggagcccactaggtgccgacccctcagaatataaccctcatgcctggacccctgagagcttctgatcccagctattagggacagaagaagcctccaaatctggaaggtgctgaatgccctgctgactgggaaagtttcagggcactgatggggtctacctggtaagcggagggcctgaggaaacctgtagcttcaatcatgtctggtaaccgggtgcctgagccccaatctgggttgtgaggaaataggggagaggtatcctgggccacatcccagcctaacacctgtgaggttcattttaggaactaacctcattagctataaggatcatgcagaggcagcaaagccgggtgcgatgagctcagcctttactcattcacatacaccatcacactttaattccaatctgtatattgctttttaaaagttaagtccattctaattacccaaatatgcatgaattcattctccttttgagaagttagattgttaaagatagtctcattcagctaccaaccactccttgatccttcccttcttagtggctgttgtttgttgtacttccgtttagactttgttttaatgcttgtacgtacatatgtgaactcattggaaatattgtgtgtttaatgcaaatgatatattgaattgtttagcaatttgttttctttgcttaacgatgtttttgagatctgtgcatgttacttaatgtagctcaatccatcttctgtaattgctgtatagattgtcatcatatgattaccacattttacttacgcatttcttttgtgatggacattaagactgtttttaggttttgctattacaaaatactacacaggagcatcactatgcctgtgtgaaagtatatgtatgaaagtttacctagggttgattcctagaagtggaattgcaaagtcataggatatttatatattggtttttaataatacttccaaattgccctcctgtactatttactcagtatttttcttgaggttgatctgaggtctaacattgttatcctatatcattttcatcccaagtagtgatatctgtgaaatcacaggtttgatgtgtgctaattatgtattcttctaatacatattaaaagacataactatcaaaacaaaaaagagaaaaagagaggagaagaggggaagaagaagaaaaaaagagaaggaaggggggggaaggaaaggaagggggaggggagaaaaaagaaagagaggggcgggggaagaaataagacggggggaataaggaataaa

SEQ ID NO: 295706 - DNA, 6595 bp, Homo sapiens
gcggcgtttcccgcgcgggctacctcagttctcgggcgtacggcgcggcctgtcctactgccgccggcgccgcggccgtcatggggttcctgaaactgattgagattgagaactttaagtcgtacaagggtcgacagattatcggaccatttcagaggttcaccgccatcattggacccaatggctctggtaagtcaaatctcatggatgccatcagctttgtgctaggtgaaaaaaccagcaacctgcgggtaaagaccctgcgggacctgatccatggagctcctgtgggcaagccagctgccaaccgggcctttgtcagcatggtctactctgaggagggtgctgaggaccgtacctttgcccgtgtcattgtaggaggttcttctgagtacaagatcaacaacaaagtggtccaactacatgagtacagtgaggaattagagaagttgggcattctcatcaaagctcgtaacttcctcgttttccagggtgctgtggaatctattgccatgaagaaccccaaagagaggacagctctatttgaagagattagtcgttctggggagctggcgcaggagtatgacaagcgaaagaaggaaatggtgaaggctgaagaggacacacagtttaattaccatcgcaagaaaaatattgcggctgaacgcaaggaagcaaagcaggagaaagaagaggctgaccggtaccagcgcctgaaggatgaggtagtacgggctcaggtacagctgcagctctttaagctttaccataatgaagtggaaattgagaagctcaacaaggaactggcctcaaagaacaaggagatcgagaaggacaagaagcgtatggacaaggtggaggatgaactgaaggagaagaagaaggagctgggcaaaatgatgcgggagcagcagcagattgagaaggagatcaaggagaaggactcagaattgaaccagaagcggcctcagtacatcaaagccaaggagaacacctcccacaaaatcaagaagctggaagcagccaagaagtctctgcagaatgctcagaagcactacaagaagcgtaaaggtgacatggatgagctggagaaggagatgctgtcagtggagaaggctcggcaggagtttgaagaacggatggaagaagagagtcagagtcagggcagagatttgacgttggaggagaatcaggtgaagaaataccaccggttgaaagaagaagccagcaagagagcagctaccctggcccaggagctggagaaattcaatcgagaccagaaagctgaccaggaccgtctggatctggaagaacggaagaaagtagagacagaggccaagatcaagcaaaagctgcgggaaattgaagagaatcagaagcggattgagaaactggaggaatacatcaccactagcaagcagtccctagaagagcagaagaagctagagggggagctgacagaggaggtggagatggccaagcggcgtattgatgaaatcaataaggagctgaaccaggtgatggagcagctaggggatgcccgcatcgaccgccaggagagcagccgccagcagcgaaaggcagagataatggaaagcatcaagcgcctttaccctggctctgtgtacggccgcctcattgacctatgccagcccacacaaaagaagtatcagattgctgtaaccaaggttttgggcaagaacatggatgccattattgtggactcggagaagacaggccgggactgtattcagtatatcaaggagcagcgtggggagcctgagaccttcttgcctcttgactacctggaggtgaagcctacagatgagaaactccgggagctgaagggggccaagctagtgattgatgtgattcgctatgagccacctcatatcaaaaaggccctgcagtatgcttgtggcaatgcccttgtctgtgacaacgtggaagatgcccgccgcattgcctttggaggccaccagcgccacaagacagtggcactggatggaaccctattccagaagtcaggagtgatctctggtggggccagtgacctgaaggccaaggcacggcgctgggatgagaaagcagtagacaagttgaaagagaagaaggagcgcttgacagaggagctgaaagagcagatgaaggcaaaacggaaagaggcagagctgcgtcaggtgcagtctcaggcccatggactgcagatgcggctcaagtactcccagagtgacctagaacagaccaagacacgacatctagccctgaatctgcaggaaaaatccaagctggagagtgagctagccaactttgggcctcgcattaatgatatcaagaggatcattcagagccgagagagggaaatgaaagacttgaaggagaagatgaaccaggtagaggatgaggtgtttgaagagttttgtcgggagattggtgtgcgcaacatccgggagtttgaggaagaaaaggtgaaacggcagaatgaaatcgccaagaagcgtttggagtttgagaatcagaagactcgcttgggcattcagttggattttgaaaagaaccaactgaaggaggaccaagataaagtacacatgtgggagcagacagtgaaaaaagatgaaaatgagatagaaaagctcaaaaaggaggaacaaagacacatgaagatcatagatgagaccatggctcagctacaagacctgaagaatcagcatctggccaagaagtcggaagtgaatgacaagaatcatgagatggaggagattcgtaagaaactcgggggcgccaacaaggaaatgacccatttacagaaggaggtgacagccattgagaccaagcttgaacagaagcgcagtgaccgtcacaacttgctacaggcctgtaagatgcaggacattaagttgccactgtcaaaaggcaccatggatgatattagtcaggaagagggtagctcccagggggaggactcagtgagtggttcacagagaatttccagtatctatgcacgagaggccctcattgagattgactacggtgatctgtgtgaggatctgaaggatgcccaggctgaggaagagatcaagcaagagatgaacacactgcagcagaagctgaatgagcagcagagtgtgcttcagcgtattgccgcccccaacatgaaggccatggaaaagctggaaagtgtccgagacaagttccaggagacctcagatgagtttgaagcagcccgaaagcgagcaaagaaggccaagcaggcattcgaacagatcaagaaggagcgctttgaccgcttcaatgcttgttttgaatctgtggctaccaacattgatgagatctataaggccctgtcccgcaatagcagtgcccaggcattcctgggccctgagaaccctgaagagccctacttggatggcatcaactacaactgtgtggctcctgggaaacgcttccggcctatggacaacttgtcaggcggggagaagacagtggcagctctggccctgctctttgccatccacagctacaagccagcccccttcttcgtcctggatgagattgatgctgccttggataacaccaacattggcaaggtggcaaattacatcaaggagcagtcgacttgcaacttccaggccatcgtcatctctctcaaggaggagttctacaccaaggccgagagcctcattggagtctatcctgagcaaggggactgtgtgatcagcaaagtcctgaccttcgacctcaccaagtacccagatgccaaccccaaccccaatgagcagtagcagtatttttgccctcccgccctgtctggatccctaagctgtccctctcccaatctctggatatttgactcccaaccttccccctacctcctggccctttttggtgtagtcatgggatttaggcactgctaatcaagcatgaagaggaacagaggtgatgttaggtctggagcaaaaattcctgaacgacagggagtattctggcctctgaaaggaggtgctgagctgaacagggccatctgttcatcacacacacccccttcctccccctcatcacccataatcgtgggccccttgggcctcttgcccactgtgtgtgtgggtatgtatgtgtgtatgtatgtatccgcatgtgtgcatgtgagtatgtttgcaaaataataaaggatattggagacctgttttagaaggagcctaggctgaatttgattccaagagagcttaggatgacagcacccctgagctgggcaaaggtactcaggacctcataggagtcttaggcagttacctgaaactgccttcattcactcatttgtgtattcattcatttatgtattcatcagacacataccgaacaccctctatttgtcaggctctgtgcttggaatacagagttgaatcagacatgatctctaccctcctagtaaggagatacagtgggttcatgaatgactatagttagctgaatgtcatatgtactttgaatttgagaagtgggtgatcccctctaggcttcctggaggtcacatttaagctagaccttgacaaattggtaggatttggtcaggcactaggagtggagcatgagctctggggacagacagttatgggttctggtcccactttttatcacttactagttgtttgaccttgggcaagtcatttgaccttctgtgcctcagtttcctcatctgtaaaatggggctaacaatattacctacctcataggatttaatgatgtcaagctcctcactggaggccttatcccttcgtggagcccactaggtgccgacccctcagaatataaccctcatgcctggacccctgagagcttctgatcccagctattagggacagaagaagcctccaaatctggaaggtgctgaatgccctgctgactgggaaagtttcagggcactgatggggtctacctggtaagcggagggcctgaggaaacctgtagcttcaatcatgtctggtaaccgggtgcctgagccccaatctgggttgtgaggaaataggggagaggtatcctgggccacatcccagcctaacacctgtgaggttcattttaggaactaacctcattagctataaggatcatgcagaggcagcaaagccgggtgcgatgagctcagcctttactcattcacatacaccatcacactttaattccaatctgtatattgctttttaaaagttaagtccattctaattacccaaatatgcatgaattcattctccttttgagaagttagattgttaaagatagtctcattcagctaccaaccactccttgatccttcccttcttagtggctgttgtttgttgtacttccgtttagactttgttttaatgcttgtacgtacatatgtgaactcattggaaatattgtgtgtttaatgcaaatgatatattgaattgtttagcaatttgttttctttgcttaacgatgtttttgagatctgtgcatgttacttaatgtagctcaatccatcttctgtaattgctgtatagattgtcatcatatgattaccacattttacttacgcatttcttttgtgatggacattaagactgtttttaggttttgctattacaaaatactacacaggagcatcactatgcctgtgtgaaagtatatgtatgaaagtttacctagggttgattcctagaagtggaattgcaaagtcataggatatttatatattggtttttaataatacttccaaattgccctcctgtactatttactcagtatttttcttgaggttgatctgaggtctaacattgttatcctatatcattttcatcccaagtagtgatatctgtgaaatcacaggtttgatgtgtgctaattatgtattcttctaatacatattaaaagacataactatcaaaacaaaaaaataaatttgtctgttttcaaccaaagaagtcacgtaccactggtggtactgtgtgccataatttggcaaatgctggcctttatggacgagcacaattcgggggtcagacctggttcaaattctagctgtagaaacttgtgcaagttacttcacctctgagcctaagtttccacatctgtaaaaggagataataaacacctaccttgcagtagtgaagcaaagagaaaattaaatatatatgaagcaatttggctggcatctagatcattcacagccctttaaaggtcacctttgctgttctccccactttacagataaggaaactgaggcccaaaaaggtttgaacccaggtcttccaagtcattcaagtgctttctccactgtacaggtggttatcaaccttggctgcgcatcagaatcgtttgtaaagctttttctttttcctttttaaaaagtaaagcaatatatacacaggtaaaaaaataaaatagtacagaagggcttataatgagaagcagcagttccctgcttgcacccccacatccaaaggatgtggagctctttaaaaataaattgctctggtcccacctctggaaatctgattcagccagcatggataataacccagataactaacccctacctcacaggataaaaaggattacatgagatgccttaggctaa

SEQ ID NO: 295707 - DNA, 5607 bp, Homo sapiens
gcggcgtttcccgcgcgggctacctcagttctcgggcgtacggcgcggcctgtcctactgccgccggcgccgcggccgtcatggggttcctgaaactgattgagattgagaactttaagtcgtacaagggtcgacagattatcggaccatttcagaggttcaccgccatcattggacccaatggctctgggtgctgtggaatctattgccatgaagaaccccaaagagaggacagctctatttgaagagattagtcgttctggggagctggcgcaggagtatgacaagcgaaagaaggaaatggtgaaggctgaagaggacacacagtttaattaccatcgcaagaaaaatattgcggctgaacgcaaggaagcaaagcaggagaaagaagaggctgaccggtaccagcgcctgaaggatgaggtagtacgggctcaggtacagctgcagctctttaagctttaccataatgaagtggaaattgagaagctcaacaaggaactggcctcaaagaacaaggagatcgagaaggacaagaagcgtatggacaaggtggaggatgaactgaaggagaagaagaaggagctgggcaaaatgatgcgggagcagcagcagattgagaaggagatcaaggagaaggactcagaattgaaccagaagcggcctcagtacatcaaagccaaggagaacacctcccacaaaatcaagaagctggaagcagccaagaagtctctgcagaatgctcagaagcactacaagaagcgtaaaggtgacatggatgagctggagaaggagatgctgtcagtggagaaggctcggcaggagtttgaagaacggatggaagaagagagtcagagtcagggcagagatttgacgttggaggagaatcaggtgaagaaataccaccggttgaaagaagaagccagcaagagagcagctaccctggcccaggagctggagaaattcaatcgagaccagaaagctgaccaggaccgtctggatctggaagaacggaagaaagtagagacagaggccaagatcaagcaaaagctgcgggaaattgaagagaatcagaagcggattgagaaactggaggaatacatcaccactagcaagcagtccctagaagagcagaagaagctagagggggagctgacagaggaggtggagatggccaagcggcgtattgatgaaatcaataaggagctgaaccaggtgatggagcagctaggggatgcccgcatcgaccgccaggagagcagccgccagcagcgaaaggcagagataatggaaagcatcaagcgcctttaccctggctctgtgtacggccgcctcattgacctatgccagcccacacaaaagaagtatcagattgctgtaaccaaggttttgggcaagaacatggatgccattattgtggactcggagaagacaggccgggactgtattcagtatatcaaggagcagcgtggggagcctgagaccttcttgcctcttgactacctggaggtgaagcctacagatgagaaactccgggagctgaagggggccaagctagtgattgatgtgattcgctatgagccacctcatatcaaaaaggccctgcagtatgcttgtggcaatgcccttgtctgtgacaacgtggaagatgcccgccgcattgcctttggaggccaccagcgccacaagacagtggcactggatggaaccctattccagaagtcaggagtgatctctggtggggccagtgacctgaaggccaaggcacggcgctgggatgagaaagcagtagacaagttgaaagagaagaaggagcgcttgacagaggagctgaaagagcagatgaaggcaaaacggaaagaggcagagctgcgtcaggtgcagtctcaggcccatggactgcagatgcggctcaagtactcccagagtgacctagaacagaccaagacacgacatctagccctgaatctgcaggaaaaatccaagctggagagtgagctagccaactttgggcctcgcattaatgatatcaagaggatcattcagagccgagagagggaaatgaaagacttgaaggagaagatgaaccaggtagaggatgaggtgtttgaagagttttgtcgggagattggtgtgcgcaacatccgggagtttgaggaagaaaaggtgaaacggcagaatgaaatcgccaagaagcgtttggagtttgagaatcagaagactcgcttgggcattcagttggattttgaaaagaaccaactgaaggaggaccaagataaagtacacatgtgggagcagacagtgaaaaaagatgaaaatgagatagaaaagctcaaaaaggaggaacaaagacacatgaagatcatagatgagaccatggctcagctacaagacctgaagaatcagcatctggccaagaagtcggaagtgaatgacaagaatcatgagatggaggagattcgtaagaaactcgggggcgccaacaaggaaatgacccatttacagaaggaggtgacagccattgagaccaagcttgaacagaagcgcagtgaccgtcacaacttgctacaggcctgtaagatgcaggacattaagttgccactgtcaaaaggcaccatggatgatattagtcaggaagagggtagctcccagggggaggactcagtgagtggttcacagagaatttccagtatctatgcacgagaggccctcattgagattgactacggtgatctgtgtgaggatctgaaggatgcccaggctgaggaagagatcaagcaagagatgaacacactgcagcagaagctgaatgagcagcagagtgtgcttcagcgtattgccgcccccaacatgaaggccatggaaaagctggaaagtgtccgagacaagttccaggagacctcagatgagtttgaagcagcccgaaagcgagcaaagaaggccaagcaggcattcgaacagatcaagaaggagcgctttgaccgcttcaatgcttgttttgaatctgtggctaccaacattgatgagatctataaggccctgtcccgcaatagcagtgcccaggcattcctgggccctgagaaccctgaagagccctacttggatggcatcaactacaactgtgtggctcctgggaaacgcttccggcctatggacaacttgtcaggcggggagaagacagtggcagctctggccctgctctttgccatccacagctacaagccagcccccttcttcgtcctggatgagattgatgctgccttggataacaccaacattggcaaggtggcaaattacatcaaggagcagtcgacttgcaacttccaggccatcgtcatctctctcaaggaggagttctacaccaaggccgagagcctcattggagtctatcctgagcaaggggactgtgtgatcagcaaagtcctgaccttcgacctcaccaagtacccagatgccaaccccaaccccaatgagcagtagcagtatttttgccctcccgccctgtctggatccctaagctgtccctctcccaatctctggatatttgactcccaaccttccccctacctcctggccctttttggtgtagtcatgggatttaggcactgctaatcaagcatgaagaggaacagaggtgatgttaggtctggagcaaaaattcctgaacgacagggagtattctggcctctgaaaggaggtgctgagctgaacagggccatctgttcatcacacacacccccttcctccccctcatcacccataatcgtgggccccttgggcctcttgcccactgtgtgtgtgggtatgtatgtgtgtatgtatgtatccgcatgtgtgcatgtgagtatgtttgcaaaataataaaggatattggagacctgttttagaaggagcctaggctgaatttgattccaagagagcttaggatgacagcacccctgagctgggcaaaggtactcaggacctcataggagtcttaggcagttacctgaaactgccttcattcactcatttgtgtattcattcatttatgtattcatcagacacataccgaacaccctctatttgtcaggctctgtgcttggaatacagagttgaatcagacatgatctctaccctcctagtaaggagatacagtgggttcatgaatgactatagttagctgaatgtcatatgtactttgaatttgagaagtgggtgatcccctctaggcttcctggaggtcacatttaagctagaccttgacaaattggtaggatttggtcaggcactaggagtggagcatgagctctggggacagacagttatgggttctggtcccactttttatcacttactagttgtttgaccttgggcaagtcatttgaccttctgtgcctcagtttcctcatctgtaaaatggggctaacaatattacctacctcataggatttaatgatgtcaagctcctcactggaggccttatcccttcgtggagcccactaggtgccgacccctcagaatataaccctcatgcctggacccctgagagcttctgatcccagctattagggacagaagaagcctccaaatctggaaggtgctgaatgccctgctgactgggaaagtttcagggcactgatggggtctacctggtaagcggagggcctgaggaaacctgtagcttcaatcatgtctggtaaccgggtgcctgagccccaatctgggttgtgaggaaataggggagaggtatcctgggccacatcccagcctaacacctgtgaggttcattttaggaactaacctcattagctataaggatcatgcagaggcagcaaagccgggtgcgatgagctcagcctttactcattcacatacaccatcacactttaattccaatctgtatattgctttttaaaagttaagtccattctaattacccaaatatgcatgaattcattctccttttgagaagttagattgttaaagatagtctcattcagctaccaaccactccttgatccttcccttcttagtggctgttgtttgttgtacttccgtttagactttgttttaatgcttgtacgtacatatgtgaactcattggaaatattgtgtgtttaatgcaaatgatatattgaattgtttagcaatttgttttctttgcttaacgatgtttttgagatctgtgcatgttacttaatgtagctcaatccatcttctgtaattgctgtatagattgtcatcatatgattaccacattttacttacgcatttcttttgtgatggacattaagactgtttttaggttttgctattacaaaatactacacaggagcatcactatgcctgtgtgaaagtatatgtatgaaagtttacctagggttgattcctagaagtggaattgcaaagtcataggatatttatatattggtttttaataatacttccaaattgccctcctgtactatttactcagtatttttcttgaggttgatctgaggtctaacattgttatcctatatcattttcatcccaagtagtgatatctgtgaaatcacaggtttgatgtgtgctaattatgtattcttctaatacatattaaaagacataactatcaaaacaaaa

SEQ ID NO: 295708 - DNA, 4659 bp, Homo sapiens
acctggcacttctcgtaggaggagaatcaggtgaagaaacaacagaaatcaatcgagacaggtcggaagaaagtagagacagaggccaagatcaagcaaaagctgcgggaaattgaagagaatcagaagcggattgagaaactggaggaatacatcaccactagcaagcagtccctagaagagcagaagaagctagagggggagctgacagaggaggtggagatggccaagcggcgtattgatgaaatcaataaggagctgaaccaggtgatggagcagctaggggatgcccgcatcgaccgccaggagagcagccgccagcagcgaaaggcagagataatggaaagcatcaagcgcctttaccctggctctgtgtacggccgcctcattgacctatgccagcccacacaaaagaagtatcagattgctgtaaccaaggttttgggcaagaacatggatgccattattgtggactcggagaagacaggccgggactgtattcagtatatcaaggagcagcgtggggagcctgagaccttcttgcctcttgactacctggaggtgaagcctacagatgagaaactccgggagctgaagggggccaagctagtgattgatgtgattcgctatgagccacctcatatcaaaaaggccctgcagtatgcttgtggcaatgcccttgtctgtgacaacgtggaagatgcccgccgcattgcctttggaggccaccagcgccacaagacagtggcactggatggaaccctattccagaagtcaggagtgatctctggtggggccagtgacctgaaggccaaggcacggcgctgggatgagaaagcagtagacaagttgaaagagaagaaggagcgcttgacagaggagctgaaagagcagatgaaggcaaaacggaaagaggcagagctgcgtcaggtgcagtctcaggcccatggactgcagatgcggctcaagtactcccagagtgacctagaacagaccaagacacgacatctagccctgaatctgcaggaaaaatccaagctggagagtgagctagccaactttgggcctcgcattaatgatatcaagaggatcattcagagccgagagagggaaatgaaagacttgaaggagaagatgaaccaggtagaggatgaggtgtttgaagagttttgtcgggagattggtgtgcgcaacatccgggagtttgaggaagaaaaggtgaaacggcagaatgaaatcgccaagaagcgtttggagtttgagaatcagaagactcgcttgggcattcagttggattttgaaaagaaccaactgaaggaggaccaagataaagtacacatgtgggagcagacagtgaaaaaagatgaaaatgagatagaaaagctcaaaaaggaggaacaaagacacatgaagatcatagatgagaccatggctcagctacaagacctgaagaatcagcatctggccaagaagtcggaagtgaatgacaagaatcatgagatggaggagattcgtaagaaactcgggggcgccaacaaggaaatgacccatttacagaaggaggtgacagccattgagaccaagcttgaacagaagcgcagtgaccgtcacaacttgctacaggcctgtaagatgcaggacattaagttgccactgtcaaaaggcaccatggatgatattagtcaggaagagggtagctcccagggggaggactcagtgagtggttcacagagaatttccagtatctatgcacgagaggccctcattgagattgactacggtgatctgtgtgaggatctgaaggatgcccaggctgaggaagagatcaagcaagagatgaacacactgcagcagaagctgaatgagcagcagagtgtgcttcagcgtattgccgcccccaacatgaaggccatggaaaagctggaaagtgtccgagacaagttccaggagacctcagatgagtttgaagcagcccgaaagcgagcaaagaaggccaagcaggcattcgaacagatcaagaaggagcgctttgaccgcttcaatgcttgttttgaatctgtggctaccaacattgatgagatctataaggccctgtcccgcaatagcagtgcccaggcattcctgggccctgagaaccctgaagagccctacttggatggcatcaactacaactgtgtggctcctgggaaacgcttccggcctatggacaacttgtcaggcggggagaagacagtggcagctctggccctgctctttgccatccacagctacaagccagcccccttcttcgtcctggatgagattgatgctgccttggataacaccaacattggcaaggtggcaaattacatcaaggagcagtcgacttgcaacttccaggccatcgtcatctctctcaaggaggagttctacaccaaggccgagagcctcattggagtctatcctgagcaaggggactgtgtgatcagcaaagtcctgaccttcgacctcaccaagtacccagatgccaaccccaaccccaatgagcagtagcagtatttttgccctcccgccctgtctggatccctaagctgtccctctcccaatctctggatatttgactcccaaccttccccctacctcctggccctttttggtgtagtcatgggatttaggcactgctaatcaagcatgaagaggaacagaggtgatgttaggtctggagcaaaaattcctgaacgacagggagtattctggcctctgaaaggaggtgctgagctgaacagggccatctgttcatcacacacacccccttcctccccctcatcacccataatcgtgggccccttgggcctcttgcccactgtgtgtgtgggtatgtatgtgtgtatgtatgtatccgcatgtgtgcatgtgagtatgtttgcaaaataataaaggatattggagacctgttttagaaggagcctaggctgaatttgattccaagagagcttaggatgacagcacccctgagctgggcaaaggtactcaggacctcataggagtcttaggcagttacctgaaactgccttcattcactcatttgtgtattcattcatttatgtattcatcagacacataccgaacaccctctatttgtcaggctctgtgcttggaatacagagttgaatcagacatgatctctaccctcctagtaaggagatacagtgggttcatgaatgactatagttagctgaatgtcatatgtactttgaatttgagaagtgggtgatcccctctaggcttcctggaggtcacatttaagctagaccttgacaaattggtaggatttggtcaggcactaggagtggagcatgagctctggggacagacagttatgggttctggtcccactttttatcacttactagttgtttgaccttgggcaagtcatttgaccttctgtgcctcagtttcctcatctgtaaaatggggctaacaatattacctacctcataggatttaatgatgtcaagctcctcactggaggccttatcccttcgtggagcccactaggtgccgacccctcagaatataaccctcatgcctggacccctgagagcttctgatcccagctattagggacagaagaagcctccaaatctggaaggtgctgaatgccctgctgactgggaaagtttcagggcactgatggggtctacctggtaagcggagggcctgaggaaacctgtagcttcaatcatgtctggtaaccgggtgcctgagccccaatctgggttgtgaggaaataggggagaggtatcctgggccacatcccagcctaacacctgtgaggttcattttaggaactaacctcattagctataaggatcatgcagaggcagcaaagccgggtgcgatgagctcagcctttactcattcacatacaccatcacactttaattccaatctgtatattgctttttaaaagttaagtccattctaattacccaaatatgcatgaattcattctccttttgagaagttagattgttaaagatagtctcattcagctaccaaccactccttgatccttcccttcttagtggctgttgtttgttgtacttccgtttagactttgttttaatgcttgtacgtacatatgtgaactcattggaaatattgtgtgtttaatgcaaatgatatattgaattgtttagcaatttgttttctttgcttaacgatgtttttgagatctgtgcatgttacttaatgtagctcaatccatcttctgtaattgctgtatagattgtcatcatatgattaccacattttacttacgcatttcttttgtgatggacattaagactgtttttaggttttgctattacaaaatactacacaggagcatcactatgcctgtgtgaaagtatatgtatgaaagtttacctagggttgattcctagaagtggaattgcaaagtcataggatatttatatattggtttttaataatacttccaaattgccctcctgtactatttactcagtatttttcttgaggttgatctgaggtctaacattgttatcctatatcattttcatcccaagtagtgatatctgtgaaatcacaggtttgatgtgtgctaattatgtattcttctaatacatattaaaagacataactatcaaaacaaaa

SEQ ID NO: 295709 - DNA, 4018 bp, Homo sapiens
tgtggattcccttgcccaggctggagctggacaggctcagtactggagattcatttgttcagcttctccccctcttctctcttccccctgctgtgtgtagacagtggcactggatggaaccctattccagaagtcaggagtgatctctggtggggccagtgacctgaaggccaaggcacggcgctgggatgagaaagcagtagacaagttgaaagagaagaaggagcgcttgacagaggagctgaaagagcagatgaaggcaaaacggaaagaggcagagctgcgtcaggtgcagtctcaggcccatggactgcagatgcggctcaagtactcccagagtgacctagaacagaccaagacacgacatctagccctgaatctgcaggaaaaatccaagctggagagtgagctagccaactttgggcctcgcattaatgatatcaagaggatcattcagagccgagagagggaaatgaaagacttgaaggagaagatgaaccaggtagaggatgaggtgtttgaagagttttgtcgggagattggtgtgcgcaacatccgggagtttgaggaagaaaaggtgaaacggcagaatgaaatcgccaagaagcgtttggagtttgagaatcagaagactcgcttgggcattcagttggattttgaaaagaaccaactgaaggaggaccaagataaagtacacatgtgggagcagacagtgaaaaaagatgaaaatgagatagaaaagctcaaaaaggaggaacaaagacacatgaagatcatagatgagaccatggctcagctacaagacctgaagaatcagcatctggccaagaagtcggaagtgaatgacaagaatcatgagatggaggagattcgtaagaaactcgggggcgccaacaaggaaatgacccatttacagaaggaggtgacagccattgagaccaagcttgaacagaagcgcagtgaccgtcacaacttgctacaggcctgtaagatgcaggacattaagttgccactgtcaaaaggcaccatggatgatattagtcaggaagagggtagctcccagggggaggactcagtgagtggttcacagagaatttccagtatctatgcacgagaggccctcattgagattgactacggtgatctgtgtgaggatctgaaggatgcccaggctgaggaagagatcaagcaagagatgaacacactgcagcagaagctgaatgagcagcagagtgtgcttcagcgtattgccgcccccaacatgaaggccatggaaaagctggaaagtgtccgagacaagttccaggagacctcagatgagtttgaagcagcccgaaagcgagcaaagaaggccaagcaggcattcgaacagatcaagaaggagcgctttgaccgcttcaatgcttgttttgaatctgtggctaccaacattgatgagatctataaggccctgtcccgcaatagcagtgcccaggcattcctgggccctgagaaccctgaagagccctacttggatggcatcaactacaactgtgtggctcctgggaaacgcttccggcctatggacaacttgtcaggcggggagaagacagtggcagctctggccctgctctttgccatccacagctacaagccagcccccttcttcgtcctggatgagattgatgctgccttggataacaccaacattggcaaggtggcaaattacatcaaggagcagtcgacttgcaacttccaggccatcgtcatctctctcaaggaggagttctacaccaaggccgagagcctcattggagtctatcctgagcaaggggactgtgtgatcagcaaagtcctgaccttcgacctcaccaagtacccagatgccaaccccaaccccaatgagcagtagcagtatttttgccctcccgccctgtctggatccctaagctgtccctctcccaatctctggatatttgactcccaaccttccccctacctcctggccctttttggtgtagtcatgggatttaggcactgctaatcaagcatgaagaggaacagaggtgatgttaggtctggagcaaaaattcctgaacgacagggagtattctggcctctgaaaggaggtgctgagctgaacagggccatctgttcatcacacacacccccttcctccccctcatcacccataatcgtgggccccttgggcctcttgcccactgtgtgtgtgggtatgtatgtgtgtatgtatgtatccgcatgtgtgcatgtgagtatgtttgcaaaataataaaggatattggagacctgttttagaaggagcctaggctgaatttgattccaagagagcttaggatgacagcacccctgagctgggcaaaggtactcaggacctcataggagtcttaggcagttacctgaaactgccttcattcactcatttgtgtattcattcatttatgtattcatcagacacataccgaacaccctctatttgtcaggctctgtgcttggaatacagagttgaatcagacatgatctctaccctcctagtaaggagatacagtgggttcatgaatgactatagttagctgaatgtcatatgtactttgaatttgagaagtgggtgatcccctctaggcttcctggaggtcacatttaagctagaccttgacaaattggtaggatttggtcaggcactaggagtggagcatgagctctggggacagacagttatgggttctggtcccactttttatcacttactagttgtttgaccttgggcaagtcatttgaccttctgtgcctcagtttcctcatctgtaaaatggggctaacaatattacctacctcataggatttaatgatgtcaagctcctcactggaggccttatcccttcgtggagcccactaggtgccgacccctcagaatataaccctcatgcctggacccctgagagcttctgatcccagctattagggacagaagaagcctccaaatctggaaggtgctgaatgccctgctgactgggaaagtttcagggcactgatggggtctacctggtaagcggagggcctgaggaaacctgtagcttcaatcatgtctggtaaccgggtgcctgagccccaatctgggttgtgaggaaataggggagaggtatcctgggccacatcccagcctaacacctgtgaggttcattttaggaactaacctcattagctataaggatcatgcagaggcagcaaagccgggtgcgatgagctcagcctttactcattcacatacaccatcacactttaattccaatctgtatattgctttttaaaagttaagtccattctaattacccaaatatgcatgaattcattctccttttgagaagttagattgttaaagatagtctcattcagctaccaaccactccttgatccttcccttcttagtggctgttgtttgttgtacttccgtttagactttgttttaatgcttgtacgtacatatgtgaactcattggaaatattgtgtgtttaatgcaaatgatatattgaattgtttagcaatttgttttctttgcttaacgatgtttttgagatctgtgcatgttacttaatgtagctcaatccatcttctgtaattgctgtatagattgtcatcatatgattaccacattttacttacgcatttcttttgtgatggacattaagactgtttttaggttttgctattacaaaatactacacaggagcatcactatgcctgtgtgaaagtatatgtatgaaagtttacctagggttgattcctagaagtggaattgcaaagtcataggatatttatatattggtttttaataatacttccaaattgccctcctgtactatttactcagtatttttcttgaggttgatctgaggtctaacattgttatcctatatcattttcatcccaagtagtgatatctgtgaaatcacaggtttgatgtgtgctaattatgtattcttctaatacatattaaaagacataactatcaaaacaaaa

SEQ ID NO: 295710 - DNA, 3549 bp, Homo sapiens
cgcacaaagactgagatctctgagatgaaccgggtagaggatgaggtgtttgaagagttttgtcgggagattggtgtgcgcaacatccgggagtttgaggaagaaaaggtgaaacggcagaatgaaatcgccaagaagcgtttggagtttgagaatcagaagactcgcttgggcattcagttggattttgaaaagaaccaactgaaggaggaccaagataaagtacacatgtgggagcagacagtgaaaaaagatgaaaatgagatagaaaagctcaaaaaggaggaacaaagacacatgaagatcatagatgagaccatggctcagctacaagacctgaagaatcagcatctggccaagaagtcggaagtgaatgacaagaatcatgagatggaggagattcgtaagaaactcgggggcgccaacaaggaaatgacccatttacagaaggaggtgacagccattgagaccaagcttgaacagaagcgcagtgaccgtcacaacttgctacaggcctgtaagatgcaggacattaagttgccactgtcaaaaggcaccatggatgatattagtcaggaagagggtagctcccagggggaggactcagtgagtggttcacagagaatttccagtatctatgcacgagaggccctcattgagattgactacggtgatctgtgtgaggatctgaaggatgcccaggctgaggaagagatcaagcaagagatgaacacactgcagcagaagctgaatgagcagcagagtgtgcttcagcgtattgccgcccccaacatgaaggccatggaaaagctggaaagtgtccgagacaagttccaggagacctcagatgagtttgaagcagcccgaaagcgagcaaagaaggccaagcaggcattcgaacagatcaagaaggagcgctttgaccgcttcaatgcttgttttgaatctgtggctaccaacattgatgagatctataaggccctgtcccgcaatagcagtgcccaggcattcctgggccctgagaaccctgaagagccctacttggatggcatcaactacaactgtgtggctcctgggaaacgcttccggcctatggacaacttgtcaggcggggagaagacagtggcagctctggccctgctctttgccatccacagctacaagccagcccccttcttcgtcctggatgagattgatgctgccttggataacaccaacattggcaaggtggcaaattacatcaaggagcagtcgacttgcaacttccaggccatcgtcatctctctcaaggaggagttctacaccaaggccgagagcctcattggagtctatcctgagcaaggggactgtgtgatcagcaaagtcctgaccttcgacctcaccaagtacccagatgccaaccccaaccccaatgagcagtagcagtatttttgccctcccgccctgtctggatccctaagctgtccctctcccaatctctggatatttgactcccaaccttccccctacctcctggccctttttggtgtagtcatgggatttaggcactgctaatcaagcatgaagaggaacagaggtgatgttaggtctggagcaaaaattcctgaacgacagggagtattctggcctctgaaaggaggtgctgagctgaacagggccatctgttcatcacacacacccccttcctccccctcatcacccataatcgtgggccccttgggcctcttgcccactgtgtgtgtgggtatgtatgtgtgtatgtatgtatccgcatgtgtgcatgtgagtatgtttgcaaaataataaaggatattggagacctgttttagaaggagcctaggctgaatttgattccaagagagcttaggatgacagcacccctgagctgggcaaaggtactcaggacctcataggagtcttaggcagttacctgaaactgccttcattcactcatttgtgtattcattcatttatgtattcatcagacacataccgaacaccctctatttgtcaggctctgtgcttggaatacagagttgaatcagacatgatctctaccctcctagtaaggagatacagtgggttcatgaatgactatagttagctgaatgtcatatgtactttgaatttgagaagtgggtgatcccctctaggcttcctggaggtcacatttaagctagaccttgacaaattggtaggatttggtcaggcactaggagtggagcatgagctctggggacagacagttatgggttctggtcccactttttatcacttactagttgtttgaccttgggcaagtcatttgaccttctgtgcctcagtttcctcatctgtaaaatggggctaacaatattacctacctcataggatttaatgatgtcaagctcctcactggaggccttatcccttcgtggagcccactaggtgccgacccctcagaatataaccctcatgcctggacccctgagagcttctgatcccagctattagggacagaagaagcctccaaatctggaaggtgctgaatgccctgctgactgggaaagtttcagggcactgatggggtctacctggtaagcggagggcctgaggaaacctgtagcttcaatcatgtctggtaaccgggtgcctgagccccaatctgggttgtgaggaaataggggagaggtatcctgggccacatcccagcctaacacctgtgaggttcattttaggaactaacctcattagctataaggatcatgcagaggcagcaaagccgggtgcgatgagctcagcctttactcattcacatacaccatcacactttaattccaatctgtatattgctttttaaaagttaagtccattctaattacccaaatatgcatgaattcattctccttttgagaagttagattgttaaagatagtctcattcagctaccaaccactccttgatccttcccttcttagtggctgttgtttgttgtacttccgtttagactttgttttaatgcttgtacgtacatatgtgaactcattggaaatattgtgtgtttaatgcaaatgatatattgaattgtttagcaatttgttttctttgcttaacgatgtttttgagatctgtgcatgttacttaatgtagctcaatccatcttctgtaattgctgtatagattgtcatcatatgattaccacattttacttacgcatttcttttgtgatggacattaagactgtttttaggttttgctattacaaaatactacacaggagcatcactatgcctgtgtgaaagtatatgtatgaaagtttacctagggttgattcctagaagtggaattgcaaagtcataggatatttatatattggtttttaataatacttccaaattgccctcctgtactatttactcagtatttttcttgaggttgatctgaggtctaacattgttatcctatatcattttcatcccaagtagtgatatctgtgaaatcacaggtttgatgtgtgctaattatgtattcttctaatacatattaaaagacataactatcaaaacaaaa

SEQ ID NO: 295711 - DNA, 3669 bp, Homo sapiens
ctggtctgctttgtcctctcaacccattgcctgtaggaaaaatccaagctggagagtgagctagccaactttgggcctcgcattaatgatatcaagaggatcattcagagccgagagagggaaatgaaagacttgaaggagaagatgaaccaggtagaggatgaggtgtttgaagagttttgtcgggagattggtgtgcgcaacatccgggagtttgaggaagaaaaggtgaaacggcagaatgaaatcgccaagaagcgtttggagtttgagaatcagaagactcgcttgggcattcagttggattttgaaaagaaccaactgaaggaggaccaagataaagtacacatgtgggagcagacagtgaaaaaagatgaaaatgagatagaaaagctcaaaaaggaggaacaaagacacatgaagatcatagatgagaccatggctcagctacaagacctgaagaatcagcatctggccaagaagtcggaagtgaatgacaagaatcatgagatggaggagattcgtaagaaactcgggggcgccaacaaggaaatgacccatttacagaaggaggtgacagccattgagaccaagcttgaacagaagcgcagtgaccgtcacaacttgctacaggcctgtaagatgcaggacattaagttgccactgtcaaaaggcaccatggatgatattagtcaggaagagggtagctcccagggggaggactcagtgagtggttcacagagaatttccagtatctatgcacgagaggccctcattgagattgactacggtgatctgtgtgaggatctgaaggatgcccaggctgaggaagagatcaagcaagagatgaacacactgcagcagaagctgaatgagcagcagagtgtgcttcagcgtattgccgcccccaacatgaaggccatggaaaagctggaaagtgtccgagacaagttccaggagacctcagatgagtttgaagcagcccgaaagcgagcaaagaaggccaagcaggcattcgaacagatcaagaaggagcgctttgaccgcttcaatgcttgttttgaatctgtggctaccaacattgatgagatctataaggccctgtcccgcaatagcagtgcccaggcattcctgggccctgagaaccctgaagagccctacttggatggcatcaactacaactgtgtggctcctgggaaacgcttccggcctatggacaacttgtcaggcggggagaagacagtggcagctctggccctgctctttgccatccacagctacaagccagcccccttcttcgtcctggatgagattgatgctgccttggataacaccaacattggcaaggtggcaaattacatcaaggagcagtcgacttgcaacttccaggccatcgtcatctctctcaaggaggagttctacaccaaggccgagagcctcattggagtctatcctgagcaaggggactgtgtgatcagcaaagtcctgaccttcgacctcaccaagtacccagatgccaaccccaaccccaatgagcagtagcagtatttttgccctcccgccctgtctggatccctaagctgtccctctcccaatctctggatatttgactcccaaccttccccctacctcctggccctttttggtgtagtcatgggatttaggcactgctaatcaagcatgaagaggaacagaggtgatgttaggtctggagcaaaaattcctgaacgacagggagtattctggcctctgaaaggaggtgctgagctgaacagggccatctgttcatcacacacacccccttcctccccctcatcacccataatcgtgggccccttgggcctcttgcccactgtgtgtgtgggtatgtatgtgtgtatgtatgtatccgcatgtgtgcatgtgagtatgtttgcaaaataataaaggatattggagacctgttttagaaggagcctaggctgaatttgattccaagagagcttaggatgacagcacccctgagctgggcaaaggtactcaggacctcataggagtcttaggcagttacctgaaactgccttcattcactcatttgtgtattcattcatttatgtattcatcagacacataccgaacaccctctatttgtcaggctctgtgcttggaatacagagttgaatcagacatgatctctaccctcctagtaaggagatacagtgggttcatgaatgactatagttagctgaatgtcatatgtactttgaatttgagaagtgggtgatcccctctaggcttcctggaggtcacatttaagctagaccttgacaaattggtaggatttggtcaggcactaggagtggagcatgagctctggggacagacagttatgggttctggtcccactttttatcacttactagttgtttgaccttgggcaagtcatttgaccttctgtgcctcagtttcctcatctgtaaaatggggctaacaatattacctacctcataggatttaatgatgtcaagctcctcactggaggccttatcccttcgtggagcccactaggtgccgacccctcagaatataaccctcatgcctggacccctgagagcttctgatcccagctattagggacagaagaagcctccaaatctggaaggtgctgaatgccctgctgactgggaaagtttcagggcactgatggggtctacctggtaagcggagggcctgaggaaacctgtagcttcaatcatgtctggtaaccgggtgcctgagccccaatctgggttgtgaggaaataggggagaggtatcctgggccacatcccagcctaacacctgtgaggttcattttaggaactaacctcattagctataaggatcatgcagaggcagcaaagccgggtgcgatgagctcagcctttactcattcacatacaccatcacactttaattccaatctgtatattgctttttaaaagttaagtccattctaattacccaaatatgcatgaattcattctccttttgagaagttagattgttaaagatagtctcattcagctaccaaccactccttgatccttcccttcttagtggctgttgtttgttgtacttccgtttagactttgttttaatgcttgtacgtacatatgtgaactcattggaaatattgtgtgtttaatgcaaatgatatattgaattgtttagcaatttgttttctttgcttaacgatgtttttgagatctgtgcatgttacttaatgtagctcaatccatcttctgtaattgctgtatagattgtcatcatatgattaccacattttacttacgcatttcttttgtgatggacattaagactgtttttaggttttgctattacaaaatactacacaggagcatcactatgcctgtgtgaaagtatatgtatgaaagtttacctagggttgattcctagaagtggaattgcaaagtcataggatatttatatattggtttttaataatacttccaaattgccctcctgtactatttactcagtatttttcttgaggttgatctgaggtctaacattgttatcctatatcattttcatcccaagtagtgatatctgtgaaatcacaggtttgatgtgtgctaattatgtattcttctaatacatattaaaagacataactatcaaaacaaaa

SEQ ID NO: 295712 - DNA, 5138 bp, Homo sapiens
gcggcgtttcccgcgcgggctacctcagttctcgggcgtacggcgcggcctgtcctactgccgccggcgccgcggccgtcatggggttcctgaaactgattgagattgagaactttaagtcgtacaagggtcgacagattatcggaccatttcagaggttcaccgccatcattggacccaatggctctggtaagtcaaatctcatggatgccatcagctttgtgctaggtgaaaaaaccagcaacctgcgggtaaagaccctgcgggacctgatccatggagctcctgtgggcaagccagctgccaaccgggcctttgtcagcatggtctactctgaggagggtgctgaggaccgtacctttgcccgtgtcattgtaggaggttcttctgagtacaagatcaacaacaaagtggtccaactacatgagtacagtgaggaattagagaagttgggcattctcatcaaagctcgtaacttcctcgttttccagggtgctgtggaatctattgccatgaagaaccccaaagagaggacagctctatttgaagagattagtcgttctggggagctggcgcaggagtatgacaagcgaaagaaggaaatggtgaaggctgaagaggacacacagtttaattaccatcgcaagaaaaatattgcggctgaacgcaaggaagcaaagcaggagaaagaagaggctgaccggtaccagcgcctgaaggatgaggtagtacgggctcaggtacagctgcagctctttaagctttaccataatgaagtggaaattgagaagctcaacaaggaactggcctcaaagaacaaggagatcgagaaggacaagaagcgtatggacaaggtggaggatgaactgaaggagaagaagaaggagctgggcaaaatgatgcgggagcagcagcagattgagaaggagatcaaggagaaggactcagaattgaaccagaagcggcctcagtacatcaaagccaaggagaacacctcccacaaaatcaagaagctggaagcagccaagaagtctctgcagaatgctcagaagcactacaagaagcgtaaaggtgacatggatgagctggagaaggagatgctgtcagtggagaaggctcggcaggagtttgaagaacggatggaagaagagagtcagagtcagggcagagatttgacgttggaggagaatcaggtgaagaaataccaccggttgaaagaagaagccagcaagagagcagctaccctggcccaggagctggagaaattcaatcgagaccagaaagctgaccaggaccgtctggatctggaagaacggaagaaagtagagacagaggccaagatcaagcaaaagctgcgggaaattgaagagaatcagaagcggattgagaaactggaggaatacatcaccactagcaagcagtccctagaagagcagaagaagctagagggggagctgacagaggaggtggagatggccaagcggcgtattgatgaaatcaataaggagctgaaccaggtgatggagcagctaggggatgcccgcatcgaccgccaggagagcagccgccagcagcgaaaggcagagataatggaaagcatcaagcgcctttaccctggctctgtgtacggccgcctcattgacctatgccagcccacacaaaagaagtatcagattgctgtaaccaaggttttgggcaagaacatggatgccattattgtggactcggagaagacaggccgggactgtattcagtatatcaaggagcagcgtggggagcctgagaccttcttgcctcttgactacctggaggtgaagcctacagatgagaaactccgggagctgaagggggccaagctagtgattgatgtgattcgctatgagccacctcatatcaaaaaggccctgcagtatgcttgtggcaatgcccttgtctgtgacaacgtggaagatgcccgccgcattgcctttggaggccaccagcgccacaagacagtggcactggatggaaccctattccagaagtcaggagtgatctctggtggggccagtgacctgaaggccaaggcacggcgctgggatgagaaagcagtagacaagttgaaagagaagaaggagcgcttgacagaggagctgaaagagcagatgaaggcaaaacggaaagaggcagagctgcgtcaggtgcagtctcaggcccatggactgcagatgcggctcaagtactcccagagtgacctagaacagaccaagacacgacatctagccctgaatctgcaggaaaaatccaagctggagagtgagctagccaactttgggcctcgcattaatgatatcaagaggatcattcagagccgagagagggaaatgaaagacttgaaggagaagatgaaccaggtagaggatgaggtgtttgaagagttttgtcgggagattggtgtgcgcaacatccgggagtttgaggaagaaaaggtgaaacggcagaatgaaatcgccaagaagcgtttggagtttgagaatcagaagactcgcttgggcattcagttggattttgaaaagaaccaactgaaggaggaccaagataaagtacacatgtgggagcagacagtgaaaaaagatgaaaatgagatagaaaagctcaaaaaggaggaacaaagacacatgaagatcatagatgagaccatggctcagctacaagacctgaagaatcagcatctggccaagaagtcggaagtgaatgacaagaatcatgagatggaggagattcgtaagaaactcgggggcgccaacaaggaaatgacccatttacagaaggaggtgacagccattgagaccaagcttgaacagaagcgcagtgaccgtcacaacttgctacaggcctgtaagatgcaggacattaagttgccactgtcaaaaggcaccatggatgatattagtcaggaagagggtagctcccagggggaggactcagtgagtggttcacagagaatttccagtatctatgcacgagaggccctcattgagattgactacggtgatctgtgtgaggatctgaaggatgcccaggctgaggaagagatcaagcaagagatgaacacactgcagcagaagctgaatgagcagcagagtgtgcttcagcgtattgccgcccccaacatgaaggccatggaaaagctggaaagtgtccgagacaagttccaggagacctcagatgagtttgaagcagcccgaaagcgagcaaagaaggccaagcaggcattcgaacagatcaagaaggagcgctttgaccgcttcaatgcttgttttgaatctgtggctaccaacattgatgagatctataaggccctgtcccgcaatagcagtgcccaggcattcctgggccctgagaaccctgaagagccctacttggatggcatcaactacaactgtgtggctcctgggaaacgcttccggcctatggacaacttgtcaggcggggagaagacagtggcagctctggccctgctctttgccatccacagctacaagccagcccccttcttcgtcctggatgagattgatgctgccttggataacaccaacattggcaaggtggcaaattacatcaaggagcagtcgacttgcaacttccaggccatcgtcatctctctcaaggaggagttctacaccaaggccgagagcctcattggagtctatcctgagcaaggggactgtgtgatcagcaaagtcctgaccttcgacctcaccaagtacccagatgccaaccccaaccccaatgagcagtagcagtatttttgccctcccgccctgtctggatccctaagctgtccctctcccaatctctggatatttgactcccaaccttccccctacctcctggccctttttggtgtagtcatgggatttaggcactgctaatcaagcatgaagaggaacagaggtgatgttaggtctggagcaaaaattcctgaacgacagggagtattctggcctctgaaaggaggtgctgagctgaacagggccatctgttcatcacacacacccccttcctccccctcatcacccataatcgtgggccccttgggcctcttgcccactgtgtgtgtgggtatgtatgtgtgtatgtatgtatccgcatgtgtgcatgtgagtatgtttgcaaaataataaaggatattggagacctgttttagaaggagcctaggctgaatttgattccaagagagcttaggatgacagcacccctgagctgggcaaaggtactcaggacctcataggagtcttaggcagttacctgaaactgccttcattcactcatttgtgtattcattcatttatgtattcatcagacacataccgaacaccctctatttgtcaggctctgtgcttggaatacagagttgaatcagacatgatctctaccctcctagtaaggagatacagtgggttcatgaatgactatagttagctgaatgtcatatgtactttgaatttgagaagtgggtgatcccctctaggcttcctggaggtcacatttaagctagaccttgacaaattggtaggatttggtcaggcactaggagtggagcatgagctctggggacagacagttatgggttctggtcccactttttatcacttactagttgtttgaccttgggcaagtcatttgaccttctgtgcctcagtttcctcatctgtaaaatggggctaacaatattacctacctcataggatttaatgatgtcaagctcctcactggaggccttatcccttcgtggagcccactaggtgccgacccctcaggggccatggtttgttgctgagcatctcaacacactgaaaaccagatgtttcacactttgctgtgaatatagttccttttggaaaaagtttcatatctatactctgacccaggtcaatcagtgccaagccagcagataaatcatcttcatcatcctgttccaaaaatccgtttccaagtatgaaattgtctggtttaatgtctccatgaatgatttcacagtcatgcacttgctcaatcatgtaaagcattctcatagcaaaagagatgacaagaccttgaggcatcactttttcaggggtatttttatagaggttaatggcatttaatgtcgacgc

SEQ ID NO: 295713 - DNA, 2888 bp, Homo sapiens
  misc_feature (2655)..(2655): n is a, c, g, or t
  misc_feature (2792)..(2792): n is a, c, g, or t
  misc_feature (2801)..(2801): n is a, c, g, or t
  misc_feature (2805)..(2805): n is a, c, g, or t
gcggcgtttcccgcgcgggctacctcagttctcgggcgtacggcgcggcctgtcctactgccgccggcgccgcggccgtcatggggttcctgaaactgattgagattgagaactttaagtcgtacaagggtcgacagattatcggaccatttcagaggttcaccgccatcattggacccaatggctctggtaagtcaaatctcatggatgccatcagctttgtgctaggtgaaaaaaccagcaacctgcgggtaaagaccctgcgggacctgatccatggagctcctgtgggcaagccagctgccaaccgggcctttgtcagcatggtctactctgaggagggtgctgaggaccgtacctttgcccgtgtcattgtaggaggttcttctgagtacaagatcaacaacaaagtggtccaactacatgagtacagtgaggaattagagaagttgggcattctcatcaaagctcgtaacttcctcgttttccagggtgctgtggaatctattgccatgaagaaccccaaagagaggacagctctatttgaagagattagtcgttctggggagctggcgcaggagtatgacaagcgaaagaaggaaatggtgaaggctgaagaggacacacagtttaattaccatcgcaagaaaaatattgcggctgaacgcaaggaagcaaagcaggagaaagaagaggctgaccggtaccagcgcctgaaggatgaggtagtacgggctcaggtacagctgcagctctttaagctttaccataatgaagtggaaattgagaagctcaacaaggaactggcctcaaagaacaaggagatcgagaaggacaagaagcgtatggacaaggtggaggatgaactgaaggagaagaagaaggagctgggcaaaatgatgcgggagcagcagcagattgagaaggagatcaaggagaaggactcagaattgaaccagaagcggcctcagtacatcaaagccaaggagaacacctcccacaaaatcaagaagctggaagcagccaagaagtctctgcagaatgctcagaagcactacaagaagcgtaaaggtgacatggatgagctggagaaggagatgctgtcagtggagaaggctcggcaggagtttgaagaacggatggaagaagagagtcagagtcagggcagagatttgacgttggaggagaatcaggtgaagaaataccaccggttgaaagaagaagccagcaagagagcagctaccctggcccaggagctggagaaattcaatcgagaccagaaagctgaccaggaccgtctggatctggaagaacggaagaaagtagagacagaggccaagatcaagcaaaagctgcgggaaattgaagagaatcagaagcggattgagaaactggaggaatacatcaccactagcaagcagtccctagaagagcagaagaagctagagggggagctgacagaggaggtggagatggccaagcggcgtattgatgaaatcaataaggagctgaaccaggtgatggagcagctaggggatgcccgcatcgaccgccaggagagcagccgccagcagcgaaaggcagagataatggaaagcatcaagcgcctttaccctggctctgtgtacggccgcctcattgacctatgccagcccacacaaaagaagtatcagattgctgtaaccaaggttttgggcaagaacatggatgccattattgtggactcggagaagacaggccgggactgtattcagtatatcaaggagcagcgtggggagcctgagaccttcttgcctcttgactacctggaggtgaagcctacagatgagaaactccgggagctgaagggggccaagctagtgattgatgtgattcgctatgagccacctcatatcaaaaaggccctgcagtatgcttgtggcaatgcccttgtctgtgacaacgtggaagatgcccgccgcattgcctttggaggccaccagcgccacaagacagtggcactggatggaaccctattccagaagtcaggagtgatctctggtggggccagtgacctgaaggccaaggcacggcgctgggatgagaaagcagtagacaagttgaaagagaagaaggagcgcttgacagaggagctgaaagagcagatgaaggcaaaacggaaagaggcagagctgcgtcaggtgcagtctcaggcccatggactgcagatgcggctcaagtactcccagagtgacctagaacagaccaagacacgacatctagccctgaatctgcaggaaaaatccaagctggagagtgagctagccaactttgggcctcgcattaatgatatcaagaggatcattcagagccgagagagggaaatgaaagacttgaaggagaagatgaaccaggtagaggatgaggtgtttgaagagttttgtcgggagattggtgtgcgcaacatccgggagtttgaggaagaaaaggtgaaacggcagaatgaaatcgccaagaagcgtttggagtttgagaatcagaagactcgcttgggcattcagttggattttgaaaagaaccaactgaaggaggaccaagataaagtacacatgtgggagcagacagtgaaaaaagatgaaaatgagatagaaaagctcaaaaaggaactggcctcanagaacaaggagatcgagaaggacaagaagcgtatggacaaggtggaggatgaactgaatgagaagaagaaggagctgggcaaaatgatgcgggagcagcagcagattgacaaggagatccacggagaaggactcagnattgaaccngaancgggcctttgtcagcatggtctactctgaggagggtgctgaggccgtaccttggcccttatcagggtaccagctcgagtcgta

SEQ ID NO: 295714 - DNA, 1864 bp, Homo sapiens
  misc_feature (1817)..(1817): n is a, c, g, or t
  misc_feature (1827)..(1827): n is a, c, g, or t
  misc_feature (1829)..(1829): n is a, c, g, or t
  misc_feature (1840)..(1840): n is a, c, g, or t
  misc_feature (1842)..(1842): n is a, c, g, or t
  misc_feature (1851)..(1851): n is a, c, g, or t
gcggcgtttcccgcgcgggctacctcagttctcgggcgtacggcgcggcctgtcctactgccgccggcgccgcggccgtcatggggttcctgaaactgattgagattgagaactttaagtcgtacaagggtcgacagattatcggaccatttcagaggttcaccgccatcattggacccaatggctctggtaagtcaaatctcatggatgccatcagctttgtgctaggtgaaaaaaccagcaacctgcgggtaaagaccctgcgggacctgatccatggagctcctgtgggcaagccagctgccaaccgggcctttgtcagcatggtctactctgaggagggtgctgaggaccgtacctttgcccgtgtcattgtaggaggttcttctgagtacaagatcaacaacaaagtggtccaactacatgagtacagtgaggaattagagaagttgggcattctcatcaaagctcgtaacttcctcgttttccagggtgctgtggaatctattgccatgaagaaccccaaagagaggacagctctatttgaagagattagtcgttctggggagctggcgcaggagtatgacaagcgaaagaaggaaatggtgaaggctgaagaggacacacagtttaattaccatcgcaagaaaaatattgcggctgaacgcaaggaagcaaagcaggagaaagaagaggctgaccggtaccagcgcctgaaggatgaggtagtacgggctcaggtacagctgcagctctttaagctttaccataatgaagtggaaattgagaagctcaacaaggaactggcctcaaagaacaaggagatcgagaaggacaagaagcgtatggacaaggtggaggatgaactgaaggagaagaagaaggagctgggcaaaatgatgcgggagcagcagcagattgagaaggagatcaaggagaaggactcagaattgaaccagaagcggcctcagtacatcaaagccaaggagaacacctcccacaaaatcaagaagctggaagcagccaagaagtctctgcagaatgctcagaagcactacaagaagcgtaaaggtgacatggatgagctggagaaggagatgctgtcagtggagaaggctcggcaggagtttgaagaacggatggaagaagagagtcagagtcagggcagagatttgacgttggaggagaatcaggtgaagaaataccaccggttgaaagaagaagccagcaagagagcagctaccctggcccaggagctggagaaattcaatcgagaccagaaagctgaccaggaccgtctggatctggaagaacggaagaaagtagagacagaggccaagatcaagcaaaagctgcgggaaattgaagagaatcagaagcggattgagaaactggaggaatacatcaccactagcaagcagtccctagaagagcagaagaagctagagggggagctgacagaggaggtggagatggccaagcggcgtattgatgaaatcaataaggagctgaaccaggtgatggagcagctaggggatgcccgcatcgaccgccaggagagcagccgccagcagcgaaaggcagagataatggaaagcatcaagcgcctttaccctggctctgtgtacggccgcctcattgacctatgccagcccacacaaaagaagtatcagattgctgtaaccaaggttttgggcaagaacatggatgccattattgtggactcggagaagacaggccgggactgtattcagtatatcaaggagcagcgtggggagcctgagaccttcttgcctcttgactacctggagatgaanccttttagangngccactcgggncntctaaggangctcaagggtatt

SEQ ID NO: 295715 - DNA, 1790 bp, Homo sapiens
gcggcgtttcccgcgcgggctacctcagttctcgggcgtacggcgcggcctgtcctactgccgccggcgccgcggccgtcatggggttcctgaaactgattgagattgagaactttaagtcgtacaagggtcgacagattatcggaccatttcagaggttcaccgccatcattggacccaatggctctggtaagtcaaatctcatggatgccatcagctttgtgctaggtgaaaaaaccagcaacctgcgggtaaagaccctgcgggacctgatccatggagctcctgtgggcaagccagctgccaaccgggcctttgtcagcatggtctactctgaggagggtgctgaggaccgtacctttgcccgtgtcattgtaggaggttcttctgagtacaagatcaacaacaaagtggtccaactacatgagtacagtgaggaattagagaagttgggcattctcatcaaagctcgtaacttcctcgttttccagggtgctgtggaatctattgccatgaagaaccccaaagagaggacagctctatttgaagagattagtcgttctggggagctggcgcaggagtatgacaagcgaaagaaggaaatggtgaaggctgaagaggacacacagtttaattaccatcgcaagaaaaatattgcggctgaacgcaaggaagcaaagcaggagaaagaagaggctgaccggtaccagcgcctgaaggatgaggtagtacgggctcaggtacagctgcagctctttaagctttaccataatgaagtggaaattgagaagctcaacaaggaactggcctcaaagaacaaggagatcgagaaggacaagaagcgtatggacaaggtggaggatgaactgaaggagaagaagaaggagctgggcaaaatgatgcgggagcagcagcagattgagaaggagatcaaggagaaggactcagaattgaaccagaagcggcctcagtacatcaaagccaaggagaacacctcccacaaaatcaagaagctggaagcagccaagaagtctctgcagaatgctcagaagcactacaagaagcgtaaaggtgacatggatgagctggagaaggagatgctgtcagtggagaaggctcggcaggagtttgaagaacggatggaagaagagagtcagagtcagggcagagatttgacgttggaggagaatcaggtgaagaaataccaccggttgaaagaagaagccagcaagagagcagctaccctggcccaggagctggagaaattcaatcgagaccagaaagctgaccaggaccgtctggatctggaagaacggaagaaagtagagacagaggccaagatcaagcaaaagctgcgggaaattgaagagaatcagaagcggattgagaaactggaggaatacatcaccactagcaagcagtccctagaagagcagaagaagctagagggggagctgacagaggaggtggagatggccaagcggcgtattgatgaaatcaataaggagctgaaccaggggcatacctggaccttctggggacagggactttatgcatttgtttactgctgtatcttaggctcaaagttggcactcaataaatattggttaaataagtgaattacaagcaggttggattattaggtaatatggttcgcagtgtgggactcctgaactccaagatgtctttgaaagtagccattttttttaatttctaatggtttagtcagactacggattacttaataacagggactatagttcattcatggatatatccccagaatcagg

SEQ ID NO: 295716 - DNA, 1443 bp, Homo sapiens
  misc_feature (1274)..(1274): n is a, c, g, or t
  misc_feature (1283)..(1283): n is a, c, g, or t
  misc_feature (1287)..(1287): n is a, c, g, or t
gcggcgtttcccgcgcgggctacctcagttctcgggcgtacggcgcggcctgtcctactgccgccggcgccgcggccgtcatggggttcctgaaactgattgagattgagaactttaagtcgtacaagggtcgacagattatcggaccatttcagaggttcaccgccatcattggacccaatggctctggtaagtcaaatctcatggatgccatcagctttgtgctaggtgaaaaaaccagcaacctgcgggtaaagaccctgcgggacctgatccatggagctcctgtgggcaagccagctgccaaccgggcctttgtcagcatggtctactctgaggagggtgctgaggaccgtacctttgcccgtgtcattgtaggaggttcttctgagtacaagatcaacaacaaagtggtccaactacatgagtacagtgaggaattagagaagttgggcattctcatcaaagctcgtaacttcctcgttttccagggtgctgtggaatctattgccatgaagaaccccaaagagaggacagctctatttgaagagattagtcgttctggggagctggcgcaggagtatgacaagcgaaagaaggaaatggtgaaggctgaagaggacacacagtttaattaccatcgcaagaaaaatattgcggctgaacgcaaggaagcaaagcaggagaaagaagaggctgaccggtaccagcgcctgaaggatgaggtagtacgggctcaggtacagctgcagctctttaagctttaccataatgaagtggaaattgagaagctcaacaaggaactggcctcaaagaacaaggagatcgagaaggacaagaagcgtatggacaaggtggaggatgaactgaaggagaagaagaaggagctgggcaaaatgatgcgggagcagcagcagattgagaaggagatcaaggagaaggactcagaattgaaccagaagcggcctcagtacatcaaagccaaggagaacacctcccacaaaatcaagaagctggaagcagccaagaagtctctgcagaatgctcagaagcactacaagaagcgtaaaggtgacatggatgagctggagaaggagatgctgtcagtggagaaggctcggcaggagtttgaagaacggatggaagaagagagtcagagtcagggcagagatttgacgttggaggagaatcagaatgagaagaagaaggagctgggcaaaatgatgcgggagcagcagcagattgacaaggagatccacggagaaggactcagnattgaaccngaancggcctcagtacatcaaagccaaggaggacacctcccacaacatcaagaagctggaagcagccaagaagtctctgcagaatgctcaggagcatctacacgaagcgtaaaggtgacatggatgagcctggagaaggagatgctctcagtgagaagga

SEQ ID NO: 295717 - DNA, 1045 bp, Homo sapiens
  misc_feature (949)..(949): n is a, c, g, or t
  misc_feature (958)..(958): n is a, c, g, or t
  misc_feature (962)..(962): n is a, c, g, or t
gcggcgtttcccgcgcgggctacctcagttctcgggcgtacggcgcggcctgtcctactgccgccggcgccgcggccgtcatggggttcctgaaactgattgagattgagaactttaagtcgtacaagggtcgacagattatcggaccatttcagaggttcaccgccatcattggacccaatggctctggtaagtcaaatctcatggatgccatcagctttgtgctaggtgaaaaaaccagcaacctgcgggtaaagaccctgcgggacctgatccatggagctcctgtgggcaagccagctgccaaccgggcctttgtcagcatggtctactctgaggagggtgctgaggaccgtacctttgcccgtgtcattgtaggaggttcttctgagtacaagatcaacaacaaagtggtccaactacatgagtacagtgaggaattagagaagttgggcattctcatcaaagctcgtaacttcctcgttttccagggtgctgtggaatctattgccatgaagaaccccaaagagaggacagctctatttgaagagattagtcgttctggggagctggcgcaggagtatgacaagcgaaagaaggaaatggtgaaggctgaagaggacacacagtttaattaccatcgcaagaaaaatattgcggctgaacgcaaggaagcaaagcaggagaaagaagaggctgaccggtaccagcgcctgaaggatgaggtagtacgggctcaggtacagctgcagctctttaagctttaccataatgaagtggaaattgagaagctcaacaaggaactggcctcaaagaacaaggagatcgagaaggacaagaagcgtatggacaaggtggaggatgaactgaaggagaagaagaaggagctgggcaaaatgatgcgggagcagcagcagattgagaaggagatcaaggagaaggactcagnattgaaccngaancgggcctttgtcagcatggtctactctgaggagggtgctgaggccgtaccttggcccttatcagggtaccagctcgagtcgta

SEQ ID NO: 295718 - DNA, 954 bp, Homo sapiens
gcggcgtttcccgcgcgggctacctcagttctcgggcgtacggcgcggcctgtcctactgccgccggcgccgcggccgtcatggggttcctgaaactgattgagattgagaactttaagtcgtacaagggtcgacagattatcggaccatttcagaggttcaccgccatcattggacccaatggctctggtaagtcaaatctcatggatgccatcagctttgtgctaggtgaaaaaaccagcaacctgcgggtaaagaccctgcgggacctgatccatggagctcctgtgggcaagccagctgccaaccgggcctttgtcagcatggtctactctgaggagggtgctgaggaccgtacctttgcccgtgtcattgtaggaggttcttctgagtacaagatcaacaacaaagtggtccaactacatgagtacagtgaggaattagagaagttgggcattctcatcaaagctcgtaacttcctcgttttccagggtgctgtggaatctattgccatgaagaaccccaaagagaggacagctctatttgaagagattagtcgttctggggagctggcgcaggagtatgacaagcgaaagaaggaaatggtgaaggctgaagaggacacacagtttaattaccatcgcaagaaaaatattgcggctgaacgcaaggaagcaaagcaggagaaagaagaggctgaccggtaccagcgcctgaaggatgaggtagtacgggctcaggtacagctgcagctctttaagctttaccataatgaagtggaaattgagaagctcaacaaggaactggcctcaaagaacaaggagatcgagaaggacaagaagcgtatggacaaggtggaggacagctctatttgaagagattagtcgttctggggagctggcgcaggagtatgacaagcgaaagaaggaaatggtgaacgcggggatcctctag

SEQ ID NO: 295719 - DNA, 417 bp, Homo sapiens
attctcatcaaagctcgtaacttcctcgttttccaggtgggcgtttttaacagttattggctatctggtttttgccagaccatgtcccatccccactctgtctgctccatctcaggctttatcatctctcccttgaactaatgtagcaccttgttcactgagcttcccaacttcagtctggcccctgagccaggttcatcttatgaggacacacatttgttttgtttcccctcccttttttccttaaaacatttcagtgattccgtattgccttacaatggtggttcttaaactgtagtctccagaccagcagtatcagcattacctggtaacatgttagaaaatgcacattctcaggccctatcctagacttcctgacttggaagaaactgtggagtggggcacagcagtttgtgt

SEQ ID NO: 295720 - DNA, 601 bp, Homo sapiens
  misc_feature (24)..(24): n is a, c, g, or t
attcggcatgaggtttgtggctcnccagcctacaaaagactttcatgtcctctattgggctgggaaaatcctgttcttcaagttatctttagtcatgctagaaaagaagcaaactgggaagagaaagacaagagaaattcataggggaaaaaaaattaaagaccagacttaaggttcctgtgagaaaaaaggaaactgaattataaatctgtcatatttagaaagactatgaaaatgatgttagataaaaattaaattcaagcaattttcttgttcgagttcaaaacgggtcataaagcagcagagataacttgcaacatcaacaatgcatttggcccaggaactgctaatgaacatacagtgcagtgcttgttcaagaagttttgcaaaggagaagaggaagatgaggagtgtagtgaccagccattagaagttgacaacaaccaagtgggagcaatcatcaaagctcatccttttacaactacacgagaaggtgccgaagagctcaccattgaccattctatggtcatttggcatttgaagcaaactggaaaggtgaaaaagctcgataagtggatgcctcatgagctgaaccaaaaaa

SEQ ID NO: 295721 - DNA, 1441 bp, Homo sapiens
ttttttttttattagaaggcagattttattgattttatacccctagacttgttgcatatcaaacctatgtaaaaacatctataaatcaaatcattaattgcacctagtataataattctatatatggaggtaatgtttgattcttcaggagctttaataacttgaagcccgtttgattgctttaaaatgatttctcattgtatttgtttatattgtatcattaagcaaaagtacagagtaagcaattagtgtgattaattcctcttctataatacagtaaagcactgcctccatagaccaattctctgggatccctggaaaacatctggcatccagcaagtcttgacccctctttagaaagccatggagaaactggaggcaattctgttaattatttgccctctagaggcaattgggttaattaccctcccttccctatccatgacacaatttctccagttacatgtagaatgctgttatgtgtctcctgaccagaccccttatttcatagatgtggaaactgaggccatgaaggatgaggtgactgttcacaatccacatggctagttagtgtccagagcctggcctggacttctctcttgttctggggccttgagttctctccctcttctttagtacatatggccacaggtaacgtaatctgcgtaccacatttgcatttggagtgcatctgttttgcattcatttaatcttgttgagatggtttgcttgttgacctactcagtcagttatcttttcacctttgtgagttgagagctttgtgtattaaatctgtaaaactttgcatcgtggaaagtgacataatctgtagcagacccatgctgtttttagatgcatcttcattgtggtagtgacagtgattgagaaactttacatgtttttctgtgctatttcagaatatgccttctgaattcagctagaggtggagtcaaaaacaacagaatactatatttttgtttctctgatttaggtaaaatacctcttttctgacaagactaggactcttacatagactaccatgaactaaaagaagcacaacattgccagagtaacctgtggtacgtgtattaatcacttactgaacattttacttgcattctttcaagaaaatgagtttatttttagatacttagtcaaattatcttgactttctgatgtttttaaagagtatttataatagatttagttatttcattaatattgaatgtatttaaaactaaatgcatcccaaaggaaactgaacagttaaaacatggtttatttctgcaaatattaacttagtgagaaatcccagggaatctgcacatttgtgttttctatctaacaatcatgaatttcttagtgtatgttttgatcaggctgtcttttgatcacagttttgtgaccactctgttattcctctctctctggcagtcatttc

SEQ ID NO: 295722 - DNA, 1395 bp, Homo sapiens
ttttttttttattagaaggcagattttattgattttatacccctagacttgttgcatatcaaacctatgtaaaaacatctataaatcaaatcattaattgcacctagtataataattctatatatggaggtaatgtttgattcttcaggagctttaataacttgaagcccgtttgattgctttaaaatgatttctcattgtatttgtttatattgtatcattaagcaaaagtacagagtaagcaattagtgtgattaattcctcttctataatacagtaaagcactgcctccatagaccaattctctgggatccctggaaaacatctggcatccagcaagtcttgacccctctttagaaagccatggagaaactggaggcaattctgttaattatttgccctctagaggcaattgggttaattaccctcccttccctatccatgacacaatttctccagttacatgtagaatgctgttatgtgtctcctgaccagaccccttatttcatagatgtggaaactgaggccatgaaggatgaggtgactgttcacaatccacatggctagttagtgtccagagcctggcctggacttctctcttgttctggggccttgagttctctccctcttctttagtacatatggccacaggtaacgtaatctgcgtaccacatttgcatttggagtgcatctgttttgcattcatttaatcttgttgagatggtttgcttgttgacctactcagtcagttatcttttcacctttgtgagttgagagctttgtgtattaaatctgtaaaactttgcatcgtggaaagtgacataatctgtagcagacccatgctgtttttagatgcatcttcattgtggtagtgacagtgattgagaaactttacatgtttttctgtgctatttcagaatatgccttctgaattcagctagaggtggagtcaaaaacaacagaatactatatttttgtttctctgatttaggtaaaatacctcttttctgacaagactaggactcttacatagactaccatgaactaaaagaagcacaacattgccagagtaacctgtgatactgtcttcatgcgaacttggtatcctgtttccatcccagccttctataacccagtaacatcttttttgaaaccagtgggtgagaaagacacctggtcaggaacgcggaccacaggacaactcaggctcacccacggcatcagactaaaggcaaacaaggactctgtataaagtaccggtggcatgtgtattagtggagatgcagcctgtgctctgcagacagggagtcacacagacacttttctataatttcttaagtgctttgaatgttcaagtagaaagtctaacattaaatttgattgaacaattgtata

SEQ ID NO: 295723 - DNA, 1066 bp, Homo sapiens
ttttttttttattagaaggcagattttattgattttatacccctagacttgttgcatatcaaacctatgtaaaaacatctataaatcaaatcattaattgcacctagtataataattctatatatggaggtaatgtttgattcttcaggagctttaataacttgaagcccgtttgattgctttaaaatgatttctcattgtatttgtttatattgtatcattaagcaaaagtacagagtaagcaattagtgtgattaattcctcttctataatacagtaaagcactgcctccatagaccaattctctgggatccctggaaaacatctggcatccagcaagtcttgacccctctttagaaagccatggagaaactggaggcaattctgttaattatttgccctctagaggcaattgggttaattaccctcccttccctatccatgacacaatttctccagttacatgtagaatgctgttatgtgtctcctgaccagaccccttatttcatagatgtggaaactgaggccatgaaggatgaggtgactgttcacaatccacatggctagttagtgtccagagcctggcctggacttctctcttgttctggggccttgagttctctccctcttctttagtacatatggccacaggtaacgtaatctgcgtaccacatttgcatttggagtgcatctgttttgcattcatttaatcttgttgagatggtttgcttgttgacctactcagtcagttatcttttcacctttgtgagttgagagctttgtgtattaaatctgtaaaactttgcatcgtggaaagtgacataatctgtagcagacccatgctgtttttagatgcatcttcattgtggtagtgacagtgattgagaaactttacatgtttttctgtgctatttcagaatatgccttctgaattcagctagaggtggagtcaaaaacaacagaatactatatttttgtttctctgatttaggtaaaatacctcttttctgacaagccacggtcaacccacaagccacggtcaacccacaagccacggtcaacccac

SEQ ID NO: 295724 - DNA, 2996 bp, Homo sapiens
attctttaactgaggtggttaaatggccctgaaaagtgaaataagctgttttcccactgcttactgtgagttctacttaggggttttccctcagcacctatcccttttcctgcagatgatgggagaggaatataagataaagctataagatgtagcttggtcgagaactaccttgtagtgacagggtcatgtgcacataatttgccttttccaaagtgagacgatatgctacgggtgcggtcaatgtaaatctgctcaggagagtcgagggaaaaagtgttaactgcatattgagctcgcaaaattgtgtagtaacctgaaaatattcctaatagttttgcgaccaagcctcaccatataaactttccttccgcacctgtagacctccattctgtggttgaagcaatttttggtttatatagctctcttgtctcaatttggtattcctttcaggtactgtgagtctataggtatttatttctgggtttcaagacgttaaatgccatcagaattgagtaatgcaaaggctgctgtcatggatagtaaagctttttagtcaagtgctgatagacaattccccattgttatcgttgggtattttacaattttctgggcaagaaatgtaatgaaaaattaagtaagttttaaaggccttcgtctttgagactggatacctaaaacaatagtgtttcctaaacagttaaaacttatttaaccctgaagctttcgagacacacaaatatatacaaatatatattgtatatttcttaaaccccacatagttccactgatctaaatcactgggggcgagaggcaaggatagacaatctatgacacaacaccaggtgattcataagtttggtaaccactgacatttgattatgcagttgccatattccttagtaagaacctggtcacaattttcactcactaccccaggcaattccccctccccacaccccccttttttctgagaatttcagtgagatatacaaaagtttcatttaatcctttattaattccagactttatatatttttattaggatttaaaatacatttcaaaaagatcaagtgagaacagaagataaaagtaccaagataaaggcataatacaaacttagaaaatacatgttaagcatactgcggcgtcctggtagccccttgcttttgttcacttttttctcttatgtacctacataaaatcccaaatagtatcttccaggatgacacacttgctgtctgccccacccaattaaaaacagattttttagttattaggtattgtgctgaatctaccttattttattgccaaaagaaaaaaaaaaaaaagcttttcaaagcttcatccccaggaaacattttcctgcttttacacataccttatatggctctactgagagataaggcctaagcctgaaaagttaatttaaagcatggaggtaggggtgagacagaaagacaacagggaaaagttgagtttataaggtaagtatatatcttccttttaacagccacctgcatggcgttcggtaaataacctaattatatgtggggaaggtagtggtcaacatttggtcctggggactgagaataagagcaggaaagcaataaacagctaactatgagagtgacttaatgtaattatattacctgtcaatcgctacttttcctttcttaccaaaattcacacaggtatgaaagcaatatgacattcaggctccattatgtgtatttgtgcacatcacttcccacgataagggagaagaaaagaaaccactgcacattcggataaaacatgctgggaatacagcagtaaacagaatagaaaaagtctacattttaattagcagataagtaaaaataagtgactaaatgtatattattcagggggccatatgtgcaattgctgttaagtaaagcagaacatggagtggagtagggatgacaggtttcatcagttaatacttgagcagagagctgaatacagtaagatagttgtaggatatcttgaggcagagtattctcagaacagaacatggtaagtacaaaggccccaaggcaggaacaagcttggtgaatgtgagaaatatgcaagctggttaatgtggctgaagcacagtgaccaagggaaagttttacagagatcacggaggtgcttgagggctggattatgtaggccattaaggagcatcacaggccactgcagagattttgtcttttaaatgagatagagtgctcttggagaatgtgactggagaggccgatggtagcagtggagatgcagagtagtagccgagatattttaaatgaaattgatttagtataggctgactgaaagagaaatcaaggattaattgtaggtttttacactgagcacttgaaaagagctgctatttgctgatatgagtaaggagtagtcttggaggaagaaaaccaagagtactgttttgaacaaaatgttgaagactcctggtaaatatcgaagtgtaaatatcaaataggaagtcagaaatatgagaatctggagtttaggaaagagaagggggttaggtttgtaagatctcatatcagtctgattcttatttttttgtagataatctaccctttctttctgtaaatgtttagaagcatgatgtctatgtgtgtatatatacacacacactcactcccccccgccaggactgcctcagttttcatctcagtatttgactaaaaccttctattcaacttcagtttcagccttagaataaccagatgtctaagtcaatgtcatttggggcatctctagacttgtgcaatcacaaaagtcaccattaccgctacatagtacgtattatgaccaatggatatcattcagagttctagtttacatatgctattatcaaacatatgtaagccttttaatgtaacttgggagtgaaattagtaaaattctatcaatttacataaattaattttactgtaaaaataaaatacattatgaaagtttctgta

SEQ ID NO: 295725 - DNA, 2789 bp, Homo sapiens
attctttaactgaggtggttaaatggccctgaaaagtgaaataagctgttttcccactgcttactgtgagttctacttaggggttttccctcagcacctatcccttttcctgcagatgatgggagaggaatataagataaacctcaccatataaactttccttccgcacctgtagacctccattctgtggttgaagcaatttttggtttatatagctctcttgtctcaatttggtattcctttcaggtactgtgagtctataggtatttatttctgggtttcaagacgttaaatgccatcagaattgagtaatgcaaaggctgctgtcatggatagtaaagctttttagtcaagtgctgatagacaattccccattgttatcgttgggtattttacaattttctgggcaagaaatgtaatgaaaaattaagtaagttttaaaggccttcgtctttgagactggatacctaaaacaatagtgtttcctaaacagttaaaacttatttaaccctgaagctttcgagacacacaaatatatacaaatatatattgtatatttcttaaaccccacatagttccactgatctaaatcactgggggcgagaggcaaggatagacaatctatgacacaacaccaggtgattcataagtttggtaaccactgacatttgattatgcagttgccatattccttagtaagaacctggtcacaattttcactcactaccccaggcaattccccctccccacaccccccttttttctgagaatttcagtgagatatacaaaagtttcatttaatcctttattaattccagactttatatatttttattaggatttaaaatacatttcaaaaagatcaagtgagaacagaagataaaagtaccaagataaaggcataatacaaacttagaaaatacatgttaagcatactgcggcgtcctggtagccccttgcttttgttcacttttttctcttatgtacctacataaaatcccaaatagtatcttccaggatgacacacttgctgtctgccccacccaattaaaaacagattttttagttattaggtattgtgctgaatctaccttattttattgccaaaagaaaaaaaaaaaaaagcttttcaaagcttcatccccaggaaacattttcctgcttttacacataccttatatggctctactgagagataaggcctaagcctgaaaagttaatttaaagcatggaggtaggggtgagacagaaagacaacagggaaaagttgagtttataaggtaagtatatatcttccttttaacagccacctgcatggcgttcggtaaataacctaattatatgtggggaaggtagtggtcaacatttggtcctggggactgagaataagagcaggaaagcaataaacagctaactatgagagtgacttaatgtaattatattacctgtcaatcgctacttttcctttcttaccaaaattcacacaggtatgaaagcaatatgacattcaggctccattatgtgtatttgtgcacatcacttcccacgataagggagaagaaaagaaaccactgcacattcggataaaacatgctgggaatacagcagtaaacagaatagaaaaagtctacattttaattagcagataagtaaaaataagtgactaaatgtatattattcagggggccatatgtgcaattgctgttaagtaaagcagaacatggagtggagtagggatgacaggtttcatcagttaatacttgagcagagagctgaatacagtaagatagttgtaggatatcttgaggcagagtattctcagaacagaacatggtaagtacaaaggccccaaggcaggaacaagcttggtgaatgtgagaaatatgcaagctggttaatgtggctgaagcacagtgaccaagggaaagttttacagagatcacggaggtgcttgagggctggattatgtaggccattaaggagcatcacaggccactgcagagattttgtcttttaaatgagatagagtgctcttggagaatgtgactggagaggccgatggtagcagtggagatgcagagtagtagccgagatattttaaatgaaattgatttagtataggctgactgaaagagaaatcaaggattaattgtaggtttttacactgagcacttgaaaagagctgctatttgctgatatgagtaaggagtagtcttggaggaagaaaaccaagagtactgttttgaacaaaatgttgaagactcctggtaaatatcgaagtgtaaatatcaaataggaagtcagaaatatgagaatctggagtttaggaaagagaagggggttaggtttgtaagatctcatatcagtctgattcttatttttttgtagataatctaccctttctttctgtaaatgtttagaagcatgatgtctatgtgtgtatatatacacacacactcactcccccccgccaggactgcctcagttttcatctcagtatttgactaaaaccttctattcaacttcagtttcagccttagaataaccagatgtctaagtcaatgtcatttggggcatctctagacttgtgcaatcacaaaagtcaccattaccgctacatagtacgtattatgaccaatggatatcattcagagttctagtttacatatgctattatcaaacatatgtaagccttttaatgtaacttgggagtgaaattagtaaaattctatcaatttacataaattaattttactgtaaaaataaaatacattatgaaagtttctgta

SEQ ID NO: 295726 - DNA, 2252 bp, Homo sapiens
agcggccgctcgcgatctgaactagaaaccccacatagttccactgatctaaatcactgggggcgagaggcaaggatagacaatctatgacacaacaccaggtgattcataagtttggtaaccactgacatttgattatgcagttgccatattccttagtaagaacctggtcacaattttcactcactaccccaggcaattccccctccccacaccccccttttttctgagaatttcagtgagatatacaaaagtttcatttaatcctttattaattccagactttatatatttttattaggatttaaaatacatttcaaaaagatcaagtgagaacagaagataaaagtaccaagataaaggcataatacaaacttagaaaatacatgttaagcatactgcggcgtcctggtagccccttgcttttgttcacttttttctcttatgtacctacataaaatcccaaatagtatcttccaggatgacacacttgctgtctgccccacccaattaaaaacagattttttagttattaggtattgtgctgaatctaccttattttattgccaaaagaaaaaaaaaaaaaagcttttcaaagcttcatccccaggaaacattttcctgcttttacacataccttatatggctctactgagagataaggcctaagcctgaaaagttaatttaaagcatggaggtaggggtgagacagaaagacaacagggaaaagttgagtttataaggtaagtatatatcttccttttaacagccacctgcatggcgttcggtaaataacctaattatatgtggggaaggtagtggtcaacatttggtcctggggactgagaataagagcaggaaagcaataaacagctaactatgagagtgacttaatgtaattatattacctgtcaatcgctacttttcctttcttaccaaaattcacacaggtatgaaagcaatatgacattcaggctccattatgtgtatttgtgcacatcacttcccacgataagggagaagaaaagaaaccactgcacattcggataaaacatgctgggaatacagcagtaaacagaatagaaaaagtctacattttaattagcagataagtaaaaataagtgactaaatgtatattattcagggggccatatgtgcaattgctgttaagtaaagcagaacatggagtggagtagggatgacaggtttcatcagttaatacttgagcagagagctgaatacagtaagatagttgtaggatatcttgaggcagagtattctcagaacagaacatggtaagtacaaaggccccaaggcaggaacaagcttggtgaatgtgagaaatatgcaagctggttaatgtggctgaagcacagtgaccaagggaaagttttacagagatcacggaggtgcttgagggctggattatgtaggccattaaggagcatcacaggccactgcagagattttgtcttttaaatgagatagagtgctcttggagaatgtgactggagaggccgatggtagcagtggagatgcagagtagtagccgagatattttaaatgaaattgatttagtataggctgactgaaagagaaatcaaggattaattgtaggtttttacactgagcacttgaaaagagctgctatttgctgatatgagtaaggagtagtcttggaggaagaaaaccaagagtactgttttgaacaaaatgttgaagactcctggtaaatatcgaagtgtaaatatcaaataggaagtcagaaatatgagaatctggagtttaggaaagagaagggggttaggtttgtaagatctcatatcagtctgattcttatttttttgtagataatctaccctttctttctgtaaatgtttagaagcatgatgtctatgtgtgtatatatacacacacactcactcccccccgccaggactgcctcagttttcatctcagtatttgactaaaaccttctattcaacttcagtttcagccttagaataaccagatgtctaagtcaatgtcatttggggcatctctagacttgtgcaatcacaaaagtcaccattaccgctacatagtacgtattatgaccaatggatatcattcagagttctagtttacatatgctattatcaaacatatgtaagccttttaatgtaacttgggagtgaaattagtaaaattctatcaatttacataaattaattttactgtaaaaataaaatacattatgaaagtttctgta

SEQ ID NO: 295727 - DNA, 3881 bp, Homo sapiens
attctttaactgaggtggttaaatggccctgaaaagtgaaataagctgttttcccactgcttactgtgagttctacttaggggttttccctcagcacctatcccttttcctgcagatgatgggagaggaatataagataaagctataagatgtagcttggtcgagaactaccttgtagtgacagggtcatgtgcacataatttgccttttccaaagtgagacgatatgctacgggtgcggtcaatgtaaatctgctcaggagagtcgagggaaaaagtgttaactgcatattgagctcgcaaaattgtgtagtaacctgaaaatattcctaatagttttgcgaccaagcctcaccatataaactttccttccgcacctgtagacctccattctgtggttgaagcaatttttggtttatatagctctcttgtctcaatttggtattcctttcaggtactgtgagtctataggtatttatttctgggtttcaagacgttaaatgccatcagaattgagtaatgcaaaggctgctgtcatggatagtaaagctttttagtcaagtgctgatagacaattccccattgttatcgttgggtattttacaattttctgggcaagaaatgtaatgaaaaattaagtaagttttaaaggccttcgtctttgagactggatacctaaaacaatagtgtttcctaaacagttaaaacttatttaaccctgaagctttcgagacacacaaatatatacaaatatatattgtatatttcttaaaccccacatagttccactgatctaaatcactgggggcgagaggcaaggatagacaatctatgacacaacaccaggtgattcataagtttggtaaccactgacatttgattatgcagttgccatattccttagtaagaacctggtcacaattttcactcactaccccaggcaattccccctccccacaccccccttttttctgagaatttcagtgagatatacaaaagtttcatttaatcctttattaattccagactttatatatttttattaggatttaaaatacatttcaaaaagatcaagtgagaacagaagataaaagtaccaagataaaggcataatacaaacttagaaaatacatgttaagcatactgcggcgtcctggtagccccttgcttttgttcacttttttctcttatgtacctacataaaatcccaaatagtatcttccaggatgacacacttgctgtctgccccacccaattaaaaacagattttttagttattaggtattgtgctgaatctaccttattttattgccaaaagaaaaaaaaaaaaaagcttttcaaagcttcatccccaggaaacattttcctgcttttacacataccttatatggctctactgagagataaggcctaagcctgaaaagttaatttaaagcatggaggtaggggtgagacagaaagacaacagggaaaagttgagtttataaggtaagtatatatcttccttttaacagccacctgcatggcgttcggtaaataacctaattatatgtggggaaggtagtggtcaacatttggtcctggggactgagaataagagcaggaaagcaataaacagctaactatgagagtgacttaatgtaattatattacctgtcaatcgctacttttcctttcttaccaaaattcacacaggtatgaaagcaatatgacattcaggctccattatgtgtatttgtgcacatcacttcccacgataagggagaagaaaagaaaccactgcacattcggataaaacatgctgggaatacagcagtaaacagaatagaaaaagtctacattttaattagcagataagtaaaaataagtgactaaatgtatattattcagggggccatatgtgcaattgctgttaagtaaagcagaacatggagtggagtagggatgacaggtttcatcagttaatacttgagcagagagctgaatacagtaagatagttgtaggatatcttgaggcagagtattctcagaacagaacatggtaagtacaaaggccccaaggcaggaacaagcttggtgaatgtgagaaatatgcaagctggttaatgtggctgaagcacagtgaccaagggaaagttttacagagatcacggaggtgcttgagggctggattatgtaggccattaaggagcatcacaggccactgcagagattttgtcttttaaatgagatagagtgctcttggagaatgtgactggagaggccgatggtagcagtggagatgcagagtagtagccgagatattttaaatgaaattgatttagtataggctgactgaaagagaaatcaaggattaattgtaggtttttacactgagcacttgaaaagagctgctatttgctgatatgagtaaggagtagtcttggaggaagaaaaccaagagtactgttttgaacaaaatgttgaagactcctggtaaatatcgaagtgtaaatatcaaataggaagtcagaaatatgagaatctggagtttaggaaagagaagggggttaggtttgtaagatctcatatcagtctgattcttatttttttgtagataatctaccctttctttctgtaaatgtttagaagcatgatgtctatgtgtgtatatatacacacacactcactcccccccgccaggactgcctcagttttcatctcagtatttgactaaaaccttctattcaacttcagtttcagccttagaataaccagatgtctaagtcaatgtcatttggggcatctctagacttgtgcaatcacaaaagtcaccattaccgctacatagtacgtattatgaccaatggatatcattcagagttctagtttacatatgctattatcaaacatatgtaagccttttaatgtaacttgggagtgaaattagtaaaattctatcaatttacataaattaattttactgtaaaaataaaatacattatgaaagtttctgtactaatgtctttgattacaatttttaaagtatttcccattttttattttgaaaattttaaacctacagaaaagttggaaaaaaaagtacaaagaccagccatagtcccttcacctggattcaccaattattacaattttgctgcatttgccttatctttgtcttctcatgtacacagacagcctctgaaccatttgaaaataaactgcaaatatgttggcacttctccctaaatatggtggcatgtctcttaaaaataggatattctcctaaatagctacaatcacattattacacctaacaaatttaatgctgattcagtaatattaatatgcaatccatattcaaatttctccaattattgaaaaaattctatatagatgttgtattagtttcttgtggctgctgcaacaaattactacaaactcaatggttttaaaacaacagtcattctcttacagttttggaggtctgaagtacaaaatcaattttactcggtagaaatcaaggctgcactccctccagagaccttaagggagggtctatttccatgccttttccagcttctagaggtttatttctggtttatggtcccttccctctgtcttcaaagcaagcagcctattaatcttcaaatccctctctccttctatcgcctccttctacacttgactttcttgcctctcctataaggactgtggtgattacatttggggcctacctggataatctggcataatctctcaatctcagaatcacatctgcaaaatcctcttggctatataaggtaatattcacaggctgtagggattaggatatggacatatttgggagccacatttagcctgccacagccattgactactgttatgggttgagttgtgtcc

SEQ ID NO: 295728 - DNA, 1194 bp, Homo sapiens
ttatataaggtgaaagacaaggccagatccaagttggcaagctggagggcaaactactaaaggagcccctaacttgtgcctaactttgggaccaatggtcaaaagcaggtcaagtaaagcagaacatggagtggagtagggatgacaggtttcatcagttaatacttgagcagagagctgaatacagtaagatagttgtaggatatcttgaggcagagtattctcagaacagaacatggtaagtacaaaggccccaaggcaggaacaagcttggtgaatgtgagaaatatgcaagctggttaatgtggctgaagcacagtgaccaagggaaagttttacagagatcacggaggtgcttgagggctggattatgtaggccattaaggagcatcacaggccactgcagagattttgtcttttaaatgagatagagtgctcttggagaatgtgactggagaggccgatggtagcagtggagatgcagagtagtagccgagatattttaaatgaaattgatttagtataggctgactgaaagagaaatcaaggattaattgtaggtttttacactgagcacttgaaaagagctgctatttgctgatatgagtaaggagtagtcttggaggaagaaaaccaagagtactgttttgaacaaaatgttgaagactcctggtaaatatcgaagtgtaaatatcaaataggaagtcagaaatatgagaatctggagtttaggaaagagaagggggttaggtttgtaagatctcatatcagtctgattcttatttttttgtagataatctaccctttctttctgtaaatgtttagaagcatgatgtctatgtgtgtatatatacacacacactcactcccccccgccaggactgcctcagttttcatctcagtatttgactaaaaccttctattcaacttcagtttcagccttagaataaccagatgtctaagtcaatgtcatttggggcatctctagacttgtgcaatcacaaaagtcaccattaccgctacatagtacgtattatgaccaatggatatcattcagagttctagtttacatatgctattatcaaacatatgtaagccttttaatgtaacttgggagtgaaattagtaaaattctatcaatttacataaattaattttactgtaaaaataaaatacattatgaaagtttctgta

SEQ ID NO: 295729 - DNA, 1002 bp, Homo sapiens
attctttaactgaggtggttaaatggccctgaaaagtgaaataagctgttttcccactgcttactgtgagttctacttaggggttttccctcagcacctatcccttttcctgcagatgatgggagaggaatataagataaagctataagatgtagcttggtcgagaactaccttgtagtgacagggtcatgtgcacataatttgccttttccaaagtgagacgatatgctacgggtgcggtcaatgtaaatctgctcaggagagtcgagggaaaaagtgttaactgcatattgagctcgcaaaattgtgtagtaacctgaaaatattcctaatagttttgcgaccaagcctcaccatataaactttccttccgcacctgtagacactcccctgctgagttagttgttactcagttcacttcctgaaatgttaaatgccaatgagtttgatctagattcctgaactaatcacagtaagaagcaggttcagacagcaattaaactaatcaggccaaccctaagaactgtgggtaaaatgcgtttctgggaaacacatgtggcagcactataacagaaacaattagaaaaataaatgctacctagtcaataacatacattataggactatgaactactaagttacacctcatgacaaacacatgagtaataaagtctagaaaaatacttaaaggtgatgtccatcattctcattgctgtgttcacagttcacaggtagaccctaaagacaggcttgtgttgtctttactgaaccctagatgcatctctcaaactgtcaactgcacatatccacttgaatagcaaagagcttctcaaatttcagtcggaactctggatctcccttcagtgtcccaacgaatatcttctctcagtgttctatcctaatagtaccactatgtacacagttgctcaagccaaaaatctaggggtttcactgttagctaaatcctgttcctcagccacacctattaattctacctcaaag

SEQ ID NO: 295730 - DNA, 1094 bp, Homo sapiens
gatttagtttatttaaaatttttaaataaaatttcacatctgaaaaaaaaccctggacatttttcctgtgatggtaatattagtctttagccttagtcaagtattaacatttggacatctgttccaaatatgtaattggagcaactctgtcctaattgaccctatttgacttgagacctttcatgaaaggtctttccttttatctaggaaattattattcctgaaatatttcaagattcaaactggtataagtaaatatgtcagacaaattggcttaactggaagtccaaaggtgcagcagggatccaaggttggctgaactccatgagtggctcagttccctgattctcccacactgtgtcctcctctgcatattgtctataatcattcttgccttcatacctaaagacagtccatcctcctgctgcctcttgaaagcaaataagctgctttcccaaaagataatagcatactacactcccctgctgagttagttgttactcagttcacttcctgaaatgttaaatgccaatgagtttgatctagattcctgaactaatcacagtaagaagcaggttcagacagcaattaaactaatcaggccaaccctaagaactgtgggtaaaatgcgtttctgggaaacacatgtggcagcactataacagaaacaattagaaaaataaatgctacctagtcaataacatacattataggactatgaactactaagttacacctcatgacaaacacatgagtaataaagtctagaaaaatacttaaaggtgatgtccatcattctcattgctgtgttcacagttcacaggtagaccctaaagacaggcttgtgttgtctttactgaaccctagatgcatctctcaaactgtcaactgcacatatccacttgaatagcaaagagcttctcaaatttcagtcggaactctggatctcccttcagtgtcccaacgaatatcttctctcagtgttctatcctaatagtaccactatgtacacagttgctcaagccaaaaatctaggggtttcactgttagctaaatcctgttcctcagccacacctattaattctacctcaaag

SEQ ID NO: 295731 - DNA, 683 bp, Homo sapiens
gcagcgtcatgcgcacagcctctgtaagtacacagtcgtttccggtagaccccgagcctaccgctctgcttgcgttctcgggggtcggtgtcggtcttgggtctggccatgcctgagcctgcaaagttcgcgccggctcccaagaagggctccaagaaagccgtcaccaaagcccagaagaaagacggcaagaagcgcaagcgcagccgcaaggagagctactccatctacgtgtacaaggtgctgaagcgggtccaccccgacaccggcatctggtgcaaggccatgggcatcatgaactccttcctcaacgacatcttcgagcgcatcgcgggagaggcgtcccgcctggcgcactacaacaagcgctccaccatcacgtcccggagatccagacggccgtgcgcctgctgctgcccggcgagctggccaagcacgccgtgtccgagggcaccaaggcggtcaccaagtacgccagctccaagtgagtccctgccgggacctggcgctcgctcgctccctccctccctccctccgcgggtcgccggctgctttgtctccaaaggctcttttcagggccacttaaccccgttagtgaaataagctgttttcccactgcttactgtgagttctacttaggggttttccctcagcacctatcccttttcctgcagatgatggga

SEQ ID NO: 295732 - DNA, 981 bp, Homo sapiens
gcagagggctcttccggcgccttcccaggcggggatgctgcggctccgcagcgggctgaggcaccttcgggcaacacccaatactcggggctccgctcggcttcttcgcgccgagatgcctaagaaggctggtgcgacgaccaagggtaaaagccagagcaaggaaccagagagaccacttcctcccttaggtcctgtggcagttgatcctaaaggatgcgtcaccatagccatccatgcaaaacctggctccaaacaaaatgctgtaacagatttgacagcagaggctgtaaatgtagctattgcagcacctccatcagagggagaggctaatgctgagctctgtcggtatctttccaaggtcctagaactcaggaagagtgatgtggttttggataagaagttgagagacttactcaagattgtaccatgcaagctggcaactagaacccaaatccttggactacttgttgaatgcagtttttctagattgtaaattaaaaatcatatctccacaacggttctggaattctggggattgccttctaatccagtttacaagtgacagaaaacctgttatgctgctttgtagtcttaccttagatttttaaatgcttatttaaatgtaaaaaaaatttttttttacatcttttaaagactatatttaccattttgttgaaaaagtaaagaaaaatcatgacttgtaattaaatgtgaattataatttttgagaagtcactgaattttcatcttcctctaataacttaaataatcagcaaattcagtagtttttatgaatctccaaagatccttaaaagaagaaagaggacttggaagctattttcagtatttgtaaaagcttgtcagaaattacatctatattaaagtttcaaaagctaataatatatttttacatcttcaggtcaagttatagtaatttattaaagaaaataaaattaatttcctttgctgatcaggaga

SEQ ID NO: 295733 - DNA, 954 bp, Homo sapiens
gcagagggctcttccggcgccttcccaggcggggatgctgcggctccgcagcgggctgaggcaccttcgggcaacacccaatactcggggctccgctcggcttcttcgcgccgagatgcctaagaaggctggtgcgacgaccaagggtaaaagccagagcaaggaaccagagagaccacttcctcccttaggtcctgtggcagttgatcctaaaggatgcgtcaccatagccatccatgcaaaacctggctccaaacaaaatgctgtaacagatttgacagcagaggctgtaaatgtagctattgcagcacctccatcagagggagaggctaatgctgagctctgtcggtatctttccaaggtcctagaactcaggaagagtgatgtggttttggataaggtaggtctcgctctcttttttttttttttgagacaaaatcttgctctgtcgcccaagctggagtgcagtggcgtagtcttggctcactgcaacctccacctcctgggttcaagctattctcctgcctcagcttcctgagtagctgggattataggcgcatgccaccatgcctggctaatttttgtatttttaatagagacggagtttcaccatgttggtcaggctggtcttgaactcctgacctcaaatgatccacctgccttctcctcccgaagcgctgggattagaggtatgagccaccatgcccggaggtctctctctttttaaacttctttaattattttctttttttttttgagacggagtctcgctctgttgtccagcctggagtgcagtggtgcaatcttgacgcactgctacctctcactcctggattcaagcgattctcctgcctcagcctcctgagtagttgggattacaggcacccaccaccaggcccacctaatttttgtatttgtagtagagacagggtttcaccatgttggacaggctgg

SEQ ID NO: 295734 - DNA, 1701 bp, Homo sapiens
gcagagggctcttccggcgccttcccaggcggggatgctgcggctccgcagcgggctgaggcaccttcgggcaacacccaatactcggggctccgctcggcttcttcgcgccgagatgcctaagaaggctggtgcgacgaccaagggtaaaagccagagcaaggaaccagagagaccacttcctcccttaggtcctgtggcagttgatcctaaaggatgcgtcaccatagccatccatgcaaaacctggctccaaacaaaatgctgtaacagatttgacagcagaggctgtaaatgtagctattgcagcacctccatcagagggagaggctaatgctgagctctgtcggtatctttccaaggtcctagaactcaggaagagtgatgtggttttggataagggtggtaaatctcgtgaaaaggtggtgaagcttttggcttctacaactccagaagagatcttggagaaattaaaaaaggaagccaaaaaaacataaaagcaagaaatgaggccgggcgcagtggctcatgcctgtaatcccagcactttgggaggccgtggtgggcggatcacctgaggtcaggagttcgagaccagcctgaccaacatggtgaaaccccatctctacgaaaaatacaaaattagccagatgtgatggcgcatgcctgtaatcccagttactcaggaggctgaggcaggagaatcacttgaacctggggggcggaggttgcagtaagccgagatcgcgccgttgcactccagcctgggcaacaagagtgaaactctctccccccgaaaaaaaagaaataaaaaatacatccttgagaaacttttttattgctaatggtgaagaggctgttaaatagaaaaatatactacatgcacagaagaacatgggggacatatatatatgtatatattcgaataagactccaaaaagtagaaatttaaaaagtgctatacattgcatcaggttctaaaatcccaaaccccaaacagcctggaacatgttactctgatttcatggcgttgtaaaataacagagctgggaagaatattcaagatgacctgatttaacacctttcattctgttggggggcctttgatttcctatatccagaagttgagagacttactcaagattgtaccatgcaagctggcaactagaacccaaatccttggactacttgttgaatgcagtttttctagattgtaaattaaaaatcatatctccacaacggttctggaattctggggattgccttctaatccagtttacaagtgacagaaaacctgttatgctgctttgtagtcttaccttagatttttaaatgcttatttaaatgtaaaaaaaatttttttttacatcttttaaagactatatttaccattttgttgaaaaagtaaagaaaaatcatgacttgtaattaaatgtgaattataatttttgagaagtcactgaattttcatcttcctctaataacttaaataatcagcaaattcagtagtttttatgaatctccaaagatccttaaaagaagaaagaggacttggaagctattttcagtatttgtaaaagcttgtcagaaattacatctatattaaagtttcaaaagctaataatatatttttacatcttcaggtcaagttatagtaatttattaaagaaaataaaattaatttcctttgctgatcaggaga

SEQ ID NO: 295735 - DNA, 1446 bp, Homo sapiens
gcagagggctcttccggcgccttcccaggcggggatgctgcggctccgcagcgggctgaggcaccttcgggcaacacccaatactcggggctccgctcggcttcttcgcgccgagatgcctaagaaggctggtgcgacgaccaagggtggtaaatctcgtgaaaaggtggtgaagcttttggcttctacaactccagaagagatcttggagaaattaaaaaaggaagccaaaaaaacataaaagcaagaaatgaggccgggcgcagtggctcatgcctgtaatcccagcactttgggaggccgtggtgggcggatcacctgaggtcaggagttcgagaccagcctgaccaacatggtgaaaccccatctctacgaaaaatacaaaattagccagatgtgatggcgcatgcctgtaatcccagttactcaggaggctgaggcaggagaatcacttgaacctggggggcggaggttgcagtaagccgagatcgcgccgttgcactccagcctgggcaacaagagtgaaactctctccccccgaaaaaaaagaaataaaaaatacatccttgagaaacttttttattgctaatggtgaagaggctgttaaatagaaaaatatactacatgcacagaagaacatgggggacatatatatatgtatatattcgaataagactccaaaaagtagaaatttaaaaagtgctatacattgcatcaggttctaaaatcccaaaccccaaacagcctggaacatgttactctgatttcatggcgttgtaaaataacagagctgggaagaatattcaagatgacctgatttaacacctttcattctgttggggggcctttgatttcctatatccagaagttgagagacttactcaagattgtaccatgcaagctggcaactagaacccaaatccttggactacttgttgaatgcagtttttctagattgtaaattaaaaatcatatctccacaacggttctggaattctggggattgccttctaatccagtttacaagtgacagaaaacctgttatgctgctttgtagtcttaccttagatttttaaatgcttatttaaatgtaaaaaaaatttttttttacatcttttaaagactatatttaccattttgttgaaaaagtaaagaaaaatcatgacttgtaattaaatgtgaattataatttttgagaagtcactgaattttcatcttcctctaataacttaaataatcagcaaattcagtagtttttatgaatctccaaagatccttaaaagaagaaagaggacttggaagctattttcagtatttgtaaaagcttgtcagaaattacatctatattaaagtttcaaaagctaataatatatttttacatcttcaggtcaagttatagtaatttattaaagaaaataaaattaatttcctttgctgatcaggaga

SEQ ID NO: 295736 - DNA, 2385 bp, Homo sapiens
cacgcgcccctcctccgcatctgagcgggggagcggcggcccccagctgaatgggcgcgagagcggcgctgggggcgggtgggggcgcggggtaccgggctggcggccggccggcgccccctcattagtatgcggacgaaggcggcgggctgcgcggagcggcgtcccctgcagccgcggaccgaggcagcggcggcacctgccggccgagcaatgccaagtgagtacacctatgtgaaactgagaagtgattgctcgaggccttccctgcaatggtacacccgagctcaaagcaagatgagaaggcccagcttgttattaaaagacatcctcaaatgtacattgcttgtgtttggagtgtggatcctttatatcctcaagttaaattatactactgaagaatgtgacatgaaaaaaatgcattatgtggaccctgaccatgtaaagagagctcagaaatatgctcagcaagtcttgcagaaggaatgtcgtcccaagtttgccaagacatcaatggcgctgttatttgagcacaggtatagcgtggacttactcccttttgtgcagaaggcccccaaagacagtgaagctgagtccaagtacgatcctccttttgggttccggaagttctccagtaaagtccagaccctcttggaactcttgccagagcacgacctccctgaacacttgaaagccaagacctgtcggcgctgtgtggttattggaagcggaggaatactgcacggattagaactgggccacaccctgaaccagttcgatgttgtgataaggttaaacagtgcaccagttgagggatattcagaacatgttggaaataaaactactataaggatgacttatccagagggcgcaccactgtctgaccttgaatattattccaatgacttatttgttgctgttttatttaagagtgttgatttcaactggcttcaagcaatggtaaaaaaggaaaccctgccattctgggtacgactcttcttttggaagcaggtggcagaaaaaatcccactgcagccaaaacatttcaggattttgaatccagttatcatcaaagagactgcctttgacatccttcagtactcagagcctcagtcaaggttctggggccgagataagaacgtccccacaatcggtgtcattgccgttgtcttagccacacatctgtgcgatgaagtcagtttggcgggttttggatatgacctcaatcaacccagaacacctttgcactacttcgacagtcaatgcatggctgctatgaactttcagaccatgcataatgtgacaacggaaaccaagttcctcttaaagctggtcaaagagggagtggtgaaagatctcagtggaggcattgatcgtgaattttgaacacagaaaacctcagttgaaaatgcaactctaactctgagagctgtttttgacagccttcttgatgtatttctccatcctgcagatactttgaagtgcagctcatgtttttaacttttaatttaaaaacacaaaaaaaattttagctcttcccactttttttttcctatttatttgaggtcagtgtttgtttttgcacaccattttgtaaatgaaacttaagaattgaattggaaagacttctcaaagagaattgtatgtaacgatgttgtattgatttttaagaaagtaatttaatttgtaaaacttctgctcgtttacactgcacattgaatacaggtaactaattggaaggagaggggaggtcactcttttgatggtggccctgaacctcattctggttccctgctgcgctgcttggtgtgacccacggaggatccactcccaggatgacgtgctccgtagctctgctgctgatactgggtctgcgatgcagcggcgtgaggcctgggctggttggagaaggtcacaacccttctctgttggtctgccttctgctgaaagactcgagaaccaaccagggaagctgtcctggaggtccctggtcggagagggacatagaatctgtgacctctgacaactgtgaagccaccctgggctacagaaaccacagtcttcccagcaattattacaattcttgaattccttggggattttttactgccctttcaaagcacttaagtgttagatctaacgtgttccagtgtctgtctgaggtgacttaaaaaatcagaacaaaacttctattatccagagtcatgggagagtacaccctttccaggaataatgttttgggaaacactgaaatgaaatcttcccagtattataaattgtgtatttaaaaaaaagaaacttttctgaatgcctacctggcggtgtataccaggcagtgtgccagtttaaaaagatgaaaaagaataaaaacttttgaggaaaaaa

SEQ ID NO: 295737 - DNA, 3491 bp, Homo sapiens
  misc_feature (402)..(402): n is a, c, g, or t
  misc_feature (440)..(440): n is a, c, g, or t
gtggcacgatctcggctcactgcaagctctgcctcccgggttcacaccattctcctgcctcagcctcccgagtagctgggactacaggtgcccaccaccacgtgcccggctaatttttgtatttttagtagagacgagtttcaccgtattagccaggatggtcatgtttttgttcttgtttttgttttagagacagggtctccctctgtcacccaggctggagtgcagtggcacaatcacagctcactacagtgtcaaccttccaggttgaggatcactcgatactcatgcctcagcctcccatgtagctggggccacaggggcacaccaccactcctgacccattttttaaaaaattttttgtataggtggggtctcaccatgttgcccaggctagcctcnaactcctgggctcaagcaaccctctcaccttggcctcncaaagtgctgagattataggtgtgacccgccatgcccgcctttcctctgagttttgttgcattcacgcagctcctggctgaggcaaaacattaaaatgcatatggaaatgcaggctgggaaaatgctttgaaaccaatgcaatttctgtgttaaggggacattccctgattctttcaggtaatttgcattctagactgtgacattctgtatctcaactgataaataagcctgtttgtcatcctgctagatgagaacctgatatatgaaaccttttttttaatcgtggttaaaaaaaacataaaatttaccatcataattatttttaaatgtaccatttggcagcattaagtatatttaaactcttgtgaaacaaatttctagaatgttttcatcttgcaaaaccgaaacgctgtacctattaaacaactccccttttctccctctcttcaaccctggtaaccatgtttttatgaatttgactactttagatacctcatataagtcaggtcatacagtatttgtctctttgtgactggcttcacttagcataatgtcctcaaagtttaactatgttgtagcatgtatcagaattttatgaaacatgaagtcttagacaccccgaagtacattttcaccccaaatgtatttgaacagtgttaggctgggggtgggaggcgggagtccttcttgctttgcctgtgcaatgaaatgaataccctgctgtgtttatctccttgtcatgtgattctcccaggttgtttcttcaagtttctgagccaaacttaactctaaaaagcaaatattctgtgttaaaagacagtaatcaacacgggagctacatcagacatcataggacaaattgtcatctagaagagtatatttttaatgcaggagagtttttaaaacccagattggtgtgatttcattccagagagctcagaaatatgctcagcaagtcttgcagaaggaatgtcgtcccaagtttgccaagacatcaatggcgctgttatttgagcacaggtatagcgtggacttactcccttttgtgcagaaggcccccaaagacagtgaagctgagtccaagtacgatcctccttttgggttccggaagttctccagtaaagtccagaccctcttggaactcttgccagagcacgacctccctgaacacttgaaagccaagacctgtcggcgctgtgtggttattggaagcggaggaatactgcacggattagaactgggccacaccctgaaccagttcgatgttgtgataagaactcagtgcactgctcttggtcagtgtggctccaggaacagtgagggacacaggaagctcttcacagtccctgcccacaagggacttaacgtttgagaagttgaaacaaaaacacaaaatggttggatgctccaaactgtcatactgaccctaagttggaggagcatgctgctggctacagttaaacagtgcaccagttgagggatattcagaacatgttggaaataaaactactataaggatgacttatccagagggcgcaccactgtctgaccttgaatattattccaatgacttatttgttgctgttttatttaagagtgttgatttcaactggcttcaagcaatggtaaaaaaggaaaccctgccattctgggtacgactcttcttttggaagcaggtggcagaaaaaatcccactgcagccaaaacatttcaggattttgaatccagttatcatcaaagagactgcctttgacatccttcagtactcagagcctcagtcaaggttctggggccgagataagaacgtccccacaatcggtgtcattgccgttgtcttagccacacatctgtgcgatgaagtcagtttggcgggttttggatatgacctcaatcaacccagaacacctttgcactacttcgacagtcaatgcatggctgctatgaactttcagaccatgcataatgtgacaacggaaaccaagttcctcttaaagctggtcaaagagggagtggtgaaagatctcagtggaggcattgatcgtgaattttgaacacagaaaacctcagttgaaaatgcaactctaactctgagagctgtttttgacagccttcttgatgtatttctccatcctgcagatactttgaagtgcagctcatgtttttaacttttaatttaaaaacacaaaaaaaattttagctcttcccactttttttttcctatttatttgaggtcagtgtttgtttttgcacaccattttgtaaatgaaacttaagaattgaattggaaagacttctcaaagagaattgtatgtaacgatgttgtattgatttttaagaaagtaatttaatttgtaaaacttctgctcgtttacactgcacattgaatacaggtaactaattggaaggagaggggaggtcactcttttgatggtggccctgaacctcattctggttccctgctgcgctgcttggtgtgacccacggaggatccactcccaggatgacgtgctccgtagctctgctgctgatactgggtctgcgatgcagcggcgtgaggcctgggctggttggagaaggtcacaacccttctctgttggtctgccttctgctgaaagactcgagaaccaaccagggaagctgtcctggaggtccctggtcggagagggacatagaatctgtgacctctgacaactgtgaagccaccctgggctacagaaaccacagtcttcccagcaattattacaattcttgaattccttggggattttttactgccctttcaaagcacttaagtgttagatctaacgtgttccagtgtctgtctgaggtgacttaaaaaatcagaacaaaacttctattatccagagtcatgggagagtacaccctttccaggaataatgttttgggaaacactgaaatgaaatcttcccagtattataaattgtgtatttaaaaaaaagaaacttttctgaatgcctacctggcggtgtataccaggcagtgtgccagtttaaaaagatgaaaaagaataaaaacttttgaggaaaaaa

SEQ ID NO: 295738 - DNA, 2319 bp, Homo sapiens
aatgcgagagcatataaccagcatgtcttgagtcttttacccatgtgcctgttatatggatgctgctgtttttgtaagatgaaatgacccttggatattctgggttatgatcagcatttcttcgtctaggcgagaaaagaaacagcaatgccaagtgagtacacctatgtgaaactgagaagtgattgctcgaggccttccctgcaatggtacacccgagctcaaagcaagatgagaaggcccagcttgttattaaaagacatcctcaaatgtacattgcttgtgtttggagtgtggatcctttatatcctcaagttaaattatactactgaagaatgtgacatgaaaaaaatgcattatgtggaccctgaccatgtaaagagagctcagaaatatgctcagcaagtcttgcagaaggaatgtcgtcccaagtttgccaagacatcaatggcgctgttatttgagcacaggtatagcgtggacttactcccttttgtgcagaaggcccccaaagacagtgaagctgagtccaagtacgatcctccttttgggttccggaagttctccagtaaagtccagaccctcttggaactcttgccagagcacgacctccctgaacacttgaaagccaagacctgtcggcgctgtgtggttattggaagcggaggaatactgcacggattagaactgggccacaccctgaaccagttcgatgttgtgataaggttaaacagtgcaccagttgagggatattcagaacatgttggaaataaaactactataaggatgacttatccagagggcgcaccactgtctgaccttgaatattattccaatgacttatttgttgctgttttatttaagagtgttgatttcaactggcttcaagcaatggtaaaaaaggaaaccctgccattctgggtacgactcttcttttggaagcaggtggcagaaaaaatcccactgcagccaaaacatttcaggattttgaatccagttatcatcaaagagactgcctttgacatccttcagtactcagagcctcagtcaaggttctggggccgagataagaacgtccccacaatcggtgtcattgccgttgtcttagccacacatctgtgcgatgaagtcagtttggcgggttttggatatgacctcaatcaacccagaacacctttgcactacttcgacagtcaatgcatggctgctatgaactttcagaccatgcataatgtgacaacggaaaccaagttcctcttaaagctggtcaaagagggagtggtgaaagatctcagtggaggcattgatcgtgaattttgaacacagaaaacctcagttgaaaatgcaactctaactctgagagctgtttttgacagccttcttgatgtatttctccatcctgcagatactttgaagtgcagctcatgtttttaacttttaatttaaaaacacaaaaaaaattttagctcttcccactttttttttcctatttatttgaggtcagtgtttgtttttgcacaccattttgtaaatgaaacttaagaattgaattggaaagacttctcaaagagaattgtatgtaacgatgttgtattgatttttaagaaagtaatttaatttgtaaaacttctgctcgtttacactgcacattgaatacaggtaactaattggaaggagaggggaggtcactcttttgatggtggccctgaacctcattctggttccctgctgcgctgcttggtgtgacccacggaggatccactcccaggatgacgtgctccgtagctctgctgctgatactgggtctgcgatgcagcggcgtgaggcctgggctggttggagaaggtcacaacccttctctgttggtctgccttctgctgaaagactcgagaaccaaccagggaagctgtcctggaggtccctggtcggagagggacatagaatctgtgacctctgacaactgtgaagccaccctgggctacagaaaccacagtcttcccagcaattattacaattcttgaattccttggggattttttactgccctttcaaagcacttaagtgttagatctaacgtgttccagtgtctgtctgaggtgacttaaaaaatcagaacaaaacttctattatccagagtcatgggagagtacaccctttccaggaataatgttttgggaaacactgaaatgaaatcttcccagtattataaattgtgtatttaaaaaaaagaaacttttctgaatgcctacctggcggtgtataccaggcagtgtgccagtttaaaaagatgaaaaagaataaaaacttttgaggaaaaaa

SEQ ID NO: 295739 - DNA, 564 bp, Homo sapiens
cacgcgcccctcctccgcatctgagcgggggagcggcggcccccagctgaatgggcgcgagagcggcgctgggggcgggtgggggcgcggggtaccgggctggcggccggccggcgccccctcattagtatgcggacgaaggcggcgggctgcgcggagcggcgtcccctgcagccgcggaccgaggcagcggcggcacctgccggccgagcaatgccaagtgagtacacctatgtgaaactgagaagtgattgctcgaggccttccctgcaatggtacacccgagctcaaagcaagatgagaaggcccagcttgttattaaaagacatcctcaaatgtacattgcttgtgtttggagtgtggatcctttatatcctcaagttaaattatactactgaagaatgtgacatgaaaaaaatgcattatgtggaccctgaccatgtaaaggttagatatcccattggtgtggtttaaatgaaaacattgccaagcatatgctcaaactataatatcattagtctactgtgtgacaaatatatgttaataaaagtttgaactcagagg

SEQ ID NO: 295740 - DNA, 2572 bp, Homo sapiens
cacgcgcccctcctccgcatctgagcgggggagcggcggcccccagctgaatgggcgcgagagcggcgctgggggcgggtgggggcgcggggtaccgggctggcggccggccggcgccccctcattagtatgcggacgaaggcggcgggctgcgcggagcggcgtcccctgcagccgcggaccgaggcagcggcggcacctgccggccgaggcactgtgaagacagtggtgtgcaaagcagagacccctgcttgcatggaatctgcattctagtgggggagacaagacaaacgtgtaattcaaaagtaaaaaacttatgaagaatcacatgtctcatgattagtgttataaagaaaaaagaaagcatgcatacaggaatatccacataagcaattttgcaatgccaagtgagtacacctatgtgaaactgagaagtgattgctcgaggccttccctgcaatggtacacccgagctcaaagcaagatgagaaggcccagcttgttattaaaagacatcctcaaatgtacattgcttgtgtttggagtgtggatcctttatatcctcaagttaaattatactactgaagaatgtgacatgaaaaaaatgcattatgtggaccctgaccatgtaaagagagctcagaaatatgctcagcaagtcttgcagaaggaatgtcgtcccaagtttgccaagacatcaatggcgctgttatttgagcacaggtatagcgtggacttactcccttttgtgcagaaggcccccaaagacagtgaagctgagtccaagtacgatcctccttttgggttccggaagttctccagtaaagtccagaccctcttggaactcttgccagagcacgacctccctgaacacttgaaagccaagacctgtcggcgctgtgtggttattggaagcggaggaatactgcacggattagaactgggccacaccctgaaccagttcgatgttgtgataaggttaaacagtgcaccagttgagggatattcagaacatgttggaaataaaactactataaggatgacttatccagagggcgcaccactgtctgaccttgaatattattccaatgacttatttgttgctgttttatttaagagtgttgatttcaactggcttcaagcaatggtaaaaaaggaaaccctgccattctgggtacgactcttcttttggaagcaggtggcagaaaaaatcccactgcagccaaaacatttcaggattttgaatccagttatcatcaaagagactgcctttgacatccttcagtactcagagcctcagtcaaggttctggggccgagataagaacgtccccacaatcggtgtcattgccgttgtcttagccacacatctgtgcgatgaagtcagtttggcgggttttggatatgacctcaatcaacccagaacacctttgcactacttcgacagtcaatgcatggctgctatgaactttcagaccatgcataatgtgacaacggaaaccaagttcctcttaaagctggtcaaagagggagtggtgaaagatctcagtggaggcattgatcgtgaattttgaacacagaaaacctcagttgaaaatgcaactctaactctgagagctgtttttgacagccttcttgatgtatttctccatcctgcagatactttgaagtgcagctcatgtttttaacttttaatttaaaaacacaaaaaaaattttagctcttcccactttttttttcctatttatttgaggtcagtgtttgtttttgcacaccattttgtaaatgaaacttaagaattgaattggaaagacttctcaaagagaattgtatgtaacgatgttgtattgatttttaagaaagtaatttaatttgtaaaacttctgctcgtttacactgcacattgaatacaggtaactaattggaaggagaggggaggtcactcttttgatggtggccctgaacctcattctggttccctgctgcgctgcttggtgtgacccacggaggatccactcccaggatgacgtgctccgtagctctgctgctgatactgggtctgcgatgcagcggcgtgaggcctgggctggttggagaaggtcacaacccttctctgttggtctgccttctgctgaaagactcgagaaccaaccagggaagctgtcctggaggtccctggtcggagagggacatagaatctgtgacctctgacaactgtgaagccaccctgggctacagaaaccacagtcttcccagcaattattacaattcttgaattccttggggattttttactgccctttcaaagcacttaagtgttagatctaacgtgttccagtgtctgtctgaggtgacttaaaaaatcagaacaaaacttctattatccagagtcatgggagagtacaccctttccaggaataatgttttgggaaacactgaaatgaaatcttcccagtattataaattgtgtatttaaaaaaaagaaacttttctgaatgcctacctggcggtgtataccaggcagtgtgccagtttaaaaagatgaaaaagaataaaaacttttgaggaaaaaa

SEQ ID NO: 295741 - DNA, 2216 bp, Homo sapiens
cattatcctgtctcgccgccacccaggacatggcttctgttccaatgccaagtgagtacacctatgtgaaactgagaagtgattgctcgaggccttccctgcaatggtacacccgagctcaaagcaagatgagaaggcccagcttgttattaaaagacatcctcaaatgtacattgcttgtgtttggagtgtggatcctttatatcctcaagttaaattatactactgaagaatgtgacatgaaaaaaatgcattatgtggaccctgaccatgtaaagagagctcagaaatatgctcagcaagtcttgcagaaggaatgtcgtcccaagtttgccaagacatcaatggcgctgttatttgagcacaggtatagcgtggacttactcccttttgtgcagaaggcccccaaagacagtgaagctgagtccaagtacgatcctccttttgggttccggaagttctccagtaaagtccagaccctcttggaactcttgccagagcacgacctccctgaacacttgaaagccaagacctgtcggcgctgtgtggttattggaagcggaggaatactgcacggattagaactgggccacaccctgaaccagttcgatgttgtgataaggttaaacagtgcaccagttgagggatattcagaacatgttggaaataaaactactataaggatgacttatccagagggcgcaccactgtctgaccttgaatattattccaatgacttatttgttgctgttttatttaagagtgttgatttcaactggcttcaagcaatggtaaaaaaggaaaccctgccattctgggtacgactcttcttttggaagcaggtggcagaaaaaatcccactgcagccaaaacatttcaggattttgaatccagttatcatcaaagagactgcctttgacatccttcagtactcagagcctcagtcaaggttctggggccgagataagaacgtccccacaatcggtgtcattgccgttgtcttagccacacatctgtgcgatgaagtcagtttggcgggttttggatatgacctcaatcaacccagaacacctttgcactacttcgacagtcaatgcatggctgctatgaactttcagaccatgcataatgtgacaacggaaaccaagttcctcttaaagctggtcaaagagggagtggtgaaagatctcagtggaggcattgatcgtgaattttgaacacagaaaacctcagttgaaaatgcaactctaactctgagagctgtttttgacagccttcttgatgtatttctccatcctgcagatactttgaagtgcagctcatgtttttaacttttaatttaaaaacacaaaaaaaattttagctcttcccactttttttttcctatttatttgaggtcagtgtttgtttttgcacaccattttgtaaatgaaacttaagaattgaattggaaagacttctcaaagagaattgtatgtaacgatgttgtattgatttttaagaaagtaatttaatttgtaaaacttctgctcgtttacactgcacattgaatacaggtaactaattggaaggagaggggaggtcactcttttgatggtggccctgaacctcattctggttccctgctgcgctgcttggtgtgacccacggaggatccactcccaggatgacgtgctccgtagctctgctgctgatactgggtctgcgatgcagcggcgtgaggcctgggctggttggagaaggtcacaacccttctctgttggtctgccttctgctgaaagactcgagaaccaaccagggaagctgtcctggaggtccctggtcggagagggacatagaatctgtgacctctgacaactgtgaagccaccctgggctacagaaaccacagtcttcccagcaattattacaattcttgaattccttggggattttttactgccctttcaaagcacttaagtgttagatctaacgtgttccagtgtctgtctgaggtgacttaaaaaatcagaacaaaacttctattatccagagtcatgggagagtacaccctttccaggaataatgttttgggaaacactgaaatgaaatcttcccagtattataaattgtgtatttaaaaaaaagaaacttttctgaatgcctacctggcggtgtataccaggcagtgtgccagtttaaaaagatgaaaaagaataaaaacttttgaggaaaaaa

SEQ ID NO: 295742 - DNA, 3153 bp, Homo sapiens
cacgcgcccctcctccgcatctgagcgggggagcggcggcccccagctgaatgggcgcgagagcggcgctgggggcgggtgggggcgcggggtaccgggctggcggccggccggcgccccctcattagtatgcggacgaaggcggcgggctgcgcggagcggcgtcccctgcagccgcggaccgaggcagcggcggcacctgccggccgaggcactgtgaagacagtggtgtgcaaagcagagacccctgcttgcatggaatctgcattctagtgggggagacaagacaaacgtgtaattcaaaagtaaaaaacttatgaagaatcacatgtctcatgattagtgttataaagaaaaaagaaagcatgcatacaggaatatccacataagcaattttgcaatgccaagtgagtacacctatgtgaaactgagaagtgattgctcgaggccttccctgcaatggtacacccgagctcaaagcaagatgagaaggcccagcttgttattaaaagacatcctcaaatgtacattgcttgtgtttggagtgtggatcctttatatcctcaagttaaattatactactgaagaatgtgacatgaaaaaaatgcattatgtggaccctgaccatgtaaagacctacaccgtgcctttaaaggaagcagggccctccctgctgaagcattcagtgagcccaggcaccagcatcttcaaaccgagtcttttctctccttagtgctgctccccgctttccaggccttcctgggatatcttagagctcctgaaggtgcggcactcgccttgaggcactttcttctgagctgtgagctatgggcaagcagtggagggggaagagagcagctgaagcagatgccggttcaacttacttaaagatgtgggacaagctctgaggaagcccccaagacaatgatgtctggttgtgcaccattgaagcaagaacagaaaccatcccagagtggaggacatggcccatgtggtcctcctgttctgagtggctatgagatggagttctgtgtgagctctctacagaaaaagccctgtctccaggcaatcagtggagatctgttaaacgagttgaaacaaaagaggacaaggaattgctgtggctttagacgttgccaggacatgtagaaactcactcaggatttactactgcatccactgtcacttaggcgcaggaggggtcacagtcagaagagagctcagaaatatgctcagcaagtcttgcagaaggaatgtcgtcccaagtttgccaagacatcaatggcgctgttatttgagcacaggtatagcgtggacttactcccttttgtgcagaaggcccccaaagacagtgaagctgagtccaagtacgatcctccttttgggttccggaagttctccagtaaagtccagaccctcttggaactcttgccagagcacgacctccctgaacacttgaaagccaagacctgtcggcgctgtgtggttattggaagcggaggaatactgcacggattagaactgggccacaccctgaaccagttcgatgttgtgataaggttaaacagtgcaccagttgagggatattcagaacatgttggaaataaaactactataaggatgacttatccagagggcgcaccactgtctgaccttgaatattattccaatgacttatttgttgctgttttatttaagagtgttgatttcaactggcttcaagcaatggtaaaaaaggaaaccctgccattctgggtacgactcttcttttggaagcaggtggcagaaaaaatcccactgcagccaaaacatttcaggattttgaatccagttatcatcaaagagactgcctttgacatccttcagtactcagagcctcagtcaaggttctggggccgagataagaacgtccccacaatcggtgtcattgccgttgtcttagccacacatctgtgcgatgaagtcagtttggcgggttttggatatgacctcaatcaacccagaacacctttgcactacttcgacagtcaatgcatggctgctatgaactttcagaccatgcataatgtgacaacggaaaccaagttcctcttaaagctggtcaaagagggagtggtgaaagatctcagtggaggcattgatcgtgaattttgaacacagaaaacctcagttgaaaatgcaactctaactctgagagctgtttttgacagccttcttgatgtatttctccatcctgcagatactttgaagtgcagctcatgtttttaacttttaatttaaaaacacaaaaaaaattttagctcttcccactttttttttcctatttatttgaggtcagtgtttgtttttgcacaccattttgtaaatgaaacttaagaattgaattggaaagacttctcaaagagaattgtatgtaacgatgttgtattgatttttaagaaagtaatttaatttgtaaaacttctgctcgtttacactgcacattgaatacaggtaactaattggaaggagaggggaggtcactcttttgatggtggccctgaacctcattctggttccctgctgcgctgcttggtgtgacccacggaggatccactcccaggatgacgtgctccgtagctctgctgctgatactgggtctgcgatgcagcggcgtgaggcctgggctggttggagaaggtcacaacccttctctgttggtctgccttctgctgaaagactcgagaaccaaccagggaagctgtcctggaggtccctggtcggagagggacatagaatctgtgacctctgacaactgtgaagccaccctgggctacagaaaccacagtcttcccagcaattattacaattcttgaattccttggggattttttactgccctttcaaagcacttaagtgttagatctaacgtgttccagtgtctgtctgaggtgacttaaaaaatcagaacaaaacttctattatccagagtcatgggagagtacaccctttccaggaataatgttttgggaaacactgaaatgaaatcttcccagtattataaattgtgtatttaaaaaaaagaaacttttctgaatgcctacctggcggtgtataccaggcagtgtgccagtttaaaaagatgaaaaagaataaaaacttttgaggaaaaaa

SEQ ID NO: 295743 - DNA, 2435 bp, Homo sapiens
cctgggagctctggagtcctcacagcctagtcacactgcttcctctcttcattgcagctcctgaaggtgcggcactcgccttgaggcactttcttctgagctgtgagctatgggcaagcagtggagggggaagagagcagctgaagcagatgccggttcaacttacttaaagatgtgggacaagctctgaggaagcccccaagacaatgatgtctggttgtgcaccattgaagcaagaacagaaaccatcccagagtggaggacatggcccatgtggtcctcctgttctgagtggctatgagatggagttctgtgtgagctctctacagaaaaagccctgtctccaggcaatcagtggagatctgttaaacgagttgaaacaaaagaggacaaggaattgctgtggctttagacgttgccaggacatgtagaaactcactcaggatttactactgcatccactgtcacttaggcgcaggaggggtcacagtcagaagagagctcagaaatatgctcagcaagtcttgcagaaggaatgtcgtcccaagtttgccaagacatcaatggcgctgttatttgagcacaggtatagcgtggacttactcccttttgtgcagaaggcccccaaagacagtgaagctgagtccaagtacgatcctccttttgggttccggaagttctccagtaaagtccagaccctcttggaactcttgccagagcacgacctccctgaacacttgaaagccaagacctgtcggcgctgtgtggttattggaagcggaggaatactgcacggattagaactgggccacaccctgaaccagttcgatgttgtgataaggttaaacagtgcaccagttgagggatattcagaacatgttggaaataaaactactataaggatgacttatccagagggcgcaccactgtctgaccttgaatattattccaatgacttatttgttgctgttttatttaagagtgttgatttcaactggcttcaagcaatggtaaaaaaggaaaccctgccattctgggtacgactcttcttttggaagcaggtggcagaaaaaatcccactgcagccaaaacatttcaggattttgaatccagttatcatcaaagagactgcctttgacatccttcagtactcagagcctcagtcaaggttctggggccgagataagaacgtccccacaatcggtgtcattgccgttgtcttagccacacatctgtgcgatgaagtcagtttggcgggttttggatatgacctcaatcaacccagaacacctttgcactacttcgacagtcaatgcatggctgctatgaactttcagaccatgcataatgtgacaacggaaaccaagttcctcttaaagctggtcaaagagggagtggtgaaagatctcagtggaggcattgatcgtgaattttgaacacagaaaacctcagttgaaaatgcaactctaactctgagagctgtttttgacagccttcttgatgtatttctccatcctgcagatactttgaagtgcagctcatgtttttaacttttaatttaaaaacacaaaaaaaattttagctcttcccactttttttttcctatttatttgaggtcagtgtttgtttttgcacaccattttgtaaatgaaacttaagaattgaattggaaagacttctcaaagagaattgtatgtaacgatgttgtattgatttttaagaaagtaatttaatttgtaaaacttctgctcgtttacactgcacattgaatacaggtaactaattggaaggagaggggaggtcactcttttgatggtggccctgaacctcattctggttccctgctgcgctgcttggtgtgacccacggaggatccactcccaggatgacgtgctccgtagctctgctgctgatactgggtctgcgatgcagcggcgtgaggcctgggctggttggagaaggtcacaacccttctctgttggtctgccttctgctgaaagactcgagaaccaaccagggaagctgtcctggaggtccctggtcggagagggacatagaatctgtgacctctgacaactgtgaagccaccctgggctacagaaaccacagtcttcccagcaattattacaattcttgaattccttggggattttttactgccctttcaaagcacttaagtgttagatctaacgtgttccagtgtctgtctgaggtgacttaaaaaatcagaacaaaacttctattatccagagtcatgggagagtacaccctttccaggaataatgttttgggaaacactgaaatgaaatcttcccagtattataaattgtgtatttaaaaaaaagaaacttttctgaatgcctacctggcggtgtataccaggcagtgtgccagtttaaaaagatgaaaaagaataaaaacttttgaggaaaaaa

SEQ ID NO: 295744 - DNA, 2633 bp, Homo sapiens
tctctcctttctgagagctaaagaccttatctccctgcggatggcattgcgtgcagttaattatggccagatggactcagccgcttcttcatcgtcttctctcggactctgcagacctacaccgtgcctttaaaggaagcagggccctccctgctgaagcattcagtgagcccaggcaccagcatcttcaaaccgagtcttttctctccttagtgctgctccccgctttccaggccttcctgggatatcttagagctcctgaaggtgcggcactcgccttgaggcactttcttctgagctgtgagctatgggcaagcagtggagggggaagagagcagctgaagcagatgccggttcaacttacttaaagatgtgggacaagctctgaggaagcccccaagacaatgatgtctggttgtgcaccattgaagcaagaacagaaaccatcccagagtggaggacatggcccatgtggtcctcctgttctgagtggctatgagatggagttctgtgtgagctctctacagaaaaagccctgtctccaggcaatcagtggagatctgttaaacgagttgaaacaaaagaggacaaggaattgctgtggctttagacgttgccaggacatgtagaaactcactcaggatttactactgcatccactgtcacttaggcgcaggaggggtcacagtcagaagagagctcagaaatatgctcagcaagtcttgcagaaggaatgtcgtcccaagtttgccaagacatcaatggcgctgttatttgagcacaggtatagcgtggacttactcccttttgtgcagaaggcccccaaagacagtgaagctgagtccaagtacgatcctccttttgggttccggaagttctccagtaaagtccagaccctcttggaactcttgccagagcacgacctccctgaacacttgaaagccaagacctgtcggcgctgtgtggttattggaagcggaggaatactgcacggattagaactgggccacaccctgaaccagttcgatgttgtgataaggttaaacagtgcaccagttgagggatattcagaacatgttggaaataaaactactataaggatgacttatccagagggcgcaccactgtctgaccttgaatattattccaatgacttatttgttgctgttttatttaagagtgttgatttcaactggcttcaagcaatggtaaaaaaggaaaccctgccattctgggtacgactcttcttttggaagcaggtggcagaaaaaatcccactgcagccaaaacatttcaggattttgaatccagttatcatcaaagagactgcctttgacatccttcagtactcagagcctcagtcaaggttctggggccgagataagaacgtccccacaatcggtgtcattgccgttgtcttagccacacatctgtgcgatgaagtcagtttggcgggttttggatatgacctcaatcaacccagaacacctttgcactacttcgacagtcaatgcatggctgctatgaactttcagaccatgcataatgtgacaacggaaaccaagttcctcttaaagctggtcaaagagggagtggtgaaagatctcagtggaggcattgatcgtgaattttgaacacagaaaacctcagttgaaaatgcaactctaactctgagagctgtttttgacagccttcttgatgtatttctccatcctgcagatactttgaagtgcagctcatgtttttaacttttaatttaaaaacacaaaaaaaattttagctcttcccactttttttttcctatttatttgaggtcagtgtttgtttttgcacaccattttgtaaatgaaacttaagaattgaattggaaagacttctcaaagagaattgtatgtaacgatgttgtattgatttttaagaaagtaatttaatttgtaaaacttctgctcgtttacactgcacattgaatacaggtaactaattggaaggagaggggaggtcactcttttgatggtggccctgaacctcattctggttccctgctgcgctgcttggtgtgacccacggaggatccactcccaggatgacgtgctccgtagctctgctgctgatactgggtctgcgatgcagcggcgtgaggcctgggctggttggagaaggtcacaacccttctctgttggtctgccttctgctgaaagactcgagaaccaaccagggaagctgtcctggaggtccctggtcggagagggacatagaatctgtgacctctgacaactgtgaagccaccctgggctacagaaaccacagtcttcccagcaattattacaattcttgaattccttggggattttttactgccctttcaaagcacttaagtgttagatctaacgtgttccagtgtctgtctgaggtgacttaaaaaatcagaacaaaacttctattatccagagtcatgggagagtacaccctttccaggaataatgttttgggaaacactgaaatgaaatcttcccagtattataaattgtgtatttaaaaaaaagaaacttttctgaatgcctacctggcggtgtataccaggcagtgtgccagtttaaaaagatgaaaaagaataaaaacttttgaggaaaaaa

SEQ ID NO: 295745 - DNA, 2452 bp, Homo sapiens
cacgcgcccctcctccgcatctgagcgggggagcggcggcccccagctgaatgggcgcgagagcggcgctgggggcgggtgggggcgcggggtaccgggctggcggccggccggcgccccctcattagtatgcggacgaaggcggcgggctgcgcggagcggcgtcccctgcagccgcggaccgaggcagcggcggcacctgccggccgaggcactgtgaagacagtggtgtgcaaagcagagacccctgcttgcatggaatctgcattctagtgggggagacaagacaaacgtgtaattcaaaagtaaaaaacttatgaagaatcacatgtctcatgattagtgttataaagaaaaaagaaagcatgcatacaggaatatccacataagcaattttgcaatgccaagtgagtacacctatgtgaaactgagaagtgattgctcgaggccttccctgcaatggtacacccgagctcaaagcaagatgagaaggcccagcttgttattaaaagacatcctcaaatgtacattgcttgtgtttggagtgtggatcctttatatcctcaagttaaattatactactgaagaatgtgacatgaaaaaaatgcattatgtggaccctgaccatgtaaagaaggcccccaaagacagtgaagctgagtccaagtacgatcctccttttgggttccggaagttctccagtaaagtccagaccctcttggaactcttgccagagcacgacctccctgaacacttgaaagccaagacctgtcggcgctgtgtggttattggaagcggaggaatactgcacggattagaactgggccacaccctgaaccagttcgatgttgtgataaggttaaacagtgcaccagttgagggatattcagaacatgttggaaataaaactactataaggatgacttatccagagggcgcaccactgtctgaccttgaatattattccaatgacttatttgttgctgttttatttaagagtgttgatttcaactggcttcaagcaatggtaaaaaaggaaaccctgccattctgggtacgactcttcttttggaagcaggtggcagaaaaaatcccactgcagccaaaacatttcaggattttgaatccagttatcatcaaagagactgcctttgacatccttcagtactcagagcctcagtcaaggttctggggccgagataagaacgtccccacaatcggtgtcattgccgttgtcttagccacacatctgtgcgatgaagtcagtttggcgggttttggatatgacctcaatcaacccagaacacctttgcactacttcgacagtcaatgcatggctgctatgaactttcagaccatgcataatgtgacaacggaaaccaagttcctcttaaagctggtcaaagagggagtggtgaaagatctcagtggaggcattgatcgtgaattttgaacacagaaaacctcagttgaaaatgcaactctaactctgagagctgtttttgacagccttcttgatgtatttctccatcctgcagatactttgaagtgcagctcatgtttttaacttttaatttaaaaacacaaaaaaaattttagctcttcccactttttttttcctatttatttgaggtcagtgtttgtttttgcacaccattttgtaaatgaaacttaagaattgaattggaaagacttctcaaagagaattgtatgtaacgatgttgtattgatttttaagaaagtaatttaatttgtaaaacttctgctcgtttacactgcacattgaatacaggtaactaattggaaggagaggggaggtcactcttttgatggtggccctgaacctcattctggttccctgctgcgctgcttggtgtgacccacggaggatccactcccaggatgacgtgctccgtagctctgctgctgatactgggtctgcgatgcagcggcgtgaggcctgggctggttggagaaggtcacaacccttctctgttggtctgccttctgctgaaagactcgagaaccaaccagggaagctgtcctggaggtccctggtcggagagggacatagaatctgtgacctctgacaactgtgaagccaccctgggctacagaaaccacagtcttcccagcaattattacaattcttgaattccttggggattttttactgccctttcaaagcacttaagtgttagatctaacgtgttccagtgtctgtctgaggtgacttaaaaaatcagaacaaaacttctattatccagagtcatgggagagtacaccctttccaggaataatgttttgggaaacactgaaatgaaatcttcccagtattataaattgtgtatttaaaaaaaagaaacttttctgaatgcctacctggcggtgtataccaggcagtgtgccagtttaaaaagatgaaaaagaataaaaacttttgaggaaaaaa

SEQ ID NO: 295746 - DNA, 1961 bp, Homo sapiens
tgaaacctgaaattaacctcttgagagctcagaaatatgctcagcaagtcttgcagaaggaatgtcgtcccaagtttgccaagacatcaatggcgctgttatttgagcacaggtatagcgtggacttactcccttttgtgcagaaggcccccaaagacagtgaagctgagtccaagtacgatcctccttttgggttccggaagttctccagtaaagtccagaccctcttggaactcttgccagagcacgacctccctgaacacttgaaagccaagacctgtcggcgctgtgtggttattggaagcggaggaatactgcacggattagaactgggccacaccctgaaccagttcgatgttgtgataaggttaaacagtgcaccagttgagggatattcagaacatgttggaaataaaactactataaggatgacttatccagagggcgcaccactgtctgaccttgaatattattccaatgacttatttgttgctgttttatttaagagtgttgatttcaactggcttcaagcaatggtaaaaaaggaaaccctgccattctgggtacgactcttcttttggaagcaggtggcagaaaaaatcccactgcagccaaaacatttcaggattttgaatccagttatcatcaaagagactgcctttgacatccttcagtactcagagcctcagtcaaggttctggggccgagataagaacgtccccacaatcggtgtcattgccgttgtcttagccacacatctgtgcgatgaagtcagtttggcgggttttggatatgacctcaatcaacccagaacacctttgcactacttcgacagtcaatgcatggctgctatgaactttcagaccatgcataatgtgacaacggaaaccaagttcctcttaaagctggtcaaagagggagtggtgaaagatctcagtggaggcattgatcgtgaattttgaacacagaaaacctcagttgaaaatgcaactctaactctgagagctgtttttgacagccttcttgatgtatttctccatcctgcagatactttgaagtgcagctcatgtttttaacttttaatttaaaaacacaaaaaaaattttagctcttcccactttttttttcctatttatttgaggtcagtgtttgtttttgcacaccattttgtaaatgaaacttaagaattgaattggaaagacttctcaaagagaattgtatgtaacgatgttgtattgatttttaagaaagtaatttaatttgtaaaacttctgctcgtttacactgcacattgaatacaggtaactaattggaaggagaggggaggtcactcttttgatggtggccctgaacctcattctggttccctgctgcgctgcttggtgtgacccacggaggatccactcccaggatgacgtgctccgtagctctgctgctgatactgggtctgcgatgcagcggcgtgaggcctgggctggttggagaaggtcacaacccttctctgttggtctgccttctgctgaaagactcgagaaccaaccagggaagctgtcctggaggtccctggtcggagagggacatagaatctgtgacctctgacaactgtgaagccaccctgggctacagaaaccacagtcttcccagcaattattacaattcttgaattccttggggattttttactgccctttcaaagcacttaagtgttagatctaacgtgttccagtgtctgtctgaggtgacttaaaaaatcagaacaaaacttctattatccagagtcatgggagagtacaccctttccaggaataatgttttgggaaacactgaaatgaaatcttcccagtattataaattgtgtatttaaaaaaaagaaacttttctgaatgcctacctggcggtgtataccaggcagtgtgccagtttaaaaagatgaaaaagaataaaaacttttgaggaaaaaa

SEQ ID NO: 295747 - DNA, 2994 bp, Homo sapiens
cacgcgcccctcctccgcatctgagcgggggagcggcggcccccagctgaatgggcgcgagagcggcgctgggggcgggtgggggcgcggggtaccgggctggcggccggccggcgccccctcattagtatgcggacgaaggcggcgggctgcgcggagcggcgtcccctgcagccgcggaccgaggcagcggcggcacctgccggccgaggcactgtgaagacagtggtgtgcaaagcagagacccctgcttgcatggaatctgcattctagtgggggagacaagacaaacgtgtaattcaaaagtaaaaaacttatgaagaatcacatgtctcatgattagtgttataaagaaaaaagaaagcatgcatacaggaatatccacataagcaattttgcaatgccaagtgagtacacctatgtgaaactgagaagtgattgctcgaggccttccctgcaatggtacacccgagctcaaagcaagatgagaaggcccagcttgttattaaaagacatcctcaaatgtacattgcttgtgtttggagtgtggatcctttatatcctcaagttaaattatactactgaagaatgtgacatgaaaaaaatgcattatgtggaccctgaccatgtaaagacctacaccgtgcctttaaaggaagcagggccctccctgctgaagcattcagtgagcccaggcaccagcatcttcaaaccgagtcttttctctccttagtgctgctccccgctttccaggccttcctgggatatcttagagctcctgaaggtgcggcactcgccttgaggcactttcttctgagctgtgagctatgggcaagcagtggagggggaagagagcagctgaagcagatgccggttcaacttacttaaagatgtgggacaagctctgaggaagcccccaagacaatgatgtctggttgtgcaccattgaagcaagaacagaaaccatcccagagtggaggacatggcccatgtggtcctcctgttctgagtggctatgagatggagttctgtgtgagctctctacagaaaaagccctgtctccaggcaatcagtggagatctgttaaacgagttgaaacaaaagaggacaaggaattgctgtggctttagacgttgccaggacatgtagaaactcactcaggatttactactgcatccactgtcacttaggcgcaggaggggtcacagtcagaagagagctcagaaatatgctcagcaagtcttgcagaaggaatgtcgtcccaagtttgccaagacatcaatggcgctgttatttgagcacaggtatagcgtggacttactcccttttgtgcagaaggcccccaaagacagtgaagctgagtccaagtacgatcctccttttgggttccggaagttctccagtaaagtccagaccctcttggaactcttgccagagcacgacctccctgaacacttgaaagccaagacctgtcggcgctgtgtggttattggaagcggaggaatactgcacggattagaactgggccacaccctgaaccagttcgatgttgtgataaggttaaacagtgcaccagttgagggatattcagaacatgttggaaataaaactactataaggatgacttatccagagggcgcaccactgtctgaccttgaatattattccaatgacttatttgttgctgttttatttaagagtgttgatttcaactggcttcaagcaatggtaaaaaaggaaaccctgaacgtccccacaatcggtgtcattgccgttgtcttagccacacatctgtgcgatgaagtcagtttggcgggttttggatatgacctcaatcaacccagaacacctttgcactacttcgacagtcaatgcatggctgctatgaactttcagaccatgcataatgtgacaacggaaaccaagttcctcttaaagctggtcaaagagggagtggtgaaagatctcagtggaggcattgatcgtgaattttgaacacagaaaacctcagttgaaaatgcaactctaactctgagagctgtttttgacagccttcttgatgtatttctccatcctgcagatactttgaagtgcagctcatgtttttaacttttaatttaaaaacacaaaaaaaattttagctcttcccactttttttttcctatttatttgaggtcagtgtttgtttttgcacaccattttgtaaatgaaacttaagaattgaattggaaagacttctcaaagagaattgtatgtaacgatgttgtattgatttttaagaaagtaatttaatttgtaaaacttctgctcgtttacactgcacattgaatacaggtaactaattggaaggagaggggaggtcactcttttgatggtggccctgaacctcattctggttccctgctgcgctgcttggtgtgacccacggaggatccactcccaggatgacgtgctccgtagctctgctgctgatactgggtctgcgatgcagcggcgtgaggcctgggctggttggagaaggtcacaacccttctctgttggtctgccttctgctgaaagactcgagaaccaaccagggaagctgtcctggaggtccctggtcggagagggacatagaatctgtgacctctgacaactgtgaagccaccctgggctacagaaaccacagtcttcccagcaattattacaattcttgaattccttggggattttttactgccctttcaaagcacttaagtgttagatctaacgtgttccagtgtctgtctgaggtgacttaaaaaatcagaacaaaacttctattatccagagtcatgggagagtacaccctttccaggaataatgttttgggaaacactgaaatgaaatcttcccagtattataaattgtgtatttaaaaaaaagaaacttttctgaatgcctacctggcggtgtataccaggcagtgtgccagtttaaaaagatgaaaaagaataaaaacttttgaggaaaaaa

SEQ ID NO: 295748 - DNA, 2246 bp, Homo sapiens
cacgcgcccctcctccgcatctgagcgggggagcggcggcccccagctgaatgggcgcgagagcggcgctgggggcgggtgggggcgcggggtaccgggctggcggccggccggcgccccctcattagtatgcggacgaaggcggcgggctgcgcggagcggcgtcccctgcagccgcggaccgaggcagcggcggcacctgccggccgagcaatgccaagtgagtacacctatgtgaaactgagaagtgattgctcgaggccttccctgcaatggtacacccgagctcaaagcaagatgagaaggcccagcttgttattaaaagacatcctcaaatgtacattgcttgtgtttggagtgtggatcctttatatcctcaagttaaattatactactgaagaatgtgacatgaaaaaaatgcattatgtggaccctgaccatgtaaagagagctcagaaatatgctcagcaagtcttgcagaaggaatgtcgtcccaagtttgccaagacatcaatggcgctgttatttgagcacaggtatagcgtggacttactcccttttgtgcagaaggcccccaaagacagtgaagctgagtccaagtacgatcctccttttgggttccggaagttctccagtaaagtccagaccctcttggaactcttgccagagcacgacctccctgaacacttgaaagccaagacctgtcggcgctgtgtggttattggaagcggaggaatactgcacggattagaactgggccacaccctgaaccagttcgatgttgtgataagagtgttgatttcaactggcttcaagcaatggtaaaaaaggaaaccctgccattctgggtacgactcttcttttggaagcaggtggcagaaaaaatcccactgcagccaaaacatttcaggattttgaatccagttatcatcaaagagactgcctttgacatccttcagtactcagagcctcagtcaaggttctggggccgagataagaacgtccccacaatcggtgtcattgccgttgtcttagccacacatctgtgcgatgaagtcagtttggcgggttttggatatgacctcaatcaacccagaacacctttgcactacttcgacagtcaatgcatggctgctatgaactttcagaccatgcataatgtgacaacggaaaccaagttcctcttaaagctggtcaaagagggagtggtgaaagatctcagtggaggcattgatcgtgaattttgaacacagaaaacctcagttgaaaatgcaactctaactctgagagctgtttttgacagccttcttgatgtatttctccatcctgcagatactttgaagtgcagctcatgtttttaacttttaatttaaaaacacaaaaaaaattttagctcttcccactttttttttcctatttatttgaggtcagtgtttgtttttgcacaccattttgtaaatgaaacttaagaattgaattggaaagacttctcaaagagaattgtatgtaacgatgttgtattgatttttaagaaagtaatttaatttgtaaaacttctgctcgtttacactgcacattgaatacaggtaactaattggaaggagaggggaggtcactcttttgatggtggccctgaacctcattctggttccctgctgcgctgcttggtgtgacccacggaggatccactcccaggatgacgtgctccgtagctctgctgctgatactgggtctgcgatgcagcggcgtgaggcctgggctggttggagaaggtcacaacccttctctgttggtctgccttctgctgaaagactcgagaaccaaccagggaagctgtcctggaggtccctggtcggagagggacatagaatctgtgacctctgacaactgtgaagccaccctgggctacagaaaccacagtcttcccagcaattattacaattcttgaattccttggggattttttactgccctttcaaagcacttaagtgttagatctaacgtgttccagtgtctgtctgaggtgacttaaaaaatcagaacaaaacttctattatccagagtcatgggagagtacaccctttccaggaataatgttttgggaaacactgaaatgaaatcttcccagtattataaattgtgtatttaaaaaaaagaaacttttctgaatgcctacctggcggtgtataccaggcagtgtgccagtttaaaaagatgaaaaagaataaaaacttttgaggaaaaaa

SEQ ID NO: 295749 - DNA, 2255 bp, Homo sapiens
gccagtgagtcctggaaggcagtgctggctgggacatggaaggcacacagagaagttcagactcaccatgatagccaataggcagtcatcctagattcttttttggtttcactgtttaaaaattgttttctggccaggcgcagtggctcatgcctataatcccagcactttgggaggccaaggcaggaggatcgcttgagctcaggagttcaagaccagcctgggcaacatagagacagcttgtctctacagaaaatcaaaaagtcagccaggcatggtggactagattttcccttctgattccttttttgaaattctggcaagaactaacatctgagcacaatggaaaatttctgaggatattttactggcacccagagaaagtcccaaatgtaatatgcttagattgagtaaaaatattagggctagatgaaattgcttgacattcagggattagatacaagtgttcgctcaagtactaaaggctgcattcctcgaaatcctagaaagacagagctgggaggggagatgaggctgcaaaccatgcactcattcttagtcataagaagacgtggaggacatgacatggatactgcctggtgtacagagatggttgatggcctgctttgtcagtgtgtctttgtcctttttatttaaataggttaaacagtgcaccagttgagggatattcagaacatgttggaaataaaactactataaggatgacttatccagagggcgcaccactgtctgaccttgaatattattccaatgacttatttgttgctgttttatttaagagtgttgatttcaactggcttcaagcaatggtaaaaaaggaaaccctgccattctgggtacgactcttcttttggaagcaggtggcagaaaaaatcccactgcagccaaaacatttcaggattttgaatccagttatcatcaaagagactgcctttgacatccttcagtactcagagcctcagtcaaggttctggggccgagataagaacgtccccacaatcggtgtcattgccgttgtcttagccacacatctgtgcgatgaagtcagtttggcgggttttggatatgacctcaatcaacccagaacacctttgcactacttcgacagtcaatgcatggctgctatgaactttcagaccatgcataatgtgacaacggaaaccaagttcctcttaaagctggtcaaagagggagtggtgaaagatctcagtggaggcattgatcgtgaattttgaacacagaaaacctcagttgaaaatgcaactctaactctgagagctgtttttgacagccttcttgatgtatttctccatcctgcagatactttgaagtgcagctcatgtttttaacttttaatttaaaaacacaaaaaaaattttagctcttcccactttttttttcctatttatttgaggtcagtgtttgtttttgcacaccattttgtaaatgaaacttaagaattgaattggaaagacttctcaaagagaattgtatgtaacgatgttgtattgatttttaagaaagtaatttaatttgtaaaacttctgctcgtttacactgcacattgaatacaggtaactaattggaaggagaggggaggtcactcttttgatggtggccctgaacctcattctggttccctgctgcgctgcttggtgtgacccacggaggatccactcccaggatgacgtgctccgtagctctgctgctgatactgggtctgcgatgcagcggcgtgaggcctgggctggttggagaaggtcacaacccttctctgttggtctgccttctgctgaaagactcgagaaccaaccagggaagctgtcctggaggtccctggtcggagagggacatagaatctgtgacctctgacaactgtgaagccaccctgggctacagaaaccacagtcttcccagcaattattacaattcttgaattccttggggattttttactgccctttcaaagcacttaagtgttagatctaacgtgttccagtgtctgtctgaggtgacttaaaaaatcagaacaaaacttctattatccagagtcatgggagagtacaccctttccaggaataatgttttgggaaacactgaaatgaaatcttcccagtattataaattgtgtatttaaaaaaaagaaacttttctgaatgcctacctggcggtgtataccaggcagtgtgccagtttaaaaagatgaaaaagaataaaaacttttgaggaaaaaa

SEQ ID NO: 295750 - DNA, 1006 bp, Homo sapiens
cacgcgcccctcctccgcatctgagcgggggagcggcggcccccagctgaatgggcgcgagagcggcgctgggggcgggtgggggcgcggggtaccgggctggcggccggccggcgccccctcattagtatgcggacgaaggcggcgggctgcgcggagcggcgtcccctgcagccgcggaccgaggcagcggcggcacctgccggccgagcaatgccaagtgagtacacctatgtgaaactgagaagtgattgctcgaggccttccctgcaatggtacacccgagctcaaagcaagatgagaaggcccagcttgttattaaaagacatcctcaaatgtacattgcttgtgtttggagtgtggatcctttatatcctcaagttaaattatactactgaagaatgtgacatgaaaaaaatgcattatgtggaccctgaccatgtaaagagagctcagaaatatgctcagcaagtcttgcagaaggaatgtcgtcccaagtttgccaagacatcaatggcgctgttatttgagcacaggtatagcgtggacttactcccttttgtgcagaaggcccccaaagacagtgaagctgagtccaagtacgatcctccttttgggttccggaagttctccagtaaagtccagaccctcttggaactcttgccagagcacgacctccctgaacacttgaaagccaagacctgtcggcgctgtgtggttattggaagcggaggaatactgcacggattagaactgggccacaccctgaaccagttcgatgttgtgataaggttaaacagtgcaccagttgagggatattcagaacatgttggaaataaaactactataaggatgacttatccagagggcgcaccactgtctgaccttgaatattattccaatgacttatttgttgctgttttatttaagagtgttgatttcaactggcttcaagcaatggtaaaaaaggaaaccctgccattctgggtacgacgcaggtggtgtg

SEQ ID NO: 295751 - DNA, 1018 bp, Homo sapiens
cacgcgcccctcctccgcatctgagcgggggagcggcggcccccagctgaatgggcgcgagagcggcgctgggggcgggtgggggcgcggggtaccgggctggcggccggccggcgccccctcattagtatgcggacgaaggcggcgggctgcgcggagcggcgtcccctgcagccgcggaccgaggcagcggcggcacctgccggccgaggcactgtgaagacagtggtgtgcaaagcagagacccctgcttgcatggaatctgcattctagtgggggagacaagacaaacgtgtaattcaaaagtaaaaaacttatgaagaatcacatgtctcatgattagtgttataaagaaaaaagaaagcatgcatacaggaatatccacataagcaattttgcaatgccaagtgagtacacctatgtgaaactgagaagtgattgctcgaggccttccctgcaatggtacacccgagctcaaagcaagatgagaaggcccagcttgttattaaaagacatcctcaaatgtacattgcttgtgtttggagtgtggatcctttatatcctcaagttaaattatactactgaagaatgtgacatgaaaaaaatgcattatgtggaccctgaccatgtaaagacctacaccgtgcctttaaaggaagcagggccctccctgctgaagcattcagtgagcccaggcaccagcatcttcaaaccgagtcttttctctccttagtgctgctccccgctttccaggccttcctgggatatcttagaggtaagaaaactgaagcctcgacctagggagaaatgctttaacaaagacgacgctgctagttaaatcaatctagaactgagtccagcctccagatctcctgattatttttttttctaacagttgatgggatgaaatctacataagatttaatcctttgaagcccattgtttgatgagtattaaaaacttatgcagccacgcctctgtcaccacaatcccgctttagcacattcccatggcccaa

SEQ ID NO: 295752 - DNA, 770 bp, Homo sapiens
ttctgattatccaactgagtggacaaagatgggcaagtggcctgcggggatcgggcctgctggatgcttgatgcacgactgcttgatgcttgagtgctgtgggagacaggtgctcagatattgctggtgagagtggaaaccaaaggtggtctttttggaaggtaatttggcataaccatccaaattgaaactgtatacatactatacatatgctgacccagaaattctacttataaagaatttatggtaatcataggacagtgtctgtaataaaacactggaaacaacctcaatgtttaaagtattaaataaattagagtacattcatattcagactatatagctgttacggtagatcttggtgtggaaatgggatgatgtcaagtatttattaagtgagggagaaacgcaaattacaaaacagtacctctaattgctccatgtatatgattaatatatatatatatatatatatgtcttttcctatatgtatatatataaggaaactgccttatttttgaagttgctggttgggatttctctgttctttcagcccctgggggacacctcagttaaagcaagatcagtctgttggccgagagtggtggctcacgcctgtaatcccagcactttgggagtccgaggcgcgtggatcacctgaggtcaagttctagaccagcctggccaacatggcgaaaccccatctctactaaaaataaaaaataataataaattaaaaaaataaaaaaaattagccgggcatggtggcg

SEQ ID NO: 295753 - DNA, 1606 bp, Homo sapiens
cttgacagtctgaaggcacaggtgataagattttgttctctgtgaatatttttaaactaataggttatgtttttaaatcttcaatttggtaaaaaactgaaacgtcttggaatattggttctattagagttaaatatggtaaaacaggaaagcgtgtttattttcagataaggggaatttatacttttcattaaagtcttggagtcttaggaaaatgttgagggtttgtcttcccccagtgtcattaatactaatgaactattagatcaaattcacttatacatttaatatcatagttattcaaaatcaggactttaaatatttttttctcccagttcatatttctttgtgcgaaaattgaatttgtatgaaaagttagataattaagctaatcaagtatgaagtatacactcttcctaagtgaatttaaataatgtaatgcttttaaataaaagcagtggtcccaccacatttttttcagcatagtagctggcattttgttatcattagccagagtagcttcagcatataagttattgatgttttccaacttcaaaagtgcattttatgcctcccagtaaatttgataatgatttgtcacagctttgtcatcttttgacttttgcttatgggcctcacttcgtacaactataacatgaaaaaggattgtcctaaagtaagggaatcagttaatggtaggatgaagaaactgtaaaaactcctagaaaaaaaacctgtgtgcatttttctggaaagttttcaaactgtgtaattcagttttcattcaattatataatttggttatatgctttaaaaaacatttgtctaaatgttcccggttttcttctggtcttagagtcagctgagtgctggctatgcagccactcgtatttttgcatccagaaaggagtaactccctttatatgaagatttttttttttaagcttagatgctatgtaagagaaaactatttgtaatcacatagtacccagggaggagtgatgaatgcttttttaaaaaaggatatttaagtatattatgtaatttaaatataaattatcaaactaaaaaacttcagcttttaaaactttctaaacaaaatgaagcaaagtacattaattccttctatcttaaatctgagactttttattttcccttgggtatatatttctctcagtgttaggtagatgttaattcaaccatcctacattctctatataaaattacactcattttacatgaaagcaaaataatgtcgttactttcatggaactgtgttctaacaggcttataatctcattctgtgcttctggtaatggcgtataccagtctgatgattcttaccatccttattcttacattactcttccaattgttttgattttaactggtggtcatgtaagttcctcggtggcagggatttatctggttcatttactgttatatatccttgtggaataggacagtgcctggcatataataggcacttttggaatgaatgtaaaatactagttgaaatatgtattcatctggcatccatggtacccatcatctgtattaaagggcttaaaaaagcatcattgcaataaaccatactaacccacca

SEQ ID NO: 295754 - DNA, 2534 bp, Homo sapiens
cttgacagtctgaaggcacaggtgataagattttgttctctgtgaatatttttaaactaataggttatgtttttaaatcttcaatttggtaaaaaactgaaacgtcttggaatattggttctattagagttaaatatggtaaaacaggaaagcgtgtttattttcagataaggggaatttatacttttcattaaagtcttggagtcttaggaaaatgttgagggtttgtcttcccccagtgtcattaatactaatgaactattagatcaaattcacttatacatttaatatcatagttattcaaaatcaggactttaaatatttttttctcccagttcatatttctttgtgcgaaaattgaatttgtatgaaaagttagataattaagctaatcaagtatgaagtatacactcttcctaagtgaatttaaataatgtaatgcttttaaataaaagcagtggtcccaccacatttttttcagcatagtagctggcattttgttatcattagccagagtagcttcagcatataagttattgatgttttccaacttcaaaagtgcattttatgcctcccagtaaatttgataatgatttgtcacagctttgtcatcttttgacttttgcttatgggcctcacttcgtacaactataacatgaaaaaggattgtcctaaagtaagggaatcagttaatggtaggatgaagaaactgtaaaaactcctagaaaaaaaacctgtgtgcatttttctggaaagttttcaaactgtgtaattcagttttcattcaattatataatttggttatatgctttaaaaaacatttgtctaaatgttcccggttttcttctggtcttagagtcagctgagtgctggctatgcagccactcgtatttttgcatccagaaaggagtaactccctttatatgaagatttttttttttaagcttagatgctatgtaagagaaaactatttgtaatcacatagtacccagggaggagtgatgaatgcttttttaaaaaaggatatttaagtatattatgtaatttaaatataaattatcaaactaaaaaacttcagcttttaaaactttctaaacaaaatgaagcaaagtacattaattccttctatcttaaatctgagactttttattttcccttgggtatatatttctctcagtgttaggtagatgttaattcaaccatcctacattctctatataaaattacactcattttacatgaaagcaaaataatgtcgttactttcatggaactgtgttctaacaggcttataatctcattctgtgcttctggtaatggcgtataccagtctgatgattcttaccatccttattcttacattactcttccaattgttttgattttaactggtggtcatgtaagttcctcggtggcagggatttatctggttcatttactgttatatatccttgtggaataggacagtgcctggcatataataggcacttttggaatgaatgtaaaatactagttgaaatatgtattcatctggcatccatggtacccatcatctgtattaaagggcttaaaaaagcatcattgcaataaaccatactaacccaccactaaagtcacagtcataattgaagtgcacccaaaataaggtccagtgactgtaccttagcttttacttcagacatgtccaaaacttgtgagaacatacaatttaaagttgaaaactcatcattttgggctatttttgaatagggctgaaatatggtgacatgtcaggcactcagttttttggagctgtcttaaaggtgaggtggaaagtgagagatgattttgctctaattacccacacattctccctaaccctccattttaagacacttagctataatagcttaagactatcaaaactgcttttgtgattctcagtaggatctagttcaaagccatctcagtgctagtgattggtaattgttaatttgatggtaattaccctacttgtaaagttgacattcatactggctaatcctccctgcccctagtcgtggacaatgaaacagtgagtggctggtgaattagatcagattcaaactaagccattccttgatgctattcttcactgctgttccttagggtatctaaatgtgttatttataaacatttttgggggctcctgcctgcaaacttcggtaggtgttggtcttccccacctctacaactgagccaaggacttgttctgaaaggtgagtaataaataagggaacaaggtttctattttctgtgtttgtaattaccagattttcacctctgtttatatattattctgatgtaaaagaacctcatagttatataaaattagaccttttgtaaataaatataatttattagaaaaaatggtatcttttactaaattggatttgtgtcagttttttcctttaagcaccactcaggcagcaagctctatgctgtgagagttgctggaggcccacgttatgttttctcagtgtaattcctctttttcttgataaaaagacttaaaaa

SEQ ID NO: 295755 - DNA, 2480 bp, Homo sapiens
cttgacagtctgaaggcacaggtgataagattttgttctctgtgaatatttttaaactaataggttatgtttttaaatcttcaatttggtaaaaaactgaaacgtcttggaatattggttctattagagttaaatatggtaaaacaggaaagcgtgtttattttcagataaggggaatttatacttttcattaaagtcttggagtcttaggaaaatgttgagggtttgtcttcccccagtgtcattaatactaatgaactattagatcaaattcacttatacatttaatatcatagttattcaaaatcaggactttaaatatttttttctcccagttcatatttctttgtgcgaaaattgaatttgtatgaaaagttagataattaagctaatcaagtatgaagtatacactcttcctaagtgaatttaaataatgtaatgcttttaaataaaagcagtggtcccaccacatttttttcagcatagtagctggcattttgttatcattagccagagtagcttcagcatataagttattgatgttttccaacttcaaaagtgcattttatgcctcccagtaaatttgataatgatttgtcacagctttgtcatcttttgacttttgcttatgggcctcacttcgtacaactataacatgaaaaaggattgtcctaaagtaagggaatcagttaatggtaggatgaagaaactgtaaaaactcctagaaaaaaaacctgtgtgcatttttctggaaagttttcaaactgtgtaattcagttttcattcaattatataatttggttatatgctttaaaaaacatttgtctaaatgttcccggttttcttctggtcttagagtcagctgagtgctggctatgcagccactcgtatttttgcatccagaaaggagtaactccctttatatgaagatttttttttttaagcttagatgctatgtaagagaaaactatttgtaatcacatagtacccagggaggagtgatgaatgcttttttaaaaaaggatatttaagtatattatgtaatttaaatataaattatcaaactaaaaaacttcagcttttaaaactttctaaacaaaatgaagcaaagtacattaattccttctatcttaaatctgagactttttattttcccttgggtatatatttctctcagtgttaggtagatgttaattcaaccatcctacattctctatataaaattacactcattttacatgaaagcaaaataatgtcgttactttcatggaactgtgttctaacaggcttataatctcattctgtgcttctggtaatggcgtataccagtctgatgattcttaccatccttattcttacattactcttccaattgttttgattttaactggtggtcatgtaagttcctcggtggcagggatttatctggttcatttactgttatatatccttgtggaataggacagtgcctggcatataataggcacttttggaatgaatgtaaaatactagttgaaatatgtattcatctggcatccatggtacccatcatctgtattaaagggcttaaaaaagcatcattgcaataaaccatactaacccaccactaaagtcacagtcataattgaagtgcacccaaaataaggtccagtgactgtaccttagcttttacttcagacatgtccaaaacttgtgagaacatacaatttaaagttgaaaactcatcattttgggctatttttgaatagggctgaaatatggtgacatgtcaggcactcagttttttggagctgtcttaaaggtgaggtggaaagtgagagatgattttgctctaattacccacacattctccctaaccctccattttaagacacttagctataatagcttaagactatcatgattggtaattgttaatttgatggtaattaccctacttgtaaagttgacattcatactggctaatcctccctgcccctagtcgtggacaatgaaacagtgagtggctggtgaattagatcagattcaaactaagccattccttgatgctattcttcactgctgttccttagggtatctaaatgtgttatttataaacatttttgggggctcctgcctgcaaacttcggtaggtgttggtcttccccacctctacaactgagccaaggacttgttctgaaaggtgagtaataaataagggaacaaggtttctattttctgtgtttgtaattaccagattttcacctctgtttatatattattctgatgtaaaagaacctcatagttatataaaattagaccttttgtaaataaatataatttattagaaaaaatggtatcttttactaaattggatttgtgtcagttttttcctttaagcaccactcaggcagcaagctctatgctgtgagagttgctggaggcccacgttatgttttctcagtgtaattcctctttttcttgataaaaagacttaaaaa

SEQ ID NO: 295756 - DNA, 2382 bp, Homo sapiens
cttgacagtctgaaggcacaggtgataagattttgttctctgtgaatatttttaaactaataggttatgtttttaaatcttcaatttggtaaaaaactgaaacgtcttggaatattggttctattagagttaaatatggtaaaacaggaaagcgtgtttattttcagataaggggaatttatacttttcattaaagtcttggagtcttaggaaaatgttgagggtttgtcttcccccagtgtcattaatactaatgaactattagatcaaattcacttatacatttaatatcatagttattcaaaatcaggactttaaatatttttttctcccagttcatatttctttgtgcgaaaattgaatttgtatgaaaagttagataattaagctaatcaagtatgaagtatacactcttcctaagtgaatttaaataatgtaatgcttttaaataaaagcagtggtcccaccacatttttttcagcatagtagctggcattttgttatcattagccagagtagcttcagcatataagttattgatgttttccaacttcaaaagtgcattttatgcctcccagtaaatttgataatgatttgtcacagctttgtcatcttttgacttttgcttatgggcctcacttcgtacaactataacatgaaaaaggattgtcctaaagtaagggaatcagttaatggtaggatgaagaaactgtaaaaactcctagaaaaaaaacctgtgtgcatttttctggaaagttttcaaactgtgtaattcagttttcattcaattatataatttggttatatgctttaaaaaacatttgtctaaatgttcccggttttcttctggtcttagagtcagctgagtgctggctatgcagccactcgtatttttgcatccagaaaggagtaactccctttatatgaagatttttttttttaagcttagatgctatgtaagagaaaactatttgtaatcacatagtacccagggaggagtgatgaatgcttttttaaaaaaggatatttaagtatattatgtaatttaaatataaattatcaaactaaaaaacttcagcttttaaaactttctaaacaaaatgaagcaaagtacattaattccttctatcttaaatctgagactttttattttcccttgggtatatatttctctcagtgttaggtagatgttaattcaaccatcctacattctctatataaaattacactcattttacatgaaagcaaaataatgtcgttactttcatggaactgtgttctaacaggcttataatctcattctgtgcttctggtaatggcgtataccagtctgatgattcttaccatccttattcttacattactcttccaattgttttgattttaactggtggtcatgtaagttcctcggtggcagggatttatctggttcatttactgttatatatccttgtggaataggacagtgcctggcatataataggcacttttggaatgaatgtaaaatactagttgaaatatgtattcatctggcatccatggtacccatcatctgtattaaagggcttaaaaaagcatcattgcaataaaccatactaacccaccactaaagtcacagtcataattgaagtgcacccaaaataaggtccagtgactgtaccttagcttttacttcagacatgtccaaaacttgtgagaacatacaatttaaagttgaaaactcatcattttgggctatttttgaatagggctgaaatatggtgacatgtcaggcactcagttttttggagctgtcttaaaggtgaggtggaaagtgagagatgattttgctctaattacccacacattctccctaaccctccattttaagacacttagctataatagcttaagactatcaaaactgcttttgtgattctcagtaggatctagttcaaagccatctcagtgctagtgattggtaattgttaatttgatggtaattaccctacttgtaaagttgacattcatactggctaatcctccctgcccctagtcgtggacaatgaaacagtgagtggctggtgaattagatcagattcaaactaagccattccttgatgctattcttcactgctgttccttagggtatctaaatgtgttatttataaacatttttgggggctcctgcctgcaaacttcggtaggtgttggtcttccccacctctacaactgagccaaggacttgttctgaaaggtgagtaataaataagggaacaaggtttctattttctgtgtttgtaattaccagattttcacctctgtttatatattattctgatgtaaaagaacctcatagttatataaaattagaccttttgtaaataaatataatttattaga

SEQ ID NO: 295757 - DNA, 2328 bp, Homo sapiens
cttgacagtctgaaggcacaggtgataagattttgttctctgtgaatatttttaaactaataggttatgtttttaaatcttcaatttggtaaaaaactgaaacgtcttggaatattggttctattagagttaaatatggtaaaacaggaaagcgtgtttattttcagataaggggaatttatacttttcattaaagtcttggagtcttaggaaaatgttgagggtttgtcttcccccagtgtcattaatactaatgaactattagatcaaattcacttatacatttaatatcatagttattcaaaatcaggactttaaatatttttttctcccagttcatatttctttgtgcgaaaattgaatttgtatgaaaagttagataattaagctaatcaagtatgaagtatacactcttcctaagtgaatttaaataatgtaatgcttttaaataaaagcagtggtcccaccacatttttttcagcatagtagctggcattttgttatcattagccagagtagcttcagcatataagttattgatgttttccaacttcaaaagtgcattttatgcctcccagtaaatttgataatgatttgtcacagctttgtcatcttttgacttttgcttatgggcctcacttcgtacaactataacatgaaaaaggattgtcctaaagtaagggaatcagttaatggtaggatgaagaaactgtaaaaactcctagaaaaaaaacctgtgtgcatttttctggaaagttttcaaactgtgtaattcagttttcattcaattatataatttggttatatgctttaaaaaacatttgtctaaatgttcccggttttcttctggtcttagagtcagctgagtgctggctatgcagccactcgtatttttgcatccagaaaggagtaactccctttatatgaagatttttttttttaagcttagatgctatgtaagagaaaactatttgtaatcacatagtacccagggaggagtgatgaatgcttttttaaaaaaggatatttaagtatattatgtaatttaaatataaattatcaaactaaaaaacttcagcttttaaaactttctaaacaaaatgaagcaaagtacattaattccttctatcttaaatctgagactttttattttcccttgggtatatatttctctcagtgttaggtagatgttaattcaaccatcctacattctctatataaaattacactcattttacatgaaagcaaaataatgtcgttactttcatggaactgtgttctaacaggcttataatctcattctgtgcttctggtaatggcgtataccagtctgatgattcttaccatccttattcttacattactcttccaattgttttgattttaactggtggtcatgtaagttcctcggtggcagggatttatctggttcatttactgttatatatccttgtggaataggacagtgcctggcatataataggcacttttggaatgaatgtaaaatactagttgaaatatgtattcatctggcatccatggtacccatcatctgtattaaagggcttaaaaaagcatcattgcaataaaccatactaacccaccactaaagtcacagtcataattgaagtgcacccaaaataaggtccagtgactgtaccttagcttttacttcagacatgtccaaaacttgtgagaacatacaatttaaagttgaaaactcatcattttgggctatttttgaatagggctgaaatatggtgacatgtcaggcactcagttttttggagctgtcttaaaggtgaggtggaaagtgagagatgattttgctctaattacccacacattctccctaaccctccattttaagacacttagctataatagcttaagactatcatgattggtaattgttaatttgatggtaattaccctacttgtaaagttgacattcatactggctaatcctccctgcccctagtcgtggacaatgaaacagtgagtggctggtgaattagatcagattcaaactaagccattccttgatgctattcttcactgctgttccttagggtatctaaatgtgttatttataaacatttttgggggctcctgcctgcaaacttcggtaggtgttggtcttccccacctctacaactgagccaaggacttgttctgaaaggtgagtaataaataagggaacaaggtttctattttctgtgtttgtaattaccagattttcacctctgtttatatattattctgatgtaaaagaacctcatagttatataaaattagaccttttgtaaataaatataatttattaga

SEQ ID NO: 295758 - DNA, 996 bp, Homo sapiens
aggtgcatagtggacctagaactcccagaggccctgtgtcctccattcccccacacctggctggcaggaagctccggcagaccacgtgcatgtgcctgcacctgctttatgggagaattgagccctggtgacatttgtttcccccgggtcaccctggcggagtagcccttgggcacccctcacctcgagttggaggtctcggctcctcatgaccgccatgttcttctcctcactgagctgtgcgtagcgcatggctaagttgtagttgtcgtccttcaccttgaccagctcgtcattgtagctgtcccgctcttccttcatcttgtagtaccgctcctggaaggttagcagctccacgcgcgtcagcgtcatctgcttcttctcatcctccagctgccgcaacctggccagcagctcgcagcgttgcaggtccttggccttcatctgctgctgcagcttgatgacctcgttcatcaggaagacggacagaagaaataaatttgatggtatgtcaaccccgattgtttggtgaagccgcctgcagtactgtttcgagaaacattccaaagttacatccaagctcagtgggaaagcatgctgattactgatgtctgccatggatgccagagagtcgcagctgatgagccacttaccaccagccacgctgggggacagtgattatcaaaccttctaaactgatccatagaaagaaaaacatttaacattgtggtctagtgaccatagacaaagataactctacaagtacatgtgtatacacatgtacataatgtaaaattaaaacaagcttcacaaaccatatttattacctttactgaatatgataaaccccccctccagaagtcaggctagaaaagcttgtggaacccttctcggaatatttttaaacagataaagtacatcagattacaaaagaaaccaattataataaaatccagttatcaaatattaaataaatttgtgtttcagtaacataaa

SEQ ID NO: 295759 - DNA, 848 bp, Homo sapiens
atttggttcctgttttaatgccctgtgaaataagatttcgccgcctatcatctgctaactgctacggactcaggctcaccgaaaggcctgcgcttcacccaggtgccagcctccacaggttccaacccaggagcccaagttccctttggccctgactcagacactattaggactggcaagtgataagcagagtcccatactctcctattgactcggactaccatatcttgatcatccttttctgtaggaatcggatataacatcatccgggtacccatggccagctgtgacttctccatccgcacctacacctatgcagacacccctgatgatttccagttgcacaacttcagcctcccagaggaagataccaagctcaagatacccctgattcaccgagccctgcagttggcccagcgtcccgtttcactccttgccagcccctggacatcacccacttggctcaagaccaatggagcggtgaatgggaaggggtcactcaagggacagcccggagacatctaccaccagacctgggccagatactttgtgaagttcctggatgcctatgctgagcacaagttacagttctgggcagtgacagctgaaaatgagccttctgctgggctgttgagtggataccccttccagtgcctgggcttcacccctgaacatcagcgagacttcattgcccgtgacctaggtcctaccctcgccaacagtactcaccacaatgtccgcctactcatgctggatgaccaacgcttgctgctgccccactgggcaaaggtggtatgacagacccagaagcagcaaagaccccaaagggagatcctctagatcaccag

SEQ ID NO: 295760 - DNA, 756 bp, Homo sapiens
atttggttcctgttttaatgccctgtgaaataagatttcgccgcctatcatctgctaactgctacggactcaggctcaccgaaaggcctgcgcttcacccaggtgccagcctccacaggttccaacccaggagcccaagttccctttggccctgactcagacactattaggactggcaagtgataagcagagtcccatactctcctattgactcggactaccatatcttgatcatccttttctgtaggaatcggatataacatcatccgggtacccatggccagctgtgacttctccatccgcacctacacctatgcagacacccctgatgatttccagttgcacaacttcagcctcccagaggaagataccaagctcaagatacccctgattcaccgagccctgcagttggcccagcgtcccgtttcactccttgccagcccctggacatcacccacttggctcaagaccaatggagcggtgaatgggaaggggtcactcaagggacagcccggagacatctaccaccagacctgggccagatactttgtgaagtaagggatcagcaaggatgtgggatcaggactggcctcccatttagccatgctgatctgtgtcccaaccctcaacctagttccacttccagatctgcctgtcctcagctcacctttctaccttctgggcctttcagccttgggcctgtcaatcttgcccactccatcaggcttcctgttctctcggtctggcccactttct

SEQ ID NO: 295761 - DNA, 471 bp, Homo sapiens
ttggcaggatcacactctcagcttctcctccctgctccctagctcctctaaggatgtgcctcttaccatcaaggatcctgctgtgggcttcctggagacaatctcacctggctactccattcacacctacctgtggcgtcgccagtgatggagcagatactcaaggaggcactgggctcagcctgggcattaaagggacagagtcagctcacacgctgtctgtgactaaagagggcacagcagggccagtgtgagcttacagcgacgtaagcccaggggcaatggtttgggtgactcactttcccctctaggtggtgccaggggctggaggcccctagaaaaagatcagtaagccccagtgtccccccagcccccatgcttatgtgaacatgcgctgtgtgctgcttgctttggaaactgggcctgggtccaggacaacggtggcctaatgagagggcgccacggtgatcc

SEQ ID NO: 295762 - DNA, 2572 bp, Homo sapiens
ccacatcgggaagccggaattacttgcagggctaacctagtgcctatagctaaggcaggtacctgcatccttgtttttgtttagtggatcctctatccttcagagactctggaacccctgtggtcttctcttcatctaatgaccctgaggggatggagttttcaagtccttccagagaggaatgtcccaagcctttgagtagggtaagcatcatggctggcagcctcacaggattgcttctacttcaggcagtgtcgtgggcatcaggtgcccgcccctgcatccctaaaagcttcggctacagctcggtggtgtgtgtctgcaatgccacatactgtgactcctttgaccccccgacctttcctgcccttggtaccttcagccgctatgagagtacacgcagtgggcgacggatggagctgagtatggggcccatccaggctaatcacacgggcacaggcctgctactgaccctgcagccagaacagaagttccagaaagtgaagggatttggaggggccatgacagatgctgctgctctcaacatccttgccctgtcaccccctgcccaaaatttgctacttaaatcgtacttctctgaagaaggaatcggatataacatcatccgggtacccatggccagctgtgacttctccatccgcacctacacctatgcagacacccctgatgatttccagttgcacaacttcagcctcccagaggaagataccaagctcaagatacccctgattcaccgagccctgcagttggcccagcgtcccgtttcactccttgccagcccctggacatcacccacttggctcaagaccaatggagcggtgaatgggaaggggtcactcaagggacagcccggagacatctaccaccagacctgggccagatactttgtgaagttcctggatgcctatgctgagcacaagttacagttctgggcagtgacagctgaaaatgagccttctgctgggctgttgagtggataccccttccagtgcctgggcttcacccctgaacatcagcgagacttcattgcccgtgacctaggtcctaccctcgccaacagtactcaccacaatgtccgcctactcatgctggatgaccaacgcttgctgctgccccactgggcaaaggtggtactgacagacccagaagcagctaaatatgttcatggcattgctgtacattggtacctggactttctggctccagccaaagccaccctaggggagacacaccgcctgttccccaacaccatgctctttgcctcagaggcctgtgtgggctccaagttctgggagcagagtgtgcggctaggctcctgggatcgagggatgcagtacagccacagcatcatcacgaacctcctgtaccatgtggtcggctggaccgactggaaccttgccctgaaccccgaaggaggacccaattgggtgcgtaactttgtcgacagtcccatcattgtagacatcaccaaggacacgttttacaaacagcccatgttctaccaccttggccacttcagcaagttcattcctgagggctcccagagagtggggctggttgccagtcagaagaacgacctggacgcagtggcactgatgcatcccgatggctctgctgttgtggtcgtgctaaaccgctcctctaaggatgtgcctcttaccatcaaggatcctgctgtgggcttcctggagacaatctcacctggctactccattcacacctacctgtggcgtcgccagtgatggagcagatactcaaggaggcactgggctcagcctgggcattaaagggacagagtcagctcacacgctgtctgtgactaaagagggcacagcagggccagtgtgagcttacagcgacgtaagcccaggggcaatggtttgggtgactcactttcccctctaggtggtgccaggggctggaggcccctagaaaaagatcagtaagccccagtgtccccccagcccccatgcttatgtgaacatgcgctgtgtgctgcttgctttggaaactgggcctgggtccaggcctagggtgagctcactgtccgtacaaacacaagatcagggctgagggtaaggaaaagaagagactaggaaagctgggcccaaaactggagactgtttgtctttcctggagatgcagaactgggcccgtggagcagcagtgtcagcatcagggcggaagccttaaagcagcagcgggtgtgcccaggcacccagatgattcctatggcaccagccaggaaaaatggcagctcttaaaggagaaaatgtttgagcccaaaaaaaaataaaaagtcacgacgacgagcacgcacacaaggaggcatctacaaactacacagagacaaaggcggggggcgcgataatccggggcgaccaccccacctttgtagcgcgccaaagagagtttaataagcgggcgacaacgggcgcacagctcgcttgtgggcacctcgggggcagggcccacaactccggataactggtcggcgcccgcggctagtctatcataggcctgacggcgctacgggtatcgtcctacaacc

SEQ ID NO: 295763 - DNA, 2564 bp, Homo sapiens
caggctgtaccggcccgaagcttaagatctagtgcctatagctaaggcaggtacctgcatccttgtttttgtttagtggatcctctatccttcagagactctggaacccctgtggtcttctcttcatctaatgaccctgaggggatggagttttcaagtccttccagagaggaatgtcccaagcctttgagtagggtaagcatcatggctggcagcctcacaggattgcttctacttcaggcagtgtcgtgggcatcaggtgcccgcccctgcatccctaaaagcttcggctacagctcggtggtgtgtgtctgcaatgccacatactgtgactcctttgaccccccgacctttcctgcccttggtaccttcagccgctatgagagtacacgcagtgggcgacggatggagctgagtatggggcccatccaggctaatcacacgggcacaggcctgctactgaccctgcagccagaacagaagttccagaaagtgaagggatttggaggggccatgacagatgctgctgctctcaacatccttgccctgtcaccccctgcccaaaatttgctacttaaatcgtacttctctgaagaaggaatcggatataacatcatccgggtacccatggccagctgtgacttctccatccgcacctacacctatgcagacacccctgatgatttccagttgcacaacttcagcctcccagaggaagataccaagctcaagatacccctgattcaccgagccctgcagttggcccagcgtcccgtttcactccttgccagcccctggacatcacccacttggctcaagaccaatggagcggtgaatgggaaggggtcactcaagggacagcccggagacatctaccaccagacctgggccagatactttgtgaagttcctggatgcctatgctgagcacaagttacagttctgggcagtgacagctgaaaatgagccttctgctgggctgttgagtggataccccttccagtgcctgggcttcacccctgaacatcagcgagacttcattgcccgtgacctaggtcctaccctcgccaacagtactcaccacaatgtccgcctactcatgctggatgaccaacgcttgctgctgccccactgggcaaaggtggtactgacagacccagaagcagctaaatatgttcatggcattgctgtacattggtacctggactttctggctccagccaaagccaccctaggggagacacaccgcctgttccccaacaccatgctctttgcctcagaggcctgtgtgggctccaagttctgggagcagagtgtgcggctaggctcctgggatcgagggatgcagtacagccacagcatcatcacgaacctcctgtaccatgtggtcggctggaccgactggaaccttgccctgaaccccgaaggaggacccaattgggtgcgtaactttgtcgacagtcccatcattgtagacatcaccaaggacacgttttacaaacagcccatgttctaccaccttggccacttcagcaagttcattcctgagggctcccagagagtggggctggttgccagtcagaagaacgacctggacgcagtggcactgatgcatcccgatggctctgctgttgtggtcgtgctaaaccgctcctctaaggatgtgcctcttaccatcaaggatcctgctgtgggcttcctggagacaatctcacctggctactccattcacacctacctgtggcgtcgccagtgatggagcagatactcaaggaggcactgggctcagcctgggcattaaagggacagagtcagctcacacgctgtctgtgactaaagagggcacagcagggccagtgtgagcttacagcgacgtaagcccaggggcaatggtttgggtgactcactttcccctctaggtggtgccaggggctggaggcccctagaaaaagatcagtaagccccagtgtccccccagcccccatgcttatgtgaacatgcgctgtgtgctgcttgctttggaaactgggcctgggtccaggcctagggtgagctcactgtccgtacaaacacaagatcagggctgagggtaaggaaaagaagagactaggaaagctgggcccaaaactggagactgtttgtctttcctggagatgcagaactgggcccgtggagcagcagtgtcagcatcagggcggaagccttaaagcagcagcgggtgtgcccaggcacccagatgattcctatggcaccagccaggaaaaatggcagctcttaaaggagaaaatgtttgagcccaaaaaaaaataaaaagtcacgacgacgagcacgcacacaaggaggcatctacaaactacacagagacaaaggcggggggcgcgataatccggggcgaccaccccacctttgtagcgcgccaaagagagtttaataagcgggcgacaacgggcgcacagctcgcttgtgggcacctcgggggcagggcccacaactccggataactggtcggcgcccgcggctagtctatcataggcctgacggcgctacgggtatcgtcctacaacc

SEQ ID NO: 295764 - DNA, 2856 bp, Homo sapiens
ccattaggcctatgaattataagatacagtcactttaaaatccactggaaggctgaagagtgagttaaacctcttataatgaatatacagtgaaaccagtagaggcattttatttagggttcctacaagaaagtgcttaaatagcatcgacgcctacatgctacatcctgttcagtctctgcctctgtgatgcagttggccagcaaatatcctccaagtcatcatttgcatagtgctagggataaaatgaggagcaataccaaatgctatacctgcccttatgggtcttatagtccaacgggagaaaaagatattatacaaataatcacggaaaataaatagaaaactgcatccttgtttttgtttagtggatcctctatccttcagagactctggaacccctgtggtcttctcttcatctaatgaccctgaggggatggagttttcaagtccttccagagaggaatgtcccaagcctttgagtagggtaagcatcatggctggcagcctcacaggattgcttctacttcaggcagtgtcgtgggcatcaggtgcccgcccctgcatccctaaaagcttcggctacagctcggtggtgtgtgtctgcaatgccacatactgtgactcctttgaccccccgacctttcctgcccttggtaccttcagccgctatgagagtacacgcagtgggcgacggatggagctgagtatggggcccatccaggctaatcacacgggcacaggcctgctactgaccctgcagccagaacagaagttccagaaagtgaagggatttggaggggccatgacagatgctgctgctctcaacatccttgccctgtcaccccctgcccaaaatttgctacttaaatcgtacttctctgaagaaggaatcggatataacatcatccgggtacccatggccagctgtgacttctccatccgcacctacacctatgcagacacccctgatgatttccagttgcacaacttcagcctcccagaggaagataccaagctcaagatacccctgattcaccgagccctgcagttggcccagcgtcccgtttcactccttgccagcccctggacatcacccacttggctcaagaccaatggagcggtgaatgggaaggggtcactcaagggacagcccggagacatctaccaccagacctgggccagatactttgtgaagttcctggatgcctatgctgagcacaagttacagttctgggcagtgacagctgaaaatgagccttctgctgggctgttgagtggataccccttccagtgcctgggcttcacccctgaacatcagcgagacttcattgcccgtgacctaggtcctaccctcgccaacagtactcaccacaatgtccgcctactcatgctggatgaccaacgcttgctgctgccccactgggcaaaggtggtactgacagacccagaagcagctaaatatgttcatggcattgctgtacattggtacctggactttctggctccagccaaagccaccctaggggagacacaccgcctgttccccaacaccatgctctttgcctcagaggcctgtgtgggctccaagttctgggagcagagtgtgcggctaggctcctgggatcgagggatgcagtacagccacagcatcatcacgaacctcctgtaccatgtggtcggctggaccgactggaaccttgccctgaaccccgaaggaggacccaattgggtgcgtaactttgtcgacagtcccatcattgtagacatcaccaaggacacgttttacaaacagcccatgttctaccaccttggccacttcagcaagttcattcctgagggctcccagagagtggggctggttgccagtcagaagaacgacctggacgcagtggcactgatgcatcccgatggctctgctgttgtggtcgtgctaaaccgctcctctaaggatgtgcctcttaccatcaaggatcctgctgtgggcttcctggagacaatctcacctggctactccattcacacctacctgtggcgtcgccagtgatggagcagatactcaaggaggcactgggctcagcctgggcattaaagggacagagtcagctcacacgctgtctgtgactaaagagggcacagcagggccagtgtgagcttacagcgacgtaagcccaggggcaatggtttgggtgactcactttcccctctaggtggtgccaggggctggaggcccctagaaaaagatcagtaagccccagtgtccccccagcccccatgcttatgtgaacatgcgctgtgtgctgcttgctttggaaactgggcctgggtccaggcctagggtgagctcactgtccgtacaaacacaagatcagggctgagggtaaggaaaagaagagactaggaaagctgggcccaaaactggagactgtttgtctttcctggagatgcagaactgggcccgtggagcagcagtgtcagcatcagggcggaagccttaaagcagcagcgggtgtgcccaggcacccagatgattcctatggcaccagccaggaaaaatggcagctcttaaaggagaaaatgtttgagcccaaaaaaaaataaaaagtcacgacgacgagcacgcacacaaggaggcatctacaaactacacagagacaaaggcggggggcgcgataatccggggcgaccaccccacctttgtagcgcgccaaagagagtttaataagcgggcgacaacgggcgcacagctcgcttgtgggcacctcgggggcagggcccacaactccggataactggtcggcgcccgcggctagtctatcataggcctgacggcgctacgggtatcgtcctacaacc

SEQ ID NO: 295765 - DNA, 2628 bp, Homo sapiens
tgcgggtggtcgggctgcatcctgccttcagagtcttactgcgcggggccccagtctccagtcccgcccaggcgcctttgcaggctgcggtgggatttcgttttgcctccggttggggctgctgtttctcttcgccgacgtggatcctctatccttcagagactctggaacccctgtggtcttctcttcatctaatgaccctgaggggatggagttttcaagtccttccagagaggaatgtcccaagcctttgagtagggtaagcatcatggctggcagcctcacaggattgcttctacttcaggcagtgtcgtgggcatcaggtgcccgcccctgcatccctaaaagcttcggctacagctcggtggtgtgtgtctgcaatgccacatactgtgactcctttgaccccccgacctttcctgcccttggtaccttcagccgctatgagagtacacgcagtgggcgacggatggagctgagtatggggcccatccaggctaatcacacgggcacaggcctgctactgaccctgcagccagaacagaagttccagaaagtgaagggatttggaggggccatgacagatgctgctgctctcaacatccttgccctgtcaccccctgcccaaaatttgctacttaaatcgtacttctctgaagaaggaatcggatataacatcatccgggtacccatggccagctgtgacttctccatccgcacctacacctatgcagacacccctgatgatttccagttgcacaacttcagcctcccagaggaagataccaagctcaagatacccctgattcaccgagccctgcagttggcccagcgtcccgtttcactccttgccagcccctggacatcacccacttggctcaagaccaatggagcggtgaatgggaaggggtcactcaagggacagcccggagacatctaccaccagacctgggccagatactttgtgaagttcctggatgcctatgctgagcacaagttacagttctgggcagtgacagctgaaaatgagccttctgctgggctgttgagtggataccccttccagtgcctgggcttcacccctgaacatcagcgagacttcattgcccgtgacctaggtcctaccctcgccaacagtactcaccacaatgtccgcctactcatgctggatgaccaacgcttgctgctgccccactgggcaaaggtggtactgacagacccagaagcagctaaatatgttcatggcattgctgtacattggtacctggactttctggctccagccaaagccaccctaggggagacacaccgcctgttccccaacaccatgctctttgcctcagaggcctgtgtgggctccaagttctgggagcagagtgtgcggctaggctcctgggatcgagggatgcagtacagccacagcatcatcacgaacctcctgtaccatgtggtcggctggaccgactggaaccttgccctgaaccccgaaggaggacccaattgggtgcgtaactttgtcgacagtcccatcattgtagacatcaccaaggacacgttttacaaacagcccatgttctaccaccttggccacttcagcaagttcattcctgagggctcccagagagtggggctggttgccagtcagaagaacgacctggacgcagtggcactgatgcatcccgatggctctgctgttgtggtcgtgctaaaccgctcctctaaggatgtgcctcttaccatcaaggatcctgctgtgggcttcctggagacaatctcacctggctactccattcacacctacctgtggcgtcgccagtgatggagcagatactcaaggaggcactgggctcagcctgggcattaaagggacagagtcagctcacacgctgtctgtgactaaagagggcacagcagggccagtgtgagcttacagcgacgtaagcccaggggcaatggtttgggtgactcactttcccctctaggtggtgccaggggctggaggcccctagaaaaagatcagtaagccccagtgtccccccagcccccatgcttatgtgaacatgcgctgtgtgctgcttgctttggaaactgggcctgggtccaggcctagggtgagctcactgtccgtacaaacacaagatcagggctgagggtaaggaaaagaagagactaggaaagctgggcccaaaactggagactgtttgtctttcctggagatgcagaactgggcccgtggagcagcagtgtcagcatcagggcggaagccttaaagcagcagcgggtgtgcccaggcacccagatgattcctatggcaccagccaggaaaaatggcagctcttaaaggagaaaatgtttgagcccaaaaaaaaataaaaagtcacgacgacgagcacgcacacaaggaggcatctacaaactacacagagacaaaggcggggggcgcgataatccggggcgaccaccccacctttgtagcgcgccaaagagagtttaataagcgggcgacaacgggcgcacagctcgcttgtgggcacctcgggggcagggcccacaactccggataactggtcggcgcccgcggctagtctatcataggcctgacggcgctacgggtatcgtcctacaacc

SEQ ID NO: 295766 - DNA, 2767 bp, Homo sapiens
tgcgggtggtcgggctgcatcctgccttcagagtcttactgcgcggggccccagtctccagtcccgcccaggcgcctttgcaggctgcggtgggatttcgttttgcctccggttggggctgctgtttctcttcgccgacgtagagacggggtttcaccatgttggtcaggctggtctccaattcctgacctcgtgatccgcccgcctcggcctgccaaacagctgtgattataggcgtgagccaccgcgcccggccaaccatcattattatttttaacgtggatcctctatccttcagagactctggaacccctgtggtcttctcttcatctaatgaccctgaggggatggagttttcaagtccttccagagaggaatgtcccaagcctttgagtagggtaagcatcatggctggcagcctcacaggattgcttctacttcaggcagtgtcgtgggcatcaggtgcccgcccctgcatccctaaaagcttcggctacagctcggtggtgtgtgtctgcaatgccacatactgtgactcctttgaccccccgacctttcctgcccttggtaccttcagccgctatgagagtacacgcagtgggcgacggatggagctgagtatggggcccatccaggctaatcacacgggcacaggcctgctactgaccctgcagccagaacagaagttccagaaagtgaagggatttggaggggccatgacagatgctgctgctctcaacatccttgccctgtcaccccctgcccaaaatttgctacttaaatcgtacttctctgaagaaggaatcggatataacatcatccgggtacccatggccagctgtgacttctccatccgcacctacacctatgcagacacccctgatgatttccagttgcacaacttcagcctcccagaggaagataccaagctcaagatacccctgattcaccgagccctgcagttggcccagcgtcccgtttcactccttgccagcccctggacatcacccacttggctcaagaccaatggagcggtgaatgggaaggggtcactcaagggacagcccggagacatctaccaccagacctgggccagatactttgtgaagttcctggatgcctatgctgagcacaagttacagttctgggcagtgacagctgaaaatgagccttctgctgggctgttgagtggataccccttccagtgcctgggcttcacccctgaacatcagcgagacttcattgcccgtgacctaggtcctaccctcgccaacagtactcaccacaatgtccgcctactcatgctggatgaccaacgcttgctgctgccccactgggcaaaggtggtactgacagacccagaagcagctaaatatgttcatggcattgctgtacattggtacctggactttctggctccagccaaagccaccctaggggagacacaccgcctgttccccaacaccatgctctttgcctcagaggcctgtgtgggctccaagttctgggagcagagtgtgcggctaggctcctgggatcgagggatgcagtacagccacagcatcatcacgaacctcctgtaccatgtggtcggctggaccgactggaaccttgccctgaaccccgaaggaggacccaattgggtgcgtaactttgtcgacagtcccatcattgtagacatcaccaaggacacgttttacaaacagcccatgttctaccaccttggccacttcagcaagttcattcctgagggctcccagagagtggggctggttgccagtcagaagaacgacctggacgcagtggcactgatgcatcccgatggctctgctgttgtggtcgtgctaaaccgctcctctaaggatgtgcctcttaccatcaaggatcctgctgtgggcttcctggagacaatctcacctggctactccattcacacctacctgtggcgtcgccagtgatggagcagatactcaaggaggcactgggctcagcctgggcattaaagggacagagtcagctcacacgctgtctgtgactaaagagggcacagcagggccagtgtgagcttacagcgacgtaagcccaggggcaatggtttgggtgactcactttcccctctaggtggtgccaggggctggaggcccctagaaaaagatcagtaagccccagtgtccccccagcccccatgcttatgtgaacatgcgctgtgtgctgcttgctttggaaactgggcctgggtccaggcctagggtgagctcactgtccgtacaaacacaagatcagggctgagggtaaggaaaagaagagactaggaaagctgggcccaaaactggagactgtttgtctttcctggagatgcagaactgggcccgtggagcagcagtgtcagcatcagggcggaagccttaaagcagcagcgggtgtgcccaggcacccagatgattcctatggcaccagccaggaaaaatggcagctcttaaaggagaaaatgtttgagcccaaaaaaaaataaaaagtcacgacgacgagcacgcacacaaggaggcatctacaaactacacagagacaaaggcggggggcgcgataatccggggcgaccaccccacctttgtagcgcgccaaagagagtttaataagcgggcgacaacgggcgcacagctcgcttgtgggcacctcgggggcagggcccacaactccggataactggtcggcgcccgcggctagtctatcataggcctgacggcgctacgggtatcgtcctacaacc

SEQ ID NO: 295767 - DNA, 2134 bp, Homo sapiens
ccacatcgggaagccggaattacttgcagggctaacctagtgcctatagctaaggcaggtacctgcatccttgtttttgtttagtggatcctctatccttcagagactctggaacccctgtggtcttctcttcatctaatgaccctgaggggatggagttttcaagtccttccagagaggaatgtcccaagcctttgagtagggtaagcatcatggctggcagcctcacaggattgcttctacttcaggcagtgtcgtgggcatcaggtgcccgcccctgcatccctaaaagcttcggctacagctcggtggtgtgtgtctgcaatgccacatactgtgactcctttgaccccccgacctttcctgcccttggtaccttcagccgctatgagagtacacgcagtgggcgacggatggagctgagtatggggcccatccaggctaatcacacgggcacaggcctgctactgaccctgcagccagaacagaagttccagaaagtgaagggatttggaggggccatgacagatgctgctgctctcaacatccttgccctgtcaccccctgcccaaaatttgctacttaaatcgtacttctctgaagaaggaatcggatataacatcatccgggtacccatggccagctgtgacttctccatccgcacctacacctatgcagacacccctgatgatttccagttgcacaacttcagcctcccagaggaagataccaagctcaagatacccctgattcaccgagccctgcagttggcccagcgtcccgtttcactccttgccagcccctggacatcacccacttggctcaagaccaatggagcggtgaatgggaaggggtcactcaagggacagcccggagacatctaccaccagacctgggccagatactttgtgaagttcctggatgcctatgctgagcacaagttacagttctgggcagtgacagctgaaaatgagccttctgctgggctgttgagtggataccccttccagtgcctgggcttcacccctgaacatcagcgagacttcattgcccgtgacctaggtcctaccctcgccaacagtactcaccacaatgtccgcctactcatgctggatgaccaacgcttgctgctgccccactgggcaaaggtggtactgacagacccagaagcagctaaatatgttcatggcattgctgtacattggtacctggactttctggctccagccaaagccaccctaggggagacacaccgcctgttccccaacaccatgctctttgcctcagaggcctgtgtgggctccaagttctgggagcagagtgtgcggctaggctcctgggatcgagggatgcagtacagccacagcatcatcacgaacctcctgtaccatgtggtcggctggaccgactggaaccttgccctgaaccccgaaggaggacccaattgggtgcgtaactttgtcgacagtcccatcattgtagacatcaccaaggacacgttttacaaacagcccatgttctaccaccttggccacttcagcaagttcattcctgagggctcccagagagtggggctggttgccagtcagaagaacgacctggacgcagtggcactgatgcatcccgatggctctgctgttgtggtcgtgctaaaccgctcctctaaggatgtgcctcttaccatcaaggatcctgctgtgggcttcctggagacaatctcacctggctactccattcacacctacctgtggcgtcgccagtgatggagcagatactcaaggaggcactgggctcagcctgggcattaaagggacagagtcagctcacacgctgtctgtgactaaagagggcacagcagggccagtgtgagcttacagcgacgtaagcccaggggcaatggtttgggtgactcactttcccctctaggtggtgccaggggctggaggcccctagaaaaagatcagtaagccccagtgtccccccagcccccatgcttatgtgaacatgcgctgtgtgctgcttgctttggaaactgggcctgggtccaggcctagggtgagctcactgtccgtacaaacacaagatcagggctgagggtaaggaaaagaagggtacagatactgctaggggggga

SEQ ID NO: 295768 - DNA, 2319 bp, Homo sapiens
ccacatcgggaagccggaattacttgcagggctaacctagtgcctatagctaaggcaggtacctgcatccttgtttttgtttagtggatcctctatccttcagagactctggaacccctgtggtcttctcttcatctaatgaccctgaggggatggagttttcaagtccttccagagaggaatgtcccaagcctttgagtagggtaagcatcatggctggcagcctcacaggattgcttctacttcaggcagtgtcgtgggcatcaggtgcccgcccctgcatccctaaaagcttcggctacagctcggtggtgtgtgtctgcaatgccacatactgtgactcctttgaccccccgacctttcctgcccttggtaccttcagccgctatgagagtacacgcagtgggcgacggatggagctgagtatggggcccatccaggctaatcacacgggcacaggcctgctactgaccctgcagccagaacagaagttccagaaagtgaagggatttggaggggccatgacagatgctgctgctctcaacatccttgccctgtcaccccctgcccaaaatttgctacttaaatcgtacttctctgaagaaggaatcggatataacatcatccgggtacccatggccagctgtgacttctccatccgcacctacacctatgcagacacccctgatgatttccagttgcacaacttcagcctcccagaggaagataccaagctcaagatacccctgattcaccgagccctgcagttggcccagcgtcccgtttcaacttcattgcccgtgacctaggtcctaccctcgccaacagtactcaccacaatgtccgcctactcatgctggatgaccaacgcttgctgctgccccactgggcaaaggtggtactgacagacccagaagcagctaaatatgttcatggcattgctgtacattggtacctggactttctggctccagccaaagccaccctaggggagacacaccgcctgttccccaacaccatgctctttgcctcagaggcctgtgtgggctccaagttctgggagcagagtgtgcggctaggctcctgggatcgagggatgcagtacagccacagcatcatcacgaacctcctgtaccatgtggtcggctggaccgactggaaccttgccctgaaccccgaaggaggacccaattgggtgcgtaactttgtcgacagtcccatcattgtagacatcaccaaggacacgttttacaaacagcccatgttctaccaccttggccacttcagcaagttcattcctgagggctcccagagagtggggctggttgccagtcagaagaacgacctggacgcagtggcactgatgcatcccgatggctctgctgttgtggtcgtgctaaaccgctcctctaaggatgtgcctcttaccatcaaggatcctgctgtgggcttcctggagacaatctcacctggctactccattcacacctacctgtggcgtcgccagtgatggagcagatactcaaggaggcactgggctcagcctgggcattaaagggacagagtcagctcacacgctgtctgtgactaaagagggcacagcagggccagtgtgagcttacagcgacgtaagcccaggggcaatggtttgggtgactcactttcccctctaggtggtgccaggggctggaggcccctagaaaaagatcagtaagccccagtgtccccccagcccccatgcttatgtgaacatgcgctgtgtgctgcttgctttggaaactgggcctgggtccaggcctagggtgagctcactgtccgtacaaacacaagatcagggctgagggtaaggaaaagaagagactaggaaagctgggcccaaaactggagactgtttgtctttcctggagatgcagaactgggcccgtggagcagcagtgtcagcatcagggcggaagccttaaagcagcagcgggtgtgcccaggcacccagatgattcctatggcaccagccaggaaaaatggcagctcttaaaggagaaaatgtttgagcccaaaaaaaaataaaaagtcacgacgacgagcacgcacacaaggaggcatctacaaactacacagagacaaaggcggggggcgcgataatccggggcgaccaccccacctttgtagcgcgccaaagagagtttaataagcgggcgacaacgggcgcacagctcgcttgtgggcacctcgggggcagggcccacaactccggataactggtcggcgcccgcggctagtctatcataggcctgacggcgctacgggtatcgtcctacaacc

SEQ ID NO: 295769 - DNA, 2213 bp, Homo sapiens
atttggttcctgttttaatgccctgtgaaataagatttcgccgcctatcatctgctaactgctacggactcaggctcaccgaaaggcctgcgcttcacccaggtgccagcctccacaggttccaacccaggagcccaagttccctttggccctgactcagacactattaggactggcaagtgataagcagagtcccatactctcctattgactcggactaccatatcttgatcatccttttctgtaggaatcggatataacatcatccgggtacccatggccagctgtgacttctccatccgcacctacacctatgcagacacccctgatgatttccagttgcacaacttcagcctcccagaggaagataccaagctcaagatacccctgattcaccgagccctgcagttggcccagcgtcccgtttcactccttgccagcccctggacatcacccacttggctcaagaccaatggagcggtgaatgggaaggggtcactcaagggacagcccggagacatctaccaccagacctgggccagatactttgtgaagttcctggatgcctatgctgagcacaagttacagttctgggcagtgacagctgaaaatgagccttctgctgggctgttgagtggataccccttccagtgcctgggcttcacccctgaacatcagcgagacttcattgcccgtgacctaggtcctaccctcgccaacagtactcaccacaatgtccgcctactcatgctggatgaccaacgcttgctgctgccccactgggcaaaggtggtactgacagacccagaagcagctaaatatgttcatggcattgctgtacattggtacctggactttctggctccagccaaagccaccctaggggagacacaccgcctgttccccaacaccatgctctttgcctcagaggcctgtgtgggctccaagttctgggagcagagtgtgcggctaggctcctgggatcgagggatgcagtacagccacagcatcatcacgaacctcctgtaccatgtggtcggctggaccgactggaaccttgccctgaaccccgaaggaggacccaattgggtgcgtaactttgtcgacagtcccatcattgtagacatcaccaaggacacgttttacaaacagcccatgttctaccaccttggccacttcagcaagttcattcctgagggctcccagagagtggggctggttgccagtcagaagaacgacctggacgcagtggcactgatgcatcccgatggctctgctgttgtggtcgtgctaaaccgctcctctaaggatgtgcctcttaccatcaaggatcctgctgtgggcttcctggagacaatctcacctggctactccattcacacctacctgtggcgtcgccagtgatggagcagatactcaaggaggcactgggctcagcctgggcattaaagggacagagtcagctcacacgctgtctgtgactaaagagggcacagcagggccagtgtgagcttacagcgacgtaagcccaggggcaatggtttgggtgactcactttcccctctaggtggtgccaggggctggaggcccctagaaaaagatcagtaagccccagtgtccccccagcccccatgcttatgtgaacatgcgctgtgtgctgcttgctttggaaactgggcctgggtccaggcctagggtgagctcactgtccgtacaaacacaagatcagggctgagggtaaggaaaagaagagactaggaaagctgggcccaaaactggagactgtttgtctttcctggagatgcagaactgggcccgtggagcagcagtgtcagcatcagggcggaagccttaaagcagcagcgggtgtgcccaggcacccagatgattcctatggcaccagccaggaaaaatggcagctcttaaaggagaaaatgtttgagcccaaaaaaaaataaaaagtcacgacgacgagcacgcacacaaggaggcatctacaaactacacagagacaaaggcggggggcgcgataatccggggcgaccaccccacctttgtagcgcgccaaagagagtttaataagcgggcgacaacgggcgcacagctcgcttgtgggcacctcgggggcagggcccacaactccggataactggtcggcgcccgcggctagtctatcataggcctgacggcgctacgggtatcgtcctacaacc

SEQ ID NO: 295770 - DNA, 2538 bp, Homo sapiens
ccattaggcctatgaattataagatacagtcactttaaaatccactggaaggctgaagagtgagttaaacctcttataatgaatatacagtgaaaccagtagaggcattttatttagggttcctacaagaaagtgcttaaatagcatcgacgcctacatgctacatcctgttcagtctctgcctctgtgatgcagttggccagcaaatatcctccaagtcatcatttgcatagtgctagggataaaatgaggagcaataccaaatgctatacctgcccttatgggtcttatagtccaacgggagaaaaagatattatacaaataatcacggaaaataaatagaaaactgcatccttgtttttgtttagtggatcctctatccttcagagactctggaacccctgtggtcttctcttcatctaatgaccctgaggggatggagttttcaagtccttccagagagaatgtcccaagccttcgggtagggtgccttcagccgctacaagagcagaagcagtgggcattggatggagctgagtacaggaccatacaggctaattgcaccggcacaggaatcggatataacatcatccgggtacccatggccagctgtgacttctccatccgcacctacacctatgcagacacccctgatgatttccagttgcacaacttcagcctcccagaggaagataccaagctcaagatacccctgattcaccgagccctgcagttggcccagcgtcccgtttcactccttgccagcccctggacatcacccacttggctcaagaccaatggagcggtgaatgggaaggggtcactcaagggacagcccggagacatctaccaccagacctgggccagatactttgtgaagttcctggatgcctatgctgagcacaagttacagttctgggcagtgacagctgaaaatgagccttctgctgggctgttgagtggataccccttccagtgcctgggcttcacccctgaacatcagcgagacttcattgcccgtgacctaggtcctaccctcgccaacagtactcaccacaatgtccgcctactcatgctggatgaccaacgcttgctgctgccccactgggcaaaggtggtactgacagacccagaagcagctaaatatgttcatggcattgctgtacattggtacctggactttctggctccagccaaagccaccctaggggagacacaccgcctgttccccaacaccatgctctttgcctcagaggcctgtgtgggctccaagttctgggagcagagtgtgcggctaggctcctgggatcgagggatgcagtacagccacagcatcatcacgaacctcctgtaccatgtggtcggctggaccgactggaaccttgccctgaaccccgaaggaggacccaattgggtgcgtaactttgtcgacagtcccatcattgtagacatcaccaaggacacgttttacaaacagcccatgttctaccaccttggccacttcagcaagttcattcctgagggctcccagagagtggggctggttgccagtcagaagaacgacctggacgcagtggcactgatgcatcccgatggctctgctgttgtggtcgtgctaaaccgctcctctaaggatgtgcctcttaccatcaaggatcctgctgtgggcttcctggagacaatctcacctggctactccattcacacctacctgtggcgtcgccagtgatggagcagatactcaaggaggcactgggctcagcctgggcattaaagggacagagtcagctcacacgctgtctgtgactaaagagggcacagcagggccagtgtgagcttacagcgacgtaagcccaggggcaatggtttgggtgactcactttcccctctaggtggtgccaggggctggaggcccctagaaaaagatcagtaagccccagtgtccccccagcccccatgcttatgtgaacatgcgctgtgtgctgcttgctttggaaactgggcctgggtccaggcctagggtgagctcactgtccgtacaaacacaagatcagggctgagggtaaggaaaagaagagactaggaaagctgggcccaaaactggagactgtttgtctttcctggagatgcagaactgggcccgtggagcagcagtgtcagcatcagggcggaagccttaaagcagcagcgggtgtgcccaggcacccagatgattcctatggcaccagccaggaaaaatggcagctcttaaaggagaaaatgtttgagcccaaaaaaaaataaaaagtcacgacgacgagcacgcacacaaggaggcatctacaaactacacagagacaaaggcggggggcgcgataatccggggcgaccaccccacctttgtagcgcgccaaagagagtttaataagcgggcgacaacgggcgcacagctcgcttgtgggcacctcgggggcagggcccacaactccggataactggtcggcgcccgcggctagtctatcataggcctgacggcgctacgggtatcgtcctacaacc

SEQ ID NO: 295771 - DNA, 1879 bp, Homo sapiens
atcagccgctatgagagtacactgcagaggaagataccaagctcaagatacccctgattcaccgagccctgcagttggcccagcgtcccgtttcactccttgccagcccctggacatcacccacttggctcaagaccaatggagcggtgaatgggaaggggtcactcaagggacagcccggagacatctaccaccagacctgggccagatactttgtgaagttcctggatgcctatgctgagcacaagttacagttctgggcagtgacagctgaaaatgagccttctgctgggctgttgagtggataccccttccagtgcctgggcttcacccctgaacatcagcgagacttcattgcccgtgacctaggtcctaccctcgccaacagtactcaccacaatgtccgcctactcatgctggatgaccaacgcttgctgctgccccactgggcaaaggtggtactgacagacccagaagcagctaaatatgttcatggcattgctgtacattggtacctggactttctggctccagccaaagccaccctaggggagacacaccgcctgttccccaacaccatgctctttgcctcagaggcctgtgtgggctccaagttctgggagcagagtgtgcggctaggctcctgggatcgagggatgcagtacagccacagcatcatcacgaacctcctgtaccatgtggtcggctggaccgactggaaccttgccctgaaccccgaaggaggacccaattgggtgcgtaactttgtcgacagtcccatcattgtagacatcaccaaggacacgttttacaaacagcccatgttctaccaccttggccacttcagcaagttcattcctgagggctcccagagagtggggctggttgccagtcagaagaacgacctggacgcagtggcactgatgcatcccgatggctctgctgttgtggtcgtgctaaaccgctcctctaaggatgtgcctcttaccatcaaggatcctgctgtgggcttcctggagacaatctcacctggctactccattcacacctacctgtggcgtcgccagtgatggagcagatactcaaggaggcactgggctcagcctgggcattaaagggacagagtcagctcacacgctgtctgtgactaaagagggcacagcagggccagtgtgagcttacagcgacgtaagcccaggggcaatggtttgggtgactcactttcccctctaggtggtgccaggggctggaggcccctagaaaaagatcagtaagccccagtgtccccccagcccccatgcttatgtgaacatgcgctgtgtgctgcttgctttggaaactgggcctgggtccaggcctagggtgagctcactgtccgtacaaacacaagatcagggctgagggtaaggaaaagaagagactaggaaagctgggcccaaaactggagactgtttgtctttcctggagatgcagaactgggcccgtggagcagcagtgtcagcatcagggcggaagccttaaagcagcagcgggtgtgcccaggcacccagatgattcctatggcaccagccaggaaaaatggcagctcttaaaggagaaaatgtttgagcccaaaaaaaaataaaaagtcacgacgacgagcacgcacacaaggaggcatctacaaactacacagagacaaaggcggggggcgcgataatccggggcgaccaccccacctttgtagcgcgccaaagagagtttaataagcgggcgacaacgggcgcacagctcgcttgtgggcacctcgggggcagggcccacaactccggataactggtcggcgcccgcggctagtctatcataggcctgacggcgctacgggtatcgtcctacaacc

SEQ ID NO: 295772 - DNA, 2285 bp, Homo sapiens
ccattaggcctatgaattataagatacagtcactttaaaatccactggaaggctgaagagtgagttaaacctcttataatgaatatacagtgaaaccagtagaggcattttatttagggttcctacaagaaagtgcttaaatagcatcgacgcctacatgctacatcctgttcagtctctgcctctgtgatgcagttggccagcaaatatcctccaagtcatcatttgcatagtgctagggataaaatgaggagcaataccaaatgctatacctgcccttatgggtcttatagtccaacgggagaaaaagatattatacaaataatcacggaaaataaatagaaaactgcatccttgtttttgtttagtggatcctctatccttcagagactctggaacccctgtggtcttctcttcatctaatgaccctgaggggatggagttttcaagtccttccagagagaatgtcccaagccttcgggtagggtgccttcagccgctacaagagcagaagcagtgggcattggatggagctgagtacaggaccatacaggctaattgcaccggcacaggaatcggatataacatcatccgggtacccatggccagctgtgacttctccatccgcacctacacctatgcagacacccctgatgatttccagttgcacaacttcagcctcccagaggaagataccaagctcaagatacccctgattcaccgagccctgcagttggcccagcgtcccgtttcaacttcattgcccgtgacctaggtcctaccctcgccaacagtactcaccacaatgtccgcctactcatgctggatgaccaacgcttgctgctgccccactgggcaaaggtggtactgacagacccagaagcagctaaatatgttcatggcattgctgtacattggtacctggactttctggctccagccaaagccaccctaggggagacacaccgcctgttccccaacaccatgctctttgcctcagaggcctgtgtgggctccaagttctgggagcagagtgtgcggctaggctcctgggatcgagggatgcagtacagccacagcatcatcacgaacctcctgtaccatgtggtcggctggaccgactggaaccttgccctgaaccccgaaggaggacccaattgggtgcgtaactttgtcgacagtcccatcattgtagacatcaccaaggacacgttttacaaacagcccatgttctaccaccttggccacttcagcaagttcattcctgagggctcccagagagtggggctggttgccagtcagaagaacgacctggacgcagtggcactgatgcatcccgatggctctgctgttgtggtcgtgctaaaccgctcctctaaggatgtgcctcttaccatcaaggatcctgctgtgggcttcctggagacaatctcacctggctactccattcacacctacctgtggcgtcgccagtgatggagcagatactcaaggaggcactgggctcagcctgggcattaaagggacagagtcagctcacacgctgtctgtgactaaagagggcacagcagggccagtgtgagcttacagcgacgtaagcccaggggcaatggtttgggtgactcactttcccctctaggtggtgccaggggctggaggcccctagaaaaagatcagtaagccccagtgtccccccagcccccatgcttatgtgaacatgcgctgtgtgctgcttgctttggaaactgggcctgggtccaggcctagggtgagctcactgtccgtacaaacacaagatcagggctgagggtaaggaaaagaagagactaggaaagctgggcccaaaactggagactgtttgtctttcctggagatgcagaactgggcccgtggagcagcagtgtcagcatcagggcggaagccttaaagcagcagcgggtgtgcccaggcacccagatgattcctatggcaccagccaggaaaaatggcagctcttaaaggagaaaatgtttgagcccaaaaaaaaataaaaagtcacgacgacgagcacgcacacaaggaggcatctacaaactacacagagacaaaggcggggggcgcgataatccggggcgaccaccccacctttgtagcgcgccaaagagagtttaataagcgggcgacaacgggcgcacagctcgcttgtgggcacctcgggggcagggcccacaactccggataactggtcggcgcccgcggctagtctatcataggcctgacggcgctacgggtatcgtcctacaacc

SEQ ID NO: 295773 - DNA, 1791 bp, Homo sapiens
catgtatgtatgtgtatatacatatatatgtgtttatatgtatatatatatacacacacacacatacatacacacacatacacacacaaattagctgggtgtggcacccgtgtagtcccagctactcaggaggctaatgtgggaggatcagttgaccctaggaagtcaaggctgcagtgagtcgtgattgcgccactgtactccagcccgagtgacagagtgacatcctgtctcaaaaacaaaaaaaaatctccccaaacctctctagttgcattcttcccgtcacccaactccaggattcctacaacaggaactagaagttccagaagcctgtgtgcaaggtccaggatcagttgctcttcctttgcaggtactgacagacccagaagcagctaaatatgttcatggcattgctgtacattggtacctggactttctggctccagccaaagccaccctaggggagacacaccgcctgttccccaacaccatgctctttgcctcagaggcctgtgtgggctccaagttctgggagcagagtgtgcggctaggctcctgggatcgagggatgcagtacagccacagcatcatcacgaacctcctgtaccatgtggtcggctggaccgactggaaccttgccctgaaccccgaaggaggacccaattgggtgcgtaactttgtcgacagtcccatcattgtagacatcaccaaggacacgttttacaaacagcccatgttctaccaccttggccacttcagcaagttcattcctgagggctcccagagagtggggctggttgccagtcagaagaacgacctggacgcagtggcactgatgcatcccgatggctctgctgttgtggtcgtgctaaaccgctcctctaaggatgtgcctcttaccatcaaggatcctgctgtgggcttcctggagacaatctcacctggctactccattcacacctacctgtggcgtcgccagtgatggagcagatactcaaggaggcactgggctcagcctgggcattaaagggacagagtcagctcacacgctgtctgtgactaaagagggcacagcagggccagtgtgagcttacagcgacgtaagcccaggggcaatggtttgggtgactcactttcccctctaggtggtgccaggggctggaggcccctagaaaaagatcagtaagccccagtgtccccccagcccccatgcttatgtgaacatgcgctgtgtgctgcttgctttggaaactgggcctgggtccaggcctagggtgagctcactgtccgtacaaacacaagatcagggctgagggtaaggaaaagaagagactaggaaagctgggcccaaaactggagactgtttgtctttcctggagatgcagaactgggcccgtggagcagcagtgtcagcatcagggcggaagccttaaagcagcagcgggtgtgcccaggcacccagatgattcctatggcaccagccaggaaaaatggcagctcttaaaggagaaaatgtttgagcccaaaaaaaaataaaaagtcacgacgacgagcacgcacacaaggaggcatctacaaactacacagagacaaaggcggggggcgcgataatccggggcgaccaccccacctttgtagcgcgccaaagagagtttaataagcgggcgacaacgggcgcacagctcgcttgtgggcacctcgggggcagggcccacaactccggataactggtcggcgcccgcggctagtctatcataggcctgacggcgctacgggtatcgtcctacaacc

SEQ ID NO: 295774 - DNA, 2211 bp, Homo sapiens
ccacatcgggaagccggaattacttgcagggctaacctagtgcctatagctaaggcaggtacctgcatccttgtttttgtttagtggatcctctatccttcagagactctggaacccctgtggtcttctcttcatctaatgaccctgaggggatggagttttcaagtccttccagagaggaatgtcccaagcctttgagtagggtaagcatcatggctggcagcctcacaggattgcttctacttcaggcagtgtcgtgggcatcaggtgcccgcccctgcatccctaaaagcttcggctacagctcggtggtgtgtgtctgcaatgccacatactgtgactcctttgaccccccgacctttcctgcccttggtaccttcagccgctatgagagtacacgcagtgggcgacggatggagctgagtatggggcccatccaggctaatcacacgggcacaggcctgctactgaccctgcagccagaacagaagttccagaaagtgaagggatttggaggggccatgacagatgctgctgctctcaacatccttgccctgtcaccccctgcccaaaatttgctacttaaatcgtacttctctgaagaaggaatcggatataacatcatccgggtacccatggccagctgtgacttctccatccgcacctacacctatgcagacacccctgatgatttccagttgcacaacttcagcctcccagaggaagataccaagctcaagatacccctgattcaccgagccctgcagttggcccagcgtcccgtttcactccttgccagcccctggacatcacccacttggctcaagaccaatggagcggtgaatgggaaggggtcactcaagggacagcccggagacatctaccaccagacctgggccagatactttgtgaagttcctggatgcctatgctgagcacaagttacagttctgggcagtgacagctgaaaatgagccttctgctgggctgttgagtggataccccttccagtgcctgggcttcacccctgaacatcagcgagacttcattgcccgtgacctaggtcctaccctcgccaacagtactcaccacaatgtccgcctactcatgctggatgaccaacgcttgctgctgccccactgggcaaaggtggtactgacagacccagaagcagctaaatatgttcatggcattgctgtacattggtacctggactttctggctccagccaaagccaccctaggggagacacaccgcctgttccccaacaccatgctctttgcctcagaggcctgtgtgggctccaagttctgggagcagagtgtgcggctaggctcctgggatcgagggatgcagtacagccacagcatcatcacgaacctcctgtaccatgtggtcggctggaccgactggaaccttgccctgaaccccgaaggaggacccaattgggtgcgtaactttgtcgacagtcccatcattgtagacatcaccaaggacacgttttacaaacagcccatgttctaccaccttggccacttcaggtgagtggagggcgggcacccccattccataccaggggctggaggcccctagaaaaagatcagtaagccccagtgtccccccagcccccatgcttatgtgaacatgcgctgtgtgctgcttgctttggaaactgggcctgggtccaggcctagggtgagctcactgtccgtacaaacacaagatcagggctgagggtaaggaaaagaagagactaggaaagctgggcccaaaactggagactgtttgtctttcctggagatgcagaactgggcccgtggagcagcagtgtcagcatcagggcggaagccttaaagcagcagcgggtgtgcccaggcacccagatgattcctatggcaccagccaggaaaaatggcagctcttaaaggagaaaatgtttgagcccaaaaaaaaataaaaagtcacgacgacgagcacgcacacaaggaggcatctacaaactacacagagacaaaggcggggggcgcgataatccggggcgaccaccccacctttgtagcgcgccaaagagagtttaataagcgggcgacaacgggcgcacagctcgcttgtgggcacctcgggggcagggcccacaactccggataactggtcggcgcccgcggctagtctatcataggcctgacggcgctacgggtatcgtcctacaacc

SEQ ID NO: 295775 - DNA, 1308 bp, Homo sapiens
  misc_feature (1)..(1): n is a, c, g, or t
ntctagaggatcccgtctacggttggatactagatccagggtggctggagagcagagtgtgcggctaggctcctgggatcgagggatgcagtacagccacagcatcatcacgaacctcctgtaccatgtggtcggctggaccgactggaaccttgccctgaaccccgaaggaggacccaattgggtgcgtaactttgtcgacagtcccatcattgtagacatcaccaaggacacgttttacaaacagcccatgttctaccaccttggccacttcagcaagttcattcctgagggctcccagagagtggggctggttgccagtcagaagaacgacctggacgcagtggcactgatgcatcccgatggctctgctgttgtggtcgtgctaaaccgctcctctaaggatgtgcctcttaccatcaaggatcctgctgtgggcttcctggagacaatctcacctggctactccattcacacctacctgtggcgtcgccagtgatggagcagatactcaaggaggcactgggctcagcctgggcattaaagggacagagtcagctcacacgctgtctgtgactaaagagggcacagcagggccagtgtgagcttacagcgacgtaagcccaggggcaatggtttgggtgactcactttcccctctaggtggtgccaggggctggaggcccctagaaaaagatcagtaagccccagtgtccccccagcccccatgcttatgtgaacatgcgctgtgtgctgcttgctttggaaactgggcctgggtccaggcctagggtgagctcactgtccgtacaaacacaagatcagggctgagggtaaggaaaagaagagactaggaaagctgggcccaaaactggagactgtttgtctttcctggagatgcagaactgggcccgtggagcagcagtgtcagcatcagggcggaagccttaaagcagcagcgggtgtgcccaggcacccagatgattcctatggcaccagccaggaaaaatggcagctcttaaaggagaaaatgtttgagcccaaaaaaaaataaaaagtcacgacgacgagcacgcacacaaggaggcatctacaaactacacagagacaaaggcggggggcgcgataatccggggcgaccaccccacctttgtagcgcgccaaagagagtttaataagcgggcgacaacgggcgcacagctcgcttgtgggcacctcgggggcagggcccacaactccggataactggtcggcgcccgcggctagtctatcataggcctgacggcgctacgggtatcgtcctacaacc

SEQ ID NO: 295776 - DNA, 1233 bp, Homo sapiens
tacctggaccctgtcagcagacaacagcatcatcacgaacctcctgtaccatgtggtcggctggaccgactggaaccttgccctgaaccccgaaggaggacccaattgggtgcgtaactttgtcgacagtcccatcattgtagacatcaccaaggacacgttttacaaacagcccatgttctaccaccttggccacttcagcaagttcattcctgagggctcccagagagtggggctggttgccagtcagaagaacgacctggacgcagtggcactgatgcatcccgatggctctgctgttgtggtcgtgctaaaccgctcctctaaggatgtgcctcttaccatcaaggatcctgctgtgggcttcctggagacaatctcacctggctactccattcacacctacctgtggcgtcgccagtgatggagcagatactcaaggaggcactgggctcagcctgggcattaaagggacagagtcagctcacacgctgtctgtgactaaagagggcacagcagggccagtgtgagcttacagcgacgtaagcccaggggcaatggtttgggtgactcactttcccctctaggtggtgccaggggctggaggcccctagaaaaagatcagtaagccccagtgtccccccagcccccatgcttatgtgaacatgcgctgtgtgctgcttgctttggaaactgggcctgggtccaggcctagggtgagctcactgtccgtacaaacacaagatcagggctgagggtaaggaaaagaagagactaggaaagctgggcccaaaactggagactgtttgtctttcctggagatgcagaactgggcccgtggagcagcagtgtcagcatcagggcggaagccttaaagcagcagcgggtgtgcccaggcacccagatgattcctatggcaccagccaggaaaaatggcagctcttaaaggagaaaatgtttgagcccaaaaaaaaataaaaagtcacgacgacgagcacgcacacaaggaggcatctacaaactacacagagacaaaggcggggggcgcgataatccggggcgaccaccccacctttgtagcgcgccaaagagagtttaataagcgggcgacaacgggcgcacagctcgcttgtgggcacctcgggggcagggcccacaactccggataactggtcggcgcccgcggctagtctatcataggcctgacggcgctacgggtatcgtcctacaacc

SEQ ID NO: 295777 - DNA, 1207 bp, Homo sapiens
ccacatcgggaagccggaattacttgcagggctaacctagtgcctatagctaaggcaggtacctgcatccttgtttttgtttagtggatcctctatccttcagagactctggaacccctgtggtcttctcttcatctaatgaccctgaggggatggagttttcaagtccttccagagaggaatgtcccaagcctttgagtagggtaagcatcatggctggcagcctcacaggattgcttctacttcaggcagtgtcgtgggcatcaggtgcccgcccctgcatccctaaaagcttcggctacagctcggtggtgtgtgtctgcaatgccacatactgtgactcctttgaccccccgacctttcctgcccttggtaccttcagccgctatgagagtacacgcagtgggcgacggatggagctgagtatggggcccatccaggctaatcacacgggcacaggcctgctactgaccctgcagccagaacagaagttccagaaagtgaagggatttggaggggccatgacagatgctgctgctctcaacatccttgccctgtcaccccctgcccaaaatttgctacttaaatcgtacttctctgaagaaggaatcggatataacatcatccgggtacccatggccagctgtgacttctccatccgcacctacacctatgcagacacccctgatgatttccagttgcacaacttcagcctcccagaggaagataccaagctcaagatacccctgattcaccgagccctgcagttggcccagcgtcccgtttcactccttgccagcccctggacatcacccacttggctcaagaccaatggagcggtgaatgggaaggggtcactcaagggacagcccggagacatctaccaccagacctgggccagatactttgtgaagttcctggatgcctatgctgagcacaagttacagttctgggcagtgacagctgaaaatgagccttctgctgggctgttgagtggataccccttccagtgcctgggcttcacccctgaacatcagcgagacttcattgcccgtgacctaggtcctaccctcgccaacagtactcaccacaatgtccgcctactcatgctggatgaccaacgcttgctgctgccccactgggcaaaggtggtatgacagacccagaagcagcaaagaccccaaagggagatcctctagatcaccag

SEQ ID NO: 295778 - DNA, 1683 bp, Homo sapiens
ccacatcgggaagccggaattacttgcagggctaacctagtgcctatagctaaggcaggtacctgcatccttgtttttgtttagtggatcctctatccttcagagactctggaacccctgtggtcttctcttcatctaatgaccctgaggggatggagttttcaagtccttccagagaggaatgtcccaagcctttgagtagggtaagcatcatggctggcagcctcacaggattgcttctacttcaggcagtgtcgtgggcatcaggtgcccgcccctgcatccctaaaagcttcggctacagctcggtggtgtgtgtctgcaatgccacatactgtgactcctttgaccccccgacctttcctgcccttggtaccttcagccgctatgagagtacacgcagtgggcgacggatggagctgagtatggggcccatccaggctaatcacacgggcacaggcctgctactgaccctgcagccagaacagaagttccagaaagtgaagggatttggaggggccatgacagatgctgctgctctcaacatccttgccctgtcaccccctgcccaaaatttgctacttaaatcgtacttctctgaagaaggtgaggaggaaggggacaagatgacatagagccattgaaacttttcgtttttcttttctttttttaaaatttttttgaggcagaatctcactctgcccattctgtcggcgagacaggagtgcagtggtgtgatctcccctcacagcaacctctgcctcccaggctatagtgattctcctgcctcagcctcctgagtagctggaattataggcgtgcgccactaccacctggctactccattcacacctacctgtggcgtcgccagtgatggagcagatactcaaggaggcactgggctcagcctgggcattaaagggacagagtcagctcacacgctgtctgtgactaaagagggcacagcagggccagtgtgagcttacagcgacgtaagcccaggggcaatggtttgggtgactcactttcccctctaggtggtgccaggggctggaggcccctagaaaaagatcagtaagccccagtgtccccccagcccccatgcttatgtgaacatgcgctgtgtgctgcttgctttggaaactgggcctgggtccaggcctagggtgagctcactgtccgtacaaacacaagatcagggctgagggtaaggaaaagaagagactaggaaagctgggcccaaaactggagactgtttgtctttcctggagatgcagaactgggcccgtggagcagcagtgtcagcatcagggcggaagccttaaagcagcagcgggtgtgcccaggcacccagatgattcctatggcaccagccaggaaaaatggcagctcttaaaggagaaaatgtttgagcccaaaaaaaaataaaaagtcacgacgacgagcacgcacacaaggaggcatctacaaactacacagagacaaaggcggggggcgcgataatccggggcgaccaccccacctttgtagcgcgccaaagagagtttaataagcgggcgacaacgggcgcacagctcgcttgtgggcacctcgggggcagggcccacaactccggataactggtcggcgcccgcggctagtctatcataggcctgacggcgctacgggtatcgtcctacaacc

SEQ ID NO: 295779 - DNA, 169 bp, Homo sapiens
acaaacagcccatgttctaccaccttggccacttcaggtgagtggagggcgggcacccccattccataccaggcctatcatctcctacatcggatggcttacatcactctacaccacgagggagcaggaaggtgttcagggtggaacctcggaagaggcacacccatcc

SEQ ID NO: 295780 - DNA, 3946 bp, Homo sapiens
gcgggggagggggcattgatcttcgatcgcgaagatggctgctggctgcctgctggccttgactctgacacttttccaatctttgctcatcggcccctcgtcggaggagccgttcccttcggccgtcactatcaaatcatgggtggataagatgcaagaagaccttgtcacactggcaaaaacagcaagtggagtcaatcagcttgttgatatttatgagaaatatcaagatttgtatactgtggaaccaaataatgcacgccagctggtagaaattgcagccagggatattgagaaacttctgagcaacagatctaaagccctggtgagcctggcattggaagcggagaaagttcaagcagctcaccagtggagagaagattttgcaagcaatgaagttgtctactacaatgcaaaggatgatctcgatcctgagaaaaatgacagtgagccaggcagccagaggataaaacctgttttcattgaagatgctaattttggacgacaaatatcttatcagcacgcagcagtccatattcctactgacatctatgagggctcaacaattgtgttaaatgaactcaactggacaagtgccttagatgaagttttcaaaaagaatcgcgaggaagacccttcattattgtggcaggtttttggcagtgccactggcctagctcgatattatccagcttcaccatgggttgataatagtagaactccaaataagattgacctttatgatgtacgcagaagaccatggtacatccaaggagctgcatctcctaaagacatgcttattctggtggatgtgagtggaagtgttagtggattgacacttaaactgatccgaacatctgtctccgaaatgttagaaaccctctcagatgatgatttcgtgaatgtagcttcatttaacagcaatgctcaggatgtaagctgttttcagcaccttgtccaagcaaatgtaagaaataaaaaagtgttgaaagacgcggtgaataatatcacagccaaaggaattacagattataagaagggctttagttttgcttttgaacagctgcttaattataatgtttccagagcaaactgcaataagattattatgctattcacggatggaggagaagagagagcccaggagatatttaacaaatacaataaagataaaaaagtacgtgtattcaggttttcagttggtcaacacaattatgagagaggacctattcagtggatggcctgtgaaaacaaaggttattattatgaaattccttccattggtgcaataagaatcaatactcaggaatatttggatgttttgggaagaccaatggttttagcaggagacaaagctaagcaagtccaatggacaaatgtgtacctggatgcattggaactgggacttgtcattactggaactcttccggtcttcaacataaccggccaatttgaaaataagacaaacttaaagaaccagctgattcttggtgtgatgggagtagatgtgtctttggaagatattaaaagactgacaccacgttttacactgtgccccaatgggtattactttgcaatcgatcctaatggttatgttttattacatccaaatcttcagccaaagaaccccaaatctcaggagccagtaacattggatttccttgatgcagagttagagaatgatattaaagtggagattcgaaataagatgattgatggggaaagtggagaaaaaacattcagaactctggttaaatctcaagatgagagatatattgacaaaggaaacaggacatacacatggacacctgtcaatggcacagattacagtttggccttggtattaccaacctacagtttttactatataaaagccaaactagaagagacaataactcaggccagatcaaaaaagggcaaaatgaaggattcggaaaccctgaagccagataattttgaagaatctggctatacattcatagcaccaagagattactgcaatgacctgaaaatatcggataataacactgaatttcttttaaatttcaacgagtttattgatagaaaaactccaaacaacccatcatgtaacgcggatttgattaatagagtcttgcttgatgcaggctttacaaatgaacttgtccaaaattactggagtaagcagaaaaatatcaagggagtgaaagcacgatttgttgtgactgatggtgggattaccagagtttatcccaaagaggctggagaaaattggcaagaaaacccagagacatatgaggacagcttctataaaaggagcctagataatgataactatgttttcactgctccctactttaacaaaagtggacctggtgcctatgaatcgggcattatggtaagcaaagctgtagaaatatatattcaagggaaacttcttaaacctgcagttgttggaattaaaattgatgtaaattcctggatagagaatttcaccaaaacctcaatcagagatccgtgtgctggtccagtttgtgactgcaaaagaaacagtgacgtaatggattgtgtgattctggatgatggtgggtttcttctgatggcaaatcatgatgattatactaatcagattggaagattttttggagagattgatcccagcttgatgagacacctggttaatatatcagtttatgcttttaacaaatcttatgattatcagtcagtatgtgagcccggtgctgcaccaaaacaaggagcaggacatcgctcagcatatgtgccatcagtagcagacatattacaaattggctggtgggccactgctgctgcctggtctattctacagcagtttctcttgagtttgacctttccacgactccttgaggcagttgagatggaggatgatgacttcacggcctccctgtccaagcagagctgcattactgaacaaacccagtatttcttcgataacgacagtaaatcattcagtggtgtattagactgtggaaactgttccagaatctttcatggagaaaagcttatgaacaccaacttaatattcataatggttgagagcaaagggacatgtccatgtgacacacgactgctcatacaagcggagcagacttctgacggtccaaatccttgtgacatggttaagcaacctagataccgaaaagggcctgatgtctgctttgataacaatgtcttggaggattatactgactgtggtggtgtttctggattaaatccctccctgtggtatatcattggaatccagtttctactactttggctggtatctggcagcacacaccggctgttatgaccttctaaaaaccaaatctgcatagttaaactccagaccctgccaaaacatgagccctgccctcaattacagtaacgtagggtcagctataaaatcagacaaacattagctgggcctgttccatggcataacactaaggcgcagactcctaaggcacccactggctgcatgtcagggtgtcagatccttaaacgtgtgtgaatgctgcatcatctatgtgtaacatcaaagcaaaatcctatacgtgtcctctattggaaaatttgggagtttgttgttgcattgttggtgattacatgtgaaagggttccccatacaattgttaatgaaccataagaaatgtcttgatattgacctggaattttgacttgctgcaattttactaagaaaatctctaaggggaaagaaattatttttgccttcactttttcttctgtgaaaagttaattcctgctttaagtagcaattattgaaatatatagagaaagagagaattaacattggtctaaattgttgaaatataaataatggctaattttctatgaaaaatttgccatgaataaaatgccttatgaagaacggcttctttgccaaaaataaaacacaattgatgaccaattcaattttgatggggta

SEQ ID NO: 295781 - DNA, 1357 bp, Homo sapiens
cattctccatttcctacatcgccgaacgactagaacacaaaacccccttccgaccatcctgggaccacagtatcaaatcatgggtggataagatgcaagaagaccttgtcacactggcaaaaacagcaagtggagtcaatcagcttgttgatatttatgagaaatatcaagatttgtatactgtggaaccaaataatgcacgccagctggtagaaattgcagccagggatattgagaaacttctgagcaacagatctaaagccctggtgcgcctggcattggaagcggagaaagttcaagcagctcaccagtggagagaagattttgcaagcaatgaagttgtctactacaatgcaaaggatgatctcgatcctgagaaaaatgacagtgagccaggcagccagaggataaaacctgttttcattgaagatgctaattttggacgacaaatatcttatcagcacgcagcagtccatattcctactgacatctatgagggctcaacaattgtgttaaatgaactcaactggacaagtgccttagatgaagttttcaaaaagaatcgcgaggaagacccttcattattgtggcaggtttttggcagtgccactggcctagctcgatattatccagcttcaccatgggttgataatagtagaactccaaataagattgacctttatgatgtacgcagaagaccatggtacatccaaggagctgcatctcctaaagacatgcttattctggtggatgtgagtggaagtgttagtggattgacacttaaactgatccgaacatctgtctccgaaatgttagaaaccctctcagatgatgatttcgtgaatgtagcttcatttaacagcaatgctcaggatgtaagctgttttcagcaccttgtccaagcaaatgtaagaaataaaaaagtgttgaaagacgcggtgaataatatcacagccaaaggaattacagattataagaagggctttagttttgcttttgaacagctgcttaattataatgtttccagagcaaactgcaataagattattatgctattcacggatggaggagaagagagagcccaggagatatttaacaaatacaataaagataaaaaagtgagtgtaattttataatatttaaattttaataatgatctaggtggtttttaaagagatagtgggtagtggtagtgaggggagaatttttgatttaaaacctgattgtgccaattataaagccatatgaatcatagattataaactaataggtgtattagagagctgttaagtataatatttatatcatattcacaagcaactcatgcctaatatgttaataaagtatatgtatgggt

SEQ ID NO: 295782 - DNA, 1448 bp, Homo sapiens
cattctccatttcctacatcgccgaacgactagaacacaaaacccccttccgaccatcctgggaccacagtatcaaatcatgggtggataagatgcaagaagaccttgtcacactggcaaaaacagcaagtggagtcaatcagcttgttgatatttatgagaaatatcaagatttgtatactgtggaaccaaataatgcacgccagctggtagaaattgcagccagggatattgagaaacttctgagcaacagatctaaagccctggtgcgcctggcattggaagcggagaaagttcaagcagctcaccagtggagagaagattttgcaagcaatgaagttgtctactacaatgcaaaggatgatctcgatcctgagaaaaatgacagtgagccaggcagccagaggataaaacctgttttcattgaagatgctaattttggacgacaaatatcttatcagcacgcagcagtccatattcctactgacatctatgagggctcaacaattgtgttaaatgaactcaactggacaagtgccttagatgaagttttcaaaaagaatcgcgaggaagacccttcattattgtggcaggtttttggcagtgccactggcctagctcgatattatccagcttcaccatgggttgataatagtagaactccaaataagattgacctttatgatgtacgcagaagaccatggtacatccaaggagctgcatctcctaaagacatgcttattctggtggatgtgagtggaagtgttagtggattgacacttaaactgatccgaacatctgtctccgaaatgttagaaaccctctcagatgatgatttcgtgaatgtagcttcatttaacagcaatgctcaggatgtaagctgttttcagcaccttgtccaagcaaatgtaagaaataaaaaagtgttgaaagacgcggtgaataatatcacagccaaaggaattacagattataagaagggctttagttttgcttttgaacagctgcttaattataatgtttccagagcaaactgcaataagattattatgctattcacggatggaggagaagagagagcccaggagatatttaacaaatacaataaagataaaaaagtacgtgtattcacgttttcagttggtcaacacaattatgacagaggacctattcagtggatggcctgtgaaaacaaaggttattattatgaaattccttccattggtgcaataagaatcaatactcaggaatatttggatgttttgggaagaccaatggttttagcaggagacaaagctaagcaagtccaatggacaaatgtgtacctggatgcattggtaagaggttgagctattcagtcaaagactgtcataacaaaagcacacagatgatttctacttctttctagatgatgtctctgttttccttttcattaaaccctccccaaa

SEQ ID NO: 295783 - DNA, 1069 bp, Homo sapiens
gaacgacaaaagtcaccacattcccagtgaaagaagatttggaaacgaggagttgtttcgcccaatccaagggatatctcgatcctgagaaaaatgacagtgagccaggcagccagaggataaaacctgttttcattgaagatgctaattttggacgacaaatatcttatcagcacgcagcagtccatattcctactgacatctatgagggctcaacaattgtgttaaatgaactcaactggacaagtgccttagatgaagttttcaaaaagaatcgcgaggaagacccttcattattgtggcaggtttttggcagtgccactggcctagctcgatattatccagcttcaccatgggttgataatagtagaactccaaataagattgacctttatgatgtacgcagaagaccatggtacatccaaggagctgcatctcctaaagacatgcttattctggtggatgtgagtggaagtgttagtggattgacacttaaactgatccgaacatctgtctccgaaatgttagaaaccctctcagatgatgatttcgtgaatgtagcttcatttaacagcaatgctcaggatgtaagctgttttcagcaccttgtccaagcaaatgtaagaaataaaaaagtgttgaaagacgcggtgaataatatcacagccaaaggaattacagattataagaagggctttagttttgcttttgaacagctgcttaattataatgtttccagagcaaactgcaataagattattatgctattcacggatggaggagaagagagagcccaggagatatttaacaaatacaataaagataaaaaagtgagtgtaattttataatatttaaattttaataatgatctaggtggtttttaaagagatagtgggtagtggtagtgaggggagaatttttgatttaaaacctgattgtgccaattataaagccatatgaatcatagattataaactaataggtgtattagagagctgttaagtataatatttatatcatattcacaagcaactcatgcctaatatgttaataaagtatatgtatgggt

SEQ ID NO: 295784 - DNA, 3866 bp, Homo sapiens
cattctccatttcctacatcgccgaacgactagaacacaaaacccccttccgaccatcctgggaccacagtatcaaatcatgggtggataagatgcaagaagaccttgtcacactggcaaaaacagcaagtggagtcaatcagcttgttgatatttatgagaaatatcaagatttgtatactgtggaaccaaataatgcacgccagctggtagaaattgcagccagggatattgagaaacttctgagcaacagatctaaagccctggtgagcctggcattggaagcggagaaagttcaagcagctcaccagtggagagaagattttgcaagcaatgaagttgtctactacaatgcaaaggatgatctcgatcctgagaaaaatgacagtgagccaggcagccagaggataaaacctgttttcattgaagatgctaattttggacgacaaatatcttatcagcacgcagcagtccatattcctactgacatctatgagggctcaacaattgtgttaaatgaactcaactggacaagtgccttagatgaagttttcaaaaagaatcgcgaggaagacccttcattattgtggcaggtttttggcagtgccactggcctagctcgatattatccagcttcaccatgggttgataatagtagaactccaaataagattgacctttatgatgtacgcagaagaccatggtacatccaaggagctgcatctcctaaagacatgcttattctggtggatgtgagtggaagtgttagtggattgacacttaaactgatccgaacatctgtctccgaaatgttagaaaccctctcagatgatgatttcgtgaatgtagcttcatttaacagcaatgctcaggatgtaagctgttttcagcaccttgtccaagcaaatgtaagaaataaaaaagtgttgaaagacgcggtgaataatatcacagccaaaggaattacagattataagaagggctttagttttgcttttgaacagctgcttaattataatgtttccagagcaaactgcaataagattattatgctattcacggatggaggagaagagagagcccaggagatatttaacaaatacaataaagataaaaaagtacgtgtattcaggttttcagttggtcaacacaattatgagagaggacctattcagtggatggcctgtgaaaacaaaggttattattatgaaattccttccattggtgcaataagaatcaatactcaggaatatttggatgttttgggaagaccaatggttttagcaggagacaaagctaagcaagtccaatggacaaatgtgtacctggatgcattggaactgggacttgtcattactggaactcttccggtcttcaacataaccggccaatttgaaaataagacaaacttaaagaaccagctgattcttggtgtgatgggagtagatgtgtctttggaagatattaaaagactgacaccacgttttacactgtgccccaatgggtattactttgcaatcgatcctaatggttatgttttattacatccaaatcttcagccaaagaaccccaaatctcaggagccagtaacattggatttccttgatgcagagttagagaatgatattaaagtggagattcgaaataagatgattgatggggaaagtggagaaaaaacattcagaactctggttaaatctcaagatgagagatatattgacaaaggaaacaggacatacacatggacacctgtcaatggcacagattacagtttggccttggtattaccaacctacagtttttactatataaaagccaaactagaagagacaataactcaggccagatattcggaaaccctgaagccagataattttgaagaatctggctatacattcatagcaccaagagattactgcaatgacctgaaaatatcggataataacactgaatttcttttaaatttcaacgagtttattgatagaaaaactccaaacaacccatcatgtaacgcggatttgattaatagagtcttgcttgatgcaggctttacaaatgaacttgtccaaaattactggagtaagcagaaaaatatcaagggagtgaaagcacgatttgttgtgactgatggtgggattaccagagtttatcccaaagaggctggagaaaattggcaagaaaacccagagacatatgaggacagcttctataaaaggagcctagataatgataactatgttttcactgctccctactttaacaaaagtggacctggtgcctatgaatcgggcattatggtaagcaaagctgtagaaatatatattcaagggaaacttcttaaacctgcagttgttggaattaaaattgatgtaaattcctggatagagaatttcaccaaaacctcaatcagagatccgtgtgctggtccagtttgtgactgcaaaagaaacagtgacgtaatggattgtgtgattctggatgatggtgggtttcttctgatggcaaatcatgatgattatactaatcagattggaagattttttggagagattgatcccagcttgatgagacacctggttaatatatcagtttatgcttttaacaaatcttatgattatcagtcagtatgtgagcccggtgctgcaccaaaacaaggagcaggacatcgctcagcatatgtgccatcagtagcagacatattacaaattggctggtgggccactgctgctgcctggtctattctacagcagtttctcttgagtttgacctttccacgactccttgaggcagttgagatggaggatgatgacttcacggcctccctgtccaagcagagctgcattactgaacaaacccagtatttcttcgataacgacagtaaatcattcagtggtgtattagactgtggaaactgttccagaatctttcatggagaaaagcttatgaacaccaacttaatattcataatggttgagagcaaagggacatgtccatgtgacacacgactgctcatacaagcggagcagacttctgacggtccaaatccttgtgacatggttaagcaacctagataccgaaaagggcctgatgtctgctttgataacaatgtcttggaggattatactgactgtggtggtgtttctggattaaatccctccctgtggtatatcattggaatccagtttctactactttggctggtatctggcagcacacaccggctgttatgaccttctaaaaaccaaatctgcatagttaaactccagaccctgccaaaacatgagccctgccctcaattacagtaacgtagggtcagctataaaatcagacaaacattagctgggcctgttccatggcataacactaaggcgcagactcctaaggcacccactggctgcatgtcagggtgtcagatccttaaacgtgtgtgaatgctgcatcatctatgtgtaacatcaaagcaaaatcctatacgtgtcctctattggaaaatttgggagtttgttgttgcattgttggtgattacatgtgaaagggttccccatacaattgttaatgaaccataagaaatgtcttgatattgacctggaattttgacttgctgcaattttactaagaaaatctctaaggggaaagaaattatttttgccttcactttttcttctgtgaaaagttaattcctgctttaagtagcaattattgaaatatatagagaaagagagaattaacattggtctaaattgttgaaatataaataatggctaattttctatgaaaaatttgccatgaataaaatgccttatgaagaacggcttctttgccaaaaataaaacacaattgatgaccaattcaattttgatggggta

SEQ ID NO: 295785 - DNA, 1275 bp, Homo sapiens
ggttaaaaccgaaaataaaaatgggctagacacaaaggactcggtgcttgtcccagccaggcgccctcggcgacgcgggcagctgggaggggaatgggcgcccggacccagctgggacccccgggtgcgactccacctacctagtccggcgccaggccgggtcgacagctccggcagcgccagcgccgcgccgtgtccagatgtcgcgtcagaggcgtgcagcggtttagtttaatttcgcttgttttccaaatctagaagaggagcggagcggcttttagttcaaaactgacattcagcctcctgattggcggatagagcaatgagatgacctcgctttcctttcttcctttttcatttttaaataatctagtttgaagaatggaagactttcgacgaggggagccaggaataaaataaggggaataggggagcggggacgcgagcagcaccagaatccgcgggagcgcggctgttcctggtcatgatgatgggcagcgcccgagtggcggagctgctgctgctccacggcgcggagcccaactgcgccgaccccgccactctcacccgacccgtgcacgacgctgcccgggagggcttcctggacacgctggtggtgctgcaccgggccggggcgcggctggacgtgcgcgatgcctggggccgtctgcccgtggacctggctgaggagctgggccatcgcgatgtcgcacggtacctgcgcgcggctgcggggggcaccagaggcagtaaccatgcccgcatagatgccgcggaaggtccctcagacatccccgattgaaagaaccagagaggctctgagaaacctccggaaacttagatcatcagtcaccgaaggtcctacagggccacaactgcccccgccacaacccaccccgctttcgtagttttcatttagaaaatagagcttttaaaaatgtcctgccttttaacgtagatatatgccttcccccactaccgtaaatgtccatttatatcattttttatatattcttataaaaatgtaaaaaagaaaaacaccgcttctgccttttcactgtgttggagttttctggagtgagcactcacgccctaagcgcacattcatgtgggcatttcttgcgagcctcgcagcctccggaagctgtcgacttcatgacaagcattttgtgaactagggaagctcaggggggttactggcttctcttgagtcacactgctagcaaatggcagaaccaaagctcaaataaaaataaaataattttcattcattca

SEQ ID NO: 295786 - DNA, 1272 bp, Homo sapiens
cctccctacgggcgcctccggcagcccttcccgcgtgcgcagggctcagagccgttccgagatcttggaggtccgggtgggagtgggggtggggtgggggtgggggtgaaggtggggggcgggcgcgctcagggaaggcgggtgcgcgcctgcggggcggagatgggcagggggcggtgcgtgggtcccagtctgcagttaagggggcaggagtggcgctgctcacctctggtgccaaagggcggcgcagcggctgccgagctcggccctggaggcggcgagaacatggtgcgcaggttcttggtgaccctccggattcggcgcgcgtgcggcccgccgcgagtgagggttttcgtggttcacatcccgcggctcacgggggagtgggcagcgccaggggcgcccgccgctgtggccctcgtgctgatgctactgaggagccagcgtctagggcagcagccgcttcctagaagaccaggtcatgatgatgggcagcgcccgagtggcggagctgctgctgctccacggcgcggagcccaactgcgccgaccccgccactctcacccgacccgtgcacgacgctgcccgggagggcttcctggacacgctggtggtgctgcaccgggccggggcgcggctggacgtgcgcgatgcctggggccgtctgcccgtggacctggctgaggagctgggccatcgcgatgtcgcacggtacctgcgcgcggctgcggggggcaccagaggcagtaaccatgcccgcatagatgccgcggaaggtccctcagacatccccgattgaaagaaccagagaggctctgagaaacctccggaaacttagatcatcagtcaccgaaggtcctacagggccacaactgcccccgccacaacccaccccgctttcgtagttttcatttagaaaatagagcttttaaaaatgtcctgccttttaacgtagatatatgccttcccccactaccgtaaatgtccatttatatcattttttatatattcttataaaaatgtaaaaaagaaaaacaccgcttctgccttttcactgtgttggagttttctggagtgagcactcacgccctaagcgcacattcatgtgggcatttcttgcgagcctcgcagcctccggaagctgtcgacttcatgacaagcattttgtgaactagggaagctcaggggggttactggcttctcttgagtcacactgctagcaaatggcagaaccaaagctcaaataaaaataaaataattttcattcattca

SEQ ID NO: 295787 - DNA, 1215 bp, Homo sapiens
cccaacctggggcgacttcaggggtgccacattcgctaagtgctcggagttaatagcacctcctccgagcactcgctcacggcgtccccttgcctggaaagataccgcggtccctccagaggatttgagggacagggtcggagggggctcttccgccagcaccggaggaagaaagaggaggggctggctggtcaccagagggtggggcggaccgcgtgcgctcggcggctgcggagagggggagagcaggcagcgggcggcggggagcagcatggagccggcggcggggagcagcatggagccttcggctgactggctggccacggccgcggcccggggtcgggtagaggaggtgcgggcgctgctggaggcgggggcgctgcccaacgcaccgaatagttacggtcggaggccgatccaggtcatgatgatgggcagcgcccgagtggcggagctgctgctgctccacggcgcggagcccaactgcgccgaccccgccactctcacccgacccgtgcacgacgctgcccgggagggcttcctggacacgctggtggtgctgcaccgggccggggcgcggctggacgtgcgcgatgcctggggccgtctgcccgtggacctggctgaggagctgggccatcgcgatgtcgcacggtacctgcgcgcggctgcggggggcaccagaggcagtaaccatgcccgcatagatgccgcggaaggtccctcagacatccccgattgaaagaaccagagaggctctgagaaacctccggaaacttagatcatcagtcaccgaaggtcctacagggccacaactgcccccgccacaacccaccccgctttcgtagttttcatttagaaaatagagcttttaaaaatgtcctgccttttaacgtagatatatgccttcccccactaccgtaaatgtccatttatatcattttttatatattcttataaaaatgtaaaaaagaaaaacaccgcttctgccttttcactgtgttggagttttctggagtgagcactcacgccctaagcgcacattcatgtgggcatttcttgcgagcctcgcagcctccggaagctgtcgacttcatgacaagcattttgtgaactagggaagctcaggggggttactggcttctcttgagtcacactgctagcaaatggcagaaccaaagctcaaataaaaataaaataattttcattcattca

SEQ ID NO: 295788 - DNA, 1170 bp, Homo sapiens
cctccctacgggcgcctccggcagcccttcccgcgtgcgcagggctcagagccgttccgagatcttggaggtccgggtgggagtgggggtggggtgggggtgggggtgaaggtggggggcgggcgcgctcagggaaggcgggtgcgcgcctgcggggcggagatgggcagggggcggtgcgtgggtcccagtctgcagttaagggggcaggagtggcgctgctcacctctggtgccaaagggcggcgcagcggctgccgagctcggccctggaggcggcgagaacatggtgcgcaggttcttggtgaccctccggattcggcgcgcgtgcggcccgccgcgagtgagggttttcgtggttcacatcccgcggctcacgggggagtgggcagcgccaggggcgcccgccgctgtggccctcgtgctgatgctactgaggagccagcgtctagggcagcagccgcttcctagaagaccaggtcatgatgatgggcagcgcccgagtggcggagctgctgctgctccacggcgcggagcccaactgcgccgaccccgccactctcacccgacccgtgcacgacgctgcccgggagggcttcctggacacgctggtggtgctgcaccgggccggggcgcggctggacgtgcgcgatgcctggggccgtctgcccgtggacctggctgaggagctgggccatcgcgatgtcgcacggtacctgcgcgcggctgcggggggcaccagaggcagtaaccatgcccgcatagatgccgcggaaggtccctcagacatccccgattgaaagaaccagagaggctctgagaaacctccggaaacttagatcatcagtcaccgaaggtcctacagggccacaactgcccccgccacaacccaccccgctttcgtagttttcatttagaaaatagagcttttaaaaatgtcctgccttttaacgtagatatatgccttcccccactaccgtaaatgtccatttatatcattttttatatattcttataaaaatgtaaaacaagaggttacaaggacacagcgacaaaaaaaaacagcaacatcaacacagaagcaaaacgaaggagcgcgcaccaggaaataccgcagaggcacacaacaaacagacagacgcacgaacttgtataaacgagagcagacaag

SEQ ID NO: 295789 - DNA, 1192 bp, Homo sapiens
cccaacctggggcgacttcaggggtgccacattcgctaagtgctcggagttaatagcacctcctccgagcactcgctcacggcgtccccttgcctggaaagataccgcggtccctccagaggatttgagggacagggtcggagggggctcttccgccagcaccggaggaagaaagaggaggggctggctggtcaccagagggtggggcggaccgcgtgcgctcggcggctgcggagagggggagcagcatggagccggcggcggggagcagcatggagccttcggctgactggctggccacggccgcggcccggggtcgggtagaggaggtgcgggcgctgctggaggcgggggcgctgcccaacgcaccgaatagttacggtcggaggccgatccaggtcatgatgatgggcagcgcccgagtggcggagctgctgctgctccacggcgcggagcccaactgcgccgaccccgccactctcacccgacccgtgcacgacgctgcccgggagggcttcctggacacgctggtggtgctgcaccgggccggggcgcggctggacgtgcgcgatgcctggggccgtctgcccgtggacctggctgaggagctgggccatcgcgatgtcgcacggtacctgcgcgcggctgcggggggcaccagaggcagtaaccatgcccgcatagatgccgcggaaggtccctcagacatccccgattgaaagaaccagagaggctctgagaaacctccggaaacttagatcatcagtcaccgaaggtcctacagggccacaactgcccccgccacaacccaccccgctttcgtagttttcatttagaaaatagagcttttaaaaatgtcctgccttttaacgtagatatatgccttcccccactaccgtaaatgtccatttatatcattttttatatattcttataaaaatgtaaaaaagaaaaacaccgcttctgccttttcactgtgttggagttttctggagtgagcactcacgccctaagcgcacattcatgtgggcatttcttgcgagcctcgcagcctccggaagctgtcgacttcatgacaagcattttgtgaactagggaagctcaggggggttactggcttctcttgagtcacactgctagcaaatggcagaaccaaagctcaaataaaaataaaataattttcattcattca

SEQ ID NO: 295790 - DNA, 1489 bp, Homo sapiens
  misc_feature (431)..(431): n is a, c, g, or t
  misc_feature (605)..(605): n is a, c, g, or t
cccaacctggggcgacttcaggggtgccacattcgctaagtgctcggagttaatagcacctcctccgagcactcgctcacggcgtccccttgcctggaaagataccgcggtccctccagaggatttgagggacagggtcggagggggctcttccgccagcaccggaggaagaaagaggaggggctggctggtcaccagagggtggggcggaccgcgtgcgctcggcggctgcggagagggggagagcaggcagcgggcggcggggagcagcatggagccggcggcggggagcagcatggagccttcggctgactggctggccacggccgcggcccggggtcgggtagaggaggtgcgggcgctgctggaggcgggggcgctgcccaacgcaccgaatagttacggtcggaggccgatccaggtgggtaganggtctgcagcgggagcaggggatggcgggcgactctggaggacgaagtttgcaggggaattggaatcaggtagcgcttcgattctccggaaaaaggggaggcttcctggggagttttcagaaggggtttgtaatcacagacctcctcctggcgacgccctgggggcttgggaanccaaggaagaggaatgaggagccacgcgcgtacagatctctcgaatgctgagaagatctgaaggggggaacatatttgtattagatggaagtcatgatgatgggcagcgcccgagtggcggagctgctgctgctccacggcgcggagcccaactgcgccgaccccgccactctcacccgacccgtgcacgacgctgcccgggagggcttcctggacacgctggtggtgctgcaccgggccggggcgcggctggacgtgcgcgatgcctggggccgtctgcccgtggacctggctgaggagctgggccatcgcgatgtcgcacggtacctgcgcgcggctgcggggggcaccagaggcagtaaccatgcccgcatagatgccgcggaaggtccctcagacatccccgattgaaagaaccagagaggctctgagaaacctccggaaacttagatcatcagtcaccgaaggtcctacagggccacaactgcccccgccacaacccaccccgctttcgtagttttcatttagaaaatagagcttttaaaaatgtcctgccttttaacgtagatatatgccttcccccactaccgtaaatgtccatttatatcattttttatatattcttataaaaatgtaaaaaagaaaaacaccgcttctgccttttcactgtgttggagttttctggagtgagcactcacgccctaagcgcacattcatgtgggcatttcttgcgagcctcgcagcctccggaagctgtcgacttcatgacaagcattttgtgaactagggaagctcaggggggttactggcttctcttgagtcacactgctagcaaatggcagaaccaaagctcaaataaaaataaaataattttcattcattca

SEQ ID NO: 295791 - DNA, 1447 bp, Homo sapiens
ggttaaaaccgaaaataaaaatgggctagacacaaaggactcggtgcttgtcccagccaggcgccctcggcgacgcgggcagctgggaggggaatgggcgcccggacccagctgggacccccgggtgcgactccacctacctagtccggcgccaggccgggtcgacagctccggcagcgccagcgccgcgccgtgtccagatgtcgcgtcagaggcgtgcagcggtttagtttaatttcgcttgttttccaaatctagaagaggagcggagcggcttttagttcaaaactgacattcagcctcctgattggcggatagagcaatgagatgacctcgctttcctttcttcctttttcatttttaaataatctagtttgaagaatggaagactttcgacgaggggagccaggaataaaataaggggaataggggagcggggacgcgagcagcaccagaatccgcgggagcgcggctgttcctgcccaggctaggaggaggaggagataaccgccggtggaggcttccccattcgggttacaacgacttagacatgtggttctcgcagtaccattgaacctggacctcccttcacacagcccctcaatcgtgggaaactgaggcgaacagagcttctaaacccacctcagaagtcagtcatgatgatgggcagcgcccgagtggcggagctgctgctgctccacggcgcggagcccaactgcgccgaccccgccactctcacccgacccgtgcacgacgctgcccgggagggcttcctggacacgctggtggtgctgcaccgggccggggcgcggctggacgtgcgcgatgcctggggccgtctgcccgtggacctggctgaggagctgggccatcgcgatgtcgcacggtacctgcgcgcggctgcggggggcaccagaggcagtaaccatgcccgcatagatgccgcggaaggtccctcagacatccccgattgaaagaaccagagaggctctgagaaacctccggaaacttagatcatcagtcaccgaaggtcctacagggccacaactgcccccgccacaacccaccccgctttcgtagttttcatttagaaaatagagcttttaaaaatgtcctgccttttaacgtagatatatgccttcccccactaccgtaaatgtccatttatatcattttttatatattcttataaaaatgtaaaaaagaaaaacaccgcttctgccttttcactgtgttggagttttctggagtgagcactcacgccctaagcgcacattcatgtgggcatttcttgcgagcctcgcagcctccggaagctgtcgacttcatgacaagcattttgtgaactagggaagctcaggggggttactggcttctcttgagtcacactgctagcaaatggcagaaccaaagctcaaataaaaataaaataattttcattcattca

SEQ ID NO: 295792 - DNA, 918 bp, Homo sapiens
aggggtaattagacacctggggcttgtgtgggggtctgcttggcggtgagggggctctacacaagcttcctttccgtcatgccggcccccaccctggctctgaccattctgttctctctggcaggtcatgatgatgggcagcgcccgagtggcggagctgctgctgctccacggcgcggagcccaactgcgccgaccccgccactctcacccgacccgtgcacgacgctgcccgggagggcttcctggacacgctggtggtgctgcaccgggccggggcgcggctggacgtgcgcgatgcctggggccgtctgcccgtggacctggctgaggagctgggccatcgcgatgtcgcacggtacctgcgcgcggctgcggggggcaccagaggcagtaaccatgcccgcatagatgccgcggaaggtccctcagacatccccgattgaaagaaccagagaggctctgagaaacctccggaaacttagatcatcagtcaccgaaggtcctacagggccacaactgcccccgccacaacccaccccgctttcgtagttttcatttagaaaatagagcttttaaaaatgtcctgccttttaacgtagatatatgccttcccccactaccgtaaatgtccatttatatcattttttatatattcttataaaaatgtaaaaaagaaaaacaccgcttctgccttttcactgtgttggagttttctggagtgagcactcacgccctaagcgcacattcatgtgggcatttcttgcgagcctcgcagcctccggaagctgtcgacttcatgacaagcattttgtgaactagggaagctcaggggggttactggcttctcttgagtcacactgctagcaaatggcagaaccaaagctcaaataaaaataaaataattttcattcattca

SEQ ID NO: 295793 - DNA, 1428 bp, Homo sapiens
catcccccctcctcctcctaaagtactgggattacagtcccaagctatcttgcccgacctgggaaacagacgttaaggaagataacaatctattttcagagagcgagtttataaaaccaatgcaatgggtaaatatgaagtgtgaataggaggagaagctaaagagtggtcggagaatctaatgcaagctacgggagaaagaaactcaagtgcaaatgctgcctcaggaataaacgtaaaaagagactttcaagtgcaaatgctccctcaggaataaaataatcttgagactctcaagtgtaaatgctgcctcgggagaaccgaacggcgagctggagcccatacgcaacgagattagagaggaaggcagaagccagagcacatgaataaatgagcatccattttgtttcagaaatgatcggaaaccatttgtgggtttgtagaagcaggcatgcgtagggaagctacgggattccgccgaggagcgccagagcctgaggcgccctttggttatcgcaagctggctggctcactccgcaccaggtgcaaaagatgcctggggatgcgggaagggaaaggccacatcttcacgccttcgcgcctggcattgtgagcaaccactgagactcattatataacactcgttttcttcttgcaaccctgcgggccgcgcggtcgcgctttctctgccctccgccgggtggacctggagcgcttgagcggtcggcgcgcctggagcagccaggcgggcagtggactagctgctggaccagggaggtgtgggagagcggtggcggcgggtacatgcacgtgaagccattgcgagaactttatccataagtatttcaatgccggtagggacggcaagagaggagggcgggatgtgccacacatctttgacctcaggtttctaacgcctgttttctttctgccctctgcagacatccccgattgaaagaaccagagaggctctgagaaacctccggaaacttagatcatcagtcaccgaaggtcctacagggccacaactgcccccgccacaacccaccccgctttcgtagttttcatttagaaaatagagcttttaaaaatgtcctgccttttaacgtagatatatgccttcccccactaccgtaaatgtccatttatatcattttttatatattcttataaaaatgtaaaaaagaaaaacaccgcttctgccttttcactgtgttggagttttctggagtgagcactcacgccctaagcgcacattcatgtgggcatttcttgcgagcctcgcagcctccggaagctgtcgacttcatgacaagcattttgtgaactagggaagctcaggggggttactggcttctcttgagtcacactgctagcaaatggcagaaccaaagctcaaataaaaataaaataattttcattcattca

SEQ ID NO: 295794 - DNA, 1141 bp, Homo sapiens
cccaacctggggcgacttcaggggtgccacattcgctaagtgctcggagttaatagcacctcctccgagcactcgctcacggcgtccccttgcctggaaagataccgcggtccctccagaggatttgagggacagggtcggagggggctcttccgccagcaccggaggaagaaagaggaggggctggctggtcaccagagggtggggcggaccgcgtgcgctcggcggctgcggagagggggagagcaggcagcgggcggcggggagcagcatggagccggcggcggggagcagcatggagccttcggctgactggctggccacggccgcggcccggggtcgggtagaggaggtgcgggcgctgctggaggcgggggcgctgcccaacgcaccgaatagttacggtcggaggccgatccaggtcatgatgatgggcagcgcccgagtggcggagctgctgctgctccacggcgcggagcccaactgcgccgaccccgccactctcacccgacccgtgcacgacgctgcccgggagggcttcctggacacgctggtggtgctgcaccgggccggggcgcggctggacgtgcgcgatgcctggggccgtctgcccgtggacctggctgaggagctgggccatcgcgatgtcgcacgacatccccgattgaaagaaccagagaggctctgagaaacctccggaaacttagatcatcagtcaccgaaggtcctacagggccacaactgcccccgccacaacccaccccgctttcgtagttttcatttagaaaatagagcttttaaaaatgtcctgccttttaacgtagatatatgccttcccccactaccgtaaatgtccatttatatcattttttatatattcttataaaaatgtaaaaaagaaaaacaccgcttctgccttttcactgtgttggagttttctggagtgagcactcacgccctaagcgcacattcatgtgggcatttcttgcgagcctcgcagcctccggaagctgtcgacttcatgacaagcattttgtgaactagggaagctcaggggggttactggcttctcttgagtcacactgctagcaaatggcagaaccaaagctcaaataaaaataaaataattttcattcattca

SEQ ID NO: 295795 - DNA, 1010 bp, Homo sapiens
cctccctacgggcgcctccggcagcccttcccgcgtgcgcagggctcagagccgttccgagatcttggaggtccgggtgggagtgggggtggggtgggggtgggggtgaaggtggggggcgggcgcgctcagggaaggcgggtgcgcgcctgcggggcggagatgggcagggggcggtgcgtgggtcccagtctgcagttaagggggcaggagtggcgctgctcacctctggtgccaaagggcggcgcagcggctgccgagctcggccctggaggcggcgagaacatggtgcgcaggttcttggtgaccctccggattcggcgcgcgtgcggcccgccgcgagtgagggttttcgtggttcacatcccgcggctcacgggggagtgggcagcgccaggggcgcccgccgctgtggccctcgtgctgatgctactgaggagccagcgtctagggcagcagccgcttcctagaagaccaggtcatgatgatgggcagcgcccgagtggcggagctgctgctgctccacggcgcggagcccaactgcgccgaccccgccactctcacccgacccgtgcacgacgctgcccgggagggcttcctggacacgctggtggtgctgcaccgggccggggcgcggctggacgtgcgcgatgcctggggccgtctgcccgtggacctggctgaggagctgggccatcgcgatgtcgcacggtacctgcgcgcggctgcggggggcaccagaggcagtaaccatgcccgcatagatgccgcggaaggtccctcagttacagctagcatccaggtcccgggaggtgaagaaggagacttcggctccagttacagctagcatccgggtcccgatttagaaggagctgccaattacagcgcggttccagggctgagcaaaaagcctgaggagccaagtgggagagggagtaaaactactgaattgggccacaagcaaatgaataaactgaacgactcttaaccaaacctaatatatttaatca

SEQ ID NO: 295796 - DNA, 3760 bp, Homo sapiens
tatttctatagtgagcatatatcacttttgtaatcctcaaaaacacaaaatggaacatccttttgttcatggatggaacaatggaaccattatttaaaacataaaagtggaatccctgaatgacaaggacagcagctggcaggcatctgggggaaggaagatgacagctgagaaattaagttagaatgaggatatggaaagcatccacactaaggcgccgtcagccagacccgcaccaggcacatgtgaggccccatcctccaccgagtgttcactgtctcagtgagtctcttggcagtagggccccgtccctgtccgccaccgcacagtgacatactttctcccgccctctcccctaggtcagctggaactgggtccgcctggaaacccgggggccgggcccccagagggctttcgcagcctggccgcccgaagctcacctgccctttcactgaactccacccggaaggtgcccggggcttcgtgttcctgggtgctgaccgtgcactccccgccgcccgaggacttagagctctggaagtagctctccagcttccttcgtactcgggggccggacttgtacacccgcacgaggagcggggacggcgggcgcagaagtgggccaccatatctggaaactacagtctatgctttgaagcgcaaaagggaataaacatttaaagactcccccggggacctggaggatggacttttccatggtggccggagcagcagcttacaatgaaaaatcaggtaggattacctcgctctcactcttgtttcagaaagtctttgctcagatctttcctcagtggagaaaggggaatacagaagaatgtctcccctacaagtgctcagagactggtgctcttggagaaaactatagttggcaaattcccattaaccacaatgacttcaaaattttaaaaaataatgagcgtcagctgtgtgaagtcctccagaataagtttggctgtatctctaccctggtctctccagttcaggaaggcaacagcaaatctctgcaagtgttcagaaaaatgctgactcctaggatagagttatcagtctggaaagatgacctcaccacacatgctgttgatgctgtggtgaatgcagccaatgaagatcttctgcatgggggaggcctggccctggccctggtaaaagctggtggatttgaaatccaagaagagagcaaacagtttgttgccagatatggtaaagtgtcagctggtgagatagctgtcacgggagcagggaggcttccctgcaaacagatcatccatgctgttgggcctcggtggatggaatgggataaacagggatgtactggaaagctgcagagggccattgtaagtattctgaattatgtcatctataaaaatactcacattaagacagtagcaattccagccttgagctctgggatttttcagttccctctgaatttgtgtacaaagactattgtagagactatccgggttagtttgcaagggaagccaatgatgagtaatttgaaagaaattcacctggtgagcaatgaggaccctactgttgctgcctttaaagctgcttcagaattcatcctagggaagagtgagctgggacaagaaaccaccccttctttcaatgcaatggtcgtgaacaacctgaccctccagattgtccagggccacattgaatggcagacggcagatgtaattgttaattctgtaaacccacatgatattacagttggacctgtggcaaagtcaattctacaacaagcaggagttgaaatgaaatcggaatttcttgccacaaaggctaaacagtttcaacggtcccagttggtactggtcacaaaaggatttaacttgttctgtaaatatatataccatgtactgtggcattcagaatttcctaaacctcagatattaaaacatgcaatgaaggagtgtttggaaaaatgcattgagcaaaatataacttccatttcctttcctgcccttgggactggaaacatggaaataaagaaggaaacagcagcagagattttgtttgatgaagttttaacatttgccaaagaccatgtaaaacaccagttaactgtaaaatttgtgatctttccaacagatttggagatatataaggctttcagttctgaaatggcaaagaggtccaagatgctgagtttgaacaattacagtgtcccccagtcaaccagagaggagaaaagagaaaatgggcttgaagctagatctcctgccatcaatctgatgggattcaacgtggaagagatgtgtgaggcccacgcatggatccaaagaatcctgagtctccagaaccaccacatcattgagaataatcatattctgtaccttgggagaaaggaacatgacattttgtctcagcttcagaaaacttcaagtgtctccatcacagaaattatcagcccaggaaggacagagttagagattgaaggagcccgggctgacctcattgaggtggttatgaacattgaagatatgctttgtaaagtacaggaggaaatggcaaggaaaaaggagcgaggcctttggcgctcgttaggacagtggactattcagcaacaaaaaacccaagacgaaatgaaagaaaatatcatatttctgaaatgtcctgtgcctccaactcaagagcttctagatcaaaagaaacagtttgaaaaatgtggtttgcaggttctaaaggtggagaagatagacaatgaggtccttatggctgcctttcaaagaaagaagaaaatgatggaagaaaaactgcacaggcaacctgtgagccataggctgtttcagcaagtcccataccagttctgcaatgtggtatgcagagttggctttcaaagaatgtactcgacaccttgcgatccaaaatacggagctggcatatacttcaccaagaacctcaaaaacctggcagagaaggccaagaaaatctctgctgcagataagctgatctatgtgtttgaggctgaagtactcacaggcttcttctgccagggacatccgttaaatattgttcccccaccactgagtcctggagctatagatggtcatgacagtgtggttgacaatgtctccagccctgaaacctttgttatttttagtggcatgcaggctatacctcagtatttgtggacatgcacccaggaatatgtacagtcacaagattactcatcaggaccaatgagaccctttgcacagcatccttggaggggattcgcaagtggcagccctgttgattaatctctacatcattttaacagctggtatggccttaccttgggtgaactaaccaaataatgaccatcgatggctcaaagagtggcttgaatatatcccatgggttatctgtatggactgactgggttattgaaaggactagccacatactagcatcttagtgcctttatctgtctttatgtcttggggttggggtaggtagataccaaatgaaacactttcaggaccttccttcctcttgcagttgttctttaatctcctttactagaggagataaatattttgcatataatgaagaaatttttctagtatataacgcaggccttttattttctaaaatgatgatagtataaaaatgttaggataacagaatgattttagattttccagagaatattataaagtgctttaggtatgaaaataaatcatctttgtctgattaaaaaaaaaaaaaattatgtgtaaaatgaaacaatttgaagtggaaggacata

SEQ ID NO: 295797 - DNA, 3655 bp, Homo sapiens
tatttctatagtgagcatatatcacttttgtaatcctcaaaaacacaaaatggaacatccttttgttcatggatggaacaatggaaccattatttaaaacataaaagtggaatccctgaatgacaaggacagcagctggcaggcatctgggggaaggaagatgacagctgagaaattaagttagaatgaggatatggaaagcatccacactaaggcgccgtcagccagacccgcaccaggcacatgtgaggccccatcctccaccgagtgttcactgtctcagtgagtctcttggcagtagggccccgtccctgtccgccaccgcacagtgacatactttctcccgccctctcccctaggtcagctggaactgggtccgcctggaaacccgggggccgggcccccagagggctttcgcagcctggccgcccgaagctcacctgccctttcactgaactccacccggaaggtgcccggggcttcgtgttcctgggtgctgaccgtgcactccccgccgcccgaggacttagagctctggaagtagctctccagcttccttcgtactcgggggccggacttgtacacccgcacgaggagcggggacggcgggcgcagaagtgggccaccatatctggaaactacagtctatgctttgaagcgcaaaagggaataaacatttaaagactcccccggggacctggaggatggacttttccatggtggccggagcagcagcttacaatgaaaaatcagagactggtgctcttggagaaaactatagttggcaaattcccattaaccacaatgacttcaaaattttaaaaaataatgagcgtcagctgtgtgaagtcctccagaataagtttggctgtatctctaccctggtctctccagttcaggaaggcaacagcaaatctctgcaagtgttcagaaaaatgctgactcctaggatagagttatcagtctggaaagatgacctcaccacacatgctgttgatgctgtggtgaatgcagccaatgaagatcttctgcatgggggaggcctggccctggccctggtaaaagctggtggatttgaaatccaagaagagagcaaacagtttgttgccagatatggtaaagtgtcagctggtgagatagctgtcacgggagcagggaggcttccctgcaaacagatcatccatgctgttgggcctcggtggatggaatgggataaacagggatgtactggaaagctgcagagggccattgtaagtattctgaattatgtcatctataaaaatactcacattaagacagtagcaattccagccttgagctctgggatttttcagttccctctgaatttgtgtacaaagactattgtagagactatccgggttagtttgcaagggaagccaatgatgagtaatttgaaagaaattcacctggtgagcaatgaggaccctactgttgctgcctttaaagctgcttcagaattcatcctagggaagagtgagctgggacaagaaaccaccccttctttcaatgcaatggtcgtgaacaacctgaccctccagattgtccagggccacattgaatggcagacggcagatgtaattgttaattctgtaaacccacatgatattacagttggacctgtggcaaagtcaattctacaacaagcaggagttgaaatgaaatcggaatttcttgccacaaaggctaaacagtttcaacggtcccagttggtactggtcacaaaaggatttaacttgttctgtaaatatatataccatgtactgtggcattcagaatttcctaaacctcagatattaaaacatgcaatgaaggagtgtttggaaaaatgcattgagcaaaatataacttccatttcctttcctgcccttgggactggaaacatggaaataaagaaggaaacagcagcagagattttgtttgatgaagttttaacatttgccaaagaccatgtaaaacaccagttaactgtaaaatttgtgatctttccaacagatttggagatatataaggctttcagttctgaaatggcaaagaggtccaagatgctgagtttgaacaattacagtgtcccccagtcaaccagagaggagaaaagagaaaatgggcttgaagctagatctcctgccatcaatctgatgggattcaacgtggaagagatgtgtgaggcccacgcatggatccaaagaatcctgagtctccagaaccaccacatcattgagaataatcatattctgtaccttgggagaaaggaacatgacattttgtctcagcttcagaaaacttcaagtgtctccatcacagaaattatcagcccaggaaggacagagttagagattgaaggagcccgggctgacctcattgaggtggttatgaacattgaagatatgctttgtaaagtacaggaggaaatggcaaggaaaaaggagcgaggcctttggcgctcgttaggacagtggactattcagcaacaaaaaacccaagacgaaatgaaagaaaatatcatatttctgaaatgtcctgtgcctccaactcaagagcttctagatcaaaagaaacagtttgaaaaatgtggtttgcaggttctaaaggtggagaagatagacaatgaggtccttatggctgcctttcaaagaaagaagaaaatgatggaagaaaaactgcacaggcaacctgtgagccataggctgtttcagcaagtcccataccagttctgcaatgtggtatgcagagttggctttcaaagaatgtactcgacaccttgcgatccaaaatacggagctggcatatacttcaccaagaacctcaaaaacctggcagagaaggccaagaaaatctctgctgcagataagctgatctatgtgtttgaggctgaagtactcacaggcttcttctgccagggacatccgttaaatattgttcccccaccactgagtcctggagctatagatggtcatgacagtgtggttgacaatgtctccagccctgaaacctttgttatttttagtggcatgcaggctatacctcagtatttgtggacatgcacccaggaatatgtacagtcacaagattactcatcaggaccaatgagaccctttgcacagcatccttggaggggattcgcaagtggcagccctgttgattaatctctacatcattttaacagctggtatggccttaccttgggtgaactaaccaaataatgaccatcgatggctcaaagagtggcttgaatatatcccatgggttatctgtatggactgactgggttattgaaaggactagccacatactagcatcttagtgcctttatctgtctttatgtcttggggttggggtaggtagataccaaatgaaacactttcaggaccttccttcctcttgcagttgttctttaatctcctttactagaggagataaatattttgcatataatgaagaaatttttctagtatataacgcaggccttttattttctaaaatgatgatagtataaaaatgttaggataacagaatgattttagattttccagagaatattataaagtgctttaggtatgaaaataaatcatctttgtctgattaaaaaaaaaaaaaattatgtgtaaaatgaaacaatttgaagtggaaggacata

SEQ ID NO: 295798 - DNA, 629 bp, Homo sapiens
gccaatgtttgctggcacatttagtattttaagtgtttcgggcatgcagatttaaaaaaacacatgcttcctgccctcccaaacacagtgctttgagcaggatttccattgcattgtgtttactagggtgtattggttatcagtaagctgtagtcattccacttccattttttaagaaagccattctcatttttcacaggtggccggagcagcagcttacaatgaaaaatcaggtaggattacctcgctctcactcttgtttcagaaagtctttgctcagatctttcctcagtggagaaaggggaatacagaagaatgtctcccctacaagtgctcaggtgcgtgactgcagacccttgtggggacccccgcacatgcttcagagttggtgtggcaccgaccagcaggcatattctctcaaggcctacaccattcctctcctttgcccgtaaatgtgagactcttttaacgacagcctatggctgaattgaccagtttagttggcatttttttccctttctcagaggcattgtaacaacaatatcttagacaccatgaaatacagtgtcccaagctgggtcctccaggaagcagaatttgagatggaattaggagtgcaaaaaattcac

SEQ ID NO: 295799 - DNA, 3708 bp, Homo sapiens
tatttctatagtgagcatatatcacttttgtaatcctcaaaaacacaaaatggaacatccttttgttcatggatggaacaatggaaccattatttaaaacataaaagtggaatccctgaatgacaaggacagcagctggcaggcatctgggggaaggaagatgacagctgagaaattaagttagaatgaggatatggaaagcatccacactaaggcgccgtcagccagacccgcaccaggcacatgtgaggccccatcctccaccgagtgttcactgtctcagtgagtctcttggcagtagggccccgtccctgtccgccaccgcacagtgacatactttctcccgccctctcccctaggtcagctggaactgggtccgcctggaaacccgggggccgggcccccagagggctttcgcagcctggccgcccgaagctcacctgccctttcactgaactccacccggaaggtgcccggggcttcgtgttcctgggtgctgaccgtgcactccccgccgcccgaggacttagagctctggaagtagctctccagcttccttcgtactcgggggccggacttgtacacccgcacgaggagcggggacggcgggcgcagaagtgggccaccatatctggaaactacagtctatgctttgaagcgcaaaagggaataaacatttaaagactcccccggggacctggaggatggacttttccatggtggccggagcagcagcttacaatgaaaaatcaggtaggattacctcgctctcactcttgtttcagaaagtctttgctcagatctttcctcagtggagaaaggggaatacagaagaatgtctcccctacaagtgctcagagactggtgctcttggagaaaactatagttggcaaattcccattaaccacaatgacttcaaaattttaaaaaataatgagcgtcagctgtgtgaagtcctccagaataagtttggctgtatctctaccctggtctctccagttcaggaaggcaacagcaaatctctgcaagtgttcagaaaaatgctgactcctaggatagagttatcagtctggaaagatgacctcaccacacatgctgttgatgctgtggtgaatgcagccaatgaagatcttctgcatgggggaggcctggccctggccctggtaaaagctggtggatttgaaatccaagaagagagcaaacagtttgttgccagatatggtaaagtgtcagctggtgagatagctgtcacgggagcagggaggcttccctgcaaacagatcatccatgctgttgggcctcggtggatggaatgggataaacagggatgtactggaaagctgcagagggccattgtaagtattctgaattatgtcatctataaaaatactcacattaagacagtagcaattccagccttgagctctgggatttttcagttccctctgaatttgtgtacaaagactattgtagagactatccgggttagtttgcaagggaagccaatgatgagtaatttgaaagaaattcacctggtgagcaatgaggaccctactgttgctgcctttaaagctgcttcagaattcatcctagggaagagtgagctgggacaagaaaccaccccttctttcaatgcaatggtcgtgaacaacctgaccctccagattgtccagggccacattgaatggcagacggcagatgtaattgttaattctgtaaacccacatgatattacagttggacctgtggcaaagtcaattctacaacaagcaggagttgaaatgaaatcggaatttcttgccacaaaggctaaacagtttcaacggtcccagttggtactggtcacaaaaggatttaacttgttctgtaaatatatataccatgtactgtggcattcagaatttcctaaacctcagatattaaaacatgcaatgaaggagtgtttggaaaaatgcattgagcaaaatataacttccatttcctttcctgcccttgggactggaaacatggaaataaagaaggaaacagcagcagagattttgtttgatgaagttttaacatttgccaaagaccatgtaaaacaccagttaactgtaaaatttgtgatctttccaacagatttggagatatataaggctttcagttctgaaatggcaaagaggtccaagatgctgagtttgaacaattacagtgtcccccagtcaaccagagaggagaaaagagaaaatgggcttgaagctagatctcctgccatcaatctgatgggattcaacgtggaagagatgtgtgaggcccacgcatggatccaaagaatcctgagtctccagaaccaccacatcattgagaataatcatattctgtaccttgggagaaaggaacatgacattttgtctcagcttcagaaaacttcaagtgtctccatcacagaaattatcagcccaggaaggacagagttagagattgaaggagcccgggctgacctcattgaggtggttatgaacattgaagatatgctttgtaaagtacaggaggaaatggcaaggaaaaaggagcgaggcctttggcgctcgttaggacagtggactattcagcaacaaaaaacccaagacgaaatgaaagaaaatatcatatttctgaaatgtcctgtgcctccaactcaagagcttctagatcaaaagaaacagtttgaaaaatgtggtttgcaggttctaaaggtggagaagatagacaatgaggtccttatggctgcctttcaaagaaagaagaaaatgatggaagaaaaactgcacaggcaacctgtgagccataggctgtttcagcaagtcccataccagttctgcaatgtggtatgcagagttggctttcaaagaatgtactcgacaccttgcgatccaaaatacggagctggcatatacttcaccaagaacctcaaaaacctggcagagaaggccaagaaaatctctgctgcagataagctgatctatgtgtttgaggctgaagtactcacaggcttcttctgccagggacatccgttaaatattgttcccccaccactgagtcctggagctatagatggtcatgacagtgtggttgacaatgtctccagccctgaaacctttgttatttttagtggcatgcaggctatacctcagtatttgtggacatgcacccaggaatatgtacagtcacaagattactcatcaggaccaatgagaccctttgcacagcatccttggaggggattcgcaagtggcagccctgttgattaatctctacatcattttaacagctggtatggccttaccttgggtgaactaaccaaataatgaccatcgatggctcaaagagtggcttgaatatatcccatgggttatctgtatggactgactgggttattgaaaggactagccacatactagcatcttagtgcctttatctgtctttatgtcttggggttggggtaggtagataccaaatgaaacactttcaggaccttccttcctcttgcagttgttctttaatctcctttactagaggagataaatattttgcatataatgaagaaatttttctagtatataacgcaggccttttattttctaaaatgatgatagtataaaaatgttaggataacagaatgattttagattttccagagaatattataaagtgctttaggtatgaaaataaatcatctttgtctgatta

SEQ ID NO: 295800 - DNA, 3194 bp, Homo sapiens
gctccctgttcccggcagagccgcttccccctcctccctgtgctgtctgcaccgaggagagcggcctgccgggtgagtaggtccggtgcctctgggccctcggggtcccctctcctgcaggctcgaggtgggcggggagaagggggacgggcgcggacccgggtcccagggccaggcctcccttgtgagtagactatgcaaagaaaaagtgggccaccatatctggaaactacagtctatgctttgaagcgcaaaagggaataaacatttaaagactcccccggggacctggaggatggacttttccatggtggccggagcagcagcttacaatgaaaaatcagagactggtgctcttggagaaaactatagttggcaaattcccattaaccacaatgacttcaaaattttaaaaaataatgagcgtcagctgtgtgaagtcctccagaataagtttggctgtatctctaccctggtctctccagttcaggaaggcaacagcaaatctctgcaagtgttcagaaaaatgctgactcctaggatagagttatcagtctggaaagatgacctcaccacacatgctgttgatgctgtggtgaatgcagccaatgaagatcttctgcatgggggaggcctggccctggccctggtaaaagctggtggatttgaaatccaagaagagagcaaacagtttgttgccagatatggtaaagtgtcagctggtgagatagctgtcacgggagcagggaggcttccctgcaaacagatcatccatgctgttgggcctcggtggatggaatgggataaacagggatgtactggaaagctgcagagggccattgtaagtattctgaattatgtcatctataaaaatactcacattaagacagtagcaattccagccttgagctctgggatttttcagttccctctgaatttgtgtacaaagactattgtagagactatccgggttagtttgcaagggaagccaatgatgagtaatttgaaagaaattcacctggtgagcaatgaggaccctactgttgctgcctttaaagctgcttcagaattcatcctagggaagagtgagctgggacaagaaaccaccccttctttcaatgcaatggtcgtgaacaacctgaccctccagattgtccagggccacattgaatggcagacggcagatgtaattgttaattctgtaaacccacatgatattacagttggacctgtggcaaagtcaattctacaacaagcaggagttgaaatgaaatcggaatttcttgccacaaaggctaaacagtttcaacggtcccagttggtactggtcacaaaaggatttaacttgttctgtaaatatatataccatgtactgtggcattcagaatttcctaaacctcagatattaaaacatgcaatgaaggagtgtttggaaaaatgcattgagcaaaatataacttccatttcctttcctgcccttgggactggaaacatggaaataaagaaggaaacagcagcagagattttgtttgatgaagttttaacatttgccaaagaccatgtaaaacaccagttaactgtaaaatttgtgatctttccaacagatttggagatatataaggctttcagttctgaaatggcaaagaggtccaagatgctgagtttgaacaattacagtgtcccccagtcaaccagagaggagaaaagagaaaatgggcttgaagctagatctcctgccatcaatctgatgggattcaacgtggaagagatgtgtgaggcccacgcatggatccaaagaatcctgagtctccagaaccaccacatcattgagaataatcatattctgtaccttgggagaaaggaacatgacattttgtctcagcttcagaaaacttcaagtgtctccatcacagaaattatcagcccaggaaggacagagttagagattgaaggagcccgggctgacctcattgaggtggttatgaacattgaagatatgctttgtaaagtacaggaggaaatggcaaggaaaaaggagcgaggcctttggcgctcgttaggacagtggactattcagcaacaaaaaacccaagacgaaatgaaagaaaatatcatatttctgaaatgtcctgtgcctccaactcaagagcttctagatcaaaagaaacagtttgaaaaatgtggtttgcaggttctaaaggtggagaagatagacaatgaggtccttatggctgcctttcaaagaaagaagaaaatgatggaagaaaaactgcacaggcaacctgtgagccataggctgtttcagcaagtcccataccagttctgcaatgtggtatgcagagttggctttcaaagaatgtactcgacaccttgcgatccaaaatacggagctggcatatacttcaccaagaacctcaaaaacctggcagagaaggccaagaaaatctctgctgcagataagctgatctatgtgtttgaggctgaagtactcacaggcttcttctgccagggacatccgttaaatattgttcccccaccactgagtcctggagctatagatggtcatgacagtgtggttgacaatgtctccagccctgaaacctttgttatttttagtggcatgcaggctatacctcagtatttgtggacatgcacccaggaatatgtacagtcacaagattactcatcaggaccaatgagaccctttgcacagcatccttggaggggattcgcaagtggcagccctgttgattaatctctacatcattttaacagctggtatggccttaccttgggtgaactaaccaaataatgaccatcgatggctcaaagagtggcttgaatatatcccatgggttatctgtatggactgactgggttattgaaaggactagccacatactagcatcttagtgcctttatctgtctttatgtcttggggttggggtaggtagataccaaatgaaacactttcaggaccttccttcctcttgcagttgttctttaatctcctttactagaggagataaatattttgcatataatgaagaaatttttctagtatataacgcaggccttttattttctaaaatgatgatagtataaaaatgttaggataacagaatgattttagattttccagagaatattataaagtgctttaggtatgaaaataaatcatctttgtctgatta

SEQ ID NO: 295801 - DNA, 3060 bp, Homo sapiens
gctccctgttcccggcagagccgcttccccctcctccctgtgctgtctgcaccgaggagagcggcctgccggaagtgggccaccatatctggaaactacagtctatgctttgaagcgcaaaagggaataaacatttaaagactcccccggggacctggaggatggacttttccatggtggccggagcagcagcttacaatgaaaaatcagagactggtgctcttggagaaaactatagttggcaaattcccattaaccacaatgacttcaaaattttaaaaaataatgagcgtcagctgtgtgaagtcctccagaataagtttggctgtatctctaccctggtctctccagttcaggaaggcaacagcaaatctctgcaagtgttcagaaaaatgctgactcctaggatagagttatcagtctggaaagatgacctcaccacacatgctgttgatgctgtggtgaatgcagccaatgaagatcttctgcatgggggaggcctggccctggccctggtaaaagctggtggatttgaaatccaagaagagagcaaacagtttgttgccagatatggtaaagtgtcagctggtgagatagctgtcacgggagcagggaggcttccctgcaaacagatcatccatgctgttgggcctcggtggatggaatgggataaacagggatgtactggaaagctgcagagggccattgtaagtattctgaattatgtcatctataaaaatactcacattaagacagtagcaattccagccttgagctctgggatttttcagttccctctgaatttgtgtacaaagactattgtagagactatccgggttagtttgcaagggaagccaatgatgagtaatttgaaagaaattcacctggtgagcaatgaggaccctactgttgctgcctttaaagctgcttcagaattcatcctagggaagagtgagctgggacaagaaaccaccccttctttcaatgcaatggtcgtgaacaacctgaccctccagattgtccagggccacattgaatggcagacggcagatgtaattgttaattctgtaaacccacatgatattacagttggacctgtggcaaagtcaattctacaacaagcaggagttgaaatgaaatcggaatttcttgccacaaaggctaaacagtttcaacggtcccagttggtactggtcacaaaaggatttaacttgttctgtaaatatatataccatgtactgtggcattcagaatttcctaaacctcagatattaaaacatgcaatgaaggagtgtttggaaaaatgcattgagcaaaatataacttccatttcctttcctgcccttgggactggaaacatggaaataaagaaggaaacagcagcagagattttgtttgatgaagttttaacatttgccaaagaccatgtaaaacaccagttaactgtaaaatttgtgatctttccaacagatttggagatatataaggctttcagttctgaaatggcaaagaggtccaagatgctgagtttgaacaattacagtgtcccccagtcaaccagagaggagaaaagagaaaatgggcttgaagctagatctcctgccatcaatctgatgggattcaacgtggaagagatgtgtgaggcccacgcatggatccaaagaatcctgagtctccagaaccaccacatcattgagaataatcatattctgtaccttgggagaaaggaacatgacattttgtctcagcttcagaaaacttcaagtgtctccatcacagaaattatcagcccaggaaggacagagttagagattgaaggagcccgggctgacctcattgaggtggttatgaacattgaagatatgctttgtaaagtacaggaggaaatggcaaggaaaaaggagcgaggcctttggcgctcgttaggacagtggactattcagcaacaaaaaacccaagacgaaatgaaagaaaatatcatatttctgaaatgtcctgtgcctccaactcaagagcttctagatcaaaagaaacagtttgaaaaatgtggtttgcaggttctaaaggtggagaagatagacaatgaggtccttatggctgcctttcaaagaaagaagaaaatgatggaagaaaaactgcacaggcaacctgtgagccataggctgtttcagcaagtcccataccagttctgcaatgtggtatgcagagttggctttcaaagaatgtactcgacaccttgcgatccaaaatacggagctggcatatacttcaccaagaacctcaaaaacctggcagagaaggccaagaaaatctctgctgcagataagctgatctatgtgtttgaggctgaagtactcacaggcttcttctgccagggacatccgttaaatattgttcccccaccactgagtcctggagctatagatggtcatgacagtgtggttgacaatgtctccagccctgaaacctttgttatttttagtggcatgcaggctatacctcagtatttgtggacatgcacccaggaatatgtacagtcacaagattactcatcaggaccaatgagaccctttgcacagcatccttggaggggattcgcaagtggcagccctgttgattaatctctacatcattttaacagctggtatggccttaccttgggtgaactaaccaaataatgaccatcgatggctcaaagagtggcttgaatatatcccatgggttatctgtatggactgactgggttattgaaaggactagccacatactagcatcttagtgcctttatctgtctttatgtcttggggttggggtaggtagataccaaatgaaacactttcaggaccttccttcctcttgcagttgttctttaatctcctttactagaggagataaatattttgcatataatgaagaaatttttctagtatataacgcaggccttttattttctaaaatgatgatagtataaaaatgttaggataacagaatgattttagattttccagagaatattataaagtgctttaggtatgaaaataaatcatctttgtctgatta

SEQ ID NO: 295802 - DNA, 1059 bp, Homo sapiens
tagccaaaggaaaagctcacctgctgatgattctaagctggctgctcatggacttggaatcctaggtggagaagatagacaatgaggtccttatggctgcctttcaaagaaagaagaaaatgatggaagaaaaactgcacaggcaacctgtgagccataggctgtttcagcaagtcccataccagttctgcaatgtggtatgcagagttggctttcaaagaatgtactcgacaccttgcgatccaaaatacggagctggcatatacttcaccaagaacctcaaaaacctggcagagaaggccaagaaaatctctgctgcagataagctgatctatgtgtttgaggctgaagtactcacaggcttcttctgccagggacatccgttaaatattgttcccccaccactgagtcctggagctatagatggtcatgacagtgtggttgacaatgtctccagccctgaaacctttgttatttttagtggcatgcaggctatacctcagtatttgtggacatgcacccaggaatatgtacagtcacaagattactcatcaggaccaatgagaccctttgcacagcatccttggaggggattcgcaagtggcagccctgttgattaatctctacatcattttaacagctggtatggccttaccttgggtgaactaaccaaataatgaccatcgatggctcaaagagtggcttgaatatatcccatgggttatctgtatggactgactgggttattgaaaggactagccacatactagcatcttagtgcctttatctgtctttatgtcttggggttggggtaggtagataccaaatgaaacactttcaggaccttccttcctcttgcagttgttctttaatctcctttactagaggagataaatattttgcatataatgaagaaatttttctagtatataacgcaggccttttattttctaaaatgatgatagtataaaaatgttaggataacagaatgattttagattttccagagaatattataaagtgctttaggtatgaaaataaatcatctttgtctgatta

SEQ ID NO: 295803 - DNA, 3653 bp, Homo sapiens
tatttctatagtgagcatatatcacttttgtaatcctcaaaaacacaaaatggaacatccttttgttcatggatggaacaatggaaccattatttaaaacataaaagtggaatccctgaatgacaaggacagcagctggcaggcatctgggggaaggaagatgacagctgagaaattaagttagaatgaggatatggaaagcatccacactaaggcgccgtcagccagacccgcaccaggcacatgtgaggccccatcctccaccgagtgttcactgtctcagtgagtctcttggcagtagggccccgtccctgtccgccaccgcacagtgacatactttctcccgccctctcccctaggtcagctggaactgggtccgcctggaaacccgggggccgggcccccagagggctttcgcagcctggccgcccgaagctcacctgccctttcactgaactccacccggaaggtgcccggggcttcgtgttcctgggtgctgaccgtgcactccccgccgcccgaggacttagagctctggaagtagctctccagcttccttcgtactcgggggccggacttgtacacccgcacgaggagcggggacggcgggcgcagaagtgggccaccatatctggaaactacagtctatgctttgaagcgcaaaagggaataaacatttaaagactcccccggggacctggaggatggacttttccatggtggccggagcagcagcttacaatgaaaaatcaggtaggattacctcgctctcactcttgtttcagaaagtctttgctcagatctttcctcagtggagaaaggggaatacagaagaatgtctcccctacaagtgctcagagactggtgctcttggagaaaactatagttggcaaattcccattaaccacaatgacttcaaaattttaaaaaataatgagcgtcagctgtgtgaagtcctccagaataagtttggctgtatctctaccctggtctctccagttcaggaaggcaacagcaaatctctgcaagtgttcagaaaaatgctgactcctaggatagagttatcagtctggaaagatgacctcaccacacatgctgttgatgctgtggtgaatgcagccaatgaagatcttctgcatgggggaggcctggccctggccctggtaaaagctggtggatttgaaatccaagaagagagcaaacagtttgttgccagatatggtaaagtgtcagctggtgagatagctgtcacgggagcagggaggcttccctgcaaacagatcatccatgctgttgggcctcggtggatggaatgggataaacagggatgtactggaaagctgcagagggccattgtaagtattctgaattatgtcatctataaaaatactcacattaagacagtagcaattccagccttgagctctgggatttttcagttccctctgaatttgtgtacaaagactattgtagagactatccgggttagtttgcaagggaagccaatgatgagtaatttgaaagaaattcacctggtgagcaatgaggaccctactgttgctgcctttaaagctgcttcagaattcatcctagggaagagtgagctgggacaagaaaccaccccttctttcaatgcaatggtcgtgaacaacctgaccctccagattgtccagggccacattgaatggcagacggcagatgtaattgttaattctgtaaacccacatgatattacagttggacctgtggcaaagtcaattctacaacaagcaggagttgaaatgaaatcggaatttcttgccacaaaggctaaacagtttcaacggtcccagttggtactggtcacaaaaggatttaacttgttctgtaaatatatataccatgtactgtggcattcagaatttcctaaacctcagatattaaaacatgcaatgaaggagtgtttggaaaaatgcattgagcaaaatataacttccatttcctttcctgcccttgggactggaaacatggaaataaagaaggaaacagcagcagagattttgtttgatgaagttttaacatttgccaaagaccatgtaaaacaccagttaactgtaaaatttgtgatctttccaacagatttggagatatataaggctttcagttctgaaatggcaaagaggtccaagatgctgagtttgaacaattacagtgtcccccagtcaaccagagaggagaaaagagaaaatgggcttgaagctagatctcctgccatcaatctgatgggattcaacgtggaagagatgtgtgaggcccacgcatggatccaaagaatcctgagtctccagaaccaccacatcattgagaataatcatattctgtaccttgggagaaaggaacatgacattttgtctcagcttcagaaaacttcaagtgtctccatcacagaaattatcagcccaggaaggacagagttagagattgaaggagcccgggctgacctcattgaggtggttatgaacattgaagatatgctttgtaaagtacaggaggaaatggcaaggaaaaaggagcgaggcctttggcgctcgttaggacagtggactattcagcaacaaaaaacccaagacgaaatgaaagaaaatatcatatttctgaaatgtcctgtgcctccaactcaagagcttctagatcaaaagaaacagtttgaaaaatgtggtttgcaggttctaaaggtggagaagatagacaatgaggtccttatggctgcctttcaaagaaagaagaaaatgatggaagaaaaactgcacaggcaacctgtgagccataggctgtttcagcaagtcccataccagttctgcaatgtggtatgcagagttggctttcaaagaatgtactcgacaccttgcgatccaaaatacggagctggcatatacttcaccaagaacctcaaaaacctggcagagaaggccaagaaaatctctgctgcagataagctgatctatgtgtttgaggctgaagtactcacaggcttcttctgccagggacatccgttaaatattgttcccccaccactgagtcctggagctatagatggtcatgacagtgtggttgacaatgtctccagccctgaaacctttgttatttttagtggcatgcaggctatacctcagtatttgtggacatgcacccaggaatatgtacagtcacaagattactcatcaggaccaatgagaccctttgcacagcatccttggaggggattcgcaagtggcagccctgttgattaatctctacatcattttaacagctggtatggccttaccttgggtgaactaaccaaataatgaccatcgatggctcaaagagtggcttgaatatatcccatgggttatctgtatggactgactgggttattgaaaggactagccacatactagcatcttagtgcctttatctgtctttatgtcttggggttggggtaggtagataccaaatgaaacactttcaggaccttcatataatgaagaaatttttctagtatataacgcaggccttttattttctaaaatgatgatagtataaaaatgttaggataacagaatgattttagattttccagagaatattataaagtgctttaggtatgaaaataaatcatctttgtctgatta

SEQ ID NO: 295804 - DNA, 3547 bp, Homo sapiens
tatttctatagtgagcatatatcacttttgtaatcctcaaaaacacaaaatggaacatccttttgttcatggatggaacaatggaaccattatttaaaacataaaagtggaatccctgaatgacaaggacagcagctggcaggcatctgggggaaggaagatgacagctgagaaattaagttagaatgaggatatggaaagcatccacactaaggcgccgtcagccagacccgcaccaggcacatgtgaggccccatcctccaccgagtgttcactgtctcagtgagtctcttggcagtagggccccgtccctgtccgccaccgcacagtgacatactttctcccgccctctcccctaggtcagctggaactgggtccgcctggaaacccgggggccgggcccccagagggctttcgcagcctggccgcccgaagctcacctgccctttcactgaactccacccggaaggtgcccggggcttcgtgttcctgggtgctgaccgtgcactccccgccgcccgaggacttagagctctggaagtagctctccagcttccttcgtactcgggggccggacttgtacacccgcacgaggagcggggacggcgggcgcagaagtgggccaccatatctggaaactacagtctatgctttgaagcgcaaaagggaataaacatttaaagactcccccggggacctggaggatggacttttccatggtggccggagcagcagcttacaatgaaaaatcaggtaggattacctcgctctcactcttgtttcagaaagtctttgctcagatctttcctcagtggagaaaggggaatacagaagaatgtctcccctacaagtgctcagagactggtgctcttggagaaaactatagttggcaaattcccattaaccacaatgacttcaaaattttaaaaaataatgagcgtcagctgtgtgaagtcctccagaataagtttggctgtatctctaccctggtctctccagttcaggaaggcaacagcaaatctctgcaagtgttcagaaaaatgctgactcctaggatagagttatcagtctggaaagatgacctcaccacacatgctgttgatgctgtggtgaatgcagccaatgaagatcttctgcatgggggaggcctggccctggccctggtaaaagctggtggatttgaaatccaagaagagagcaaacagtttgttgccagatatggtaaagtgtcagctggtgagatagctgtcacgggagcagggaggcttccctgcaaacagatcatccatgctgttgggcctcggtggatggaatgggataaacagggatgtactggaaagctgcagagggccattgtaagtattctgaattatgtcatctataaaaatactcacattaagacagtagcaattccagccttgagctctgggatttttcagttccctctgaatttgtgtacaaagactattgtagagactatccgggttagtttgcaagggaagccaatgatgagtaatttgaaagaaattcacctggtgagcaatgaggaccctactgttgctgcctttaaagctgcttcagaattcatcctagggaagagtgagctgggacaagaaaccaccccttctttcaatgcaatggtcgtgaacaacctgaccctccagattgtccagggccacattgaatggcagacggcagatgtaattgttaattctgtaaacccacatgatattacagttggacctgtggcaaagtcaattctacaacaagcaggagttgaaatgaaatcggaatttcttgccacaaaggctaaacagtttcaacggtcccagttggtactggtcacaaaaggatttaacttgttctgtaaatatatataccatgtactgtggcattcagaatttcctaaacctcagatattaaaacatgcaatgaaggagtgtttggaaaaatgcattgagcaaaatataacttccatttcctttcctgcccttgggactggaaacatggaaataaagaaggaaacagcagcagagattttgtttgatgaagttttaacatttgccaaagaccatgtaaaacaccagttaactgtaaaatttgtgatctttccaacagatttggagatatataaggctttcagttctgaaatggcaaagaggtccaagatgctgagtttgaacaattacagtgtcccccagtcaaccagagaggagaaaagagaaaatgggcttgaagctagatctcctgccatcaatctgatgggattcaacgtggaagagatgtgtgaggcccacgcatggatccaaagaatcctgagtctccagaaccaccacatcattgagaataatcatattctgtaccttgggagaaaggaacatgacattttgtctcagcttcagaaaacttcaagtgtctccatcacagaaattatcagcccaggaaggacagagttagagattgaaggagcccgggctgacctcattgaggtggttatgaacattgaagatatgctttgtaaagtacaggaggaaatggcaaggaaaaaggagcgaggcctttggcgctcgttaggacagtggactattcagcaacaaaaaacccaagacgaaatgaaagaaaatatcatatttctgaaatgtcctgtgcctccaactcaagagcttctagatcaaaagaaacagtttgaaaaatgtggtttgcaggttctaaaggtggagaagatagacaatgaggtccttatggctgcctttcaaagaaagaagaaaatgatggaagaaaaactgcacaggcaacctgtgagccataggctgtttcagcaagtcccataccagttctgcaatgtggtatgcagagttggctttcaaagaatgtactcgacaccttgcgatccaaaatacggagctggcatatacttcaccaagaacctcaaaaacctggcagagaaggccaagaaaatctctgctgcagataagctgatctatgtgtttgaggctgaagtactcacaggcttcttctgccagggacatccgttaaatattgttcccccaccactgagtcctggagctatagatggtcatgacagtgtggttgacaatgtctccagccctgaaacctttgttatttttagtggcatgcaggctataccgtgaactaaccaaataatgaccatcgatggctcaaagagtggcttgaatatatcccatgggttatctgtatggactgactgggttattgaaaggactagccacatactagcatcttagtgcctttatctgtctttatgtcttggggttggggtaggtagataccaaatgaaacactttcaggaccttccttcctcttgcagttgttctttaatctcctttactagaggagataaatattttgcatataatgaagaaatttttctagtatataacgcaggccttttattttctaaaatgatgatagtataaaaatgttaggataacagaatgattttagattttccagagaatattataaagtgctttaggtatgaaaataaatcatctttgtctgatta

SEQ ID NO: 295805 - DNA, 3633 bp, Homo sapiens
tatttctatagtgagcatatatcacttttgtaatcctcaaaaacacaaaatggaacatccttttgttcatggatggaacaatggaaccattatttaaaacataaaagtggaatccctgaatgacaaggacagcagctggcaggcatctgggggaaggaagatgacagctgagaaattaagttagaatgaggatatggaaagcatccacactaaggcgccgtcagccagacccgcaccaggcacatgtgaggccccatcctccaccgagtgttcactgtctcagtgagtctcttggcagtagggccccgtccctgtccgccaccgcacagtgacatactttctcccgccctctcccctaggtcagctggaactgggtccgcctggaaacccgggggccgggcccccagagggctttcgcagcctggccgcccgaagctcacctgccctttcactgaactccacccggaaggtgcccggggcttcgtgttcctgggtgctgaccgtgcactccccgccgcccgaggacttagagctctggaagtagctctccagcttccttcgtactcgggggccggacttgtacacccgcacgaggagcggggacggcgggcgcagaagtgggccaccatatctggaaactacagtctatgctttgaagcgcaaaagggaataaacatttaaagactcccccggggacctggaggatggacttttccatggtggccggagcagcagcttacaatgaaaaatcaggtaggattacctcgctctcactcttgtttcagaaagtctttgctcagatctttcctcagtggagaaaggggaatacagaagaatgtctcccctacaagtgctcagagactggtgctcttggagaaaactatagttggcaaattcccattaaccacaatgacttcaaaattttaaaaaataatgagcgtcagctgtgtgaagtcctccagaataagtttggctgtatctctaccctggtctctccagttcaggaaggcaacagcaaatctctgcaagtgttcagaaaaatgctgactcctaggatagagttatcagtctggaaagatgacctcaccacacatgctgttgatgctgtggtgaatgcagccaatgaagatcttctgcatgggggaggcctggccctggccctggtaaaagctggtggatttgaaatccaagaagagagcaaacagtttgttgccagatatggtaaagtgtcagctggtgagatagctgtcacgggagcagggaggcttccctgcaaacagatcatccatgctgttgggcctcggtggatggaatgggataaacagggatgtactggaaagctgcagagggccattgtaagtattctgaattatgtcatctataaaaatactcacattaagacagtagcaattccagccttgagctctgggatttttcagttccctctgaatttgtgtacaaagactattgtagagactatccgggttagtttgcaagggaagccaatgatgagtaatttgaaagaaattcacctggtgagcaatgaggaccctactgttgctgcctttaaagctgcttcagaattcatcctagggaagagtgagctgggacaagaaaccaccccttctttcaatgcaatggtcgtgaacaacctgaccctccagattgtccagggccacattgaatggcagacggcagatgtaattgttaattctgtaaacccacatgatattacagttggacctgtggcaaagtcaattctacaacaagcaggagttgaaatgaaatcggaatttcttgccacaaaggctaaacagtttcaacggtcccagttggtactggtcacaaaaggatttaacttgttctgtaaatatatataccatgtactgtggcattcagaatttcctaaacctcagatattaaaacatgcaatgaaggagtgtttggaaaaatgcattgagcaaaatataacttccatttcctttcctgcccttgggactggaaacatggaaataaagaaggaaacagcagcagagattttgtttgatgaagttttaacatttgccaaagaccatgtaaaacaccagttaactgtaaaatttgtgatctttccaacagatttggagatatataaggctttcagttctgaaatggcaaagaggtccaagatgctgagtttgaacaattacagtgtcccccagtcaaccagagaggagaaaagagaaaatgggcttgaagctagatctcctgccatcaatctgatgggattcaacgtggaagagatgtgtgaggcccacgcatggatccaaagaatcctgagtctccagaaccaccacatcattgagaataatcatattctgtaccttgggagaaaggaacatgacattttgtctcagcttcagaaaacttcaagtgtctccatcacagaaattatcagcccaggaaggacagagttagagattgaaggagcccgggctgacctcattgaggtggttatgaacattgaagatatgctttgtaaagtacaggaggaaatggcaaggaaaaaggagcgaggcctttggcgctcgttaggacagtggactattcagcaacaaaaaacccaagacgaaatgaaagaaaatatcatatttctgaaatgtcctgtgcctccaactcaagagcttctagatcaaaagaaacagtttgaaaaatgtggtttgcaggttctaaaggtggagaagatagacaatgaggtccttatggctgcctttcaaagaaagaagaaaatgatggaagaaaaactgcacaggcaacctgtgagccataggctgtttcagcaagtcccataccagttctgcaatgtggtatgcagagttggctttcaaagaatgtactcgacaccttgcgagacgaggtttcatcatgttggccaggctgatctccagctactcgtgatccgtccacctcagcctcccaaagtgttgggcttacagatccaaaatacggagctggcatatacttcaccaagaacctcaaaaacctggcagagaaggccaagaaaatctctgctgcagataagctgatctatgtgtttgaggctgaagtactcacaggcttcttctgccagggacatccgttaaatattgttcccccaccactgagtcctggagctatagatggtcatgacagtgtggttgacaatgtctccagccctgaaacctttgttatttttagtggcatgcaggctataccgtgaactaaccaaataatgaccatcgatggctcaaagagtggcttgaatatatcccatgggttatctgtatggactgactgggttattgaaaggactagccacatactagcatcttagtgcctttatctgtctttatgtcttggggttggggtaggtagataccaaatgaaacactttcaggaccttccttcctcttgcagttgttctttaatctcctttactagaggagataaatattttgcatataatgaagaaatttttctagtatataacgcaggccttttattttctaaaatgatgatagtataaaaatgttaggataacagaatgattttagattttccagagaatattataaagtgctttaggtatgaaaataaatcatctttgtctgatta

SEQ ID NO: 295806 - DNA, 3313 bp, Homo sapiens
tatttctatagtgagcatatatcacttttgtaatcctcaaaaacacaaaatggaacatccttttgttcatggatggaacaatggaaccattatttaaaacataaaagtggaatccctgaatgacaaggacagcagctggcaggcatctgggggaaggaagatgacagctgagaaattaagttagaatgaggatatggaaagcatccacactaaggcgccgtcagccagacccgcaccaggcacatgtgaggccccatcctccaccgagtgttcactgtctcagtgagtctcttggcagtagggccccgtccctgtccgccaccgcacagtgacatactttctcccgccctctcccctaggtcagctggaactgggtccgcctggaaacccgggggccgggcccccagagggctttcgcagcctggccgcccgaagctcacctgccctttcactgaactccacccggaaggtgcccggggcttcgtgttcctgggtgctgaccgtgcactccccgccgcccgaggacttagagctctggaagtagctctccagcttccttcgtactcgggggccggacttgtacacccgcacgaggagcggggacggcgggcgcagaagtgggccaccatatctggaaactacagtctatgctttgaagcgcaaaagggaataaacatttaaagactcccccggggacctggaggatggacttttccatggtggccggagcagcagcttacaatgaaaaatcaggtaggattacctcgctctcactcttgtttcagaaagtctttgctcagatctttcctcagtggagaaaggggaatacagaagaatgtctcccctacaagtgctcagagactggtgctcttggagaaaactatagttggcaaattcccattaaccacaatgacttcaaaattttaaaaaataatgagcgtcagctgtgtgaagtcctccagaataagtttggctgtatctctaccctggtctctccagttcaggaaggcaacagcaaatctctgcaagtgttcagaaaaatgctgactcctaggatagagttatcagtctggaaagatgacctcaccacacatgctgttgatgctgtggtgaatgcagccaatgaagatcttctgcatgggggaggcctggccctggccctggtaaaagctggtggatttgaaatccaagaagagagcaaacagtttgttgccagatatggtaaagtgtcagctggtgagatagctgtcacgggagcagggaggcttccctgcaaacagatcatccatgctgttgggcctcggtggatggaatgggataaacagggatgtactggaaagctgcagagggccattgtaagtattctgaattatgtcatctataaaaatactcacattaagacagtagcaattccagccttgagctctgggatttttcagttccctctgaatttgtgtacaaagactattgtagagactatccgggttagtttgcaagggaagccaatgatgagtaatttgaaagaaattcacctggtgagcaatgaggaccctactgttgctgcctttaaagctgcttcagaattcatcctagggaagagtgagctgggacaagaaaccaccccttctttcaatgcaatggtcgtgaacaacctgaccctccagattgtccagggccacattgaatggcagacggcagatgtaattgttaattctgtaaacccacatgatattacagttggacctgtggcaaagtcaattctacaacaagcaggagttgaaatgaaatcggaatttcttgccacaaaggctaaacagtttcaacggtcccagttggtactggtcacaaaaggatttaacttgttctgtaaatatatataccatgtactgtggcattcagaatttcctaaacctcagatattaaaacatgcaatgaaggagtgtttggaaaaatgcattgagcaaaatataacttccatttcctttcctgcccttgggactggaaacatggaaataaagaaggaaacagcagcagagattttgtttgatgaagttttaacatttgccaaagaccatgtaaaacaccagttaactgtaaaatttgtgatctttccaacagatttggagatatataaggctttcagttctgaaatggcaaagaggtccaagatgctgagtttgaacaattacagtgtcccccagtcaaccagagaggagaaaagagaaaatgggcttgaagctagatctcctgccatcaatctgatgggattcaacgtggaagagatgtgtgaggcccacgcatggatccaaagaatcctgagtctccagaaccaccacatcattgagaataatcatattctgtaccttgggagaaaggaacatgacattttgtctcagcttcagaaaacttcaagtgtctccatcacagaaattatcagcccaggaaggacagagttagagattgaaggagcccgggctgacctcattgaggtggttatgaacattgaagatatgctttgtaaagtacaggaggaaatggcaaggaaaaaggagcgaggcctttggcgctcgttaggacagtggactattcagcaacaaaaaacccaagacgaaatgaaagaaaatatcatatttctgaaatgtcctgtgcctccaactcaagagcttctagatcaaaagaaacagtttgaaaaatgtggtttgcaggttctaaaggtggagaagatagacaatgaggtccttatggctgcctttcaaagaaagaagaaaatgatggaagaaaaactgcacaggcaacctgtgagccataggctgtttcagcaagtcccataccagttctgcaatgtggtatgcagagttggctttcaaagaatgtactcgacaccttgcgagattgggtctcactgtgttgccccaggctagtctcaaactcctgacctccaccaatcctcctgccttggcctcccaaagtgctgggattacagacatgagccactcagcctggaagttttaaacgacatgtgtgactcataatccaaaatacggagctggcatatacttcaccaagaacctcaaaaacctggcagagaaggccaagaaaatctctgctgcagataagctgatctatgtgtttgaggctgaagtactcacaggcttcttctgccagggacatccgttaaatattgttcccccaccactgagtcctggagctatagatggtcatgacagtgtggttgacaatgtctccagccctgaaacctttgttatttttagtggcatgcaggctatacctacatcagacagggatctcaaga

SEQ ID NO: 295807 - DNA, 3263 bp, Homo sapiens
tatttctatagtgagcatatatcacttttgtaatcctcaaaaacacaaaatggaacatccttttgttcatggatggaacaatggaaccattatttaaaacataaaagtggaatccctgaatgacaaggacagcagctggcaggcatctgggggaaggaagatgacagctgagaaattaagttagaatgaggatatggaaagcatccacactaaggcgccgtcagccagacccgcaccaggcacatgtgaggccccatcctccaccgagtgttcactgtctcagtgagtctcttggcagtagggccccgtccctgtccgccaccgcacagtgacatactttctcccgccctctcccctaggtcagctggaactgggtccgcctggaaacccgggggccgggcccccagagggctttcgcagcctggccgcccgaagctcacctgccctttcactgaactccacccggaaggtgcccggggcttcgtgttcctgggtgctgaccgtgcactccccgccgcccgaggacttagagctctggaagtagctctccagcttccttcgtactcgggggccggacttgtacacccgcacgaggagcggggacggcgggcgcagaagtgggccaccatatctggaaactacagtctatgctttgaagcgcaaaagggaataaacatttaaagactcccccggggacctggaggatggacttttccatggtggccggagcagcagcttacaatgaaaaatcaggtaggattacctcgctctcactcttgtttcagaaagtctttgctcagatctttcctcagtggagaaaggggaatacagaagaatgtctcccctacaagtgctcagagactggtgctcttggagaaaactatagttggcaaattcccattaaccacaatgacttcaaaattttaaaaaataatgagcgtcagctgtgtgaagtcctccagaataagtttggctgtatctctaccctggtctctccagttcaggaaggcaacagcaaatctctgcaagtgttcagaaaaatgctgactcctaggatagagttatcagtctggaaagatgacctcaccacacatgctgttgatgctgtggtgaatgcagccaatgaagatcttctgcatgggggaggcctggccctggccctggtaaaagctggtggatttgaaatccaagaagagagcaaacagtttgttgccagatatggtaaagtgtcagctggtgagatagctgtcacgggagcagggaggcttccctgcaaacagatcatccatgctgttgggcctcggtggatggaatgggataaacagggatgtactggaaagctgcagagggccattgtaagtattctgaattatgtcatctataaaaatactcacattaagacagtagcaattccagccttgagctctgggatttttcagttccctctgaatttgtgtacaaagactattgtagagactatccgggttagtttgcaagggaagccaatgatgagtaatttgaaagaaattcacctggtgagcaatgaggaccctactgttgctgcctttaaagctgcttcagaattcatcctagggaagagtgagctgggacaagaaaccaccccttctttcaatgcaatggtcgtgaacaacctgaccctccagattgtccagggccacattgaatggcagacggcagatgtaattgttaattctgtaaacccacatgatattacagttggacctgtggcaaagtcaattctacaacaagcaggagttgaaatgaaatcggaatttcttgccacaaaggctaaacagtttcaacggtcccagttggtactggtcacaaaaggatttaacttgttctgtaaatatatataccatgtactgtggcattcagaatttcctaaacctcagatattaaaacatgcaatgaaggagtgtttggaaaaatgcattgagcaaaatataacttccatttcctttcctgcccttgggactggaaacatggaaataaagaaggaaacagcagcagagattttgtttgatgaagttttaacatttgccaaagaccatgtaaaacaccagttaactgtaaaatttgtgatctttccaacagatttggagatatataaggctttcagttctgaaatggcaaagaggtccaagatgctgagtttgaacaattacagtgtcccccagtcaaccagagaggagaaaagagaaaatgggcttgaagctagatctcctgccatcaatctgatgggattcaacgtggaagagatgtgtgaggcccacgcatggatccaaagaatcctgagtctccagaaccaccacatcattgagaataatcatattctgtaccttgggagaaaggaacatgacattttgtctcagcttcagaaaacttcaagtgtctccatcacagaaattatcagcccaggaaggacagagttagagattgaaggagcccgggctgacctcattgaggtggttatgaacattgaagatatgctttgtaaagtacaggaggaaatggcaaggaaaaaggagcgaggcctttggcgctcgttaggacagtggactattcagcaacaaaaaacccaagacgaaatgaaagaaaatatcatatttctgaaatgtcctgtgcctccaactcaagagcttctagatcaaaagaaacagtttgaaaaatgtggtttgcaggttctaaaggtggagaagatagacaatgaggtccttatggctgcctttcaaagaaagaagaaaatgatggaagaaaaactgcacaggcaacctgtgagccataggctgtttcagcaagtcccataccagttctgcaatgtggtatgcagagttggctttcaaagaatgtactcgacaccttgcggtaggtgtcaatgcctcatcattggggctactctgtggaatttggtgagctgacatcagtagattcttccactgatagcatttgttgttgtggggaagggatcatttgtgactgtgatttagaggtcacaaatgatgacccaggtcacaaagtattttggaaagagtggtattttttacttttccttcgtatcttttgttgctgatgcattttacattgatgaaaagtgtgagcagtaagaactacggttcactgtttttctcctttatgtgtttctgtgtcctatccgcagagaacacgttgaggctttttttttcttctggtagccatcctaatgggtgtgaagtggtatctcattgcaacacggtctctca

SEQ ID NO: 295808 - DNA, 1241 bp, Homo sapiens
gctccctgttcccggcagagccgcttccccctcctccctgtgctgtctgcaccgaggagagcggcctgccgggtgagtaggtccggtgcctctgggccctcggggtcccctctcctgcaggctcgaggtgggcggggagaagggggacgggcgcggacccgggtcccagggccaggcctcccttgtgagtagactatgcaaagaaaaagtgggccaccatatctggaaactacagtctatgctttgaagcgcaaaagggaataaacatttaaagactcccccggggacctggaggatggacttttccatggtggccggagcagcagcttacaatgaaaaatcagagactggtgctcttggagaaaactatagttggcaaattcccattaaccacaatgacttcaaaattttaaaaaataatgagcgtcagctgtgtgaagtcctccagaataagtttggctgtatctctaccctggtctctccagttcaggaaggcaacagcaaatctctgcaagtgttcagaaaaatgctgactcctaggatagagttatcagtctggaaagatgacctcaccacacatgctgttgatgctgtggtgaatgcagccaatgaagatcttctgcatgggggaggcctggccctggccctggtaaaagctggtggatttgaaatccaagaagagagcaaacagtttgttgccagatatggtaaagtgtcagctggtgagatagctgtcacgggagcagggaggcttccctgcaaacagatcatccatgctgttgggcctcggtggatggaatgggataaacagggatgtactggaaagctgcagagggccattgtaagtattctgaattatgtcatctataaaaatactcacattaagacagtagttgaactacccttgatatggttcagctctgtatccccacccaaatctcatgtcaaattgtaattcccagtgttgagggagggagctggtgggaggtgattggctcatgggggccgacgtcccccttgctgttctcgtgacagtgagtgagccctcgtgggatctgcttgttgaaaagtgtgcagcacctcccgcttcactctctctgtctctcctgctccaccatggccagacgtgcctgcttcccctttgccttctgcatgattgtcagtttcctgaggcctccccagccatgcttcctgtacagcctgcagaactgtgagtcaattaaacctctttcttcataaaa

SEQ ID NO: 295809 - DNA, 1382 bp, Homo sapiens
tatttctatagtgagcatatatcacttttgtaatcctcaaaaacacaaaatggaacatccttttgttcatggatggaacaatggaaccattatttaaaacataaaagtggaatccctgaatgacaaggacagcagctggcaggcatctgggggaaggaagatgacagctgagaaattaagttagaatgaggatatggaaagcatccacactaaggcgccgtcagccagacccgcaccaggcacatgtgaggccccatcctccaccgagtgttcactgtctcagtgagtctcttggcagtagggccccgtccctgtccgccaccgcacagtgacatactttctcccgccctctcccctaggtcagctggaactgggtccgcctggaaacccgggggccgggcccccagagggctttcgcagcctggccgcccgaagctcacctgccctttcactgaactccacccggaaggtgcccggggcttcgtgttcctgggtgctgaccgtgcactccccgccgcccgaggacttagagctctggaagtagctctccagcttccttcgtactcgggggccggacttgtacacccgcacgaggagcggggacggcgggcgcagaagtgggccaccatatctggaaactacagtctatgctttgaagcgcaaaagggaataaacatttaaagactcccccggggacctggaggatggacttttccatggtggccggagcagcagcttacaatgaaaaatcaggtaggattacctcgctctcactcttgtttcagaaagtctttgctcagatctttcctcagtggagaaaggggaatacagaagaatgtctcccctacaagtgctcaggtgcgtgactgcagacccttgtggggacccccgcacatgcttcagagttggtgtggcaccgaccagcaggcatattctctcaaggcctacaccattcctctcctttgcccgtaaatgtgagactcttttaacgacagcctatggctgaattgaccagatggggtggccaactgattgtctccttgctcaacgagtactatacaagctaaatagttctggcttaattccaggggtcccccattaaagattttcaaccaaagctcaggccaatagggcctgactacccaatttcggcttcgtttgggtaattgaggccacaagaggtctttctaggagactcagattagaaatgggagttgaagcaaaataaaagtaatgatcacattttatctattttaggatgcacatttttttttcacattttaacaatataccttatttcaatcggcccaggtgggcagattgcttgaaatcaggagtttgagaccagcctaggcaatatggtgaaaccccatctctacaga

SEQ ID NO: 295810 - DNA, 336 bp, Homo sapiens
gtgctgtctgcaccgaggagagcggcctgccgggtgagtaggtccggtgcctctgggccctcggggtcccctctcctgcaggctcgaggtgggcggggagaagggggacgggcgcggacccgggtcccagggccaggcctcccttgtgagtagactatgcaaagaaagtaagtttctcctgtgtttcttattctttgtaactcttactgctgttaccactattatttgatcctaaaaagtaattcacattctgaatccatgttaaacttacccatttttgaaaatttgaatgtgttcatctggtaattgtgacctgttaccccttccctccctcca

SEQ ID NO: 295811 - DNA, 1048 bp, Homo sapiens
tggatcctgaaacctcagggagtaccaaaccctatatacactatggtttttactatatggtaatgagtgggtagcatgtatagtggataggctggacaaaggaatgattcatgtcccaggtgggatggaatgagacagcatgagatttcttagtgcaaagaatggcatgtaatttaaaacttgcgaagtctttatttctggaatttttaatttcatgttttcagactgtgattgactatgggtaacaaaccattgtggaaagcaaaaccttggataagggtataaggacttcctatacttgctaagtatttaggtcaagaattacatcctatttaattagctattaatatagataaaagtaccctacatgcagaaaaacccagagttagattcattgctgaaaacaagagcctggagtagggctcttttttgttaaaggggagctacaaaaagttgttgctgtttgttatcctgaggtatgacttaaatgaagatttacggagatgagacgatgatgcaggaaaataggaggacatcagcacagtcttacgaccaccacatctgaaccaatctgaaccattgaactgttagctgagtgtttggatttgtgatatagccagtattactgcttacaagagttatatatgagttttggggcttgcagaaatgccagacccaaaattgtaatactgagaaagaaagaaaaaaattgtattcaagatgatcctgcaaacctaaattccaaaatacatgaagacaaaatctgtgaaagatagctgataaaatcaacaattaggagatgaattcatgtcagattaaagaaaacaaaacattctgttgaagactttgaaaatcagtatgcttgcaattgtcagtgagataaaagaagcaatagcatctatagaaaagaagtgaaacaaaaacaataaatacggaaaaacaatcaaatcctgtacatgagaaacccatttcattgattctaagacaattttttgaaatcggagtgcatcttgctattcaaggcatgtcagtgtttctctctcttttt

SEQ ID NO: 295812 - DNA, 901 bp, Homo sapiens
agcggaggaagagcgctcccgcgaactgcggcggtggtggctgggccaccagagggaagcgggtgtggcccaggcagcgggggctgggacagacctggaaaggaggaagcggggaaggaaggttgtcctgtcgggctgggggctcccgggaatccggaggccagcagtggaaccgcaaggctctacagggcagatctgcctcccgggctgtctcagctacgccgagtcgttggctcagggcggaggattttcctattggccgcgttatttgaatggaatggaggataggtcgtgaagtaggtgctgctggttgatctttctaaggaactcagatgaacttgggcatgtcagaattaataaccttttaaaagtggggtctgtgtggccgagggttttaatggtaagttcttgaggtgaccacctattgacaagggttgacctgctgtaattgctgtggcttcctgccaaccccactttagaaatgtttttcttcctctctttacttgttttgtttgctttctctcacgcttgggttctcttctttcttccttcagtgctttaagcctgtctcgtactacccatgagcttagctcagcctgattactggtccttaccttttaagggatttctggttacagctccatctctttctaaggaggggtaaagacctagcttgcgtctagcatttaaaaaggggaaagtttgaagggaaggggacaatttacggtaaagacagatattttaattgggataaactaaataaatggagccagggagaaggggaaataggggctgtagagatacacctgggaagagatttggaaacttattgtgaagcaccaaagtgtgagaataaaacggagcaaaaagagagtagagagtagaatggggataaaaaaag

SEQ ID NO: 295813 - DNA, 1064 bp, Homo sapiens
agcggaggaagagcgctcccgcgaactgcggcggtggtggctgggccaccagagggaagcgggtgtggcccaggcagcgggggctgggacagacctggaaaggaggaagcggggaaggaaggttgtcctgtcgggctgggggctcccgggaatccggaggccagcagtggaaccgcaaggctctacagggcagatctgcctcccgggctgtctcagctacgccgagtcgttggctcagggcggaggattttcctattggccgcgttatttgaatggaatggaggataggtcgtgaagtaggtgctgctggttgatctttctaaggaactcagatgaacttgggcatgtcagaattaataaccttttaaaagtggggtctgtgtggccgagggttttaatgtcctacccagggagttgaccagaaccaacatggaaccaccctaacttgcttcagactccattgctagatcaatcctgatttctagatcatagcatctaatctttgccttgcctctggattacaagggtggaaccaagcagaggggttcacccaagccatctttgggtgcttccatgggaaagaaggatttcactgagaataataagtgacaccaaggctcaaaagaatgagagagaagtctgttggtctcttgaacagcagggatttgctcacagatctctggaagtagccagaatgtgacaggatctcaaaatgaatggctgcttcatggaggctggaacataagcctgggactcccagtagccaaacatagctgtgccacaaacatggctgaaatgtagcagtttggtggatccgaggtcagtcattgaaaatgtattgattggcacctattctttgtgaatcattattctgggttctggggtcacaggagcaaatgaaacaaatgaagtacctgccatcaatgagcttacattctagtaaagagggacagaaaatgaatacattttaaatgaataaattcagataccgctaaatgtagtgaagaaaaaaattgggctaaagagagcgaaaaacaatttctgaagttactagcagtgaaggg

SEQ ID NO: 295814 - DNA, 3622 bp, Homo sapiens
ggtgggaagaggctgggagctgcggccgctgtgccagggtgaccggtagagttgtagccgaggtggcggcgcggggcggggcgggcggagagagaaggaaggaggtggttgtgcaggatggcgacggcggcctacgagcagctgaagctgcatatcacacctgaaaaattttatgtggaagcttgtgatgatggagcagatgacgtacttaccattgaccgtgtgtccacagaggttacccttgcagtcaagaaagatgttcctccttcagctgtcacaagaccaatatttggtatactgggcacaatccatctggtggcaggtaattatcttatagtcattaccaaaaagataaaagtaggtgaatttttcagtcatgtagtctggaaagcaacagattttgatgtcctttcttataagaagacaatgttgcacttaactgatattcagttacaagataataaaaccttcctagcgatgctaaaccatgtcttgaatgtggatggattttacttttcaacaacatatgatttgacccatactttgcagcggctatccaacactagtcctgaattccaagaaatgagtctcttggaaagggcagatcagcggtttgtatggaatggtcatcttctaagagaactttctgcacagccagaggttcatcggtttgcccttccagtgttacatggctttattaccatgcattcatgttctattaatggaaaatactttgattggattctcatctcgaggaggagctgtttcagagctggtgtgcgctattatgtaagaggaattgattcggaaggccatgcagctaactttgtagaaacagaacaaattgtgcactacaatgggagcaaagcttcgtttgtacagactcgaggatcaatacctgttttctggtcccaaagaccaaacctcaagtacaaaccactgccacagatcagcaaagtagcaaatcacatggacggtttccaaaggcattttgattcccaagtaattatttatggaaaacaagttataatcaatctgattaaccagaagggctcggagaagccacttgagcagacatttgcaacaatggtgtcttccttgggaagtggaatgatgagatacattgcctttgacttccataaggaatgtaaaaatatgagatgggatcgactaagtattttattggatcaggtagcagaaatgcaagatgaattaagttattttctagtggactctgctggccaggtggtggcaaaccaggaaggcgtgttccgaagcaattgcatggattgtctagatagaaccaatgtgatccagagtttgttagctcgtcgttcacttcaggcccaacttcagagactaggagttttgcatgtgggacaaaagcttgaagaacaagatgaatttgagaagattttcaaaaatgcctgggctgacaacgcaaatgcttgtgccaagcaatatgcgggaactggtgccttgaagactgactttaccagaactggaaagagaactcatttgggacttataatggatggctggaactcaatgatacgatattataagaacaacttttccgatggatttagacaagattccatagacttatttcttggaaactattcagtggatgaattagaatctcatagtcctttaagtgttccaagggactggaaattcctggctttgcctattatcatggttgttgccttttcaatgtgcattatctgtttgcttatggctggtgacacttggacagaaacactggcctatgtgctcttctggggagttgcaagcattggaacattttttatcattctttacaatggcaaagattttgtcgatgctcccagactggtccagaaagaaaagatagactgaatttgtatttgtggaaagcggcttggcttggaagattccattgtgcagaactggagtctttactgacccgctttccacatcagcccaaggtctttttaatgcctttatccaaaagcacatcttgtgctccatgcaggatgatgacagaattgatctgatgttactgccttgatggtctctttactattgggacagttagatttataatttgaagctattctgtaattaaaatataacctgaattcagcttgcagaatggaagctgaatctgttcattgtattctattgattgtcaatttaattagctgttgcagaataagtaatatattttaaaaacctagctcctttcattatttaaaacagcaaaattatttttgtagctcagtttcattattgtcattgtagaagcggtcactattagcaggcatacttttccacacatctttggacttttcttaaaagttcagtaataagctaactgtgtttataaaatgtaagtctcttacagacatcaagtagtttgatgagacagtctgtgacttcatgataggaaagaggaggatgaggtctggggttctttaaagtctctggtgggctgcctcatgactttaatcagcttgaactgccagtgcaccagcagtttaggtgtgatgagagaattcagatatactttatctttttaaaaaagtgtaaataaaatcaaagaatgtaaagtctatctcttacgctagaggtccaaagctgcctctgttttaaagattatcccaatgtggaagatgcccatgactggtcagctacttcctcctatacattttggtttctttgagggtcactcattgagacacgcaggcctctgagagggtcttgttctagatttcatattgcacttggagggtaacagctgctttttcacgcatggtactcttgatgtttttcactctgtcaaggattttgttggctatcaatgaatgtgtctaaaacttagtgcttccaggtagttatagtactccaaatcaaggaccaacttaaacgttaatttttgtgcaaaaacaaacctgaaaaatatgcttcggaaactgtgcatagttctaattgtaagtcagattgtatattcaaattgtaattaagagatttaaatattagaacggtatgtaaggtagtataattaccactattttaaaacaattcagttaaacactgctgcaatatttcagtgttgtgcttgaaaatatgtacagtttttttccaatattaataccttatgttgtccttaaatatttctaaaagcgcctttatttcagcattacctttttttcatcactatcttttataaaacattaatataagtcgttacttttagaaactaaaggaaataatagctggaaaaccctctgtagtttaaaatcagtcattaaactcacaatagggtaagtaaatatagccacctgttaacatgtaaataagcataatttgttccaaagatggaatattgaaacttagttcatgtctgctgtaaaatattatttaaatgctgctgggcatttcacttaaagaacttaatgtcaacagctacaacaaagaccaaatctgaactgctaatgtggctgctttgtagggaatggactaatatcagtgtgttagatcttaaggtatcagtatttcagaatcctgcgacgattttatttctaaattcatgtactgtatgtccataagtgaaaataaaatgtcatattcttttcta

SEQ ID NO: 295815 - DNA, 671 bp, Homo sapiens
gggttaaattcgcagttctccccggttttttacttaaggatttaccccccccaaggttgaaggtgccaaaaaaccaaaaaccccccaccttggaaaaagattttgaatttgccttaatggaccttaaagaagtagctgaccatgggaatgctgacactattcaccattcaagggactgtaggtatgcagccagaggtcctggtgcaggcgaactgaccgacattaatgatggagtggctgtgacgaaagggatgacagtatcccagagaaagtgatgcctgcaacagacttcccattaaaggaaaccttggagatatttcccaacattgaaagtgcaaaggataaaatgtcagaagttggtttagacttaggaaggtgtatgacagttcaccagggatagaagaaatattctgtatcttaatctatatgacaagaaggcggcaagcactgttcaagtctcttgataaatttttttacaaagaaaatattttttattctcggtgtttctaatgttttaaattatagtgtgctaaatattagttttacaatttgttcatttatgcttataatttactatatataacttacaagttacatctacaacgtaactatataagttaatatctataactaatatctataacttacaatagagtttttaatgttttgac

SEQ ID NO: 295816 - DNA, 3822 bp, Homo sapiens
  misc_feature (3631)..(3631): n is a, c, g, or t
  misc_feature (3633)..(3633): n is a, c, g, or t
  misc_feature (3644)..(3644): n is a, c, g, or t
  misc_feature (3652)..(3652): n is a, c, g, or t
  misc_feature (3658)..(3658): n is a, c, g, or t
  misc_feature (3660)..(3660): n is a, c, g, or t
  misc_feature (3664)..(3664): n is a, c, g, or t
  misc_feature (3672)..(3672): n is a, c, g, or t
ggtgggaagaggctgggagctgcggccgctgtgccagggtgaccggtagagttgtagccgaggtggcggcgcggggcggggcgggcggagagagaaggaaggaggtggttgtgcaggatggcgacggcggcctacgagcagctgaagctgcatatcacacctgaaaaattttatgtggaagcttgtgatgatggagcagatgacgtacttaccattgaccgtgtgtccacagaggttacccttgcagtcaagaaagatgttcctccttcagctgtcacaagaccaatatttggtatactgggcacaatccatctggtggcaggtaattatcttatagtcattaccaaaaagataaaagtaggtgaatttttcagtcatgtagtctggaaagcaacagattttgatgtcctttcttataagaagacaatgttgcacttaactgatattcagttacaagataataaaaccttcctagcgatgctaaaccatgtcttgaatgtggatggattttacttttcaacaacatatgatttgacccatactttgcagcggctatccaacactagtcctgaattccaagaaatgagtctcttggaaagggcagatcagcggtttgtatggaatggtcatcttctaagagaactttctgcacagccagaggttcatcggtttgcccttccagtgttacatggctttattaccatgcattcatgttctattaatggaaaatactttgattggattctcatctcgaggaggagctgtttcagagctggtgtgcgctattatgtaagaggaattgattcggaaggccatgcagctaactttgtagaaacagaacaaattgtgcactacaatgggagcaaagcttcgtttgtacagactcgaggatcaatacctgttttctggtcccaaagaccaaacctcaagtacaaaccactgccacagatcagcaaagtagcaaatcacatggacggtttccaaaggcattttgattcccaagtaattatttatggaaaacaagttataatcaatctgattaaccagaagggctcggagaagccacttgagcagacatttgcaacaatggtgtcttccttgggaagtggaatgatgagatacattgcctttgacttccataaggaatgtaaaaatatgagatgggatcgactaagtattttattggatcaggtagcagaaatgcaagatgaattaagttattttctagtggactctgctggccaggtggtggcaaaccaggaaggcgtgttccgaagcaattgcatggattgtctagatagaaccaatgtgatccagagtttgttagctcgtcgttcacttcaggcccaacttcagagactaggagttttgcatgtgggacaaaagcttgaagaacaagatgaatttgagaagattttcaaaaatgcctgggctgacaacgcaaatgcttgtgccaagcaatatgcgggaactggtgccttgaagactgactttaccagaactggaaagagaactcatttgggacttataatggatggctggaactcaatgatacgatattataagaacaacttttccgatggatttagacaagattccatagacttatttcttggaaactattcagtggatgaattagaatctcatagtcctttaagtgttccaagggactggaaattcctggctttgcctattatcatggttgttgccttttcaatgtgcattatctgtttgcttatggctggtgacacttggacagaaacactggcctatgtgctcttctggggagttgcaagcattggaacattttttatcattctttacaatggcaaagattttgtcgatgctcccagactggtccagaaagaaaagatagactgaatttgtatttgtggaaagcggcttggcttggaagattccattgtgcagaactggagtctttactgacccgctttccacatcagcccaaggtctttttaatgcctttatccaaaagcacatcttgtgctccatgcaggatgatgacagaattgatctgatgttactgccttgatggtctctttactattgggacagttagatttataatttgaagctattctgtaattaaaatataacctgaattcagcttgcagaatggaagctgaatctgttcattgtattctattgattgtcaatttaattagctgttgcagaataagtaatatattttaaaaacctagctcctttcattatttaaaacagcaaaattatttttgtagctcagtttcattattgtcattgtagaagcggtcactattagcaggcatacttttccacacatctttggacttttcttaaaagttcagtaataagctaactgtgtttataaaatgtaagtctcttacagacatcaagtagtttgatgagacagtctgtgacttcatgataggaaagaggaggatgaggtctggggttctttaaagtctctggtgggctgcctcatgactttaatcagcttgaactgccagtgcaccagcagtttaggtgtgatgagagaattcagatatactttatctttttaaaaaagtgtaaataaaatcaaagaatgtaaagtctatctcttacgctagaggtccaaagctgcctctgttttaaagattatcccaatgtggaagatgcccatgactggtcagctacttcctcctatacattttggtttctttgagggtcactcattgagacacgcaggcctctgagagggtcttgttctagatttcatattgcacttggagggtaacagctgctttttcacgcatggtactcttgatgtttttcactctgtcaaggattttgttggctatcaatgaatgtgtctaaaacttagtgcttccaggtagttatagtactccaaatcaaggaccaacttaaacgttaatttttgtgcaaaaacaaacctgaaaaatatgcttcggaaactgtgcatagttctaattgtaagtcagattgtatattcaaattgtaattaagagatttaaatattagaacggtatgtaaggtagtataattaccactattttaaaacaattcagttaaacactgctgcaatatttcagtgttgtgcttgaaaatatgtacagtttttttccaatattaataccttatgttgtccttaaatatttctaaaagcgcctttatttcagcattacctttttttcatcactatcttttataaaacattaatataagtcgttacttttagaaactaaaggaaataatagctggaaaaccctctgtagtttaaaatcagtcattaaactcacaatagggtaagtaaatatagccacctgttaacatgtaaataagcataatttgttccaaagatggaatattgaaacttagttcatgtctgctgtaaaatattatttaaatgctgctgggcatttcacttaaagaacttaatgtcaacagctacaacaaagaccaaatctgaactgctaatgtggctgctttgtagggaatggactaatatcagtgtgttagatcttaaggtatcagtatttcagaatcctgcgacgattttatttctaaattcatgtactgtatgtccataagtgaaaataaaatgtcatattcttttctaaaaaaaacnanaaaaaaaaaanttttgggncgctgngncccngaaaaagntttttgacacaactcgtgggggcccggcccagaggttagggaagtgccacgcgttccaggaaccggcctgaatgggttggttccccaaaaaagcccggggaccggcgttgaaacccagggtgggcagggtaagggcagggcataaccggg

SEQ ID NO: 295817 - DNA, 2654 bp, Homo sapiens
agggatcagtctgtggtaaaggtttaaggtcttctcaggactcttttcagcatgcatcttgcctggttatattaaccagaagggctcggagaagccacttgagcagacatttgcaacaatggtgtcttccttgggaagtggaatgatgagatacattgcctttgacttccataaggaatgtaaaaatatgagatgggatcgactaagtattttattggatcaggtagcagaaatgcaagatgaattaagttattttctagtggactctgctggccaggtggtggcaaaccaggaaggcgtgttccgaagcaattgcatggattgtctagatagaaccaatgtgatccagagtttgttagctcgtcgttcacttcaggcccaacttcagagactaggagttttgcatgtgggacaaaagcttgaagaacaagatgaatttgagaagattttcaaaaatgcctgggctgacaacgcaaatgcttgtgccaagcaatatgcgggaactggtgccttgaagactgactttaccagaactggaaagagaactcatttgggacttataatggatggctggaactcaatgatacgatattataagaacaacttttccgatggatttagacaagattccatagacttatttcttggaaactattcagtggatgaattagaatctcatagtcctttaagtgttccaagggactggaaattcctggctttgcctattatcatggttgttgccttttcaatgtgcattatctgtttgcttatggctggtgacacttggacagaaacactggcctatgtgctcttctggggagttgcaagcattggaacattttttatcattctttacaatggcaaagattttgtcgatgctcccagactggtccagaaagaaaagatagactgaatttgtatttgtggaaagcggcttggcttggaagattccattgtgcagaactggagtctttactgacccgctttccacatcagcccaaggtctttttaatgcctttatccaaaagcacatcttgtgctccatgcaggatgatgacagaattgatctgatgttactgccttgatggtctctttactattgggacagttagatttataatttgaagctattctgtaattaaaatataacctgaattcagcttgcagaatggaagctgaatctgttcattgtattctattgattgtcaatttaattagctgttgcagaataagtaatatattttaaaaacctagctcctttcattatttaaaacagcaaaattatttttgtagctcagtttcattattgtcattgtagaagcggtcactattagcaggcatacttttccacacatctttggacttttcttaaaagttcagtaataagctaactgtgtttataaaatgtaagtctcttacagacatcaagtagtttgatgagacagtctgtgacttcatgataggaaagaggaggatgaggtctggggttctttaaagtctctggtgggctgcctcatgactttaatcagcttgaactgccagtgcaccagcagtttaggtgtgatgagagaattcagatatactttatctttttaaaaaagtgtaaataaaatcaaagaatgtaaagtctatctcttacgctagaggtccaaagctgcctctgttttaaagattatcccaatgtggaagatgcccatgactggtcagctacttcctcctatacattttggtttctttgagggtcactcattgagacacgcaggcctctgagagggtcttgttctagatttcatattgcacttggagggtaacagctgctttttcacgcatggtactcttgatgtttttcactctgtcaaggattttgttggctatcaatgaatgtgtctaaaacttagtgcttccaggtagttatagtactccaaatcaaggaccaacttaaacgttaatttttgtgcaaaaacaaacctgaaaaatatgcttcggaaactgtgcatagttctaattgtaagtcagattgtatattcaaattgtaattaagagatttaaatattagaacggtatgtaaggtagtataattaccactattttaaaacaattcagttaaacactgctgcaatatttcagtgttgtgcttgaaaatatgtacagtttttttccaatattaataccttatgttgtccttaaatatttctaaaagcgcctttatttcagcattacctttttttcatcactatcttttataaaacattaatataagtcgttacttttagaaactaaaggaaataatagctggaaaaccctctgtagtttaaaatcagtcattaaactcacaatagggtaagtaaatatagccacctgttaacatgtaaataagcataatttgttccaaagatggaatattgaaacttagttcatgtctgctgtaaaatattatttaaatgctgctgggcatttcacttaaagaacttaatgtcaacagctacaacaaagaccaaatctgaactgctaatgtggctgctttgtagggaatggactaatatcagtgtgttagatcttaaggtatcagtatttcagaatcctgcgacgattttatttctaaattcatgtactgtatgtccataagtgaaaataaaatgtcatattcttttcta

SEQ ID NO: 295818 - DNA, 2719 bp, Homo sapiens
ggtgggaagaggctgggagctgcggccgctgtgccagggtgaccggtagagttgtagccgaggtggcggcgcggggcggggcgggcggagagagaaggaaggaggtggttgtgcaggatggcgacggcggcctacgagcagctgaagctgcatatcacacctgaaaaattttatgtggaagcttgtgatgatggagcagatgacgtacttaccattgaccgtgtgtccacagaggttacccttgcagtcaagaaagatgttcctccttcagctgtcacaagaccaatatttggtatactgggcacaatccatctggtggcaggtaattatcttatagtcattaccaaaaagataaaagtaggtgaatttttcagtcatgtagtctggaaagcaacagattttgatgtcctttcttataagaagacaatgttgcacttaactgatattcagttacaagataataaaaccttcctagcgatgctaaaccatgtcttgaatgtggatggattttacttttcaacaacatatgatttgacccatactttgcagcggctatccaacactagtcctgaattccaagaaatgagtctcttggaaagggcagatcagcggtttgtatggaatggtcatcttctaagagaactttctgcacagccagaggttcatcggtttgcccttccagtgttacatggctttattaccatgcattcatgttctattaatggaaaatactttgattggattctcatctcgaggaggagctgtttcagagctggtgtgcgctattatgtaagaggaattgattcggaaggccatgcagctaactttgtagaaacagaacaaattgtgcactacaatgggagcaaagcttcgtttgtacagactcgaggatcaatacctgttttctggtcccaaagaccaaacctcaagtacaaaccactgccacagatcagcaaagtagcaaatcacatggacggtttccaaaggcattttgattcccaagtaattatttatggaaaacaagttataatcaatctgattaaccagaagggctcggagaagccacttgagcagacatttgcaacaatggtgtcttccttgggaagtggaatgatgagatacattgcctttgacttccataaggaatgtaaaaatatgagatgggatcgactaagtattttattggatcaggtagcagaaatgcaagatgaattaagttattttctagtggactctgctggccaggtggtggcaaaccaggaaggcgtgttccgaagcaattgcatggattgtctagatagaaccaatgtgatccagagtttgttagctcgtcgttcacttcaggcccaacttcagagactaggagttttgcatgtgggacaaaagcttgaagaacaagatgaatttgagaagattttcaaaaatgcctgggctgacaacgcaaatgcttgtgccaagcaatatgcgggaactggtgccttgaagactgactttaccagaactggaaagagaactcatttgggacttataatggatggctggaactcaatgatacgatattataagaacaacttttccgatggatttagacaagattccatagacttatttcttggaaactattcagtggatgaattagaatctcatagtcctttaagtgttccaagggactggaaattcctggctttgcctattatcatggttgttgccttttcaatgtgcattatctgtttgcttatggctggtgacacttggacagaaacactggcctatgtgctcttctggggagttgcaagcattggaacattttttatcattctttacaatggcaaagattttgtcgatgctcccagactggtccagaaagaaaagatagactgaatttgtatttgtggaaagcggcttggcttggaagattccattgtgcagaactggagtctttactgacccgctttccacatcagcccaaggtctttttaatgcctttatccaaaagcacatcttgtgctccatgcaggatgatgacagaattgatctgatgttactgccttgatggtctctttactattgggacagttagatttataatttgaagctattctgtaattaaaatataacctgaattcagcttgcagaatggaagctgaatctgttcattgtattctattgattgtcaatttaattagctgttgcagaataagtaatatattttaaaaacctagctcctttcattatttaaaacagcaaaattatttttgtagctcagtttcattattgtcattgtagaagcggtcactattagcaggcatacttttccacacatctttggacttttcttaaaagttcagtaataagctaatctacaagcgtggttatggccaaaatccaataagaagcgaattgcttttgacagataacgctttgatgctcgatctcttggtaataccggcatcatctgctggaggattcgcttcactgagatctattctgtggaaaacgctttgagaaggcaataacttccgttggcgttaaatgtcttccccgaggtggtattagcaacagacccccctttcgtgtcatctggcttctgccccggggcccattccggcttctcacaaatcgcacggccgccccatattctagcgcgggcccacgcccccctcgtcaacaaaaaaaaggcgggtgactgtggcgccccctcttcgccaacagtaacacg

SEQ ID NO: 295819 - DNA, 807 bp, Homo sapiens
  misc_feature (671)..(671): n is a, c, g, or t
  misc_feature (681)..(681): n is a, c, g, or t
  misc_feature (683)..(683): n is a, c, g, or t
  misc_feature (687)..(687): n is a, c, g, or t
  misc_feature (692)..(692): n is a, c, g, or t
  misc_feature (696)..(696): n is a, c, g, or t
  misc_feature (700)..(700): n is a, c, g, or t
  misc_feature (705)..(705): n is a, c, g, or t
  misc_feature (723)..(724): n is a, c, g, or t
ggtgggaagaggctgggagctgcggccgctgtgccagggtgaccggtagagttgtagccgaggtggcggcgcggggcggggcgggcggagagagaaggaaggaggtggttgtgcaggatggcgacggcggcctacgagcagctgaagctgcatatcacacctgaaaaattttatgtggaagcttgtgatgatggagcagatgacgtacttaccattgaccgtgtgtccacagaggttacccttgcagtcaagaaagatgttcctccttcagctgtcacaagaccaatatttggtatactgggcacaatccatctggtggcaggtaattatcttatagtcattaccaaaaagataaaagtaggtgaatttttcagtcatgtagtctggaaagcaacagattttgatgtcctttcttataagaagacaatgttgcacttaactgatattcagttacaagataataaaaccttcctagcgatgctaaaccatgtcttgaatgtggatggattttacttttcaacaacatatgatttgacccatactttgcagcggctatccaacactagtcctgaattccaagaaatgagtctcttggaaagggcagatcagcggtttgtatggaatggtcatcttctaagagaactttctgcacagccagaggttcatcggtntgccctcccngngtancatgncttnattnccatncattcatgttctattaanngaaaatactttgactggtttctcatctaaagaataacgctgcagcgtgttgtaactggagcaatagcaactggagctgctgta

SEQ ID NO: 295820 - DNA, 877 bp, Homo sapiens
ggtgggaagaggctgggagctgcggccgctgtgccagggtgaccggtagagttgtagccgaggtggcggcgcggggcggggcgggcggagagagaaggaaggaggtggttgtgcaggatggcgacggcggcctacgagcagctgaagctgcatatcacacctgaaaaattttatgtggaagcttgtgatgatggagcagatgacgtacttaccattgaccgtgtgtccacagaggttacccttgcagtcaagaaagatgttcctccttcagctgtcacaagaccaatatttggtatactgggcacaatccatctggtggcaggtaattatcttatagtcattaccaaaaagataaaagtaggtgaatttttcagtcatgtagtctggaaagcaacagattttgatgtcctttcttataagaagacaatgttgcacttaactgatattcagttacaagataataaaaccttcctagcgatgctaaaccatgtcttgaatgtggatggattttacttttcaacaacatatgatttgacccatactttgcagcggctatccaacactagtcctgaattccaagaaatgagtctcttggaaagggcagatcagcggtttgtatggaatggtcatcttctaagagaactttctgcacagccagaggtaatgtacacgaaataaaatctgcttaattgttacagtccaagctttaattcaatgcatactataaagtgacttcctaatcaccaagaatttcgagaaacaattctaatttaactgtttataacttacaaacttggatcaggtctaccctgtcacatcattctaggttgaagaagcctaactattttactctgatcttctatagaagccttaaata

SEQ ID NO: 295821 - DNA, 1638 bp, Homo sapiens
ggtgggaagaggctgggagctgcggccgctgtgccagggtgaccggtagagttgtagccgaggtggcggcgcggggcggggcgggcggagagagaaggaaggaggtggttgtgcaggatggcgacggcggcctacgagcagctgaagctgcatatcacacctgaaaaattttatgtggaagcttgtgatgatggagcagatgacgtacttaccattgaccgtgtgtccacagaggttacccttgcagtcaagaaagatgttcctccttcagctgtcacaagaccaatatttggtatactgggcacaatccatctggtggcaggtaattatcttatagtcattaccaaaaagataaaagtaggtgaatttttcagtcatgtagtctggaaagcaacagattttgatgtcctttcttataagaagacaatgttgcacttaactgatattcagtaagaactggaaattgttactaattgcaacgcccgaagaagtagcatgggctggggagaggagggtgagggtgttgtggaatacaaagaatgctataattattttaacaacctatagagtaagatcactctacctacttttctacctaggcataaaaaatattttttaaatcatttgttgctcttgttttttttttttaaaagattcagttcttaaattatgcaatttcatgtggagagaagggaaaacagaaatgcacgggtactcaacaccagatttaacttcatatcctctttgtaaagaaataaaatataaatacctttgaagttctactcctcttaactcattcccttctttcccagagaggttttctctatttttaccacatgtgaatgtaagtgtgtgtgtgtgtttatgaaatgtgtatatattctttcaggcagttttccttttgcactattcctgtatgcacagatttcagtaaccatagtttagttaacaccagtacccaaacagcatggcttaaatttcagttactccagtttattaactgaagaattaacccaccaaagatgaaggtgcaaaaaaacaaaaagcaacaactctggaagagaaattgaaattgaacataaatggagcatagaagaagtagctgaccatgggaatgctgacactattcaccattcaagggactgtaggtatgcagccagaggtcctggtgcaggcgaactgaccgacattaatgatggagtggctgtgacgaaagggatgacagtatcccagagaaagtgatgcctgcaacagacttcccattaaaggaaaccttggagatatttcccaacattgaaagtgcaaaggataaaatgtcagaagttggtttagacttaggaaggtgtatgacagttcaccagggatagaagaaatattctgtatcttaatctatatgacaagaaggcggcaagcactgttcaagtctcttgataaatttttttacaaagaaaatattttttattctcggtgtttctaatgttttaaattatagtgtgctaaatattagttttacaatttgttcatttatgcttataatttactatatataacttacaagttacatctacaacgtaactatataagttaatatctataactaatatctataacttacaatagagtttttaatgttttgac

SEQ ID NO: 295822 - DNA, 744 bp, Homo sapiens
  misc_feature (608)..(608): n is a, c, g, or t
  misc_feature (618)..(618): n is a, c, g, or t
  misc_feature (620)..(620): n is a, c, g, or t
  misc_feature (624)..(624): n is a, c, g, or t
  misc_feature (629)..(629): n is a, c, g, or t
  misc_feature (633)..(633): n is a, c, g, or t
  misc_feature (637)..(637): n is a, c, g, or t
  misc_feature (642)..(642): n is a, c, g, or t
  misc_feature (660)..(661): n is a, c, g, or t
ggtgggaagaggctgggagctgcggccgctgtgccagggtgaccggtagagttgtagccgaggtggcggcgcggggcggggcgggcggagagagaaggaaggaggtggttgtgcaggatggcgacggcggcctacgagcagctgaagctgcatatcacacctgaaaaattttatgtggaagcttgtgatgatggagcagatgacgtacttaccattgaccgtgtgtccacagaggttacccttgcagtcaagaaagatgttcctccttcagctgtcacaagaccaatatttggtatactgggcacaatccatctggtggcaggtaattatcttatagtcattaccaaaaagataaaagtaggtgaatttttcagtcatgtagtctggaaagcaacagattttgatgtcctttcttataagaagacaatgttgcacttaactgatattcagttttcaacaacatatgatttgacccatactttgcagcggctatccaacactagtcctgaattccaagaaatgagtctcttggaaagggcagatcagcggtttgtatggaatggtcatcttctaagagaactttctgcacagccagaggttcatcggtntgccctcccngngtancatgncttnattnccatncattcatgttctattaanngaaaatactttgactggtttctcatctaaagaataacgctgcagcgtgttgtaactggagcaatagcaactggagctgctgta

SEQ ID NO: 295823 - DNA, 570 bp, Homo sapiens
cctgggtactaggaacttgctagaatgcagattcctggggcccaacagttgatgctttatcaagccctgcagaagattctggtactagccagggtttgagaaccactggtttaaaccttaattaagaggttcttatatttttcctgtgaatgtgctagtaaactttaatgttgccaaaatgtgctaaacagctgaaaactgggtctgatatcaacaaacgacttatttagctttttgtttcttaatatcaacaggtgacacttggacagaaacactggcctatgtgctcttctggggagttgcaagcattggaacattttttatcattctttacaatggcaaagattttgtcgatgctcccagactggtccagaaagaaaagatagactgaatttgtatttgtggaaagcggcttggcttggaagattccattgtgcagaactggagtctttactgacccgctttccacatcagcccaaggtctttttaatgcctttatccaaaagcacatcttgtgctccatgcaggatgatgacagaattgatctgatgttactgccttgatggtctc

SEQ ID NO: 295824 - DNA, 637 bp, Homo sapiens
  misc_feature (34)..(34): n is a, c, g, or t
taattcgatgcaagggacggcgtcttcattgtanattcactgtgcccgtcgttttacaatttacactcctgcccggcgtctctatggcctctgtgggcatcgccatctacacctccatgatgactagcgacaactactactacacccacagcatctggcacatcctgctggccgggagcgcagccttgctgctgccgccacctgaccagcccgccgagccctgggcctgctcgcagaaattcccctgccactatcagatctgcaagaacgatcgggaggaactgtacgcagtgacgtgacactggcctggggacagctgctgctctgatgacctcttcagccaggagctgtatcgagggggaggcgcctggtccagccctggacagattgatttccagctgaataaattggcctagataccaaaaaaaaaaaaacaaaaaaacaatgaaaaacaacacaaaaccacaacgggagacatattgactgaggtggggacgaaaaaagggcgatataacaggagagcccaggtgtccacagagcacaacaccgagccacaagagatctgcagcaagaggtgagactatcgcggcacccctatgggagaagccgatcacggacagggcgagtgcccctcata

SEQ ID NO: 295825 - DNA, 3648 bp, Homo sapiens
catgggcgccgggggcagaggcggaggcggcagaggcggaggcggcagaggctgcccgggcggcggcgggggccggcggcgcgggacgcgggccgggtagcgccgggccgagcgcggagccatgggccgggctggcaccgggaccgggggcgaggcggtggccgcggtggtggcggggccgctgctgctgctgctgcttgcccggcccccgcctgcctccgccggctacagcgggaagagcgaggtggggctggtgtccgagcacttctcacaggccccgcagaggctgtccttctacagctggtatggcagtgccaggctcttccgcttccgcgtgcccccagatgctgtgcttctacgctggctcctgcaggtctcccgggagagcggcgctgcctgcaccgacgcggagatcaccgtgcacttccgttccggcgcccctccggtcatcaacccgctgggcaccagcttcccggacgacaccgcggtgcagccctccttccaggtcggggtgccgctgagcaccgcaccgagaagcaatgcctccgtcaacgtttcccacccggcccccggggactggttcgtggccgcccacctgcccccctcatcccagaagatcgagttgaagggcttggctcccacctgtgcctacgtcttccagcctgaactgctggtcacgcgggtggtcgagatttccatcatggagccggacgtgccccttcctcagaccctcctctcccatcccagctacctcaaggtctttgtccccgattacacgcgggagcttctgctggagctgcgggactgcgtgtccaatgggagcctgggctgccccgtgcgtctcaccgtgggcccggtcaccctgcctagcaacttccagaaggtgctcacctgcaccggtgccccctggccctgccgcctgctgctgccctcaccgccctgggaccggtggctgcaagtgacagctgagagcctggtggggcccctcgggacagtggctttcagtgctgtagctgccctcacagcttgcaggccacggagcgtgaccgtccagccccttctgcagagcagccaaaaccagagcttcaatgcctcctctggtctgctgtccccgagccccgaccaccaggacctgggcaggagtggcagggtggaccgcagccccttctgcctcacaaactacccagtcacgcgggaggacatggacgtggtgtcggtgcacttccagcccctggacagggtctcggtgagggtgtgttcggacacgccctccgtgatgcggctgcgcctgaacaccggcatggacagcgggggttccctcaccatctccctgcgggccaacaagacagagatgcggaacgagaccgtcgtagtggcctgcgtgaatgctgcctcgcccttccttggcttcaatacttcgctcaactgcaccacagccttcttccagggctaccctttgtctctgagcgcctggtctcgcagggccaacctcatcatcccctacccagagacagacaactggtacctctccctgcagctcatgtgccctgagaatgctgaggactgtgagcaggctgtggtccacgtggagaccaccttgtacctggtgccctgtttgaacgattgtggaccctatggccagtgcctcctgctccgcagacacagctacctgtatgccagctgcagctgcaaggcaggctggcgtgggtggagctgcacggacaacagcacagcccagacggtggcccagcagagggcggccacactgctgctcacgctcagcaacctcatgttcctggcccccatcgccgtctcagtgcggcgattcttcctggtggaggcctccgtctacgcctacaccatgttcttctccacgttctaccacgcctgcgaccagcccggggaggcggtgctgtgcatcctcagctacgacacgctgcagtactgcgacttcttgggctccggggcggccatctgggtcaccatcctgtgcatggcacggctcaagacagtcctgaaatacgtgctgtttcttctgggtacactggtcatcgccatgtccttgcagctggaccgcaggggcatgtggaacatgctggggccctgcctctttgccttcgtgatcatggcctccatgtgggcttaccgctgcgggcaccggcgccagtgctaccccacctcgtggcagcgctgggccttctacctcctgcccggcgtctctatggcctctgtgggcatcgccatctacacctccatgatgactagcgacaactactactacacccacagcatctggcacatcctgctggccgggagcgcagccttgctgctgccgccacctgaccagcccgccgagccctgggcctgctcgcagaaattcccctgccactatcagatctgcaagaacgatcgggaggaactgtacgcagtgacgtgacactggcctggggacagctgctgctctgatgacctcttcagccaggagctgtatcgagggggaggcgcctggtccagccctggacagattgatttccagctgaataaattggcctagataccctcttacttcctcctactgaggagagggccacccctccctcacacgcacctctcctcgccagctgcctgctcgctgctgagatccctctgcagatcccagctgctgtctgcagtggcccctggggcctgggcttggttacttggagaccacaggtgcctgtgcgagggtggggctgtgtgctctgctggcctgtgggtggctagagatggggagaaggactccctatggtcctgttccctggcgaggctgtggtgagacccatggcgcccaggagccctgagcccaccactggggccgggagctgtggactccgagacccctgctcctggcccctgtgtggccctgatgccagcctgcctggggcatggaggatccccctctgctgctgtggtcaccatagggacgggagacggaggtttcccccagagctgatgggcactggggatgcaggctcccgccccgcccctccctttttcctggctctggagccttgggtccctgagaagagcttccttggactggggtgctctgctgctctgggggtttggcccagaaggaacccctacccagccctgtccacccaccccagcgttcctgggcccccctctgggagcttcctcttggtcccaggagctgcggtggtgtctgccccctgcactgggctctgtgccctgtgggtgttcaggagactggactgtctctgctcctcatgcaaaccttgtgggggaagcaatgaccaggagcagcacctggcccctccctgaggcctgtgagtgtctcggatccgccctggagaagtgagtggctgagacccgggtggggccctcctacccttggctctgggggcttcccttctgggtcttgtccgggatatggccttcctgaaggtcttacctcccccagccgccctgcacttgaccaccaaagcaatctctaagcttataaaggagaaacatgtatatatggggttttttggagtaaaggaaaattctaagatattaagacatatttttatgtagatctgatctatctgtgtttggtgaatttaatattctacattgatttttcaaactaaacgagtttttaca

SEQ ID NO: 295826 - DNA, 3555 bp, Homo sapiens
catgggcgccgggggcagaggcggaggcggcagaggcggaggcggcagaggctgcccgggcggcggcgggggccggcggcgcgggacgcgggccgggtagcgccgggccgagcgcggagccatgggccgggctggcaccgggaccgggggcgaggcggtggccgcggtggtggcggggccgctgctgctgctgctgcttgcccggcccccgcctgcctccgccggctacagcgggaagagcgaggtggggctggtgtccgagcacttctcacaggccccgcagaggctgtccttctacagctggtatggcagtgccaggctcttccgcttccgcgtgcccccagatgctgtgcttctacgctggctcctgcaggtctcccgggagagcggcgctgcctgcaccgacgcggagatcaccgtgcacttccgttccggcgcccctccggtcatcaacccgctgggcaccagcttcccggacgacaccgcggtgcagccctccttccaggtcggggtgccgctgagcaccgcaccgagaagcaatgcctccgtcaacgtttcccacccggcccccggggactggttcgtggccgcccacctgcccccctcatcccagaagatcgagttgaagggcttggctcccacctgtgcctacgtcttccagcctgaactgctggtcacgcgggtggtcgagatttccatcatggagccggacgtgccccttcctcagaccctcctctcccatcccagctacctcaaggtctttgtccccgattacacgcgggagcttctgctggagctgcgggactgcgtgtccaatgggagcctgggctgccccgtgcgtctcaccgtgggcccggtcaccctgcctagcaacttccagaaggtgctcacctgcaccggtgccccctggccctgccgcctgctgctgccctcaccgccctgggaccggtggctgcaagtgacagctgagagcctggtggggcccctcgggacagtggctttcagtgctgtagctgccctcacagcttgcaggccacggagcgtgaccgtccagccccttctgcagagcagccaaaaccagagcttcaatgcctcctctggtctgctgtccccgagccccgaccaccaggacctgggcaggagtggcagggtggaccgcagccccttctgcctcacaaactacccagtcacgcgggaggacatggacgtggtgtcggtgcacttccagcccctggacagggtctcggtgagggtgtgttcggacacgccctccgtgatgcggctgcgcctgaacaccggcatggacagcgggggttccctcaccatctccctgcgggccaacaagacagagatgcggaacgagaccgtcgtagtggcctgcgtgaatgctgcctcgcccttccttggcttcaatacttcgctcaactgcaccacagccttcttccagggctaccctttgtctctgagcgcctggtctcgcagggccaacctcatcatcccctacccagagacagacaactggtacctctccctgcagctcatgtgccctgagaatgctgaggactgtgagcaggctgtggtccacgtggagaccaccttgtacctggtgccctgtttgaacgattgtggaccctatggccagtgcctcctgctccgcagacacagctacctgtatgccagctgcagctgcaaggcaggctggcgtgggtggagctgcacggacaacagcacagcccagacggtggcccagcagagggcggccacactgctgctcacgctcagcaacctcatgttcctggcccccatcgccgtctcagtgcggcgattcttcctggtggaggcctccgtctacgcctacaccatgttcttctccacgttctaccacgcctgcgaccagcccggggaggcggtgctgtgcatcctcagctacgacacgctgcagtactgcgacttcttgggctccggggcggccatctgggtcaccatcctgtgcatggcacggctcaagacagtcctgaaatacgtgctgtttcttctgggtacactggtcatcgccatgtccttgcagctggaccgcaggggcatgtggaacatgctggggccctgcctctttgccttcgtgatcatggcctccatgtgggcttaccgctgcgggcaccggcgccagtgctaccccacctcgtggcagcgctgggccttctacctcctgcccggcgtctctatggcctctgtgggcatcgccatctacacctccatgatgactagcgacaactactactacacccacagcatctggcacatcctgctggccgggagcgcagccttgctgctgccgccacctgaccagcccgccgagccctgggcctgctcgcagaaattcccctgccactatcagatctgcaagaacgatcgggaggaactgtacgcagtgacgtgacactggcctggggacagctgctgctctgatgacctcttcagccaggagctgtatcgagggggaggcgcctggtccagccctggacagattgatttccagctgaataaattggcctagataccctcttacttcctcctactgaggagagggccacccctccctcacacgcacctctcctcgccagctgcctgctcgctgctgagatccctctgcagatcccagctgctgtctgcagtggcccctggggcctgggcttggttacttggagaccacaggtgcctgtgcgagggtggggctgtgtgctctgctggcctgtgggtggctagagatggggagaaggactccctatggtcctgttccctggcgaggctgtggtgagacccatggcgcccaggagccctgagcccaccactggggccgggagctgtggactccgagacccctgctcctggcccctgtgtggccctgatgccagcctgcctggggcatggaggatccccctctgctgctgtggtcaccatagggacgggagacggaggtttcccccagagctgatgggcactggggatgcaggctcccgccccgcccctccctttttcctggctctggagccttgggtccctgagaagagcttccttggactggggtgctctgctgctctgggggtttggcccagaaggaacccctacccagccctgtccacccaccccagcgttcctgggcccccctctgggagcttcctcttggtcccaggagctgcggtggtgtctgccccctgcactgggctctgtgccctgtgggtgttcaggagactggactgtctctgctcctcatgcaaaccttgtgggggaagcaatgaccaggagcagcacctggcccctccctgaggcctgtgagtgtctcggatccgccctggagaagtgagtggctgagacccgggtggggccctcctacccttggctctgggggcttcccttctgggtcttgtccgggatatggccttcctgaaggtcttacctcccccagccgccctgcacttgaccaccaaagcaatctctaagcttataaaggagaaacatgtatatatggggttttttggagtaaaggaaaattctaag

SEQ ID NO: 295827 - DNA, 3599 bp, Homo sapiens
catgggcgccgggggcagaggcggaggcggcagaggcggaggcggcagaggctgcccgggcggcggcgggggccggcggcgcgggacgcgggccgggtagcgccgggccgagcgcggagccatgggccgggctggcaccgggaccgggggcgaggcggtggccgcggtggtggcggggccgctgctgctgctgctgcttgcccggcccccgcctgcctccgccggctacagcgggaagagcgaggtggggctggtgtccgagcacttctcacaggccccgcagaggctgtccttctacagctggtatggcagtgccaggctcttccgcttccgcgtgcccccagatgctgtgcttctacgctggctcctgcaggtctcccgggagagcggcgctgcctgcaccgacgcggagatcaccgtgcacttccgttccggcgcccctccggtcatcaacccgctgggcaccagcttcccggacgacaccgcggtgcagccctccttccaggtcggggtgccgctgagcaccgcaccgagaagcaatgcctccgtcaacgtttcccacccggcccccggggactggttcgtggccgcccacctgcccccctcatcccagaagatcgagttgaagggcttggctcccacctgtgcctacgtcttccagcctgaactgctggtcacgcgggtggtcgagatttccatcatggagccggacgtgccccttcctcagaccctcctctcccatcccagctacctcaaggtctttgtccccgattacacgcgggagcttctgctggagctgcgggactgcgtgtccaatgggagcctgggctgccccgtgcgtctcaccgtgggcccggtcaccctgcctagcaacttccagaaggtgctcacctgcaccggtgccccctggccctgccgcctgctgctgccctcaccgccctgggaccggtggctgcaagtgacagctgagagcctggtggggcccctcgggacagtggctttcagtgctgtagctgccctcacagcttgcaggccacggagcgtgaccgtccagccccttctgcagagcagccaaaaccagagcttcaatgcctcctctggtctgctgtccccgagccccgaccaccaggacctgggcaggagtggcagggtggaccgcagccccttctgcctcacaaactacccagtcacgcgggaggacatggacgtggtgtcggtgcacttccagcccctggacagggtctcggtgagggtgtgttcggacacgccctccgtgatgcggctgcgcctgaacaccggcatggacagcgggggttccctcaccatctccctgcgggccaacaagacagagatgcggaacgagaccgtcgtagtggcctgcgtgaatgctgcctcgcccttccttggcttcaatacttcgctcaactgcaccacagccttcttccagggctaccctttgtctctgagcgcctggtctcgcagggccaacctcatcatcccctacccagagacagacaactggtacctctccctgcagctcatgtgccctgagaatgctgaggactgtgagcaggctgtggtccacgtggagaccaccttgtacctggtgccctgtttgaacgattgtggaccctatggccagtgcctcctgctccgcagacacagctacctgtatgccagctgcagctgcaaggcaggctggcgtgggtggagctgcacggacaacagcacagcccagacggtggcccagcagagggcggccacactgctgctcacgctcagcaacctcatgttcctggcccccatcgccgtctcagtgcggcgattcttcctggtggaggcctccgtctacgcctacaccatgttcttctccacgttctaccacgcctgcgaccagcccggggaggcggtgctgtgcatcctcagctacgacacgctgcagtactgcgacttcttgggctccggggcggccatctgggtcaccatcctgtgcatggcacggctcaagacagtcctgaaatacgtgctgtttcttctgggtacactggtcatcgccatgtccttgcagctggaccgcaggggcatgtggaacatgctggggccctgcctctttgccttcgtgatcatggcctccatgtgggcttaccgctgcgggcaccggcgccagtgctaccccacctcgtggcagcgctgggccttctacctcctgcccggcgtctctatggcctctgtgggcatcgccatctacacctccatgatgactagcgacaactactactacacccacagcatctggcacatcctgctggccgggagcgcagccttgctgctgccgccacctgaccagcccgccgagccctgggcctgctcgcagaaattcccctgccactatcagatctgcaagaacgatcgggaggaactgtacgcagtgacgtgacactggcctggggacagctgctgctctgatgacctcttcagccaggagctgtatcgagggggaggcgcctggtccagccctggacagattgatttccagctgaataaattggcctagataccctcttacttcctcctactgaggagagggccacccctccctcacacgcacctctcctcgccagctgcctgctcgctgctgagatccctctgcagatcccagctgctgtctgcagtggcccctggggcctgggcttggttacttggagaccacaggtgcctgtgcgagggtggggctgtgtgctctgctggcctgtgggtggctagagatggggagaaggactccctatggtcctgttccctggcgaggctgtggtgagacccatggcgcccaggagccctgagccctgtgtggccctgatgccagcctgcctggggcatggaggatccccctctgctgctgtggtcaccatagggacgggagacggaggtttcccccagagctgatgggcactggggatgcaggctcccgccccgcccctccctttttcctggctctggagccttgggtccctgagaagagcttccttggactggggtgctctgctgctctgggggtttggcccagaaggaacccctacccagccctgtccacccaccccagcgttcctgggcccccctctgggagcttcctcttggtcccaggagctgcggtggtgtctgccccctgcactgggctctgtgccctgtgggtgttcaggagactggactgtctctgctcctcatgcaaaccttgtgggggaagcaatgaccaggagcagcacctggcccctccctgaggcctgtgagtgtctcggatccgccctggagaagtgagtggctgagacccgggtggggccctcctacccttggctctgggggcttcccttctgggtcttgtccgggatatggccttcctgaaggtcttacctcccccagccgccctgcacttgaccaccaaagcaatctctaagcttataaaggagaaacatgtatatatggggttttttggagtaaaggaaaattctaagatattaagacatatttttatgtagatctgatctatctgtgtttggtgaatttaatattctacattgatttttcaaactaaacgagtttttaca

SEQ ID NO: 295828 - DNA, 3330 bp, Homo sapiens
catgggcgccgggggcagaggcggaggcggcagaggcggaggcggcagaggctgcccgggcggcggcgggggccggcggcgcgggacgcgggccgggtagcgccgggccgagcgcggagccatgggccgggctggcaccgggaccgggggcgaggcggtggccgcggtggtggcggggccgctgctgctgctgctgcttgcccggcccccgcctgcctccgccggctacagcgggaagagcgaggtggggctggtgtccgagcacttctcacaggccccgcagaggctgtccttctacagctggtatggcagtgccaggctcttccgcttccgcgtgcccccagatgctgtgcttctacgctggctcctgcaggtctcccgggagagcggcgctgcctgcaccgacgcggagatcaccgtgcacttccgttccggcgcccctccggtcatcaacccgctgggcaccagcttcccggacgacaccgcggtgcagccctccttccaggtcggggtgccgctgagcaccgcaccgagaagcaatgcctccgtcaacgtttcccacccggcccccggggactggttcgtggccgcccacctgcccccctcatcccagaagatcgagttgaagggcttggctcccacctgtgcctacgtcttccagcctgaactgctggtcacgcgggtggtcgagatttccatcatggagccggacgtgccccttcctcagaccctcctctcccatcccagctacctcaaggtctttgtccccgattacacgcgggagcttctgctggagctgcgggactgcgtgtccaatgggagcctgggctgccccgtgcgtctcaccgtgggcccggtcaccctgcctagcaacttccagaaggtgctcacctgcaccggtgccccctggccctgccgcctgctgctgccctcaccgccctgggaccggtggctgcaagtgacagctgagagcctggtggggcccctcgggacagtggctttcagtgctgtagctgccctcacagcttgcaggccacggagcgtgaccgtccagccccttctgcagagcagccaaaaccagagcttcaatgcctcctctggtctgctgtccccgagccccgaccaccaggacctgggcaggagtggcagggtggaccgcagccccttctgcctcacaaactacccagtcacgcgggaggacatggacgtggtgtcggtgcacttccagcccctggacagggtctcggtgagggtgtgttcggacacgccctccgtgatgcggctgcgcctgaacaccggcatggacagcgggggttccctcaccatctccctgcgggccaacaagacagagatgcggaacgagaccgtcgtagtggcctgcgtgaatgctgcctcgcccttccttggcttcaatacttcgctcaactgcaccacagccttcttccagggctaccctttgtctctgagcgcctggtctcgcagggccaacctcatcatcccctacccagagacagacaactggtacctctccctgcagctcatgtgccctgagaatgctgaggactgtgagcaggctgtggtccacgtggagaccaccttgtacctggtgccctgtttgaacgattgtggaccctatggccagtgcctcctgctccgcagacacagctacctgtatgccagctgcagctgcaaggcaggctggcgtgggtggagctgcacggacaacagcacagcccagacggtggcccagcagagggcggccacactgctgctcacgctcagcaacctcatgttcctggcccccatcgccgtctcagtgcggcgattcttcctggtggaggcctccgtctacgcctacaccatgttcttctccacgttctaccacgcctgcgaccagcccggggaggcggtgctgtgcatcctcagctacgacacgctgcagtactgcgacttcttgggctccggggcggccatctgggtcaccatcctgtgcatggcacggctcaagacagtcctgaaatacgtgctgtttcttctgggtacactggtcatcgccatgtccttgcagctggaccgcaggggcatgtggaacatgctggggccctgcctctttgccttcgtgatcatggcctccatgtgggcttaccgctgcgggcaccggcgccagtgctaccccacctcgtggcagcgctgggccttctacctcctgcccggcgtctctatggcctctgtgggcatcgccatctacacctccatgatgactagcgacaactactactacacccacagcatctggcacatcctgctggccgggagcgcagccttgctgctgccgccacctgaccagcccgccgagccctgggcctgctcgcagaaattcccctgccactatcagatctgcaagaacgatcgggaggaactgtacgcagtgacgtgacactggcctggggacagctgctgctctgatgacctcttcagccaggagctgtatcgagggggaggcgcctggtccagccctggacagattgatttccagctgaataaattggcctagataccctcttacttcctcctactgaggagagggccacccctccctcacacgcacctctcctcgccagctgcctgctcgctgctgagatccctctgcagatcccagctgctgtctgcagtggcccctggggcctgggcttggttacttggagaccacaggtgcctgtgcgagggtggggctgtgtgctctgctggcctgtgggtggctagagatggggagaaggactccctatggtcctgttccctggcgaggctgtggtgagacccatggcgcccaggagccctgagcccaccactggggccgggagctgtggactccgagacccctgctcctggcccctgtgtggccctgatgccagcctgcctggggcatggaggatccccctctgctgctgtggtcaccatagggacgggagacggaggtttcccccagagctgatggcccctccctgaggcctgtgagtgtctcggatccgccctggagaagtgagtggctgagacccgggtggggccctcctacccttggctctgggggcttcccttctgggtcttgtccgggatatggccttcctgaaggtcttacctcccccagccgccctgcacttgaccaccaaagcaatctctaagcttataaaggagaaacatgtatatatggggttttttggagtaaaggaaaattctaagatattaagacatatttttatgtagatctgatctatctgtgtttggtgaatttaatattctacattgatttttcaaactaaacgagtttttaca

SEQ ID NO: 295829 - DNA, 3289 bp, Homo sapiens
  misc_feature (23)..(23): n is a, c, g, or t
  misc_feature (43)..(43): n is a, c, g, or t
taggctaggtacgaggctgggtnggtgtcttctacgctgctgnaccgacgcggagataccggcacttccgttccggcgcccctccggtcatcaacccgctgggcaccagcttcccggacgacaccgcggtgcagccctccttccaggtcggggtgccgctgagcaccgcaccgagaagcaatgcctccgtcaacgtttcccacccggcccccggggactggttcgtggccgcccacctgcccccctcatcccagaagatcgagttgaagggcttggctcccacctgtgcctacgtcttccagcctgaactgctggtcacgcgggtggtcgagatttccatcatggagccggacgtgccccttcctcagaccctcctctcccatcccagctacctcaaggtctttgtccccgattacacgcgggagcttctgctggagctgcgggactgcgtgtccaatgggagcctgggctgccccgtgcgtctcaccgtgggcccggtcaccctgcctagcaacttccagaaggtgctcacctgcaccggtgccccctggccctgccgcctgctgctgccctcaccgccctgggaccggtggctgcaagtgacagctgagagcctggtggggcccctcgggacagtggctttcagtgctgtagctgccctcacagcttgcaggccacggagcgtgaccgtccagccccttctgcagagcagccaaaaccagagcttcaatgcctcctctggtctgctgtccccgagccccgaccaccaggacctgggcaggagtggcagggtggaccgcagccccttctgcctcacaaactacccagtcacgcgggaggacatggacgtggtgtcggtgcacttccagcccctggacagggtctcggtgagggtgtgttcggacacgccctccgtgatgcggctgcgcctgaacaccggcatggacagcgggggttccctcaccatctccctgcgggccaacaagacagagatgcggaacgagaccgtcgtagtggcctgcgtgaatgctgcctcgcccttccttggcttcaatacttcgctcaactgcaccacagccttcttccagggctaccctttgtctctgagcgcctggtctcgcagggccaacctcatcatcccctacccagagacagacaactggtacctctccctgcagctcatgtgccctgagaatgctgaggactgtgagcaggctgtggtccacgtggagaccaccttgtacctggtgccctgtttgaacgattgtggaccctatggccagtgcctcctgctccgcagacacagctacctgtatgccagctgcagctgcaaggcaggctggcgtgggtggagctgcacggacaacagcacagcccagacggtggcccagcagagggcggccacactgctgctcacgctcagcaacctcatgttcctggcccccatcgccgtctcagtgcggcgattcttcctggtggaggcctccgtctacgcctacaccatgttcttctccacgttctaccacgcctgcgaccagcccggggaggcggtgctgtgcatcctcagctacgacacgctgcagtactgcgacttcttgggctccggggcggccatctgggtcaccatcctgtgcatggcacggctcaagacagtcctgaaatacgtgctgtttcttctgggtacactggtcatcgccatgtccttgcagctggaccgcaggggcatgtggaacatgctggggccctgcctctttgccttcgtgatcatggcctccatgtgggcttaccgctgcgggcaccggcgccagtgctaccccacctcgtggcagcgctgggccttctacctcctgcccggcgtctctatggcctctgtgggcatcgccatctacacctccatgatgactagcgacaactactactacacccacagcatctggcacatcctgctggccgggagcgcagccttgctgctgccgccacctgaccagcccgccgagccctgggcctgctcgcagaaattcccctgccactatcagatctgcaagaacgatcgggaggaactgtacgcagtgacgtgacactggcctggggacagctgctgctctgatgacctcttcagccaggagctgtatcgagggggaggcgcctggtccagccctggacagattgatttccagctgaataaattggcctagataccctcttacttcctcctactgaggagagggccacccctccctcacacgcacctctcctcgccagctgcctgctcgctgctgagatccctctgcagatcccagctgctgtctgcagtggcccctggggcctgggcttggttacttggagaccacaggtgcctgtgcgagggtggggctgtgtgctctgctggcctgtgggtggctagagatggggagaaggactccctatggtcctgttccctggcgaggctgtggtgagacccatggcgcccaggagccctgagcccaccactggggccgggagctgtggactccgagacccctgctcctggcccctgtgtggccctgatgccagcctgcctggggcatggaggatccccctctgctgctgtggtcaccatagggacgggagacggaggtttcccccagagctgatgggcactggggatgcaggctcccgccccgcccctccctttttcctggctctggagccttgggtccctgagaagagcttccttggactggggtgctctgctgctctgggggtttggcccagaaggaacccctacccagccctgtccacccaccccagcgttcctgggcccccctctgggagcttcctcttggtcccaggagctgcggtggtgtctgccccctgcactgggctctgtgccctgtgggtgttcaggagactggactgtctctgctcctcatgcaaaccttgtgggggaagcaatgaccaggagcagcacctggcccctccctgaggcctgtgagtgtctcggatccgccctggagaagtgagtggctgagacccgggtggggccctcctacccttggctctgggggcttcccttctgggtcttgtccgggatatggccttcctgaaggtcttacctcccccagccgccctgcacttgaccaccaaagcaatctctaagcttataaaggagaaacatgtatatatggggttttttggagtaaaggaaaattctaagatattaagacatatttttatgtagatctgatctatctgtgtttggtgaatttaatattctacattgatttttcaaactaaacgagtttttaca

SEQ ID NO: 295830 - DNA, 3721 bp, Homo sapiens
catgggcgccgggggcagaggcggaggcggcagaggcggaggcggcagaggctgcccgggcggcggcgggggccggcggcgcgggacgcgggccgggtagcgccgggccgagcgcggagccatgggccgggctggcaccgggaccgggggcgaggcggtggccgcggtggtggcggggccgctgctgctgctgctgcttgcccggcccccgcctgcctccgccggctacagcgggaagagcgaggtggggctggtgtccgagcacttctcacaggccccgcagaggctgtccttctacagctggtatggcagtgccaggctcttccgcttccgcgtgcccccagatgctgtgcttctacgctggctcctgcaggtctcccgggagagcggcgctgcctgcaccgacgcggagatcaccgtgcacttccgttccggcgcccctccggtcatcaacccgctgggcaccagcttcccggacgacaccgcggtgcagccctccttccaggtcggggtgccgctgagcaccgcaccgagaagcaatgcctccgtcaacgtttcccacccggcccccggggactggttcgtggccgcccacctgcccccctcatcccagaagatcgagttgaagggcttggctcccacctgtgcctacgtcttccagcctgaactgctggtcacgcgggtggtcgagatttccatcatggagccggacgtgccccttcctcagaccctcctctcccatcccagctacctcaaggtctttgtccccgattacacgcgggagcttctgctggagctgcgggactgcgtgtccaatgggagcctgggctgccccgtgcgtctcaccgtgggcccggtcaccctgcctagcaacttccagaaggtgctcacctgcaccggtgccccctggccctgccgcctgctgctgccctcaccgccctgggaccggtggctgcaagtgacagctgagagcctggtggggcccctcgggacagtggctttcagtgctgtagctgccctcacagcttgcaggccacggagcgtgaccgtccagccccttctgcagagcagccaaaaccagagcttcaatgcctcctctggtctgctgtccccgagccccgaccaccaggacctgggcaggagtggcagggtggaccgcagccccttctgcctcacaaactacccagtcacgcgggaggacatggacgtggtgtcggtgcacttccagcccctggacagggtctcggtgagggtgtgttcggacacgccctccgtgatgcggctgcgcctgaacaccggcatggacagcgggggttccctcaccatctccctgcgggccaacaagacagagatgcggaacgagaccgtcgtagtggcctgcgtgaatgctgcctcgcccttccttggcttcaatacttcgctcaactgcaccacagccttcttccagggctaccctttgtctctgagcgcctggtctcgcagggccaacctcatcatcccctacccagagacagacaactggtacctctccctgcagctcatgtgccctgagaatgctgacctgttgggagcgctggtggcagctgggctgtcagatcactgcaccagctttcctgtggccccttcctcaaagggactgtgagcaggctgtggtccacgtggagaccaccttgtacctggtgccctgtttgaacgattgtggaccctatggccagtgcctcctgctccgcagacacagctacctgtatgccagctgcagctgcaaggcaggctggcgtgggtggagctgcacggacaacagcacagcccagacggtggcccagcagagggcggccacactgctgctcacgctcagcaacctcatgttcctggcccccatcgccgtctcagtgcggcgattcttcctggtggaggcctccgtctacgcctacaccatgttcttctccacgttctaccacgcctgcgaccagcccggggaggcggtgctgtgcatcctcagctacgacacgctgcagtactgcgacttcttgggctccggggcggccatctgggtcaccatcctgtgcatggcacggctcaagacagtcctgaaatacgtgctgtttcttctgggtacactggtcatcgccatgtccttgcagctggaccgcaggggcatgtggaacatgctggggccctgcctctttgccttcgtgatcatggcctccatgtgggcttaccgctgcgggcaccggcgccagtgctaccccacctcgtggcagcgctgggccttctacctcctgcccggcgtctctatggcctctgtgggcatcgccatctacacctccatgatgactagcgacaactactactacacccacagcatctggcacatcctgctggccgggagcgcagccttgctgctgccgccacctgaccagcccgccgagccctgggcctgctcgcagaaattcccctgccactatcagatctgcaagaacgatcgggaggaactgtacgcagtgacgtgacactggcctggggacagctgctgctctgatgacctcttcagccaggagctgtatcgagggggaggcgcctggtccagccctggacagattgatttccagctgaataaattggcctagataccctcttacttcctcctactgaggagagggccacccctccctcacacgcacctctcctcgccagctgcctgctcgctgctgagatccctctgcagatcccagctgctgtctgcagtggcccctggggcctgggcttggttacttggagaccacaggtgcctgtgcgagggtggggctgtgtgctctgctggcctgtgggtggctagagatggggagaaggactccctatggtcctgttccctggcgaggctgtggtgagacccatggcgcccaggagccctgagcccaccactggggccgggagctgtggactccgagacccctgctcctggcccctgtgtggccctgatgccagcctgcctggggcatggaggatccccctctgctgctgtggtcaccatagggacgggagacggaggtttcccccagagctgatgggcactggggatgcaggctcccgccccgcccctccctttttcctggctctggagccttgggtccctgagaagagcttccttggactggggtgctctgctgctctgggggtttggcccagaaggaacccctacccagccctgtccacccaccccagcgttcctgggcccccctctgggagcttcctcttggtcccaggagctgcggtggtgtctgccccctgcactgggctctgtgccctgtgggtgttcaggagactggactgtctctgctcctcatgcaaaccttgtgggggaagcaatgaccaggagcagcacctggcccctccctgaggcctgtgagtgtctcggatccgccctggagaagtgagtggctgagacccgggtggggccctcctacccttggctctgggggcttcccttctgggtcttgtccgggatatggccttcctgaaggtcttacctcccccagccgccctgcacttgaccaccaaagcaatctctaagcttataaaggagaaacatgtatatatggggttttttggagtaaaggaaaattctaagatattaagacatatttttatgtagatctgatctatctgtgtttggtgaatttaatattctacattgatttttcaaactaaacgagtttttaca

SEQ ID NO: 295831 - DNA, 3531 bp, Homo sapiens
catgggcgccgggggcagaggcggaggcggcagaggcggaggcggcagaggctgcccgggcggcggcgggggccggcggcgcgggacgcgggccgggtagcgccgggccgagcgcggagccatgggccgggctggcaccgggaccgggggcgaggcggtggccgcggtggtggcggggccgctgctgctgctgctgcttgcccggcccccgcctgcctccgccggctacagcgggaagagcgaggtggggctggtgtccgagcacttctcacaggccccgcagaggctgtccttctacagctggtatggcagtgccaggctcttccgcttccgcgtgcccccagatgctgtgcttctacgctggctcctgcaggtctcccgggagagcggcgctgcctgcaccgacgcggagatcaccgtgcacttccgttccggcgcccctccggtcatcaacccgctgggcaccagcttcccggacgacaccgcggtgcagccctccttccaggtcggggtgccgctgagcaccgcaccgagaagcaatgcctccgtcaacgtttcccacccggcccccggggactggttcgtggccgcccacctgcccccctcatcccagaagatcgagttgaagggcttggctcccacctgtgcctacgtcttccagcctgaactgctggtcacgcgggtggtcgagatttccatcatggagccggacgtgccccttcctcagaccctcctctcccatcccagctacctcaaggtctttgtccccgattacacgcgggagcttctgctggagctgcgggactgcgtgtccaatgggagcctgggctgccccgtgcgtctcaccgtgggcccggtcaccctgcctagcaacttccagaaggtgctcacctgcaccggtgccccctggccctgccgcctgctgctgccctcaccgccctgggaccggtggctgcaagtgacagctgagagcctggtggggcccctcgggacagtggctttcagtgctgtagctgccctcacagcttgcaggccacggagcgtgaccgtccagccccttctgcagagcagccaaaaccagagcttcaatgcctcctctggtctgctgtccccgagccccgaccaccaggacctgggcaggagtggcagggtggaccgcagccccttctgcctcacaaactacccagtcacgcgggaggacatggacgtggtgtcggtgcacttccagcccctggacagggtctcggtgagggtgtgttcggacacgccctccgtgatgcggctgcgcctgaacaccggcatggacagcgggggttccctcaccatctccctgcgggccaacaagacagagatgcggaacgagaccgtcgtagtggcctgcgtgaatgctgcctcgcccttccttggcttcaatacttcgctcaactgcaccacagccttcttccagggctaccctttgtctctgagcgcctggtctcgcagggccaacctcatcatcccctacccagagacagacaactggtacctctccctgcagctcatgtgccctgagaatgctgaggactgtgagcaggctgtggtccacgtggagaccaccttgtacctggtgccctgtttgaacgattgtggaccctatggccagtgcctcctgctccgcagacacagctacctgtatgccagctgcagctgcaaggcaggctggcgtgggtggagctgcacggacaacagcacagcccagacggtggcccagcagagggcggccacactgctgctcacgctcagcaacctcatgttcctggcccccatcgccgtctcagtgcggcgattcttcctggtggaggcctccgtctacgcctacaccatgttcttctccacgttctaccacgcctgcgaccagcccggggaggcggtgctgtgcatcctcagctacgacacgctgcagtactgcgacttcttgggctccggggcggccatctgggtcaccatcctgtgcatggcacggctcaagacagtcctgaaatacgcttaccgctgcgggcaccggcgccagtgctaccccacctcgtggcagcgctgggccttctacctcctgcccggcgtctctatggcctctgtgggcatcgccatctacacctccatgatgactagcgacaactactactacacccacagcatctggcacatcctgctggccgggagcgcagccttgctgctgccgccacctgaccagcccgccgagccctgggcctgctcgcagaaattcccctgccactatcagatctgcaagaacgatcgggaggaactgtacgcagtgacgtgacactggcctggggacagctgctgctctgatgacctcttcagccaggagctgtatcgagggggaggcgcctggtccagccctggacagattgatttccagctgaataaattggcctagataccctcttacttcctcctactgaggagagggccacccctccctcacacgcacctctcctcgccagctgcctgctcgctgctgagatccctctgcagatcccagctgctgtctgcagtggcccctggggcctgggcttggttacttggagaccacaggtgcctgtgcgagggtggggctgtgtgctctgctggcctgtgggtggctagagatggggagaaggactccctatggtcctgttccctggcgaggctgtggtgagacccatggcgcccaggagccctgagcccaccactggggccgggagctgtggactccgagacccctgctcctggcccctgtgtggccctgatgccagcctgcctggggcatggaggatccccctctgctgctgtggtcaccatagggacgggagacggaggtttcccccagagctgatgggcactggggatgcaggctcccgccccgcccctccctttttcctggctctggagccttgggtccctgagaagagcttccttggactggggtgctctgctgctctgggggtttggcccagaaggaacccctacccagccctgtccacccaccccagcgttcctgggcccccctctgggagcttcctcttggtcccaggagctgcggtggtgtctgccccctgcactgggctctgtgccctgtgggtgttcaggagactggactgtctctgctcctcatgcaaaccttgtgggggaagcaatgaccaggagcagcacctggcccctccctgaggcctgtgagtgtctcggatccgccctggagaagtgagtggctgagacccgggtggggccctcctacccttggctctgggggcttcccttctgggtcttgtccgggatatggccttcctgaaggtcttacctcccccagccgccctgcacttgaccaccaaagcaatctctaagcttataaaggagaaacatgtatatatggggttttttggagtaaaggaaaattctaagatattaagacatatttttatgtagatctgatctatctgtgtttggtgaatttaatattctacattgatttttcaaactaaacgagtttttaca

SEQ ID NO: 295832 - DNA, 2317 bp, Homo sapiens
catgggcgccgggggcagaggcggaggcggcagaggcggaggcggcagaggctgcccgggcggcggcgggggccggcggcgcgggacgcgggccgggtagcgccgggccgagcgcggagccatgggccgggctggcaccgggaccgggggcgaggcggtggccgcggtggtggcggggccgctgctgctgctgctgcttgcccggcccccgcctgcctccgccggctacagcgggaagagcgaggtggggctggtgtccgagcacttctcacaggccccgcagaggctgtccttctacagctggtatggcagtgccaggctcttccgcttccgcgtgcccccagatgctgtgcttctacgctggctcctgcaggtctcccgggagagcggcgctgcctgcaccgacgcggagatcaccgtgcacttccgttccggcgcccctccggtcatcaacccgctgggcaccagcttcccggacgacaccgcggtgcagccctccttccaggtcggggtgccgctgagcaccgcaccgagaagcaatgcctccgtcaacgtttcccacccggcccccggggactggttcgtggccgcccacctgcccccctcatcccagaagatcgagttgaagggcttggctcccacctgtgcctacgtcttccagcctgaactgctggtcacgcgggtggtcgagatttccatcatggagccggacgtgccccttcctcagaccctcctctcccatcccagctacctcaaggtctttgtccccgattacacgcgggagcttctgctggagctgcgggactgcgtgtccaatgggagcctgggctgccccgtgcgtctcaccgtgggcccggtcaccctgcctagcaacttccagaaggtgctcacctgcaccggtgccccctggccctgccgcctgctgctgccctcaccgccctgggaccggtggctgcaagtgacagctgagagcctggtggggcccctcgggacagtggctttcagtgctgtagctgccctcacagcttgcaggccacggagcgtgaccgtccagccccttctgcagagcagccaaaaccagagcttcaatgcctcctctggtctgctgtccccgagccccgaccaccaggacctgggcaggagtggcagggtggaccgcagccccttctgcctcacaaactacccagtcacgcgggaggacatggacgtggtgtcggtgcacttccagcccctggacagggtctcggtgagggtgtgttcggacacgccctccgtgatgcggctgcgcctgaacaccggcatggacagcgggggttccctcaccatctccctgcgggccaacaagacagagatgcggaacgagaccgtcgtagtggcctgcgtgaatgctgcctcgcccttccttggcttcaatacttcgctcaactgcaccacagccttcttccagggctaccctttgtctctgagcgcctggtctcgcagggccaacctcatcatcccctacccagagacagacaactggtacctctccctgcagctcatgtgccctgagaatgctgaggactgtgagcaggctgtggtccacgtggagaccaccttgtacctggtgccctgtttgaacgattgtggaccctatggccagtgcctcctgctccgcagacacagctacctgtatgccagctgcagctgcaaggcaggctggcgtgggtggagctgcacggacaacagcacagcccagacggtggcccagcagagggcggccacactgctgctcacgctcagcaacctcatgttcctggcccccatcgccgtctcagtgcggcgattcttcctggtggaggcctccgtctacgcctacaccatgttcttctccacgttctaccacgcctgcgaccagcccggggaggcggtgctgtgcatcctcagctacgacacgctgcagtactgcgacttcttgggctccggggcggccatctgggtcaccatcctgtgcatggcacggctcaagacagtcctgaaatacgtgctgtttcttctgggtacactggtcatcgccatgtccttgcagctggaccgcaggggcatgtggaacatgctggggccctgcctctttgccttcgtgatcatggcctccatgtgggtaaggagccgggctggctggcactgctgcccaggtgctcggagaagagagcctggccccttgctctagccacgttcctggtcctgctccaaccagtgaatgcccatatctgctgggggttgccatggcacccacagaggcccagcatggctgtgtccctgaggcctgggcctgagg

SEQ ID NO: 295833 - DNA, 2221 bp, Homo sapiens
  misc_feature (32)..(32): n is a, c, g, or t
ctagaggatcccccgctctcatagcggggaangggtgggctttgcgaagatggcggcgctgggggtgctggagtccgacctgccaagtgccgtgacacttctgaaaaatctccaggagcaagtgatggctgtaactgcacaagtgaaatcactgacacaaaaagttcaagctggtgcctatcctacagaaaagggtctcagcttcttggaagtgaaagaccagctgctgctcatgtaccttatggatttgacccacctcattctggacaaagcctcaggaggatctcttcagggacatgatgcagttttgagactggtagagattcgaacggttttggaaaagcttcgtcccttggaccaaaagctgaagtatcaaattgacaagctgatcaagactgcagtgacaggcagccttagtgagaatgacccacttcgttttaagcctcatcccagcaatatgatgagcaagttgagctctgaggatgaggaggaagatgaagcagaagatgaccagtctgaggcttcagggaagaaatctgtgaagggagtgtctaagaaatatgttcctccacgcttggttccagtacattatgatgaaacagaagctgagcgggagaagaagcgtctagaacgagccaagagacgggcattgagcagctctgtcattcgtgaacttaaggagcagtactcagatgctccagaggaaatccgtgatgctcggcatccccatgttacccgccagagtcaggaggaccaacacaggattaactatgaggagagcatgatggtgcgtttgagcgtcagtaagcgagagaaaggacggcgaaaacgagcaaatgtcatgagctcacaacttcattcccttacacacttcagtgacatcagtgctttgacagggggaactgttcatcttgatgaggatcagaatcctattaagaagcggaagaagatacctcagaaaggtcggaagaaaaaaggtcagtgaactgctgggacttaggtgatcaggtgcaaggtggggagtacaaattgagtctctttggatttgccattctgggtctcaccaagccctgtagtatctcttccatactgggcaataatctccttaggtgggcttttattttttgctttcctgagctggaaatcagcatcattcacaaaatgaatctctggattctgcctctaaggtcccacagctcctgttcaggcttccctaaatagaactggtaaagtgtcacttgaaggaaccattatcccatttcaattttattcctacttctcgtcttttgtcctgggaagatattcagggtactgcctaggagaccccacccctgtgagcccttccctctagatgtcctgttttcctgtccctttagcttttccaactgtcctttgcctcattcttggtttcccttcctttcaggttttcggaggcggcggtgattatgggtgtacatatttgtatattttttgtcatcctgagatacttctaatttcattgtatataggtggttttccctggaattcattaattgtttgctttggacatgtggaaagagccttactaataaaattgattttacttatgaattaaagcccctttttgcacatgtattgtacgactggagtcgttgggtttgggatatttttggtgagtggttggtgaaaagggaaattttttttggaagtgcaaaacatttgtattgttttctttgataatatatttttcccaaaaactaaaaattggttacgtcacaaaaagtattgagagacgaggctggtataatcaactctttcaacccatgttgccacaacttcctgtatgatttgttataatacaatacagattgagatattaacacatgaattttaggttttattagtgttatctgggctggccaccaggtggcataagtggttcaagaaacttgagcttggctgtaatcaaaagcaagatagaacctttccacatcagcaagattattcttatctccacttctctgaatgtttttcatttctttctgaaatagcatgaacataaggctgatctttggtcagttactgagggagtttgtagaaaatagtagagtgagtaagaaggctagagtgaagagtcagtatagtcttgtgtttttcagactctgacccccacccccccgccttcaactgagggtcattttaccagagtcaataaaggccaacccttctataaagagctggc

SEQ ID NO: 295834 - DNA, 2942 bp, Homo sapiens
atttagccagttcctttattccattggccagatcagactcctcctctcgtttatcctgttgggggcggaagtgagaaagcccttattcgtattggcttagatttgcaagcggcagttgtctatcaaatctatcaagtcgcccttagcgctcaggaagtacgacaccggaaggggtgggctttgcgaagatggcggcgctgggggtgctggagtccgacctgccaagtgccgtgacacttctgaaaaatctccaggagcaagtgatggctgtaactgcacaagtgaaatcactgacacaaaaagttcaagctggtgcctatcctacagaaaagggtctcagcttcttggaagtgaaagaccagctgctgctcatgtaccttatggatttgacccacctcattctggacaaagcctcaggaggatctcttcagggacatgatgcagttttgagactggtagagattcgaacggtatgaagcatttggcttcttggagttttaggtttctaaattttgagctccaagggtatcacacagtagctctcatttaagtgagtcttctcatgtttaaggaaaccaaatgagaaaaggtatttttctattcatttgctctactttgtacatattttaggtgccttatgtggcaccttaatatagggactctggtgtgtgcttcattttgggaaggaaatataatcctgattaactaccatgttgtaggttttggaaaagcttcgtcccttggaccaaaagctgaagtatcaaattgacaagctgatcaagactgcagtgacaggcagccttagtaagtgaggagaccatcatgaagttgtggggaccatcagaaagttccaaattttgtaaaattcattgggttatttatttcaggtgagaatgacccacttcgttttaagcctcatcccagcaatatgatgagcaaggtaaggggttgtagtattctcctgatttttttctgaggcagctatacctagatgagcctcttggtgatcctggataccctgggattctcttaggacttgattttccaacttgtgtgttagaatgctgagtttgagattcccttttttccctttttatattcccaccaccccagggtactccagctttgggttttcttctcacttatctcatgaatgcttcctaaatttgcagacattgtttcttttgtagttgagctctgaggatgaggaggaagatgaagcagaagatgaccagtctgaggcttcagggaagaaatctgtgaagggagtgtctaagaaatatgttcctccacgcttggttccagtacattatgatgaaacagaagctgagcgggagaagaagcgtctagaacgagccaagagacgggcattgagcagctctgtcattcgtgaacttaaggagcagtactcagatgctccagaggaaatccgtgatgctcggcatccccatgttacccgccagagtcaggaggaccaacacaggattaactatgaggagagcatgatggtgcgtttgagcgtcagtaagcgagagaaaggacggcgaaaacgagcaaatgtcatgagctcacaacttcattcccttacacacttcagtgacatcagtgctttgacagggggaactgttcatcttgatgaggatcagaatcctattaagaagcggaagaagatacctcagaaaggtcggaagaaaaaaggtcagtgaactgctgggacttaggtgatcaggtgcaaggtggggagtacaaattgagtctctttggatttgccattctgggtctcaccaagccctgtagtatctcttccatactgggcaataatctccttaggtgggcttttattttttgctttcctgagctggaaatcagcatcattcacaaaatgaatctctggattctgcctctaaggtcccacagctcctgttcaggcttccctaaatagaactggtaaagtgtcacttgaaggaaccattatcccatttcaattttattcctacttctcgtcttttgtcctgggaagatattcagggtactgcctaggagaccccacccctgtgagcccttccctctagatgtcctgttttcctgtccctttagcttttccaactgtcctttgcctcattcttggtttcccttcctttcaggttttcggaggcggcggtgattatgggtgtacatatttgtatattttttgtcatcctgagatacttctaatttcattgtatataggtggttttccctggaattcattaattgtttgctttggacatgtggaaagagccttactaataaaattgattttacttatgaattaaagcccctttttgcacatgtattgtacgactggagtcgttgggtttgggatatttttggtgagtggttggtgaaaagggaaattttttttggaagtgcaaaacatttgtattgttttctttgataatatatttttcccaaaaactaaaaattggttacgtcacaaaaagtattgagagacgaggctggtataatcaactctttcaacccatgttgccacaacttcctgtatgatttgttataatacaatacagattgagatattaacacatgaattttaggttttattagtgttatctgggctggccaccaggtggcataagtggttcaagaaacttgagcttggctgtaatcaaaagcaagatagaacctttccacatcagcaagattattcttatctccacttctctgaatgtttttcatttctttctgaaatagcatgaacataaggctgatctttggtcagttactgagggagtttgtagaaaatagtagagtgagtaagaaggctagagtgaagagtcagtatagtcttgtgtttttcagactctgacccccacccccccgccttcaactgagggtcattttaccagagtcaataaaggccaacccttctataaagagctggc

SEQ ID NO: 295835 - DNA, 616 bp, Homo sapiens
tcctcagcatgaactgtttctcttttctctgttcttggataaccctgcttattttcatcatgtagatgaaacagaagctgagcgggagaagaagcgtctagaacgagccaagagacgggcattgagcagctctgtcattcgtgaacttaaggagcagtactcagatgctccagaggaaatccgtgatgctcggcatccccatgttacccgccagagtcaggaggaccaacacaggattaactatgaggagagcatgatggtgcgtttgagcgtcagtaagcgagagaaaggacggcgaaaacgagcaaatgtcatgagctcacaacttcattcccttacacacttcagtgacatcagtgctttgacagggggaactgttcatcttgatgaggatcagaatcctattaagaagcggaagaagatacctcagaaaggtcggaagaaaaaaggttttcggaggcggcggtgattatgggtgtacatatttgtatattttttgtcatcctgagatacttctaatttcattgtatataggtggttttccctggaattcattaattgtttgctttggacatgtggaaagagccttactaataaaattgattttacttatgaa

SEQ ID NO: 295836 - DNA, 967 bp, Homo sapiens
atttagccagttcctttattccattggccagatcagactcctcctctcgtttatcctgttgggggcggaagtgagaaagcccttattcgtattggcttagatttgcaagcggcagttgtctatcaaatctatcaagtcgcccttagcgctcaggaagtacgacaccggaaggggtgggctttgcgaagatggcggcgctgggggtgctggagtccgacctgccaagtgccgtgacacttctgaaaaatctccaggagcaagtgatggctgtaactgcacaagtgaaatcactgacacaaaaagttcaagctggtgcctatcctacagaaaaggtaagatgtactcaaacagtaagcatcccctgacttaatgttctcagtagttctttcattgtatgtttattgtgtcttatatatcctaagtgctcgagcttcaaacataaatatgatccagtttctgtgctgaagtctagagggaagacaaagcaaagcaatagatgtaagtattaatagtagcagtcacattacagagttatgagtctccagccaaagagagggattaattaactgccagaagagcagagggattcaggacaggcttcccagaggaggtgataggattttgaggaataaatgggagggacagaaagaaggaacatgtgcaaaggcacaaaggcctgaaagtatggtgataagggaaaggagtaagtcatttttgtgataggatgtactttctgtgttatgtgtgttgggggtaggaaataagactggaaaagtcactctgaagattactgtaggccaactgaggagttactttcagatttcatctaatctaagacacttattaattgggacatatcacttattgtatatattaagaaaaaatgtgacaggccggcaggggggtaatcctgatttaccacttagaggtgaggtggggacccttagctcaaaatgggcaaccggta

SEQ ID NO: 295837 - DNA, 1144 bp, Homo sapiens
  misc_feature (32)..(32): n is a, c, g, or t
ctagaggatcccccgctctcatagcggggaangggtgggctttgcgaagatggcggcgctgggggtgctggagtccgacctgccaagtgccgtgacacttctgaaaaatctccaggagcaagtgatggctgtaactgcacaagtgaaatcactgacacaaaaagttcaagctggtgcctatcctacagaaaagggtctcagcttcttggaagtgaaagaccagctgctgctcatgtaccttatggatttgacccacctcattctggacaaagcctcaggaggatctcttcagggacatgatgcagttttgagactggtagagattcgaacggttttggaaaagcttcgtcccttggaccaaaagctgaagtatcaaattgacaagctgatcaagactgcagtgacaggcagccttagtgagaatgacccacttcgttttaagcctcatcccagcaatatgatgagcaagttgagctctgaggatgaggaggaagatgaagcagaagatgaccagtctgaggcttcagggaagaaatctgtgaagggagtgtctaagaaatatgttcctccacgcttggttccagtacattatgatgaaacagaagctgagcgggagaagaagcgtctagaacgagccaagagacgggcattgagcagctctgtcattcgtgaacttaaggagcagtactcagatgctccagaggaaatccgtgatgctcggcatccccatgttacccgccagagtcaggaggaccaacacaggattaactatgaggagagcatgatggtgcgtttgagcgtcagtaagcgagagaaaggacggcgaaaacgagcaaatgtcatgagctcacaacttcattcccttacacacttcagtgacatcagtgctttgacagggggaactgttcatcttgatgaggatcagaatcctattaagaagcggaagaagatacctcagaaaggtcggaagaaaaaaggttttcggaggcggcggtgattatgggtgtacatatttgtatattttttgtcatcctgagatacttctaatttcattgtatataggtggttttccctggaattcattaattgtttgctttggacatgtggaaagagccttactaataaaattgattttacttatgaa

SEQ ID NO: 295838 - DNA, 1775 bp, Homo sapiens
  misc_feature (32)..(32): n is a, c, g, or t
ctagaggatcccccgctctcatagcggggaangggtgggctttgcgaagatggcggcgctgggggtgctggagtccgacctgccaagtgccgtgacacttctgaaaaatctccaggagcaagtgatggctgtaactgcacaagtgaaatcactgacacaaaaagttcaagctggtgcctatcctacagaaaagggtctcagcttcttggaagtgaaagaccagctgctgctcatgtaccttatggatttgacccacctcattctggacaaagcctcaggaggatctcttcagggacatgatgcagttttgagactggtagagattcgaacggttttggaaaagcttcgtcccttggaccaaaagctgaagtatcaaattgacaagctgatcaagactgcagtgacaggcagccttagtgagaatgacccacttcgttttaagcctcatcccagcaatatgatgagcaagttgagctctgaggatgaggaggaagatgaagcagaagatgaccagtctgaggcttcagggaagaaatctgtgaagggagtgtctaagaaatatgttcctccacgcttggttccagtacattatgatgaaacagaagctgagcgggagaagaagcgtctagaacgagccaagagacgggcattgagcagctctgtcattcgtgaacttaaggagcagtactcagatgctccagaggaaatccgtgatgctcggcatccccatgttacccgccagagtcaggaggaccaacacaggattaactatgaggagagcatgatggtgcgtttgagcgtcagtaagcgagagaaaggacggcgaaaacgagcaaatgtcatgagctcacaacttcattcccttacacacttcagtgacatcagtgctttgacagggggaactgttcatcttgatgaggatcagaatcctattaagaagcggaagaagatacctcagaaaggtcggaagaaaaaaggttttcggaggcggcggtgattatgggtgtacatatttgtatattttttgtcatcctgagatacttctaatttcattgtatataggtggttttccctggaattcattaattgtttgctttggacatgtggaaagagccttactaataaaattgattttacttatgaattaaagcccctttttgcacatgtattgtacgactggagtcgttgggtttgggatatttttggtgagtggttggtgaaaagggaaattttttttggaagtgcaaaacatttgtattgttttctttgataatatatttttcccaaaaactaaaaattggttacgtcacaaaaagtattgagagacgaggctggtataatcaactctttcaacccatgttgccacaacttcctgtatgatttgttataatacaatacagattgagatattaacacatgaattttaggttttattagtgttatctgggctggccaccaggtggcataagtggttcaagaaacttgagcttggctgtaatcaaaagcaagatagaacctttccacatcagcaagattattcttatctccacttctctgaatgtttttcatttctttctgaaatagcatgaacataaggctgatctttggtcagttactgagggagtttgtagaaaatagtagagtgagtaagaaggctagagtgaagagtcagtatagtcttgtgtttttcagactctgacccccacccccccgccttcaactgagggtcattttaccagagtcaataaaggccaacccttctataaagagctggc

SEQ ID NO: 295839 - DNA, 1590 bp, Homo sapiens
  misc_feature (32)..(32): n is a, c, g, or t
ctagaggatcccccgctctcatagcggggaangggtgggctttgcgaagatggcggcgctgggggtgctggagtccgacctgccaagtgccgtgacacttctgaaaaatctccaggagcaagtgatggctgtaactgcacaagtgaaatcactgacacaaaaagttcaagctggtgcctatcctacagaaaagggtctcagcttcttggaagtgaaagaccagctgctgctcatgtaccttatggatttgacccacctcattctggacaaagcctcaggaggatctcttcagggacatgatgcagttttgagactggtagagattcgaacggttttggaaaagcttcgtcccttggaccaaaagctgaagtatcaaattgacaagctgatcaagactgcagtgacaggcagccttagtgagaatgacccacttcgttttaagcctcatcccagcaatatgatgagcaagttgagctctgaggatgaggaggaagatgaagcagaagatgaccagtctgaggcttcagggaagaaatctgtgaagggagtgtctaagaaatatgttcctccacgcttggttccagtacattatgatgaaacagaagctgagcgggagaagaagcgtctagaacgagccaagagacgggcattgagcagctctgtcattcgtgaacttaaggagcagtactcagatgctccagaggaaatccgtgatgctcggcatccccatgttacccgccagagtcaggaggaccaacacaggattaactatgaggagagcatgatggtgcgtttgagcgtcagtaagcgagagaaaggacggcgaaaacgagcaaatgtcatgagctcacaacttcattcccttacacacttcagtgacatcagtgctttgacagggggaactgttcatcttgatgaggatcagaatcctattaagaagcggaagaagatacctcagaaaggtcggaagaaaaaaggtcagtgaactgctgggacttaggtgatcaggtgcaaggtggggagtacaaattgagtctctttggatttgccattctgggtctcaccaagccctgtagtatctcttccatactgggcaataatctccttaggtgggcttttattttttgctttcctgagctggaaatcagcatcattcacaaaatgaatctctggattctgcctctaaggtcccacagctcctgttcaggcttccctaaatagaactggtaaagtgtcacttgaaggaaccattatcccatttcaattttattcctacttctcgtcttttgtcctgggaagatattcagggtactgcctaggagaccccacccctgtgagcccttccctctagatgtcctgttttcctgtccctttagcttttccaactgtcctttgcctcattcttggtttcccttcctttcaggttttcggaggcggcggtgattatgggtgtacatatttgtatattttttgtcatcctgagatacttctaatttcattgtatataggtggttttccctggaattcattaattgtttgctttggacatgtggaaagagccttactaataaaattgattttacttatgaa

SEQ ID NO: 295840 - DNA, 1736 bp, Homo sapiens
  misc_feature (32)..(32): n is a, c, g, or t
ctagaggatcccccgctctcatagcggggaangggtgggctttgcgaagatggcggcgctgggggtgctggagtccgacctgccaagtgccgtgacacttctgaaaaatctccaggagcaagtgatggctgtaactgcacaagtgaaatcactgacacaaaaagttcaagctggtgcctatcctacagaaaagggtctcagcttcttggaagtgaaagaccagctgctgctcatgtaccttatggatttgacccacctcattctggacaaagcctcaggaggatctcttcagggacatgatgcagttttgagactggtagagattcgaacggttttggaaaagcttcgtcccttggaccaaaagctgaagtatcaaattgacaagctgatcaagactgcagtgacaggcagccttagtgagaatgacccacttcgttttaagcctcatcccagcaatatgatgagcaagttgagctctgaggatgaggaggaagatgaagcagaagatgaccagtctgaggcttcagggaagaaatctgtgaagggagtgtctaagaaatatgttcctccacgcttggttccagtacattatgatgaaacagaagctgagcgggagaagaagcgtctagaacgagccaagagacgggcattgagcagctctgtcattcgtgaacttaaggagcagtactcagatgctccagaggaaatccgtgatgctcggcatccccatgttacccgccagagtcaggaggaccaacacaggattaactatgaggagagcatgatggtgcgtttgagcgtcagtaagcgagagaaaggacggcgaaaacgagcaaatgtcatgagctcacaacttcattcccttacacacttcagtgacatcagtgctttgacagggggaactgttcatcttgatgaggtgaggttgagatatggttgtagtaggatgtgactttcatgctttcagcaaaatgtatgtggggcttattaccatgaggaacttgggaagggatgctggctctcagaaccacagtgccattccatcacttctccatctgtctccaggatcagaatcctattaagaagcggaagaagatacctcagaaaggtcggaagaaaaaaggtcagtgaactgctgggacttaggtgatcaggtgcaaggtggggagtacaaattgagtctctttggatttgccattctgggtctcaccaagccctgtagtatctcttccatactgggcaataatctccttaggtgggcttttattttttgctttcctgagctggaaatcagcatcattcacaaaatgaatctctggattctgcctctaaggtcccacagctcctgttcaggcttccctaaatagaactggtaaagtgtcacttgaaggaaccattatcccatttcaattttattcctacttctcgtcttttgtcctgggaagatattcagggtactgcctaggagaccccacccctgtgagcccttccctctagatgtcctgttttcctgtccctttagcttttccaactgtcctttgcctcattcttggtttcccttcctttcaggttttcggaggcggcggtgattatgggtgtacatatttgtatattttttgtcatcctgagatacttctaatttcattgtatataggtggttttccctggaattcattaattgtttgctttggacatgtggaaagagccttactaataaaattgattttacttatgaa

SEQ ID NO: 295841 - DNA, 1029 bp, Homo sapiens
  misc_feature (32)..(32): n is a, c, g, or t
ctagaggatcccccgctctcatagcggggaangggtgggctttgcgaagatggcggcgctgggggtgctggagtccgacctgccaagtgccgtgacacttctgaaaaatctccaggagcaagtgatggctgtaactgcacaagtgaaatcactgacacaaaaagttcaagctggtgcctatcctacagaaaagggtctcagcttcttggaagtgaaagaccagctgctgctcatgtaccttatggatttgacccacctcattctggacaaagcctcaggaggatctcttcagggacatgatgcagttttgagactggtagagattcgaacggttttggaaaagcttcgtcccttggaccaaaagctgaagtatcaaattgacaagctgatcaagactgcagtgacaggcagccttagtgagaatgacccacttcgttttaagcctcatcccagcaatatgatgagcaagttgagctctgaggatgaggaggaagatgaagcagaagatgaccagtctgaggcttcagggaagaaatctgtgaagggagtgtctaagaaatatgttcctccacgcttggttccagtacattatgatgaaacagaagctgagcgggagaagaagcgtctagaacgagccaagagacgggcattgagcagctctgtcattcgtgaacttaaggagcagtactcagatgctccagaggaaatccgtgatgctcggcatccccatgttacccgccagagtcaggaggaccaacacaggattaactatgaggagagcatgatggtgcgtttgagcgtcagtaagcgagagaaaggacggcgaaaacgagcaaatgtcatgagctcacaacttcattcccttacacacttcagtgacatcagtgctttgacagggggaactgttcatcttgatgaggatcagaatcctattaagaagcggaagaagatacctcagaaaggtcggaagaaaaaaggttttcggaggcggcggtgattatgggtgtacctcggccgcgaccacgctaa

SEQ ID NO: 295842 - DNA, 1623 bp, Homo sapiens
  misc_feature (32)..(32): n is a, c, g, or t
ctagaggatcccccgctctcatagcggggaangggtgggctttgcgaagatggcggcgctgggggtgctggagtccgacctgccaagtgccgtgacacttctgaaaaatctccaggagcaagtgatggctgtaactgcacaagtgaaatcactgacacaaaaagttcaagctggtgcctatcctacagaaaagggtctcagcttcttggaagtgaaagaccagctgctgctcatgtaccttatggatttgacccacctcattctggacaaagcctcaggaggatctcttcagggacatgatgcagttttgagactggtagagattcgaacggttttggaaaagcttcgtcccttggaccaaaagctgaagtatcaaattgacaagctgatcaagactgcagtgacaggcagccttagtgagaatgacccacttcgttttaagcctcatcccagcaatatgatgagcaagttgagctctgaggatgaggaggaagatgaagcagaagatgaccagtctgaggcttcagggaagaaatctgtgaagggagtgtctaagaaatatgttcctccacgcttggttccagtacattatgatgaaacagaagctgagcgggagaagaagcgtctagaacgagccaagagacgggcattgagcagctctgtcattcgtgaacttaaggagcagtactcagatgctccagaggaaatccgtgatgctcggcatccccatgttacccgccagagtcaggaggaccaacacaggattaactatgaggagagcatgatggtgcgtttgagcgtcagtaagcgagagaaaggacggcgaaaacgagcaaatgtcatgagctcacaacttcattcccttacacacttcagtgacatcagtgctttgacagggggaactgttcatcttgatgaggtgaggttgagatatggttgtagtaggatgtgactttcatgctttcagcaaaatgtatgtggggcttattaccatgaggaacttgggaagggatgctggctctcagaaccacagtgccattccatcacttctccatctgtctccaggatcagaatcctattaagaagcggaagaagatacctcagaaaggtcggaagaaaaaaggttttcggaggcggcggtgattatgggtgtacatatttgtatattttttgtcatcctgagatacttctaatttcattgtatataggtggttttccctggaattcattaattgtttgctttggacatgtggaaagagccttactaataaaattgattttacttatgaaaaaaaaaaaaagaacaaaaaaaaaaaaacactcccccgcgggactgccgcccagcaagaagcgggagtacatccaaggggggggccgcgacaaccaaactattggtgcgcaccatcagaaggggccgacctacacaagcgcgcgtggagaatacacttgggccagaagccaggtgtgctttgcggtggaagaacatgatagtcgtcaggcgccgacgaatatcctcgcacacaactacatatgcagaagcgaatgcgtcggtcaccgacgaccggcaacacatgcagccactgcagcaaacacgaagaccagcagagccacagcatgcggaac

SEQ ID NO: 295843 - DNA, 1510 bp, Homo sapiens
gaaaataatgccaatgctttttccaggtagtattgaggagctgggctgagtgcttgttgtttgtttttaagtactatttgtccaaatgcacacatctgtgggactgctgcaattttgaaagaaaaatgacagctgtgtaaaaccagtgcataggaaaaaagaagtgtcaacaatttggctgccaggcacaccgcgcccctgcagcaatctggtggggcaggggaggacactcggagtaggtagaaaactaaccaggctgaacggccccttcaggggttggtgagctgtccaaatcaatgtctgaaaaggcatagccaactctggcattttccaggttggtcctgatctcgaaaggtggtagtctgtaggtgggatgtggtgagtggatgtgaagtggcagcatagttctctgaagatggcggcgctgggggtgctggagtccgacctgccaagtgccgtgacacttctgaaaaatctccaggagcaagtgatggctgtaactgcacaagtgaaatcactgacacaaaaagttcaagctggtgcctatcctacagaaaagggtctcagcttcttggaagtgaaagaccagctgctgctcatgtaccttatggatttgacccacctcattctggacaaagcctcaggaggatctcttcagggacatgatgcagttttgagactggtagagattcgaacggttttggaaaagcttcgtcccttggaccaaaagctgaagtatcaaattgacaagctgatcaagactgcagtgacaggcagccttagtgagaatgacccacttcgttttaagcctcatcccagcaatatgatgagcaagttgagctctgaggatgaggaggaagatgaagcagaagatgaccagtctgaggcttcagggaagaaatctgtgaagggagtgtctaagaaatatgttcctccacgcttggttccagtacattatgatgaaacagaagctgagcgggagaagaagcgtctagaacgagccaagagacgggcattgagcagctctgtcattcgtgaacttaaggagcagtactcagatgctccagaggaaatccgtgatgctcggcatccccatgttacccgccagagtcaggaggaccaacacaggattaactatgaggagagcatgatggtgcgtttgagcgtcagtaagcgagagaaaggacggcgaaaacgagcaaatgtcatgagctcacaacttcattcccttacacacttcagtgacatcagtgctttgacagggggaactgttcatcttgatgaggatcagaatcctattaagaagcggaagaagatacctcagaaaggtcggaagaaaaaaggttttcggaggcggcggtgattatgggtgtacatatttgtatattttttgtcatcctgagatacttctaatttcattgtatataggtggttttccctggaattcattaattgtttgctttggacatgtggaaagagccttactaataaaattgattttacttatgaa

SEQ ID NO: 295844 - DNA, 1597 bp, Homo sapiens
atttagccagttcctttattccattggccagatcagactcctcctctcgtttatcctgttgggggcggaagtgagaaagcccttattcgtattggcttagatttgcaagcggcagttgtctatcaaatctatcaagtcgcccttagcgctcaggaagtacgacaccggaaggggtgggctttgcgaagatggcggcgctggtgagtttggtgtggtttcttcctcgcgtagctattgtggagttgtcctttgccttcagcggctggaggcaaactgttggtaccagggaagggtggtgatgaaagttgcttcagggaggcggcctccctagagttaccgttcctgtccggtaacccaaggggctggctttaaggcgagtctgtgaacccgagtgtgaaggccccgagtctgggtgtctgacggagagagggcagtttcccaccctagacgttccactttcctataatcctgaggaaagaatgacttttctttacgcctcctctcccttctgtagggggtgctggagtccgacctgccaagtgccgtgacacttctgaaaaatctccaggagcaagtgatggctgtaactgcacaagtgaaatcactgacacaaaaagttcaagctggtgcctatcctacagaaaagggtctcagcttcttggaagtgaaagaccagctgctgctcatgtaccttatggatttgacccacctcattctggacaaagcctcaggaggatctcttcagggacatgatgcagttttgagactggtagagattcgaacggttttggaaaagcttcgtcccttggaccaaaagctgaagtatcaaattgacaagctgatcaagactgcagtgacaggcagccttagtgagaatgacccacttcgttttaagcctcatcccagcaatatgatgagcaagttgagctctgaggatgaggaggaagatgaagcagaagatgaccagtctgaggcttcagggaagaaatctgtgaagggagtgtctaagaaatatgttcctccacgcttggttccagtacattatgatgaaacagaagctgagcgggagaagaagcgtctagaacgagccaagagacgggcattgagcagctctgtcattcgtgaacttaaggagcagtactcagatgctccagaggaaatccgtgatgctcggcatccccatgttacccgccagagtcaggaggaccaacacaggattaactatgaggagagcatgatggtgcgtttgagcgtcagtaagcgagagaaaggacggcgaaaacgagcaaatgtcatgagctcacaacttcattcccttacacacttcagtgacatcagtgctttgacagggggaactgttcatcttgatgaggatcagaatcctattaagaagcggaagaagatacctcagaaaggtcggaagaaaaaaggttttcggaggcggcggtgattatgggtgtacatatttgtatattttttgtcatcctgagatacttctaatttcattgtatataggtggttttccctggaattcattaattgtttgctttggacatgtggaaagagccttactaataaaattgattttacttatgaa

SEQ ID NO: 295845 - DNA, 972 bp, Homo sapiens
tttctgttttgttcaactcagggtctcagcttcttggaagtgaaagaccagctgctgctcatgtaccttatggatttgacccacctcattctggacaaagcctcaggaggatctcttcagggacatgatgcagttttgagactggtagagattcgaacggttttggaaaagcttcgtcccttggaccaaaagctgaagtatcaaattgacaagctgatcaagactgcagtgacaggcagccttagtgagaatgacccacttcgttttaagcctcatcccagcaatatgatgagcaagttgagctctgaggatgaggaggaagatgaagcagaagatgaccagtctgaggcttcagggaagaaatctgtgaagggagtgtctaagaaatatgttcctccacgcttggttccagtacattatgatgaaacagaagctgagcgggagaagaagcgtctagaacgagccaagagacgggcattgagcagctctgtcattcgtgaacttaaggagcagtactcagatgctccagaggaaatccgtgatgctcggcatccccatgttacccgccagagtcaggaggaccaacacaggattaactatgaggagagcatgatggtgcgtttgagcgtcagtaagcgagagaaaggacggcgaaaacgagcaaatgtcatgagctcacaacttcattcccttacacacttcagtgacatcagtgctttgacagggggaactgttcatcttgatgaggatcagaatcctattaagaagcggaagaagatacctcagaaaggtcggaagaaaaaaggttttcggaggcggcggtgattatgggtgtacatatttgtatattttttgtcatcctgagatacttctaatttcattgtatataggtggttttccctggaattcattaattgtttgctttggacatgtggaaagagccttactaataaaattgattttacttatgaa

SEQ ID NO: 295846 - DNA, 983 bp, Homo sapiens
gctcatgtaccttatggatttgagcagcagctggtctttcacttccaagaagctgagaccagctgctgctcatgtaccttatggatttgacccacctcattctggacaaagcctcaggaggatctcttcagggacatgatgcagttttgagactggtagagattcgaacggttttggaaaagcttcgtcccttggaccaaaagctgaagtatcaaattgacaagctgatcaagactgcagtgacaggcagccttagtgagaatgacccacttcgttttaagcctcatcccagcaatatgatgagcaagttgagctctgaggatgaggaggaagatgaagcagaagatgaccagtctgaggcttcagggaagaaatctgtgaagggagtgtctaagaaatatgttcctccacgcttggttccagtacattatgatgaaacagaagctgagcgggagaagaagcgtctagaacgagccaagagacgggcattgagcagctctgtcattcgtgaacttaaggagcagtactcagatgctccagaggaaatccgtgatgctcggcatccccatgttacccgccagagtcaggaggaccaacacaggattaactatgaggagagcatgatggtgcgtttgagcgtcagtaagcgagagaaaggacggcgaaaacgagcaaatgtcatgagctcacaacttcattcccttacacacttcagtgacatcagtgctttgacagggggaactgttcatcttgatgaggatcagaatcctattaagaagcggaagaagatacctcagaaaggtcggaagaaaaaaggttttcggaggcggcggtgattatgggtgtacatatttgtatattttttgtcatcctgagatacttctaatttcattgtatataggtggttttccctggaattcattaattgtttgctttggacatgtggaaagagccttactaataaaattgattttacttatgaa

SEQ ID NO: 295847 - DNA, 1139 bp, Homo sapiens
tcggaataccgaggatgcccagaagtgcccgcttgacacattctgcaaccgatcgtccagcggagcataggttgatgccactcgataacctccggagcgaaggtagaccaggttcagcttgacagcaagacacaggttcccaaactgagctgactctaatcgctacacgatagaagcggtctacgagcctgtactatgcgcaagctagaaaggaccagctgctgctcatgtaccttatggatttgacccacctcattctggacaaagcctcaggaggatctcttcagggacatgatgcagttttgagactggtagagattcgaacggttttggaaaagcttcgtcccttggaccaaaagctgaagtatcaaattgacaagctgatcaagactgcagtgacaggcagccttagtgagaatgacccacttcgttttaagcctcatcccagcaatatgatgagcaagttgagctctgaggatgaggaggaagatgaagcagaagatgaccagtctgaggcttcagggaagaaatctgtgaagggagtgtctaagaaatatgttcctccacgcttggttccagtacattatgatgaaacagaagctgagcgggagaagaagcgtctagaacgagccaagagacgggcattgagcagctctgtcattcgtgaacttaaggagcagtactcagatgctccagaggaaatccgtgatgctcggcatccccatgttacccgccagagtcaggaggaccaacacaggattaactatgaggagagcatgatggtgcgtttgagcgtcagtaagcgagagaaaggacggcgaaaacgagcaaatgtcatgagctcacaacttcattcccttacacacttcagtgacatcagtgctttgacagggggaactgttcatcttgatgaggatcagaatcctattaagaagcggaagaagatacctcagaaaggtcggaagaaaaaaggttttcggaggcggcggtgattatgggtgtacatatttgtatattttttgtcatcctgagatacttctaatttcattgtatataggtggttttccctggaattcattaattgtttgctttggacatgtggaaagagccttactaataaaattgattttacttatgaa

SEQ ID NO: 295848 - DNA, 1532 bp, Homo sapiens
atttagccagttcctttattccattggccagatcagactcctcctctcgtttatcctgttgggggcggaagtgagaaagcccttattcgtattggcttagatttgcaagcggcagttgtctatcaaatctatcaagtcgcccttagcgctcaggaagtacgacaccggaaggggtgggctttgcgaagatggcggcgctgggggtgctggagtccgacctgccaagtgccgtgacacttctgaaaaatctccaggagcaagtgatggctgtaactgcacaagtgaaatcactgacacaaaaagttcaagctggtgcctatcctacagaaaagggtctcagcttcttggaagtgaaagaccagctgctgctcatgtaccttatggatttgacccacctcattctggacaaagcctcaggaggatctcttcagggacatgatgcagttttgagactggtagagattcgaacggtatgaagcatttggcttcttggagttttaggtttctaaattttgagctccaagggtatcacacagtagctctcatttaagtgagtcttctcatgtttaaggaaaccaaatgagaaaaggtatttttctattcatttgctctactttgtacatattttaggtgccttatgtggcaccttaatatagggactctggtgtgtgcttcattttgggaaggaaatataatcctgattaactaccatgttgtaggttttggaaaagcttcgtcccttggaccaaaagctgaagtatcaaattgacaagctgatcaagactgcagtgacaggcagccttagtgagaatgacccacttcgttttaagcctcatcccagcaatatgatgagcaagttgagctctgaggatgaggaggaagatgaagcagaagatgaccagtctgaggcttcagggaagaaatctgtgaagggagtgtctaagaaatatgttcctccacgcttggttccagtacattatgatgaaacagaagctgagcgggagaagaagcgtctagaacgagccaagagacgggcattgagcagctctgtcattcgtgaacttaaggagcagtactcagatgctccagaggaaatccgtgatgctcggcatccccatgttacccgccagagtcaggaggaccaacacaggattaactatgaggagagcatgatggtgcgtttgagcgtcagtaagcgagagaaaggacggcgaaaacgagcaaatgtcatgagctcacaacttcattcccttacacacttcagtgacatcagtgctttgacagggggaactgttcatcttgatgaggatcagaatcctattaagaagcggaagaagatacctcagaaaggtcggaagaaaaaaggttttcggaggcggcggtgattatgggtgtacatatttgtatattttttgtcatcctgagatacttctaatttcattgtatataggtggttttccctggaattcattaattgtttgctttggacatgtggaaagagccttactaataaaattgattttacttatgaa

SEQ ID NO: 295849 - DNA, 1760 bp, Homo sapiens
gaaaataatgccaatgctttttccaggtagtattgaggagctgggctgagtgcttgttgtttgtttttaagtactatttgtccaaatgcacacatctgtgggactgctgcaattttgaaagaaaaatgacagctgtgtaaaaccagtgcataggaaaaaagaagtgtcaacaatttggctgccaggcacaccgcgcccctgcagcaatctggtggggcaggggaggacactcggagtaggtagaaaactaaccaggctgaacggccccttcaggggttggtgagctgtccaaatcaatgtctgaaaaggcatagccaactctggcattttccaggttggtcctgatctcgaaaggtggtagtctgtaggtgggatgtggtgagtggatgtgaagtggcagcatagttctctgaagatggcggcgctgggggtgctggagtccgacctgccaagtgccgtgacacttctgaaaaatctccaggagcaagtgatggctgtaactgcacaagtgaaatcactgacacaaaaagttcaagctggtgcctatcctacagaaaagggtctcagcttcttggaagtgaaagaccagctgctgctcatgtaccttatggatttgacccacctcattctggacaaagcctcaggaggatctcttcagggacatgatgcagttttgagactggtagagattcgaacggttttggaaaagcttcgtcccttggaccaaaagctgaagtatcaaattgacaagctgatcaagactgcagtgacaggcagccttagtgagaatgacccacttcgttttaagcctcatcccagcaatatgatgagcaaggtaaggggttgtagtattctcctgatttttttctgaggcagctatacctagatgagcctcttggtgatcctggataccctgggattctcttaggacttgattttccaacttgtgtgttagaatgctgagtttgagattcccttttttccctttttatattcccaccaccccagggtactccagctttgggttttcttctcacttatctcatgaatgcttcctaaatttgcagacattgtttcttttgtagttgagctctgaggatgaggaggaagatgaagcagaagatgaccagtctgaggcttcagggaagaaatctgtgaagggagtgtctaagaaatatgttcctccacgcttggttccagtacattatgatgaaacagaagctgagcgggagaagaagcgtctagaacgagccaagagacgggcattgagcagctctgtcattcgtgaacttaaggagcagtactcagatgctccagaggaaatccgtgatgctcggcatccccatgttacccgccagagtcaggaggaccaacacaggattaactatgaggagagcatgatggtgcgtttgagcgtcagtaagcgagagaaaggacggcgaaaacgagcaaatgtcatgagctcacaacttcattcccttacacacttcagtgacatcagtgctttgacagggggaactgttcatcttgatgaggatcagaatcctattaagaagcggaagaagatacctcagaaaggtcggaagaaaaaaggttttcggaggcggcggtgattatgggtgtacatatttgtatattttttgtcatcctgagatacttctaatttcattgtatataggtggttttccctggaattcattaattgtttgctttggacatgtggaaagagccttactaataaaattgattttacttatgaa

SEQ ID NO: 295850 - DNA, 1792 bp, Homo sapiens
atttagccagttcctttattccattggccagatcagactcctcctctcgtttatcctgttgggggcggaagtgagaaagcccttattcgtattggcttagatttgcaagcggcagttgtctatcaaatctatcaagtcgcccttagcgctcaggaagtacgacaccggaaggggtgggctttgcgaagatggcggcgctggtgagtttggtgtggtttcttcctcgcgtagctattgtggagttgtcctttgccttcagcggctggaggcaaactgttggtaccagggaagggtggtgatgaaagttgcttcagggaggcggcctccctagagttaccgttcctgtccggtaacccaaggggctggctttaaggcgagtctgtgaacccgagtgtgaaggccccgagtctgggtgtctgacggagagagggcagtttcccaccctagacgttccactttcctataatcctgaggaaagaatgacttttctttacgcctcctctcccttctgtagggggtgctggagtccgacctgccaagtgccgtgacacttctgaaaaatctccaggagcaagtgatggctgtaactgcacaagtgaaatcactgacacaaaaagttcaagctggtgcctatcctacagaaaagggtctcagcttcttggaagtgaaagaccagctgctgctcatgtaccttatggatttgacccacctcattctggacaaagcctcaggaggatctcttcagggacatgatgcagttttgagactggtagagattcgaacggtatgaagcatttggcttcttggagttttaggtttctaaattttgagctccaagggtatcacacagtagctctcatttaagtgagtcttctcatgtttaaggaaaccaaatgagaaaaggtatttttctattcatttgctctactttgtacatattttaggtgccttatgtggcaccttaatatagggactctggtgtgtgcttcattttgggaaggaaatataatcctgattaactaccatgttgtaggttttggaaaagcttcgtcccttggaccaaagtgagaatgacccacttcgttttaagcctcatcccagcaatatgatgagcaagttgagctctgaggatgaggaggaagatgaagcagaagatgaccagtctgaggcttcagggaagaaatctgtgaagggagtgtctaagaaatatgttcctccacgcttggttccagtacattatgatgaaacagaagctgagcgggagaagaagcgtctagaacgagccaagagacgggcattgagcagctctgtcattcgtgaacttaaggagcagtactcagatgctccagaggaaatccgtgatgctcggcatccccatgttacccgccagagtcaggaggaccaacacaggattaactatgaggagagcatgatggtgcgtttgagcgtcagtaagcgagagaaaggacggcgaaaacgagcaaatgtcatgagctcacaacttcattcccttacacacttcagtgacatcagtgctttgacagggggaactgttcatcttgatgaggatcagaatcctattaagaagcggaagaagatacctcagaaaggtcggaagaaaaaaggttttcggaggcggcggtgattatgggtgtacatatttgtatattttttgtcatcctgagatacttctaatttcattgtatataggtggttttccctggaattcattaattgtttgctttggacatgtggaaagagccttactaataaaattgattttacttatgaa

SEQ ID NO: 295851 - DNA, 1512 bp, Homo sapiens
atttagccagttcctttattccattggccagatcagactcctcctctcgtttatcctgttgggggcggaagtgagaaagcccttattcgtattggcttagatttgcaagcggcagttgtctatcaaatctatcaagtcgcccttagcgctcaggaagtacgacaccggaaggggtgggctttgcgaagatggcggcgctggtgagtttggtgtggtttcttcctcgcgtagctattgtggagttgtcctttgccttcagcggctggaggcaaactgttggtaccagggaagggtggtgatgaaagttgcttcagggaggcggcctccctagagttaccgttcctgtccggtaacccaaggggctggctttaaggcgagtctgtgaacccgagtgtgaaggccccgagtctgggtgtctgacggagagagggcagtttcccaccctagacgttccactttcctataatcctgaggaaagaatgacttttctttacgcctcctctcccttctgtagggggtgctggagtccgacctgccaagtgccgtgacacttctgaaaaatctccaggagcaagtgatggctgtaactgcacaagtgaaatcactgacacaaaaagttcaagctggtgcctatcctacagaaaaggtaagatgtactcaaacagtaagcatcccctgacttaatgttctcagtagttctttcattgtatgtttattgtgtcttatatatcctaagtgctcgagcttcaaacataaatatgatccagtttctgtgctgaagtctagagggaagacaaagcaaagcaatagatgtaagtattaatagtagcagtcacattacagagttatgagtctccagccaaagagagggattaattaactgccagaagagcagagggattcaggacaggcttcccagaggaggtgataggattttgaggaataaatgggagggacagaaagaaggaacatgtgcaaaggcacaaaggcctgaaagtatggtgataagggaaaggagtaagtcatttttgtgataggatgtactttctgtgttatgtgtgttgggggtaggaaataagactggaaaagtcactctgaagattactgtaggccaactgaggagttactttcagatttcatctaatctaagacacttattaattgggacatatcacttattgtatatattaagaaaaaatgtgacaggccgggcatggtggctcatgcctgtaattccagcacttcaggaggctgaggctggaggatcgcttgagctcaggagttcgggaccaacctgggtaacatagtgagaccctacaaaagttaaaaattagccgggcatgatggcatgtgcctgtagtcctagccactcaggaggctgaggccagaggattgcttaagcctgggaggttgaggctgcagtaagctgtgattgtgccactgcattcagcctgggtgacagagcaagaccctgtctcaaaaaaaaaaaaaaaattgcttatgacataatac

SEQ ID NO: 295852 - DNA, 890 bp, Homo sapiens
cctcataaacaccatcatccttcatttcagtaagtagtcggcatcacctaagaagcggaagaagatacctcagaaaggtcggaagaaaaaaggttttcggaggcggcggtgattatgggtgtacatatttgtatattttttgtcatcctgagatacttctaatttcattgtatataggtggttttccctggaattcattaattgtttgctttggacatgtggaaagagccttactaataaaattgattttacttatgaattaaagcccctttttgcacatgtattgtacgactggagtcgttgggtttgggatatttttggtgagtggttggtgaaaagggaaattttttttggaagtgcaaaacatttgtattgttttctttgataatatatttttcccaaaaactaaaaattggttacgtcacaaaaagtattgagagacgaggctggtataatcaactctttcaacccatgttgccacaacttcctgtatgatttgttataatacaatacagattgagatattaacacatgaattttaggttttattagtgttatctgggctggccaccaggtggcataagtggttcaagaaacttgagcttggctgtaatcaaaagcaagatagaacctttccacatcagcaagattattcttatctccacttctctgaatgtttttcatttctttctgaaatagcatgaacataaggctgatctttggtcagttactgagggagtttgtagaaaatagtagagtgagtaagaaggctagagtgaagagtcagtatagtcttgtgtttttcagactctgacccccacccccccgccttcaactgagggtcattttaccagagtcaataaaggccaacccttctataaagagctggc

SEQ ID NO: 295853 - DNA, 2312 bp, Homo sapiens
atcattgggtttcgagctcacttctgtggaaaagagtttaagggagtggtctagactttccagggaagttattgcctggctgtgtccctctagtcctaattttatacttaactttcccccacctccttcagcctcatctgtttcaatggtgcaactcttttcatccccttttggttaccagtcaccttcaggccattcagaggaggaaagagaggggaatatgaagtcagccaagccccaagtgaaccacagtcagcatggggaaagccagcgggccttgagccccctgcagtctactctgagttctgctgcatctccttcccaagcgtatgagacctatattgaaaatggactcatatgccttaaacacaaaattagaaacatcgagaaaaagaagctcaaactggaggattataaggatcgcctgaaaagtggagagcatcttaatccagaccagttggaagctgtagagaaatatgaagaagtgctacataatttggaatttgccaaggagcttcaaaaaaccttttctgggttgagcctagatctactaaaagcgcaaaagaaggcccagagaagggagcacatgctaaaacttgaggctgagaagaaaaagcttcgaactatacttcaagttcagtatgtattgcagaacttgacacaggagcacgtacaaaaagacttcaaagggggtttgaatggtgcagtgtatttgccttcaaaagaacttgactacctcattaagttttcaaaactgacctgccctgaaagaaatgaaagtctgagacaaacacttgaaggatctactgtctaaattgctgaactcaggctattttgaaagtatcccagttcccaaaaatgccaaggaaaaggaagtaccactggaggaagaaatgctaatacaatcagagaaaaaaacacaattatcgaagactgaatctgtcaaagagtcagagtctctaatggaatttgcccagccagagatacaaccacaagagtttcttaacagacgctatatgacagaagtagattattcaaacaaacaaggcgaagagcaaccttgggaagcagattatgctagaaaaccaaatctcccaaaacgttgggatatgcttactgaaccagatggtcaagagaagaaacaggagtcctttaagtcctgggaggcttctggtaagcaccaggaggtatccaagcctgcagtttccttagaacagaggaaacaagacacctcaaaactcaggtctactctgccggaagagcagaagaagcaggagatctccaaatccaagccatctcctagccagtggaagcaagatacacctaaatccaaagcagggtatgttcaagaggaacaaaagaaacaggagacaccaaagctgtggccagttcagctgcagaaagaacaagatccaaagaagcaaactccaaagtcttggacaccttccatgcagagcgaacagaacaccaccaagtcatggaccactcccatgtgtgaagaacaggattcaaaacagccagagactccaaaatcctgggaaaacaatgttgagagtcaaaaacactctttaacatcacagtcacagatttctccaaagtcctggggagtagctacagcaagcctcataccaaatgaccagctgctgcccaggaagttgaacacagaacccaaagatgtgcctaagcctgtgcatcagcctgtaggttcttcctctacccttccgaaggatccagtattgaggaaagaaaaactgcaggatctgatgactcagattcaaggaacttgtaactttatgcaagagtctgttcttgactttgacaaaccttcaagtgcaattccaacgtcacaaccgccttcagctactccaggtagccccgtagcatctaaagaacaaaatctgtccagtcaaagtgattttcttcaagagccgttacaggctacttcttctccagttacttgtagctcaaatgcttgcttggttactaccgatcaggcttcttctggatctgaaacagagtttatgacctcagagactcctgaggcagcaattcccccaggcaagcaaccgtcttcactagcttctccaaatcctcccatggcaaagggctctgaacagggcttccagtcacctccagcaagtagtagttcagtaaccattaacacagcaccctttcaagccatgcagacagtatttaacgttaatgcacctctgcctccacggaaaaggaacaaggaaataaaagaatccccttattcacctggctacaatcaaagttttaccacagcaagtacacaaacaccaccccagtgc

SEQ ID NO: 295854 - DNA, 2183 bp, Homo sapiens
ccccggggcggggcggggctcccgagggccgcggtcggtgcgttttccgcagtcaccttcaggccattcagaggaggaaagagaggggaatatgaagtcagccaagccccaagtgaaccacagtcagcatggggaaagccagcgggccttgagccccctgcagtctactctgagttctgctgcatctccttcccaagcgtatgagacctatattgaaaatggactcatatgccttaaacacaaaattagaaacatcgagaaaaagaagctcaaactggaggattataaggatcgcctgaaaagtggagagcatcttaatccagaccagttggaagctgtagagaaatatgaagaagtgctacataatttggaatttgccaaggagcttcaaaaaaccttttctgggttgagcctagatctactaaaagcgcaaaagaaggcccagagaagggagcacatgctaaaacttgaggctgagaagaaaaagcttcgaactatacttcaagttcagtatgtattgcagaacttgacacaggagcacgtacaaaaagacttcaaagggggtttgaatggtgcagtgtatttgccttcaaaagaacttgactacctcattaagttttcaaaactgacctgccctgaaagaaatgaaagtctgagacaaacacttgaaggatctactgtctaaattgctgaactcaggctattttgaaagtatcccagttcccaaaaatgccaaggaaaaggaagtaccactggaggaagaaatgctaatacaatcagagaaaaaaacacaattatcgaagactgaatctgtcaaagagtcagagtctctaatggaatttgcccagccagagatacaaccacaagagtttcttaacagacgctatatgacagaagtagattattcaaacaaacaaggcgaagagcaaccttgggaagcagattatgctagaaaaccaaatctcccaaaacgttgggatatgcttactgaaccagatggtcaagagaagaaacaggagtcctttaagtcctgggaggcttctggtaagcaccaggaggtatccaagcctgcagtttccttagaacagaggaaacaagacacctcaaaactcaggtctactctgccggaagagcagaagaagcaggagatctccaaatccaagccatctcctagccagtggaagcaagatacacctaaatccaaagcagggtatgttcaagaggaacaaaagaaacaggagacaccaaagctgtggccagttcagctgcagaaagaacaagatccaaagaagcaaactccaaagtcttggacaccttccatgcagagcgaacagaacaccaccaagtcatggaccactcccatgtgtgaagaacaggattcaaaacagccagagactccaaaatcctgggaaaacaatgttgagagtcaaaaacactctttaacatcacagtcacagatttctccaaagtcctggggagtagctacagcaagcctcataccaaatgaccagctgctgcccaggaagttgaacacagaacccaaagatgtgcctaagcctgtgcatcagcctgtaggttcttcctctacccttccgaaggatccagtattgaggaaagaaaaactgcaggatctgatgactcagattcaaggaacttgtaactttatgcaagagtctgttcttgactttgacaaaccttcaagtgcaattccaacgtcacaaccgccttcagctactccaggtagccccgtagcatctaaagaacaaaatctgtccagtcaaagtgattttcttcaagagccgttacaggctacttcttctccagttacttgtagctcaaatgcttgcttggttactaccgatcaggcttcttctggatctgaaacagagtttatgacctcagagactcctgaggcagcaattcccccaggcaagcaaccgtcttcactagcttctccaaatcctcccatggcaaagggctctgaacagggcttccagtcacctccagcaagtagtagttcagtaaccattaacacagcaccctttcaagccatgcagacagtatttaacgttaatgcacctctgcctccacggaaaaggaacaaggaaataaaagaatccccttattcacctggctacaatcaaagttttaccacagcaagtacacaaacaccaccccagtgc

SEQ ID NO: 295855 - DNA, 2320 bp, Homo sapiens
ggctgagtcggctgggtctctggcgccgcagaggccgcgggcgaggaccgggaggggagagggaggagacaggaggaggagacgcgagtgcggggtggcgccggtccacctccgcagcgctcctgcctcccccaggctttggaaggcgggcccgggctgcggcagcggcggcctcggctgcctggggagtcaccttcaggccattcagaggaggaaagagaggggaatatgaagtcagccaagccccaagtgaaccacagtcagcatggggaaagccagcgggccttgagccccctgcagtctactctgagttctgctgcatctccttcccaagcgtatgagacctatattgaaaatggactcatatgccttaaacacaaaattagaaacatcgagaaaaagaagctcaaactggaggattataaggatcgcctgaaaagtggagagcatcttaatccagaccagttggaagctgtagagaaatatgaagaagtgctacataatttggaatttgccaaggagcttcaaaaaaccttttctgggttgagcctagatctactaaaagcgcaaaagaaggcccagagaagggagcacatgctaaaacttgaggctgagaagaaaaagcttcgaactatacttcaagttcagtatgtattgcagaacttgacacaggagcacgtacaaaaagacttcaaagggggtttgaatggtgcagtgtatttgccttcaaaagaacttgactacctcattaagttttcaaaactgacctgccctgaaagaaatgaaagtctgagacaaacacttgaaggatctactgtctaaattgctgaactcaggctattttgaaagtatcccagttcccaaaaatgccaaggaaaaggaagtaccactggaggaagaaatgctaatacaatcagagaaaaaaacacaattatcgaagactgaatctgtcaaagagtcagagtctctaatggaatttgcccagccagagatacaaccacaagagtttcttaacagacgctatatgacagaagtagattattcaaacaaacaaggcgaagagcaaccttgggaagcagattatgctagaaaaccaaatctcccaaaacgttgggatatgcttactgaaccagatggtcaagagaagaaacaggagtcctttaagtcctgggaggcttctggtaagcaccaggaggtatccaagcctgcagtttccttagaacagaggaaacaagacacctcaaaactcaggtctactctgccggaagagcagaagaagcaggagatctccaaatccaagccatctcctagccagtggaagcaagatacacctaaatccaaagcagggtatgttcaagaggaacaaaagaaacaggagacaccaaagctgtggccagttcagctgcagaaagaacaagatccaaagaagcaaactccaaagtcttggacaccttccatgcagagcgaacagaacaccaccaagtcatggaccactcccatgtgtgaagaacaggattcaaaacagccagagactccaaaatcctgggaaaacaatgttgagagtcaaaaacactctttaacatcacagtcacagatttctccaaagtcctggggagtagctacagcaagcctcataccaaatgaccagctgctgcccaggaagttgaacacagaacccaaagatgtgcctaagcctgtgcatcagcctgtaggttcttcctctacccttccgaaggatccagtattgaggaaagaaaaactgcaggatctgatgactcagattcaaggaacttgtaactttatgcaagagtctgttcttgactttgacaaaccttcaagtgcaattccaacgtcacaaccgccttcagctactccaggtagccccgtagcatctaaagaacaaaatctgtccagtcaaagtgattttcttcaagagccgttacaggctacttcttctccagttacttgtagctcaaatgcttgcttggttactaccgatcaggcttcttctggatctgaaacagagtttatgacctcagagactcctgaggcagcaattcccccaggcaagcaaccgtcttcactagcttctccaaatcctcccatggcaaagggctctgaacagggcttccagtcacctccagcaagtagtagttcagtaaccattaacacagcaccctttcaagccatgcagacagtatttaacgttaatgcacctctgcctccacggaaaaggaacaaggaaataaaagaatccccttattcacctggctacaatcaaagttttaccacagcaagtacacaaacaccaccccagtgc

SEQ ID NO: 295856 - DNA, 2156 bp, Homo sapiens
atcattgggtttcgagctcacttctgtggaaaagagtttaagggagtggtctagactttccagggaagttattgcctggctgtgtccctctagtcctaattttatacttaactttcccccacctccttcagcctcatctgtttcaatggtgcaactcttttcatccccttttggttaccagtcaccttcaggccattcagaggaggaaagagaggggaatatgaagtcagccaagccccaagtgaaccacagtcagcatggggaaagccagcgggccttgagccccctgcagtctactctgagttctgctgcatctccttcccaagcgtatgagacctatattgaaaatggactcatatgccttaaacacaaaattagaaacatcgagaaaaagaagctcaaactggaggattataaggatcgcctgaaaagtggagagcatcttaatccagaccagttggaagctgtagagaaatatgaagaagtgctacataatttggaatttgccaaggagcttcaaaaaaccttttctgggttgagcctagatctactaaaagcgcaaaagaaggcccagagaagggagcacatgctaaaacttgaggctgagaagaaaaagcttcgaactatacttcaagttcagtatgtattgcagaacttgacacaggagcacgtacaaaaagacttcaaagggggtttgaatggtgcagtgtatttgccttcaaaagaacttgactacctcattaagttttcaaaactgacctgccctgaaagaaatgaaagtctgagacaaacacttgaaggatctactgtctaaattgctgaactcaggctattttgaaagtatcccagttcccaaaaatgccaaggaaaaggaagtaccactggaggaagaaatgctaatacaatcagagaaaaaaacacaattatcgaagactgaatctgtcaaagagtcagagtctctaatggaatttgcccagccagagatacaaccacaagagtttcttaacagacgctatatgacagaagtagattattcaaacaaacaaggcgaagagcaaccttgggaagcagattatgctagaaaaccaaatctcccaaaacgttgggatatgcttactgaaccagatggtcaagagaagaaacaggagtcctttaagtcctgggaggcttctggtaagcaccaggaggtatccaagcctgcagtttccttagaacagaggaaacaagacacctcaaaactcaggtctactctgccggaagagcagaagaagcaggagatctccaaatccaagccatctcctagccagtggaagcaagatacacctaaatccaaagcagggtatgttcaagaggaacaaaagaaacaggagacaccaaagctgtggccagttcagctgcagaaagaacaagatccaaagaagcaaactccaaagtcttggacaccttccatgcagagcgaacagaacaccaccaagtcatggaccactcccatgtgtgaagaacaggattcaaaacagccagagactccaaaatcctgggaaaacaatgttgagagtcaaaaacactctttaacatcacagtcacagatttctccaaagtcctggggagtagctacagcaagcctcataccaaatgaccagctgctgcccaggaagttgaacacagaacccaaagatgtgagttgatctgtatcattctgcttctgtaagtgtaggcataaataaggtgtcgtggtaatgactttttagttctcttttttttttttttttgagatggagaaacactctgttacccaggctggagtgcagtggcactatctctgctcactgtaacctccgcctcctggattcaagcgattctcttgcctcagcctcctgagtagctgggactacaggcgcatgccaccacacctggctaatttttttgtatttttagtagagacggggtttcactgtgttagccaggatggcctggatctcctgatctcgtgatccaaccgcctcggcctcccaaagtgctgagattacaggcgtgagccattgtgcccggccttagttctcttcaaagcccatgtgaagttaatgtataaaatatttcaccctctttagtgggtagatttattgttttcccttgaaaactgggagttaatctagtct

SEQ ID NO: 295857 - DNA, 1986 bp, Homo sapiens
gatggaattttgtagttgaaaaatacttcagagtttgtaaaagatagggttttctaaaatagattaataatattagtaatctaatagagattgtccaatataggattttctaacccaatctaatagattttgaggaactgacttttacttctctaaagccttaattacttggggaaggtagagtggttgctagctgtgatgtcttgggagcagataggaaaaatgacttatttctcatctcagggaatagatgtgtgcttttgtgacatacttgattagggtctctgatttttagtcatttttcaaatggtggaaatggaggtccagagaaacttaagtgacttgctgaacttttgagattctgatctcattaaaattcatattgattcagcataaaataaagatggactgcatatttacttttcatggtactgacaagttctccagtcagtaccatgaaagtgtaaactgttgtaaactattgtaaggatgtactatgtacatcaatgtaaactattgtaacaatgtactacaactaggataaaattaggatttctattcccagtaattttcaattaggtcatgtgacaattaagtcttaatcactctttcttagacaaacacttgaaggatctactgtctaaattgctgaactcaggctattttgaaagtatcccagttcccaaaaatgccaaggaaaaggaagtaccactggaggaagaaatgctaatacaatcagagaaaaaaacacaattatcgaagactgaatctgtcaaagagtcagagtctctaatggaatttgcccagccagagatacaaccacaagagtttcttaacagacgctatatgacagaagtagattattcaaacaaacaaggcgaagagcaaccttgggaagcagattatgctagaaaaccaaatctcccaaaacgttgggatatgcttactgaaccagatggtcaagagaagaaacaggagtcctttaagtcctgggaggcttctggtaagcaccaggaggtatccaagcctgcagtttccttagaacagaggaaacaagacacctcaaaactcaggtctactctgccggaagagcagaagaagcaggagatctccaaatccaagccatctcctagccagtggaagcaagatacacctaaatccaaagcagggtatgttcaagaggaacaaaagaaacaggagacaccaaagctgtggccagttcagctgcagaaagaacaagatccaaagaagcaaactccaaagtcttggacaccttccatgcagagcgaacagaacaccaccaagtcatggaccactcccatgtgtgaagaacaggattcaaaacagccagagactccaaaatcctgggaaaacaatgttgagagtcaaaaacactctttaacatcacagtcacagatttctccaaagtcctggggagtagctacagcaagcctcataccaaatgaccagctgctgcccaggaagttgaacacagaacccaaagatgtgagttgatctgtatcattctgcttctgtaagtgtaggcataaataaggtgtcgtggtaatgactttttagttctcttttttttttttttttgagatggagaaacactctgttacccaggctggagtgcagtggcactatctctgctcactgtaacctccgcctcctggattcaagcgattctcttgcctcagcctcctgagtagctgggactacaggcgcatgccaccacacctggctaatttttttgtatttttagtagagacggggtttcactgtgttagccaggatggcctggatctcctgatctcgtgatccaaccgcctcggcctcccaaagtgctgagattacaggcgtgagccattgtgcccggccttagttctcttcaaagcccatgtgaagttaatgtataaaatatttcaccctctttagtgggtagatttattgttttcccttgaaaactgggagttaatctagtct

SEQ ID NO: 295858 - DNA, 2239 bp, Homo sapiens
atcattgggtttcgagctcacttctgtggaaaagagtttaagggagtggtctagactttccagggaagttattgcctggctgtgtccctctagtcctaattttatacttaactttcccccacctccttcagcctcatctgtttcaatggtgcaactcttttcatccccttttggttaccagtcaccttcaggccattcagaggaggaaagagaggggaatatgaagtcagccaagccccaagtgaaccacagtcagcatggggaaagccagcgggccttgagccccctgcagtctactctgagttctgctgcatctccttcccaagcgtatgagacctatattgaaaatggactcatatgccttaaacacaaaattagaaacatcgagaaaaagaagctcaaactggaggattataaggatcgcctgaaaagtggagagcatcttaatccagaccagttggaagctgtagagaaatatgaagaagtgctacataatttggaatttgccaaggagcttcaaaaaaccttttctgggttgagcctagatctactaaaagcgcaaaagaaggcccagagaagggagcacatgctaaaacttgaggctgagaagaaaaagcttcgaactatacttcaagttcagtatgtattgcagaacttgacacaggagcacgtacaaaaagacttcaaagggggtttgaatggtgcagtgtatttgccttcaaaagaacttgactacctcattaagttttcaaaactgacctgccctgaaagaaatgaaagtctgagtgttgaagaccagatggagcagtcatccttgtacttttgggaccttttggaaggtagtgagaaagcagtggtaggaacgacatacaaacacttgaaggatctactgtctaaattgctgaactcaggctattttgaaagtatcccagttcccaaaaatgccaaggaaaaggaagtaccactggaggaagaaatgctaatacaatcagagaaaaaaacacaattatcgaagactgaatctgtcaaagagtcagagtctctaatggaatttgcccagccagagatacaaccacaagagtttcttaacagacgctatatgacagaagtagattattcaaacaaacaaggcgaagagcaaccttgggaagcagattatgctagaaaaccaaatctcccaaaacgttgggatatgcttactgaaccagatggtcaagagaagaaacaggagtcctttaagtcctgggaggcttctggtaagcaccaggaggtatccaagcctgcagtttccttagaacagaggaaacaagacacctcaaaactcaggtctactctgccggaagagcagaagaagcaggagatctccaaatccaagccatctcctagccagtggaagcaagatacacctaaatccaaagcagggtatgttcaagaggaacaaaagaaacaggagacaccaaagctgtggccagttcagctgcagaaagaacaagatccaaagaagcaaactccaaagtcttggacaccttccatgcagagcgaacagaacaccaccaagtcatggaccactcccatgtgtgaagaacaggattcaaaacagccagagactccaaaatcctgggaaaacaatgttgagagtcaaaaacactctttaacatcacagtcacagatttctccaaagtcctggggagtagctacagcaagcctcataccaaatgaccagctgctgcccaggaagttgaacacagaacccaaagatgtgagttgatctgtatcattctgcttctgtaagtgtaggcataaataaggtgtcgtggtaatgactttttagttctcttttttttttttttttgagatggagaaacactctgttacccaggctggagtgcagtggcactatctctgctcactgtaacctccgcctcctggattcaagcgattctcttgcctcagcctcctgagtagctgggactacaggcgcatgccaccacacctggctaatttttttgtatttttagtagagacggggtttcactgtgttagccaggatggcctggatctcctgatctcgtgatccaaccgcctcggcctcccaaagtgctgagattacaggcgtgagccattgtgcccggccttagttctcttcaaagcccatgtgaagttaatgtataaaatatttcaccctctttagtgggtagatttattgttttcccttgaaaactgggagttaatctagtct

SEQ ID NO: 295859 - DNA, 2060 bp, Homo sapiens
atcattgggtttcgagctcacttctgtggaaaagagtttaagggagtggtctagactttccagggaagttattgcctggctgtgtccctctagtcctaattttatacttaactttcccccacctccttcagcctcatctgtttcaatggtgcaactcttttcatccccttttggttaccagtcaccttcaggccattcagaggaggaaagagaggggaatatgaagtcagccaagccccaagtgaaccacagtcagcatggggaaagccagcgggccttgagccccctgcagtctactctgagttctgctgcatctccttcccaagcgtatgagacctatattgaaaatggactcatatgccttaaacacaaaattagaaacatcgagaaaaagaagctcaaactggaggattataaggatcgcctgaaaagtggagagcatcttaatccagaccagttggaagctgtagagaaatatgaagaagtgctacataatttggaatttgccaaggagcttcaaaaaaccttttctgggttgagcctagatctactaaaagcgcaaaagaaggcccagagaagggagcacatgctaaaacttgaggctgagaagaaaaagcttcgaactatacttcaagttcagtatgtattgcagaacttgacacaggagcacgtacaaaaagacttcaaagggggtttgaatggtgcagtgtatttgccttcaaaagaacttgactacctcattaagttttcaaaactgacctgccctgaaagaaatgaaagtctgagacaaacacttgaaggatctactgtctaaattgctgaactcaggctattttgaaagtatcccagttcccaaaaatgccaaggaaaaggaagtaccactggaggaagaaatgctaatacaatcagagaaaaaaacacaattatcgaagactgaatctgtcaaagagtcagagtctctaatggaatttgcccagccagagatacaaccacaagagtttcttaacagacgctatatgacagaagtagattattcaaacaaacaaggcgaagagcaaccttgggaagcagattatgctagaaaaccaaatctcccaaaacgttgggatatgcttactgaaccagatggtcaagagaagaaacaggagtcctttaagtcctgggaggcttctggtaagcaccaggaggtatccaagcctgcagtttccttagaacagaggaaacaagacacctcaaaactcaggtctactctgccggaagagcagaagaagcaggagatctccaaatccaagccatctcctagccagtggaagcaagatacacctaaatccaaagcagggtatgttcaagaggaacaaaagaaacaggagacaccaaagctgtggccagttcagctgcagaaagaacaagatccaaagaagcaaactccaaagtcttggacaccttccatgcagagcgaacagaacaccaccaagtcatggaccactcccatgtgtgaagaacaggattcaaaacagccagagactccaaaatcctgggaaaacaatgttgagagtcaaaaacactctttaacatcacagtcacagatttctccaaagtcctggggagtagctacagcaagcctcataccaaatgaccagctgctgcccaggaagttgaacacagaacccaaagatgtgcctaagcctgtgcatcagcctgtaggttcttcctctacccttccgaaggatccagtattgaggaaagaaaaactgcaggatctgatgactcagattcaaggaacttgtaactttatgcaagagtctgttcttgactttgacaaaccttcaagtgcaattccaacgtcacaaccgccttcagctactccaggtagccccgtagcatctaaagaacaaaatctgtccagtcaaagtgattttcttcaagagccgttacaggtatttaacgttaatgcacctctgcctccacggaaaaggaacaaggaaataaaagaatccccttattcacctggctacaatcaaagttttaccacagcaagtacacaaacaccaccccagtgc

SEQ ID NO: 295860 - DNA, 1892 bp, Homo sapiens
atcattgggtttcgagctcacttctgtggaaaagagtttaagggagtggtctagactttccagggaagttattgcctggctgtgtccctctagtcctaattttatacttaactttcccccacctccttcagcctcatctgtttcaatggtgcaactcttttcatccccttttggttaccagtcaccttcaggccattcagaggaggaaagagaggggaatatgaagtcagccaagccccaagtgaaccacagtcagcatggggaaagccagcgggccttgagccccctgcagtctactctgagttctgctgcatctccttcccaagcgtatgagacctatattgaaaatggactcatatgccttaaacacaaaattagaaacatcgagaaaaagaagctcaaactggaggattataaggatcgcctgaaaagtggagagcatcttaatccagaccagttggaagctgtagagaaatatgaagaagtgctacataatttggaatttgccaaggagcttcaaaaaaccttttctgggttgagcctagatctactaaaagcgcaaaagaaggcccagagaagggagcacatgctaaaacttgaggctgagaagaaaaagcttcgaactatacttcaagttcagtatgtattgcagaacttgacacaggagcacgtacaaaaagacttcaaagggggtttgaatggtgcagtgtatttgccttcaaaagaacttgactacctcattaagttttcaaaactgacctgccctgaaagaaatgaaagtctgagagtctctaatggaatttgcccagccagagatacaaccacaagagtttcttaacagacgctatatgacagaagtagattattcaaacaaacaaggcgaagagcaaccttgggaagcagattatgctagaaaaccaaatctcccaaaacgttgggatatgcttactgaaccagatggtcaagagaagaaacaggagtcctttaagtcctgggaggcttctggtaagcaccaggaggtatccaagcctgcagtttccttagaacagaggaaacaagacacctcaaaactcaggtctactctgccggaagagcagaagaagcaggagatctccaaatccaagccatctcctagccagtggaagcaagatacacctaaatccaaagcagggtatgttcaagaggaacaaaagaaacaggagacaccaaagctgtggccagttcagctgcagaaagaacaagatccaaagaagcaaactccaaagtcttggacaccttccatgcagagcgaacagaacaccaccaagtcatggaccactcccatgtgtgaagaacaggattcaaaacagccagagactccaaaatcctgggaaaacaatgttgagagtcaaaaacactctttaacatcacagtcacagatttctccaaagtcctggggagtagctacagcaagcctcataccaaatgaccagctgctgcccaggaagttgaacacagaacccaaagatgtgcctaagcctgtgcatcagcctgtaggttcttcctctacccttccgaaggatccagtattgaggaaagaaaaactgcaggatctgatgactcagattcaaggaacttgtaactttatgcaagagtctgttcttgactttgacaaaccttcaagtgcaattccaacgtcacaaccgccttcagctactccaggtagccccgtagcatctaaagaacaaaatctgtccagtcaaagtgattttcttcaagagccgttacaggtatttaacgttaatgcacctctgcctccacggaaaaggaacaaggaaataaaagaatccccttattcacctggctacaatcaaagttttaccacagcaagtacacaaacaccaccccagtgc

SEQ ID NO: 295861 - DNA, 673 bp, Homo sapiens
atcagttggatcagtggagataaggcagttggatgatttgctcttttcccgctttctagctgtaagaagaaatgtcttctgattttcttctttttccaagtatatacatctcctcatcaaagttcagactatctgagatactattgtttttggaaaatcttctgaagatctggcttggaagcagtatccaaggtgttttccccatcaacactctcttcagcattttctcccagaacaggggagctgactgaaagaacatgaactttggtttccaaatcttgagcatctggcttcatgactgcagccggaccatcaatgccatgaagacgacattgctgtggggggtatgagagtccatcaaaggagtctgctcctcattggcctttggcttcacccaacttagcctgacttctggatttggctgcaccatgaatggctgaaggtgcttttttctctgcttcttcttaagcagtgctctctgattatccagtgccagctgttaaagtttcatcgtctcatcgtgaaagacactgtccccactggaaccaagccggcagcaactggcattcatgcctgctgctgtttaagtggcagccatgtccccactcctagccacccatggctctaaactacttttaagagcttgttggccaggcgtggtggctcacacctg

SEQ ID NO: 295862 - DNA, 1060 bp, Homo sapiens
cagcattattcataatagctaaaaggtggaagcaacccaagtgtccattgacagatgaatgaatgagcaaaatgtggtatgcacagtgaaattttactccgccttaaaggacattcagacactttctacaacatgaaccttgagaatactgtgctaggtgaaataagccagtcacagaaagacaaatattctgtgattccacttctgtgaagaaagcagcgtagtcaaaatcatagagacagaaagtagaatagtggctgccagggttggggaaaaagggaatggagagttggtgtttatggggacagttttagtccccccccgccccgcttaccccaacttgaagctcagagtcttagttgtacaagatgaaaagagttctggagatgtgtgggggtgatggccgtacaacatcgtgaatgtatttagtgcccctgaaccacacacctacatatggctaagatggtaaatgttatgctatgtatattttactacaataaaatatgttggaaaaaaaattttgatgtgataatgcaaacttacagcgactcacacctgctttatcgggagtttcagaaggggcaggagggagaggacacgctgagcagccagaggctattgacacaccagaagcatccccagggactgcctttctcaacatcaccctctgtaatggcagcgtcagccaagagcgcactgccattggttttactgaccaaacctaaagaaacggctgcgttcccatcagatttgctcactaaatcatgccgacacacagacatgcatcttccagcctgttcggcagcagtgcagacaacatgaggggtctcagatcctccacaagaatgattctggttctgcctgagccttcgcctgagcccccatcagacattgtaaaggtcaacttaaggatgatgggcaggcagaggcaggaataaggactgatatggttgaatctctcattgctctagcaccatccgcttggtgctgctctcatgatagctggttgtttaaaagtgtgtggcacctgccgggcgcggtggctcacgcctgtcatccc

SEQ ID NO: 295863 - DNA, 859 bp, Homo sapiens
ggccggggcgggtcaatggcggtggcggaaacggcgggccactgcgcgggaacgggttacgcggctgacgtccgccgcagcagccgctgggtcctggaggcagaagcctccctgagaagcgcacaataggcagggcgcggtggctcacgcctgtaatcccagcactttgggaggctcaggcgggcggatcacaagcctgcactaggtgacgctgaagccacagaagacactgcagtgggaaaaccagcatgagccgctgcccccaaggaacctcgaagcccaggcagaggaccagccatcccagcctgcagggtctcctgagaacacagaccagaattactgagcgactcacacctgctttatcgggagtttcagaaggggcaggagggagaggacacgctgagcagccagaggctattgacacaccagaagcatccccagggactgcctttctcaacatcaccctctgtaatggcagcgtcagccaagagcgcactgccattggttttactgaccaaacctaaagaaacggctgcgttcccatcagatttgctcactaaatcatgccgacacacagacatgcatcttccagcctgttcggcagcagtgcagacaacatgaggggtctcagatcctccacaagaatgattctggttctgcctgagccttcgcctgagcccccatcagacattgtaaaggtcaacttaaggatgatgggcaggcagaggcaggaataaggactgatatggttgaatctctcattgctctagcaccatccgcttggtgctgctctcatgatagctggttgtttaaaagtgtgtggcacctgccgggcgcggtggctcacgcctgtcatccc

SEQ ID NO: 295864 - DNA, 1476 bp, Homo sapiens
atttttcttctgtgcctggcttatttcacttaacataatgacctccagttccatccatcaggcctccttttttcacggaggatttattttaggaaacttgcaattgtgagttctttctctacctctttgagaggcaaatcttctcccaaattttcttctagcctcctcctagttttgcaacccaggaatgcctttctcaagacttcagagccatccctttaaaatgcaattattgaaggagatgatacatctgtgtctcagtttttgtagaagggcagattcccagttttgaaaaattccaatgagccaacgcagatagctttacggcatttcctaacctcttcctgatgtctctagttccttctcagcatctcaccccggcacttaaaaactccccagccttttgtttcaatgaagttaagctcctctcttccgtattgcagtagtcctgactgagtccttccttgaaggtttaacttgtctggtgcaattttttctttgacaatgtccagatcaaatgatcccataaaaacatcgagtgtgattttagcctgagaagggggagggtgagaagatagattgggaggcagctgtgtaggcaggggacttggccactccctaaacctctcccagtctcacctgtaaatggagtgcataggtagcagtgcttctcccccaaggctggggcgatggaatcagttagactattgagggcatctggaagggcatctgtgtcagggttagtcctcagggtatggtggccaatgggtttcttttggttgactgttgacaatgcgtttgttgaatggcagcctgcactaggtgacgctgaagccacagaagacactgcagtgggaaaaccagcatgagccgctgcccccaaggaacctcgaagcccaggcagaggaccagccatcccagcctgcagggtctcctgagaacacagaccagaattactgagcgactcacacctgctttatcgggagtttcagaaggggcaggagggagaggacacgctgagcagccagaggctattgacacaccagaagcatccccagggactgcctttctcaacatcaccctctgtaatggcagcgtcagccaagagcgcactgccattggttttactgaccaaacctaaagaaacggctgcgttcccatcagatttgctcactaaatcatgccgacacacagacatgcatcttccagcctgttcggcagcagtgcagacaacatgaggggtctcagatcctccacaagaatgattctggttctgcctgagccttcgcctgagcccccatcagacattgtaaaggtcaacttaaggatgatgggcaggcagaggcaggaataaggactgatatggttgaatctctcattgctctagcaccatccgcttggtgctgctctcatgatagctggttgtttaaaagtgtgtggcacctgccgggcgcggtggctcacgcctgtcatccc

SEQ ID NO: 295865 - DNA, 482 bp, Homo sapiens
catcttaagaaagttgagcgtctactctgtatattgttttttaatgtgtgctgtttctagtcccccgaccctccatcttttaaatttatattgactgtttcatatagaaatcttagcaaatgattcattgtctggaataatttcatagatttttagttgtttaattaagccaaattgtgcattagcaacagacttttaggatgctaatgtgtccagtagttaggtcctgaggaatgtttgaaagataagagtagctcttttcacatggaagagaaatggattttccttttgttacagcgtagtatggacctaaagaccatagatgaaagttacagagagctcagttaaaacacatgcacacaaacttcctagcaattagagagctatttacagattgagtaaactcactttcagaacagttaagtcctaaacagtgggaattgtaaaagcagaggctggttgccctttttttttaaaaaaaa

SEQ ID NO: 295866 - DNA, 384 bp, Homo sapiens
ggcttgtattagtaatgtaatttaccatagataactttcctcatgtttcaaactgctggtcattaccaattagtgggttgagaaaacactttagatctcatacagcatggtaaaaaagtagaatagaatggaagctatgagagtgtatcacatgtagttagaggattgttttttatgacattttagtttgttgtataaatgttgtatataaatgtatgttatgtgagtatatgcttgtgtacactaggtggtgatataaaatatgtttaatgggccgggcgcggtggctcacgcttgtaatcccagcactttgggaggccgaggtgggtggatcacgaggtcaggagatcgagaccacggtgaaaccccgtctctactaaaaat

SEQ ID NO: 295867 - DNA, 4820 bp, Homo sapiens
  misc_feature (2170)..(2170): n is a, c, g, or t
  misc_feature (2175)..(2175): n is a, c, g, or t
  misc_feature (3077)..(3077): n is a, c, g, or t
agccggaagtgcgtggccgcccggggccatggcgacactcagcttcgtcttcctgctgctgggggcagtgtcctggcctccggcttctgcctccggccaggagttctggcccggacaatcggcggccgatattctgtcgggggcggcttcccgcagacggtatcttctgtatgacgtcaaccccccggaaggcttcaacctgcgcagggatgtctatatccgaatcgcctctctcctgaagactctgctgaagacggaggagtgggtgcttgtcctgcctccatggggccgcctctatcactggcagagtcctgacatccaccaggtccggattccctggtctgagttttttgatcttccaagtctcaataaaaacatccccgtcatcgagtatgagcagttcatcgcagaatctggtgggccctttattgaccaggtttacgtcctgcaaagttacgcagaggggtggaaagaagggacctgggaagagaaggtggacgagcggccgtgtattgatcagctcctgtactcccaggacaagcacgagtactacagaggatggttttggggttatgaggagaccaggggtctaaacgtctcctgtctgtccgtccagggctcagcctccatcgtggcgcccctgctgctgagaaacacatcagcccggtccgtgatgttagacagagccgagaacctacttcacgaccactatggagggaaagaatactgggatacccgtcgcagcatggtgtttgccaggcacctgcgggaggtgggagacgagttcaggagcagacatctcaactccacggacgacgcagacaggatccccttccaggaggactggatgaagatgaaggtcaagctgggctccgcgctagggggcccctacctgggagtccacctgagaagaaaagatttcatctggggtcacagacaggatgtacccagtctggaaggggccgtgaggaagatccgcagcctcatgaagacccaccggctggacaaggtgtttgtggccacagatgccgtcagaaaggaatatgaagagctaaaaaagctgttacccgagatggtgaggtttgaacccacgtgggaggagctggagctctacaaggacggaggcgttgcgattattgaccagtggatctgcgcacacgccaggtgcctgcccacgtcactgtcggccgagagcgggtcgggtggctttcaaaggttcttctgtcccaagtactcggtgtcagagcagatggtcgcctgtgttcacagtggtcatttccatactgtttgcctcctcgtctgagtctcctgtagcatctggttcagtgtttccctgggctgaagttaattgttcatcttgcccctttagttctcatgcacagaattcctccatagcaggctgttggcatagctggcctcgtctcagaacctcttcttgtgtcgcattttcccatcattcccggtttctgcccctgtctgccccctgccctgagagttgcccgtgccctggacttgggcatgtccttgttgctgtgttgttgagcatccgtgagcgtccccgaggccgggagcgtgggccctcgtgtgatcattctcgtggggctgccatgagcgtccccaaggctgggagcatgggccctcgtgtgatcgttcttgtggggctgccgtgagcgtccccgaggccgggagcgtgggccctcgtgtgatcattctcgtggggctgccgtgagcgtcccagaggccgggagcgtgggccctgcgtgcagtcattcctctggggttgctgtgggaggtacgcctgggcctctgttcctccaaagacctgcctgcccatctgcataggagatgaaggctggggttagggtgaaacggtttgagttaaatggaaaatgaaagtagagggaatgatcttccccgtggttagcactgtgcacacgcgtgcgtctctgtgggttagtctgtctctctcctgcccgaggaatgctgagcgccctgagccggtgcctcttcacacatctgctatttcctgtggtgttctgggcatggtgtgtaagacccacagaggctccgggtgatgctgtctgctgggtgtgggtccctttccctgttaagcagacaggatgcagcgctgacttcttaggtcagggcggaggtgtgcaggagcccagtnacganctcacccctgcttctcaggtgtggccttgggattttgactgcgaccttggcggtgctgtctccgcagcccaggaagcctgctgtggggaggcttcgcactgagctctcagcctcctgccctcagctgcgcgaagcgctcggcccagctcactgaagctgccctgcctccgggccggcgcggcctgctctggcaggcccctgtgtgtggggtggtgagggtctccccaccagtgctgcaccccgcagcagcatacaggcctgtgtggcctgctggccctgtggctctgtgtacagcgctgtgcatgttacatttgctctggaaacatctctggggtttgcttgttcacgaagttcatgaagtgccgctggagagccagagaccagctgcgcaggagccggaggaacgggcaggccgctgacctgaggtctggagaaacccctggagaagggtgtccccaccagcccatacagcgtgtgtgtggagggggccttgacctccgtgatgtctactgtgcctcaggataaggacccgccatgccctggctagacagtgtgtggttagtaggaatctctcattgttcaccatgtgacccccaggaggtattcgacctgcactggcgtgcctggcctgggatttggtgacggagaggagggctcccagggggacatgcggtgggacaggagcgtggcggctgctgactgtggggtgtggatggggctgcagcaccaggcagagcccctcagggcgccgatgtcgagggcacctgagcgaggggtgccagcaagggggcggccggctggtgggtgctcgggggacggccgtgttggttccatgtaactgtggaactcatttcactcagctgctcctctcagttctccctgactctggaacctctgtgacnccagttctccctgactctggaacctctgtgatcctttgcaggttttttattggcacctcagtctcaacattttcttttcggattcatgaggaaagagaaatcctggggttggaccccaagacgacgtacaacaggttctgcggagaccaagagaaggcgtgtgagcaacccacccactggaagatcacctactgaggaggatcctccagggccgctccccggacccgacaggcgcgggtggatgcaggttctgtcgccgtggagtcaccgtctactgccagccgggagctgggcggacaggaccgtccctcgcagggtcccaggcccagaagaggccccacgcctctagagctgggctccgtcctcggcgttgccagccgccatggctgatgaagaggctccgctgctctcgggggtggcggttgttttcaggcagcgtctgtgaacccacagctcggttgccagcagtgcccgcgtggtgacccagaagcaggagtgtttgtcaggctcccgctctggcctttccagccacctttcatgtcttcatattttaagtgcattgaggatagatgcaggcgggtgagctgccctccgtcaggtggacccgggctgacatttccctgggagctggtgcaaggagaagcgtcattttaaatgtctgcagagcgaccaggggcctcatgaatctctccgttgccctccgcgcagcaggaggctgcctgtgtgtttcctcctgggatgcgtgcaaggcagacctggtgctgcaaaggaaagggcctgaggcctcagggagccccgtggagggatgacagttcaggccctactgctggcacgtcagagcactgggaagtttttcagtgacgtctctggggcactcagtggattgtctgtaggaaacttgcagctctgctcctcacaccaggcccggctggccacccaccctcgcccccactggccacccctccctcgccccgactgccccgccccaccctcaccccgactgccccgccctcgcccggctggccgtccctgccctcgccccggctggcaggtgcacatggggcctccaggtctgccattcgctattgagaactagaaatgaggaaggacagttacgctaactccaaaaggctgtctaggatgagctgctttatcagggagctccttgtacccattttacagaaatcatttttaggtctttgtgccaccaccacgaggggcatctgcaaagagggcaacgctagacgacagaatccgtggaaggtgcagcagtgcctcaggggtcctcagggtcagggagcccccctcaccctcttggcccgttaccctttgtgactttccaccatggtgtcgtgtgaccctcagtcaggttggtgggggctgagtcctcactgagcagccactttccacatctgctagaggaacagtgacatggacacctgtgacagagagaggacagttaggagggacagacagctcttcctttcggagcctggctagtctaggacatcaccttgctgtgtcttctcaagcttttaaaattgaccctgaacgtgtgacagggtcctatggtgttactcaaagctgtgcagggtaaatgatgacatatttattctttttccatttgttctagaaacagtgcctttttcatcagttgcattttccaggctgagagctgtataaaacattttggactgtgaccatgtaccttcctttttaagaaaaataaactgctttatggaa

SEQ ID NO: 295868 - DNA, 3072 bp, Homo sapiens
agccggaagtgcgtggccgcccggggccatggcgacactcagcttcgtcttcctgctgctgggggcagtgtcctggcctccggcttctgcctccggccaggagttctggcccggacaatcggcggccgatattctgtcgggggcggcttcccgcagacggtatcttctgtatgacgtcaaccccccggaaggcttcaacctgcgcagggatgtctatatccgaatcgcctctctcctgaagactctgctgaagacggaggagtgggtgcttgtcctgcctccatggggccgcctctatcactggcagagtcctgacatccaccaggtccggattccctggtctgagttttttgatcttccaagtctcaataaaaacatccccgtcatcgagtatgagcagttcatcgcagaatctggtgggccctttattgaccaggtttacgtcctgcaaagttacgcagaggggtggaaagaagggacctgggaagagaaggtggacgagcggccgtgtattgatcagctcctgtactcccaggacaagcacgagtactacagaggatggttttggggttatgaggagaccaggggtctaaacgtctcctgtctgtccgtccagggctcagcctccatcgtggcgcccctgctgctgagaaacacatcagcccggtccgtgatgttagacagagccgagaacctacttcacgaccactatggagggaaagaatactgggatacccgtcgcagcatggtgtttgccaggcacctgcgggaggtgggagacgagttcaggagcagacatctcaactccacggacgacgcagacaggatccccttccaggaggactggatgaagatgaaggtcaagctgggctccgcgctagggggcccctacctgggagtccacctgagaagaaaagatttcatctggggtcacagacaggatgtacccagtctggaaggggccgtgaggaagatccgcagcctcatgaagacccaccggctggacaaggtgtttgtggccacagatgccgtcagaaaggaatatgaagagctaaaaaagctgttacccgagatggtgaggtttgaacccacgtgggaggagctggagctctacaaggacggaggcgttgcgattattgaccagtggatctgcgcacacgccagttcatgaagtgccgctggagagccagagaccagctgcgcaggagccggaggaacgggcaggccgctgacctgaggtctggagaaacccctggagaagggtgtccccaccagcccatacagcgtgtgtgtggagggggccttgacctccgtgatgtctactgtgcctcaggataaggacccgccatgccctggctagacagtgtgtggttttttattggcacctcagtctcaacattttcttttcggattcatgaggaaagagaaatcctggggttggaccccaagacgacgtacaacaggttctgcggagaccaagagaaggcgtgtgagcaacccacccactggaagatcacctactgaggaggatcctccagggccgctccccggacccgacaggcgcgggtggatgcaggttctgtcgccgtggagtcaccgtctactgccagccgggagctgggcggacaggaccgtccctcgcagggtcccaggcccagaagaggccccacgcctctagagctgggctccgtcctcggcgttgccagccgccatggctgatgaagaggctccgctgctctcgggggtggcggttgttttcaggcagcgtctgtgaacccacagctcggttgccagcagtgcccgcgtggtgacccagaagcaggagtgtttgtcaggctcccgctctggcctttccagccacctttcatgtcttcatattttaagtgcattgaggatagatgcaggcgggtgagctgccctccgtcaggtggacccgggctgacatttccctgggagctggtgcaaggagaagcgtcattttaaatgtctgcagagcgaccaggggcctcatgaatctctccgttgccctccgcgcagcaggaggctgcctgtgtgtttcctcctgggatgcgtgcaaggcagacctggtgctgcaaaggaaagggcctgaggcctcagggagccccgtggagggatgacagttcaggccctactgctggcacgtcagagcactgggaagtttttcagtgacgtctctggggcactcagtggattgtctgtaggaaacttgcagctctgctcctcacaccaggcccggctggccacccaccctcgcccccactggccacccctccctcgccccgactgccccgccccaccctcaccccgactgccccgccctcgcccggctggccgtccctgccctcgccccggctggcaggtgcacatggggcctccaggtctgccattcgctattgagaactagaaatgaggaaggacagttacgctaactccaaaaggctgtctaggatgagctgctttatcagggagctccttgtacccattttacagaaatcatttttaggtctttgtgccaccaccacgaggggcatctgcaaagagggcaacgctagacgacagaatccgtggaaggtgcagcagtgcctcaggggtcctcagggtcagggagcccccctcaccctcttggcccgttaccctttgtgactttccaccatggtgtcgtgtgaccctcagtcaggttggtgggggctgagtcctcactgagcagccactttccacatctgctagaggaacagtgacatggacacctgtgacagagagaggacagttaggagggacagacagctcttcctttcggagcctggctagtctaggacatcaccttgctgtgtcttctcaagcttttaaaattgaccctgaacgtgtgacagggtcctatggtgttactcaaagctgtgcagggtaaatgatgacatatttattctttttccatttgttctagaaacagtgcctttttcatcagttgcattttccaggctgagagctgtataaaacattttggactgtgaccatgtaccttcctttttaagaaaaataaactgctttatggaa

SEQ ID NO: 295869 - DNA, 1191 bp, Homo sapiens
taggtttgccaccggacaagggttgcagtaattcggacgagacgctgtggaaagaatgcctgcccaggaatggcgtctctaccacggaacagatgcagctccggctttgagctcgagtcagtgaatttgtttccaggcagcttatgtgaacctctcctttttgtcaaagaaaaccttcccccaccctcccctcctcaggcacgcctgcagcttgccatagccgtcggtggatcctggattccaagccttttgcccactgtcaaatacactcctcaaattaggagatacttttctctgatgtcattctgttcgttgacagtcggcattaaagccctctcagaaccgtggtgtggaggccagacggcagcctgcctgtgtctcagccataaccacccaacgcgccctggttagtgtccctcggagacttggtctctgcttcctcggcccggggttctcccagtttgtgctctgagagtgtgaatgtcatcatccttaactcttataactgtttattcttctgttgtttaaaaacaggtccgtgatgttagacagagccgagaacctacttcacgaccactatggagggaaagaatactgggatgtgagtgtttcctcgggagcgtttttctcagttagtgtatgttgcccattatttagcttttgaaaatttaaaacagtcgacagctctttttgaaccttgctgattaaaaccatcattttaagccatggatttgggcaactgcggtgactgtgccacccccaagcctcacgtggctgcagagccaggtcctcgggagcccgcagggccacccagctctcccctctgatgccacaggccctgaatgcggtggcagcgccctggagtcagccccggagtcagtgactccgtcagtggctggaacgtagacccctcctttctcctctctttagctttgaaaggtgggactattctctgcagcgggtcttttccgttggcgttgatttccgcattgatggggtgacttcccatagccacccctggttctgtgagtgagtgggagcagagggcgggaagtggctgccccctcccgtggacacagcaggcctgctgacgtgttcaccagggcagcagcttgtaaagccggaacctgcctgcaggagacacagtccctgctcacgtgggactttgtgcaggtcagtcccaccccgttt

SEQ ID NO: 295870 - DNA, 2866 bp, Homo sapiens
agccggaagtgcgtggccgcccggggccatggcgacactcagcttcgtcttcctgctgctgggggcagtgtcctggcctccggcttctgcctccggccaggagttctggcccggacaatcggcggccgatattctgtcgggggcggcttcccgcagacggtatcttctgtatgacgtcaaccccccggaaggcttcaacctgcgcagggatgtctatatccgaatcgcctctctcctgaagactctgctgaagacggaggagtgggtgcttgtcctgcctccatggggccgcctctatcactggcagagtcctgacatccaccaggtccggattccctggtctgagttttttgatcttccaagtctcaataaaaacatccccgtcatcgagtatgagcagttcatcgcagaatctggtgggccctttattgaccaggtttacgtcctgcaaagttacgcagaggggtggaaagaagggacctgggaagagaaggtggacgagcggccgtgtattgatcagctcctgtactcccaggacaagcacgagtactacagaggatggttttggggttatgaggagaccaggggtctaaacgtctcctgtctgtccgtccagggctcagcctccatcgtggcgcccctgctgctgagaaacacatcagcccggtccgtgatgttagacagagccgagaacctacttcacgaccactatggagggaaagaatactgggatacccgtcgcagcatggtgtttgccaggcacctgcgggaggtgggagacgagttcaggagcagacatctcaactccacggacgacgcagacaggatccccttccaggaggactggatgaagatgaaggtcaagctgggctccgcgctagggggcccctacctgggagtccacctgagaagaaaagatttcatctggggtcacagacaggatgtacccagtctggaaggggccgtgaggaagatccgcagcctcatgaagacccaccggctggacaaggtgtttgtggccacagatgccgtcagaaaggaatatgaagagctaaaaaagctgttacccgagatggtgaggtttgaacccacgtgggaggagctggagctctacaaggacggaggcgttgcgattattgaccagtggatctgcgcacacgccaggttttttattggcacctcagtctcaacattttcttttcggattcatgaggaaagagaaatcctggggttggaccccaagacgacgtacaacaggttctgcggagaccaagagaaggcgtgtgagcaacccacccactggaagatcacctactgaggaggatcctccagggccgctccccggacccgacaggcgcgggtggatgcaggttctgtcgccgtggagtcaccgtctactgccagccgggagctgggcggacaggaccgtccctcgcagggtcccaggcccagaagaggccccacgcctctagagctgggctccgtcctcggcgttgccagccgccatggctgatgaagaggctccgctgctctcgggggtggcggttgttttcaggcagcgtctgtgaacccacagctcggttgccagcagtgcccgcgtggtgacccagaagcaggagtgtttgtcaggctcccgctctggcctttccagccacctttcatgtcttcatattttaagtgcattgaggatagatgcaggcgggtgagctgccctccgtcaggtggacccgggctgacatttccctgggagctggtgcaaggagaagcgtcattttaaatgtctgcagagcgaccaggggcctcatgaatctctccgttgccctccgcgcagcaggaggctgcctgtgtgtttcctcctgggatgcgtgcaaggcagacctggtgctgcaaaggaaagggcctgaggcctcagggagccccgtggagggatgacagttcaggccctactgctggcacgtcagagcactgggaagtttttcagtgacgtctctggggcactcagtggattgtctgtaggaaacttgcagctctgctcctcacaccaggcccggctggccacccaccctcgcccccactggccacccctccctcgccccgactgccccgccccaccctcaccccgactgccccgccctcgcccggctggccgtccctgccctcgccccggctggcaggtgcacatggggcctccaggtctgccattcgctattgagaactagaaatgaggaaggacagttacgctaactccaaaaggctgtctaggatgagctgctttatcagggagctccttgtacccattttacagaaatcatttttaggtctttgtgccaccaccacgaggggcatctgcaaagagggcaacgctagacgacagaatccgtggaaggtgcagcagtgcctcaggggtcctcagggtcagggagcccccctcaccctcttggcccgttaccctttgtgactttccaccatggtgtcgtgtgaccctcagtcaggttggtgggggctgagtcctcactgagcagccactttccacatctgctagaggaacagtgacatggacacctgtgacagagagaggacagttaggagggacagacagctcttcctttcggagcctggctagtctaggacatcaccttgctgtgtcttctcaagcttttaaaattgaccctgaacgtgtgacagggtcctatggtgttactcaaagctgtgcagggtaaatgatgacatatttattctttttccatttgttctagaaacagtgcctttttcatcagttgcattttccaggctgagagctgtataaaacattttggactgtgaccatgtaccttcctttttaagaaaaataaactgctttatggaa

SEQ ID NO: 295871 - DNA, 4820 bp, Homo sapiens
  misc_feature (2170)..(2170): n is a, c, g, or t
  misc_feature (2175)..(2175): n is a, c, g, or t
agccggaagtgcgtggccgcccggggccatggcgacactcagcttcgtcttcctgctgctgggggcagtgtcctggcctccggcttctgcctccggccaggagttctggcccggacaatcggcggccgatattctgtcgggggcggcttcccgcagacggtatcttctgtatgacgtcaaccccccggaaggcttcaacctgcgcagggatgtctatatccgaatcgcctctctcctgaagactctgctgaagacggaggagtgggtgcttgtcctgcctccatggggccgcctctatcactggcagagtcctgacatccaccaggtccggattccctggtctgagttttttgatcttccaagtctcaataaaaacatccccgtcatcgagtatgagcagttcatcgcagaatctggtgggccctttattgaccaggtttacgtcctgcaaagttacgcagaggggtggaaagaagggacctgggaagagaaggtggacgagcggccgtgtattgatcagctcctgtactcccaggacaagcacgagtactacagaggatggttttggggttatgaggagaccaggggtctaaacgtctcctgtctgtccgtccagggctcagcctccatcgtggcgcccctgctgctgagaaacacatcagcccggtccgtgatgttagacagagccgagaacctacttcacgaccactatggagggaaagaatactgggatacccgtcgcagcatggtgtttgccaggcacctgcgggaggtgggagacgagttcaggagcagacatctcaactccacggacgacgcagacaggatccccttccaggaggactggatgaagatgaaggtcaagctgggctccgcgctagggggcccctacctgggagtccacctgagaagaaaagatttcatctggggtcacagacaggatgtacccagtctggaaggggccgtgaggaagatccgcagcctcatgaagacccaccggctggacaaggtgtttgtggccacagatgccgtcagaaaggaatatgaagagctaaaaaagctgttacccgagatggtgaggtttgaacccacgtgggaggagctggagctctacaaggacggaggcgttgcgattattgaccagtggatctgcgcacacgccaggtgcctgcccacgtcactgtcggccgagagcgggtcgggtggctttcaaaggttcttctgtcccaagtactcggtgtcagagcagatggtcgcctgtgttcacagtggtcatttccatactgtttgcctcctcgtctgagtctcctgtagcatctggttcagtgtttccctgggctgaagttaattgttcatcttgcccctttagttctcatgcacagaattcctccatagcaggctgttggcatagctggcctcgtctcagaacctcttcttgtgtcgcattttcccatcattcccggtttctgcccctgtctgccccctgccctgagagttgcccgtgccctggacttgggcatgtccttgttgctgtgttgttgagcatccgtgagcgtccccgaggccgggagcgtgggccctcgtgtgatcattctcgtggggctgccatgagcgtccccaaggctgggagcatgggccctcgtgtgatcgttcttgtggggctgccgtgagcgtccccgaggccgggagcgtgggccctcgtgtgatcattctcgtggggctgccgtgagcgtcccagaggccgggagcgtgggccctgcgtgcagtcattcctctggggttgctgtgggaggtacgcctgggcctctgttcctccaaagacctgcctgcccatctgcataggagatgaaggctggggttagggtgaaacggtttgagttaaatggaaaatgaaagtagagggaatgatcttccccgtggttagcactgtgcacacgcgtgcgtctctgtgggttagtctgtctctctcctgcccgaggaatgctgagcgccctgagccggtgcctcttcacacatctgctatttcctgtggtgttctgggcatggtgtgtaagacccacagaggctccgggtgatgctgtctgctgggtgtgggtccctttccctgttaagcagacaggatgcagcgctgacttcttaggtcagggcggaggtgtgcaggagcccagtnacganctcacccctgcttctcaggtgtggccttgggattttgactgcgaccttggcggtgctgtctccgcagcccaggaagcctgctgtggggaggcttcgcactgagctctcagcctcctgccctcagctgcgcgaagcgctcggcccagctcactgaagctgccctgcctccgggccggcgcggcctgctctggcaggcccctgtgtgtggggtggtgagggtctccccaccagtgctgcaccccgcagcagcatacaggcctgtgtggcctgctggccctgtggctctgtgtacagcgctgtgcatgttacatttgctctggaaacatctctggggtttgcttgttcacgaagttcatgaagtgccgctggagagccagagaccagctgcgcaggagccggaggaacgggcaggccgctgacctgaggtctggagaaacccctggagaagggtgtccccaccagcccatacagcgtgtgtgtggagggggccttgacctccgtgatgtctactgtgcctcaggataaggacccgccatgccctggctagacagtgtgtggttttttattggcacctcagtctcaacattttcttttcggattcatgaggaaagagaaatcctggggttggaccccaagacgacgtacaacaggttctgcggagaccaagagaaggcgtgtgagcaacccacccactggaagatcacctactgaggaggatcctccagggccgctccccggacccgacaggcgcgggtggatgcaggttctgtcgccgtggagtcaccgtctactgccagccgggagctgggcggacaggaccgtccctcgcagggtcccaggcccagaagaggccccacgcctctagagctgggctccgtcctcggcgttgccagccgccatggctgatgaagaggctccgctgctctcgggggtggcggttgttttcaggcagcgtctgtgaacccacagctcggttgccagcagtgcccgcgtggtgacccagaagcaggagtgtttgtcaggctcccgctctggcctttccagccacctttcatgtcttcatattttaagtgcattgaggatagatgcaggcgggtgagctgccctccgtcaggtggacccgggctgacatttccctgggagctggtgcaaggagaagcgtcattttaaatgtctgcagagcgaccaggggcctcatgaatctctccgttgccctccgcgcagcaggaggctgcctgtgtgtttcctcctgggatgcgtgcaaggcagacctggtgctgcaaaggaaagggcctgaggcctcagggagccccgtggagggatgacagttcaggccctactgctggcacgtcagagcactgggaagtttttcagtgacgtctctggggcactcagtggattgtctgtaggaaacttgcagctctgctcctcacaccaggcccggctggccacccaccctcgcccccactggccacccctccctcgccccgactgccccgccccaccctcaccccgactgccccgccctcgcccggctggccgtccctgccctcgccccggctggcaggtgcacatggggcctccaggtctgccattcgctattgagaactagaaatgaggaaggacagttacgctaactccaaaaggctgtctaggatgagctgctttatcagggagctccttgtacccattttacagaaatcatttttaggtctttgtgccaccaccacgaggggcatctgcaaagagggcaacgctagacgacagaatccgtggaaggtgcagcagtgcctcaggggtcctcagggtcagggagcccccctcaccctcttggcccgttaccctttgtgactttccaccatggtgtcgtgtgaccctcagtcaggttggtgggggctgagtcctcactgagcagccactttccacatctgctagaggaacagtgacatggacacctgtgacagagagaggacagttaggagggacagacagctcttcctttcggagcctggctagtctaggacatcaccttgctgtgtcttctcaagcttttaaaattgaccctgaacgtgtgacagggtcctatggtgttactcaaagctgtgcagggtaaatgatgacatatttattctttttccatttgttctagaaacagtgcctttttcatcagttgcattttccaggctgagagctgtataaaacattttggactgtgaccatgtaccttcctttttaagaaaaataaactgctttatggaagttggtagctgtggagtgtagactcattagactcatttcctgccacacagcggaaggtggaagaaccttttcggatctcccagaaagcggatggtgaccaggcatggaggaacagggtaggggccgctcctgctggcctgcgagtgctgtggcatctacatcaggacaccacttctgccagagcccctgggcccccagtgtggcctgggtgtgctcaaggggccctgtaagtcctcgtcatcaacagcagccagccctcctctgttcattagactgctgggaggcctctttggggaaagaatccctcaggtgtaaaactgccaggtttttaggcacataggagatggcagtatggcctttgggagtttaattgtggtgggaaaaga

SEQ ID NO: 295872 - DNA, 2721 bp, Homo sapiens
agccggaagtgcgtggccgcccggggccatggcgacactcagcttcgtcttcctgctgctgggggcagtgtcctggcctccggcttctgcctccggccaggagttctggcccggacaatcggcggccgatattctgtcgggggcggcttcccgcagacggtatcttctgtatgacgtcaaccccccggaaggcttcaacctgcgcagggatgtctatatccgaatcgcctctctcctgaagactctgctgaagacggaggagtgggtgcttgtcctgcctccatggggccgcctctatcactggcagagtcctgacatccaccaggtccggattccctggtctgagttttttgatcttccaagtctcaataaaaacatccccgtcatcgagtatgagcagttcatcgcagaggatggttttggggttatgaggagaccaggggtctaaacgtctcctgtctgtccgtccagggctcagcctccatcgtggcgcccctgctgctgagaaacacatcagcccggtccgtgatgttagacagagccgagaacctacttcacgaccactatggagggaaagaatactgggatacccgtcgcagcatggtgtttgccaggcacctgcgggaggtgggagacgagttcaggagcagacatctcaactccacggacgacgcagacaggatccccttccaggaggactggatgaagatgaaggtcaagctgggctccgcgctagggggcccctacctgggagtccacctgagaagaaaagatttcatctggggtcacagacaggatgtacccagtctggaaggggccgtgaggaagatccgcagcctcatgaagacccaccggctggacaaggtgtttgtggccacagatgccgtcagaaaggaatatgaagagctaaaaaagctgttacccgagatggtgaggtttgaacccacgtgggaggagctggagctctacaaggacggaggcgttgcgattattgaccagtggatctgcgcacacgccaggttttttattggcacctcagtctcaacattttcttttcggattcatgaggaaagagaaatcctggggttggaccccaagacgacgtacaacaggttctgcggagaccaagagaaggcgtgtgagcaacccacccactggaagatcacctactgaggaggatcctccagggccgctccccggacccgacaggcgcgggtggatgcaggttctgtcgccgtggagtcaccgtctactgccagccgggagctgggcggacaggaccgtccctcgcagggtcccaggcccagaagaggccccacgcctctagagctgggctccgtcctcggcgttgccagccgccatggctgatgaagaggctccgctgctctcgggggtggcggttgttttcaggcagcgtctgtgaacccacagctcggttgccagcagtgcccgcgtggtgacccagaagcaggagtgtttgtcaggctcccgctctggcctttccagccacctttcatgtcttcatattttaagtgcattgaggatagatgcaggcgggtgagctgccctccgtcaggtggacccgggctgacatttccctgggagctggtgcaaggagaagcgtcattttaaatgtctgcagagcgaccaggggcctcatgaatctctccgttgccctccgcgcagcaggaggctgcctgtgtgtttcctcctgggatgcgtgcaaggcagacctggtgctgcaaaggaaagggcctgaggcctcagggagccccgtggagggatgacagttcaggccctactgctggcacgtcagagcactgggaagtttttcagtgacgtctctggggcactcagtggattgtctgtaggaaacttgcagctctgctcctcacaccaggcccggctggccacccaccctcgcccccactggccacccctccctcgccccgactgccccgccccaccctcaccccgactgccccgccctcgcccggctggccgtccctgccctcgccccggctggcaggtgcacatggggcctccaggtctgccattcgctattgagaactagaaatgaggaaggacagttacgctaactccaaaaggctgtctaggatgagctgctttatcagggagctccttgtacccattttacagaaatcatttttaggtctttgtgccaccaccacgaggggcatctgcaaagagggcaacgctagacgacagaatccgtggaaggtgcagcagtgcctcaggggtcctcagggtcagggagcccccctcaccctcttggcccgttaccctttgtgactttccaccatggtgtcgtgtgaccctcagtcaggttggtgggggctgagtcctcactgagcagccactttccacatctgctagaggaacagtgacatggacacctgtgacagagagaggacagttaggagggacagacagctcttcctttcggagcctggctagtctaggacatcaccttgctgtgtcttctcaagcttttaaaattgaccctgaacgtgtgacagggtcctatggtgttactcaaagctgtgcagggtaaatgatgacatatttattctttttccatttgttctagaaacagtgcctttttcatcagttgcattttccaggctgagagctgtataaaacattttggactgtgaccatgtaccttcctttttaagaaaaataaactgctttatggaa

SEQ ID NO: 295873 - DNA, 4250 bp, Homo sapiens
  misc_feature (2170)..(2170): n is a, c, g, or t
  misc_feature (2175)..(2175): n is a, c, g, or t
agccggaagtgcgtggccgcccggggccatggcgacactcagcttcgtcttcctgctgctgggggcagtgtcctggcctccggcttctgcctccggccaggagttctggcccggacaatcggcggccgatattctgtcgggggcggcttcccgcagacggtatcttctgtatgacgtcaaccccccggaaggcttcaacctgcgcagggatgtctatatccgaatcgcctctctcctgaagactctgctgaagacggaggagtgggtgcttgtcctgcctccatggggccgcctctatcactggcagagtcctgacatccaccaggtccggattccctggtctgagttttttgatcttccaagtctcaataaaaacatccccgtcatcgagtatgagcagttcatcgcagaatctggtgggccctttattgaccaggtttacgtcctgcaaagttacgcagaggggtggaaagaagggacctgggaagagaaggtggacgagcggccgtgtattgatcagctcctgtactcccaggacaagcacgagtactacagaggatggttttggggttatgaggagaccaggggtctaaacgtctcctgtctgtccgtccagggctcagcctccatcgtggcgcccctgctgctgagaaacacatcagcccggtccgtgatgttagacagagccgagaacctacttcacgaccactatggagggaaagaatactgggatacccgtcgcagcatggtgtttgccaggcacctgcgggaggtgggagacgagttcaggagcagacatctcaactccacggacgacgcagacaggatccccttccaggaggactggatgaagatgaaggtcaagctgggctccgcgctagggggcccctacctgggagtccacctgagaagaaaagatttcatctggggtcacagacaggatgtacccagtctggaaggggccgtgaggaagatccgcagcctcatgaagacccaccggctggacaaggtgtttgtggccacagatgccgtcagaaaggaatatgaagagctaaaaaagctgttacccgagatggtgaggtttgaacccacgtgggaggagctggagctctacaaggacggaggcgttgcgattattgaccagtggatctgcgcacacgccaggtgcctgcccacgtcactgtcggccgagagcgggtcgggtggctttcaaaggttcttctgtcccaagtactcggtgtcagagcagatggtcgcctgtgttcacagtggtcatttccatactgtttgcctcctcgtctgagtctcctgtagcatctggttcagtgtttccctgggctgaagttaattgttcatcttgcccctttagttctcatgcacagaattcctccatagcaggctgttggcatagctggcctcgtctcagaacctcttcttgtgtcgcattttcccatcattcccggtttctgcccctgtctgccccctgccctgagagttgcccgtgccctggacttgggcatgtccttgttgctgtgttgttgagcatccgtgagcgtccccgaggccgggagcgtgggccctcgtgtgatcattctcgtggggctgccatgagcgtccccaaggctgggagcatgggccctcgtgtgatcgttcttgtggggctgccgtgagcgtccccgaggccgggagcgtgggccctcgtgtgatcattctcgtggggctgccgtgagcgtcccagaggccgggagcgtgggccctgcgtgcagtcattcctctggggttgctgtgggaggtacgcctgggcctctgttcctccaaagacctgcctgcccatctgcataggagatgaaggctggggttagggtgaaacggtttgagttaaatggaaaatgaaagtagagggaatgatcttccccgtggttagcactgtgcacacgcgtgcgtctctgtgggttagtctgtctctctcctgcccgaggaatgctgagcgccctgagccggtgcctcttcacacatctgctatttcctgtggtgttctgggcatggtgtgtaagacccacagaggctccgggtgatgctgtctgctgggtgtgggtccctttccctgttaagcagacaggatgcagcgctgacttcttaggtcagggcggaggtgtgcaggagcccagtnacganctcacccctgcttctcaggtgtggccttgggattttgactgcgaccttggcggtgctgtctccgcagcccaggaagcctgctgtggggaggcttcgcactgagctctcagcctcctgccctcagctgcgcgaagcgctcggcccagctcactgaagctgccctgcctccgggccggcgcggcctgctctggcaggcccctgtgtgtggggtggtgagggtctccccaccagtgctgcaccccgcagcagcatacaggcctgtgtggcctgctggccctgtggctctgtgtacagcgctgtgcatgttacatttgctctggaaacatctctggggtttgcttgttcacgaagttcatgaagtgccgctggagagccagagaccagctgcgcaggagccggaggaacgggcaggccgctgacctgaggtctggagaaacccctggagaagggtgtccccaccagcccatacagcgtgtgtgtggagggggccttgacctccgtgatgtctactgtgcctcaggataaggacccgccatgccctggctagacagtgtgtggttttttattggcacctcagtctcaacattttcttttcggattcatgaggaaagagaaatcctggggttggaccccaagacgacgtacaacaggttctgcggagaccaagagaaggcgtgtgagcaacccacccactggaagatcacctactgaggaggatcctccagggccgctccccggacccgacaggcgcgggtggatgcaggttctgtcgccgtggagtcaccgtctactgccagccgggagctgggcggacaggaccgtccctcgcagggtcccaggcccagaagaggccccacgcctctagagctgggctccgtcctcggcgttgccagccgccatggctgatgaagaggctccgctgctctcgggggtggcggttgttttcaggcagcgtctgtgaacccacagctcggttgccagcagtgcccgcgtggtgacccagaagcaggagtgtttgtcaggctcccgctctggcctttccagccacctttcatgtcttcatattttaagtgcattgaggatagatgcaggcgggtgagctgccctccgtcaggtggacccgggctgacatttccctgggagctggtgcaaggagaagcgtcattttaaatgtctgcagagcgaccaggggcctcatgaatctctccgttgccctccgcgcagcaggaggctgcctgtgtgtttcctcctgggatgcgtgcaaggcagacctggtgctgcaaaggaaagggcctgaggcctcagggagccccgtggagggatgacagttcaggccctactgctggcacgtcagagcactgggaagtttttcagtgacgtctctggggcactcagtggattgtctgtaggaaacttgcagctctgctcctcacaccaggcccggctggccacccaccctcgcccccactggccacccctccctcgccccgactgccccgccccaccctcaccccgactgccccgccctcgcccggctggccgtccctgccctcgccccggctggcaggtgcacatggggcctccaggtctgccattcgctattgagaactagaaatgaggaaggacagttacgctaactccaaaaggctgtctaggatgagctgctttatcagggagctccttgtacccattttacagaaatcatttttaggtctttgtgccaccaccacgaggggcatctgcaaagagggcaacgctagacgacagaatccgtggaaggtgcagcagtgcctcaggggtcctcagggtcagggagcccccctcaccctcttggcccgttaccctttgtgactttccaccatggtgtcgtgtgaccctcagtcaggttggtgggggctgagtcctcactgagcagccactttccacatctgctagaggaacagtgacatggacacctgtgacagagagaggacagttaggagggacagacagctcttcctttcggagcctggctagtctaggacatcaccttgctgtgtcttctacgcttcgtcgtacgggatcctctagacacc

SEQ ID NO: 295874 - DNA, 3878 bp, Homo sapiens
  misc_feature (1614)..(1614): n is a, c, g, or t
  misc_feature (1619)..(1619): n is a, c, g, or t
tgagcccagtgtgtgccgcagcttcccacggcaggggctggcagagccggcaggggtgggcggcttgccctgcgttggcttcatgcaggagaccctccaagagcctccaccgtggatggcgctgcttctcaggcgaccgtggatgacgtgtctgaggggcttgttccagctgcggggacccgtcgcagcatggtgtttgccaggcacctgcgggaggtgggagacgagttcaggagcagacatctcaactccacggacgacgcagacaggatccccttccaggaggactggatgaagatgaaggtcaagctgggctccgcgctagggggcccctacctgggagtccacctgagaagaaaagatttcatctggggtcacagacaggatgtacccagtctggaaggggccgtgaggaagatccgcagcctcatgaagacccaccggctggacaaggtgtttgtggccacagatgccgtcagaaaggaatatgaagagctaaaaaagctgttacccgagatggtgaggtttgaacccacgtgggaggagctggagctctacaaggacggaggcgttgcgattattgaccagtggatctgcgcacacgccaggtgcctgcccacgtcactgtcggccgagagcgggtcgggtggctttcaaaggttcttctgtcccaagtactcggtgtcagagcagatggtcgcctgtgttcacagtggtcatttccatactgtttgcctcctcgtctgagtctcctgtagcatctggttcagtgtttccctgggctgaagttaattgttcatcttgcccctttagttctcatgcacagaattcctccatagcaggctgttggcatagctggcctcgtctcagaacctcttcttgtgtcgcattttcccatcattcccggtttctgcccctgtctgccccctgccctgagagttgcccgtgccctggacttgggcatgtccttgttgctgtgttgttgagcatccgtgagcgtccccgaggccgggagcgtgggccctcgtgtgatcattctcgtggggctgccatgagcgtccccaaggctgggagcatgggccctcgtgtgatcgttcttgtggggctgccgtgagcgtccccgaggccgggagcgtgggccctcgtgtgatcattctcgtggggctgccgtgagcgtcccagaggccgggagcgtgggccctgcgtgcagtcattcctctggggttgctgtgggaggtacgcctgggcctctgttcctccaaagacctgcctgcccatctgcataggagatgaaggctggggttagggtgaaacggtttgagttaaatggaaaatgaaagtagagggaatgatcttccccgtggttagcactgtgcacacgcgtgcgtctctgtgggttagtctgtctctctcctgcccgaggaatgctgagcgccctgagccggtgcctcttcacacatctgctatttcctgtggtgttctgggcatggtgtgtaagacccacagaggctccgggtgatgctgtctgctgggtgtgggtccctttccctgttaagcagacaggatgcagcgctgacttcttaggtcagggcggaggtgtgcaggagcccagtnacganctcacccctgcttctcaggtgtggccttgggattttgactgcgaccttggcggtgctgtctccgcagcccaggaagcctgctgtggggaggcttcgcactgagctctcagcctcctgccctcagctgcgcgaagcgctcggcccagctcactgaagctgccctgcctccgggccggcgcggcctgctctggcaggcccctgtgtgtggggtggtgagggtctccccaccagtgctgcaccccgcagcagcatacaggcctgtgtggcctgctggccctgtggctctgtgtacagcgctgtgcatgttacatttgctctggaaacatctctggggtttgcttgttcacgaagttcatgaagtgccgctggagagccagagaccagctgcgcaggagccggaggaacgggcaggccgctgacctgaggtctggagaaacccctggagaagggtgtccccaccagcccatacagcgtgtgtgtggagggggccttgacctccgtgatgtctactgtgcctcaggataaggacccgccatgccctggctagacagtgtgtggttttttattggcacctcagtctcaacattttcttttcggattcatgaggaaagagaaatcctggggttggaccccaagacgacgtacaacaggttctgcggagaccaagagaaggcgtgtgagcaacccacccactggaagatcacctactgaggaggatcctccagggccgctccccggacccgacaggcgcgggtggatgcaggttctgtcgccgtggagtcaccgtctactgccagccgggagctgggcggacaggaccgtccctcgcagggtcccaggcccagaagaggccccacgcctctagagctgggctccgtcctcggcgttgccagccgccatggctgatgaagaggctccgctgctctcgggggtggcggttgttttcaggcagcgtctgtgaacccacagctcggttgccagcagtgcccgcgtggtgacccagaagcaggagtgtttgtcaggctcccgctctggcctttccagccacctttcatgtcttcatattttaagtgcattgaggatagatgcaggcgggtgagctgccctccgtcaggtggacccgggctgacatttccctgggagctggtgcaaggagaagcgtcattttaaatgtctgcagagcgaccaggggcctcatgaatctctccgttgccctccgcgcagcaggaggctgcctgtgtgtttcctcctgggatgcgtgcaaggcagacctggtgctgcaaaggaaagggcctgaggcctcagggagccccgtggagggatgacagttcaggccctactgctggcacgtcagagcactgggaagtttttcagtgacgtctctggggcactcagtggattgtctgtaggaaacttgcagctctgctcctcacaccaggcccggctggccacccaccctcgcccccactggccacccctccctcgccccgactgccccgccccaccctcaccccgactgccccgccctcgcccggctggccgtccctgccctcgccccggctggcaggtgcacatggggcctccaggtctgccattcgctattgagaactagaaatgaggaaggacagttacgctaactccaaaaggctgtctaggatgagctgctttatcagggagctccttgtacccattttacagaaatcatttttaggtctttgtgccaccaccacgaggggcatctgcaaagagggcaacgctagacgacagaatccgtggaaggtgcagcagtgcctcaggggtcctcagggtcagggagcccccctcaccctcttggcccgttaccctttgtgactttccaccatggtgtcgtgtgaccctcagtcaggttggtgggggctgagtcctcactgagcagccactttccacatctgctagaggaacagtgacatggacacctgtgacagagagaggacagttaggagggacagacagctcttcctttcggagcctggctagtctaggacatcaccttgctgtgtcttctcaagcttttaaaattgaccctgaacgtgtgacagggtcctatggtgttactcaaagctgtgcagggtaaatgatgacatatttattctttttccatttgttctagaaacagtgcctttttcatcagttgcattttccaggctgagagctgtataaaacattttggactgtgaccatgtaccttcctttttaagaaaaataaactgctttatggaa

SEQ ID NO: 295875 - DNA, 4302 bp, Homo sapiens
  misc_feature (2038)..(2038): n is a, c, g, or t
  misc_feature (2043)..(2043): n is a, c, g, or t
taggtttgccaccggacaagggttgcagtaattcggacgagacgctgtggaaagaatgcctgcccaggaatggcgtctctaccacggaacagatgcagctccggctttgagctcgagtcagtgaatttgtttccaggcagcttatgtgaacctctcctttttgtcaaagaaaaccttcccccaccctcccctcctcaggcacgcctgcagcttgccatagccgtcggtggatcctggattccaagccttttgcccactgtcaaatacactcctcaaattaggagatacttttctctgatgtcattctgttcgttgacagtcggcattaaagccctctcagaaccgtggtgtggaggccagacggcagcctgcctgtgtctcagccataaccacccaacgcgccctggttagtgtccctcggagacttggtctctgcttcctcggcccggggttctcccagtttgtgctctgagagtgtgaatgtcatcatccttaactcttataactgtttattcttctgttgtttaaaaacaggtccgtgatgttagacagagccgagaacctacttcacgaccactatggagggaaagaatactgggatacccgtcgcagcatggtgtttgccaggcacctgcgggaggtgggagacgagttcaggagcagacatctcaactccacggacgacgcagacaggatccccttccaggaggactggatgaagatgaaggtcaagctgggctccgcgctagggggcccctacctgggagtccacctgagaagaaaagatttcatctggggtcacagacaggatgtacccagtctggaaggggccgtgaggaagatccgcagcctcatgaagacccaccggctggacaaggtgtttgtggccacagatgccgtcagaaaggaatatgaagagctaaaaaagctgttacccgagatggtgaggtttgaacccacgtgggaggagctggagctctacaaggacggaggcgttgcgattattgaccagtggatctgcgcacacgccaggtgcctgcccacgtcactgtcggccgagagcgggtcgggtggctttcaaaggttcttctgtcccaagtactcggtgtcagagcagatggtcgcctgtgttcacagtggtcatttccatactgtttgcctcctcgtctgagtctcctgtagcatctggttcagtgtttccctgggctgaagttaattgttcatcttgcccctttagttctcatgcacagaattcctccatagcaggctgttggcatagctggcctcgtctcagaacctcttcttgtgtcgcattttcccatcattcccggtttctgcccctgtctgccccctgccctgagagttgcccgtgccctggacttgggcatgtccttgttgctgtgttgttgagcatccgtgagcgtccccgaggccgggagcgtgggccctcgtgtgatcattctcgtggggctgccatgagcgtccccaaggctgggagcatgggccctcgtgtgatcgttcttgtggggctgccgtgagcgtccccgaggccgggagcgtgggccctcgtgtgatcattctcgtggggctgccgtgagcgtcccagaggccgggagcgtgggccctgcgtgcagtcattcctctggggttgctgtgggaggtacgcctgggcctctgttcctccaaagacctgcctgcccatctgcataggagatgaaggctggggttagggtgaaacggtttgagttaaatggaaaatgaaagtagagggaatgatcttccccgtggttagcactgtgcacacgcgtgcgtctctgtgggttagtctgtctctctcctgcccgaggaatgctgagcgccctgagccggtgcctcttcacacatctgctatttcctgtggtgttctgggcatggtgtgtaagacccacagaggctccgggtgatgctgtctgctgggtgtgggtccctttccctgttaagcagacaggatgcagcgctgacttcttaggtcagggcggaggtgtgcaggagcccagtnacganctcacccctgcttctcaggtgtggccttgggattttgactgcgaccttggcggtgctgtctccgcagcccaggaagcctgctgtggggaggcttcgcactgagctctcagcctcctgccctcagctgcgcgaagcgctcggcccagctcactgaagctgccctgcctccgggccggcgcggcctgctctggcaggcccctgtgtgtggggtggtgagggtctccccaccagtgctgcaccccgcagcagcatacaggcctgtgtggcctgctggccctgtggctctgtgtacagcgctgtgcatgttacatttgctctggaaacatctctggggtttgcttgttcacgaagttcatgaagtgccgctggagagccagagaccagctgcgcaggagccggaggaacgggcaggccgctgacctgaggtctggagaaacccctggagaagggtgtccccaccagcccatacagcgtgtgtgtggagggggccttgacctccgtgatgtctactgtgcctcaggataaggacccgccatgccctggctagacagtgtgtggttttttattggcacctcagtctcaacattttcttttcggattcatgaggaaagagaaatcctggggttggaccccaagacgacgtacaacaggttctgcggagaccaagagaaggcgtgtgagcaacccacccactggaagatcacctactgaggaggatcctccagggccgctccccggacccgacaggcgcgggtggatgcaggttctgtcgccgtggagtcaccgtctactgccagccgggagctgggcggacaggaccgtccctcgcagggtcccaggcccagaagaggccccacgcctctagagctgggctccgtcctcggcgttgccagccgccatggctgatgaagaggctccgctgctctcgggggtggcggttgttttcaggcagcgtctgtgaacccacagctcggttgccagcagtgcccgcgtggtgacccagaagcaggagtgtttgtcaggctcccgctctggcctttccagccacctttcatgtcttcatattttaagtgcattgaggatagatgcaggcgggtgagctgccctccgtcaggtggacccgggctgacatttccctgggagctggtgcaaggagaagcgtcattttaaatgtctgcagagcgaccaggggcctcatgaatctctccgttgccctccgcgcagcaggaggctgcctgtgtgtttcctcctgggatgcgtgcaaggcagacctggtgctgcaaaggaaagggcctgaggcctcagggagccccgtggagggatgacagttcaggccctactgctggcacgtcagagcactgggaagtttttcagtgacgtctctggggcactcagtggattgtctgtaggaaacttgcagctctgctcctcacaccaggcccggctggccacccaccctcgcccccactggccacccctccctcgccccgactgccccgccccaccctcaccccgactgccccgccctcgcccggctggccgtccctgccctcgccccggctggcaggtgcacatggggcctccaggtctgccattcgctattgagaactagaaatgaggaaggacagttacgctaactccaaaaggctgtctaggatgagctgctttatcagggagctccttgtacccattttacagaaatcatttttaggtctttgtgccaccaccacgaggggcatctgcaaagagggcaacgctagacgacagaatccgtggaaggtgcagcagtgcctcaggggtcctcagggtcagggagcccccctcaccctcttggcccgttaccctttgtgactttccaccatggtgtcgtgtgaccctcagtcaggttggtgggggctgagtcctcactgagcagccactttccacatctgctagaggaacagtgacatggacacctgtgacagagagaggacagttaggagggacagacagctcttcctttcggagcctggctagtctaggacatcaccttgctgtgtcttctcaagcttttaaaattgaccctgaacgtgtgacagggtcctatggtgttactcaaagctgtgcagggtaaatgatgacatatttattctttttccatttgttctagaaacagtgcctttttcatcagttgcattttccaggctgagagctgtataaaacattttggactgtgaccatgtaccttcctttttaagaaaaataaactgctttatggaa

SEQ ID NO: 295876 - DNA, 3131 bp, Homo sapiens
  misc_feature (2170)..(2170): n is a, c, g, or t
  misc_feature (2175)..(2175): n is a, c, g, or t
agccggaagtgcgtggccgcccggggccatggcgacactcagcttcgtcttcctgctgctgggggcagtgtcctggcctccggcttctgcctccggccaggagttctggcccggacaatcggcggccgatattctgtcgggggcggcttcccgcagacggtatcttctgtatgacgtcaaccccccggaaggcttcaacctgcgcagggatgtctatatccgaatcgcctctctcctgaagactctgctgaagacggaggagtgggtgcttgtcctgcctccatggggccgcctctatcactggcagagtcctgacatccaccaggtccggattccctggtctgagttttttgatcttccaagtctcaataaaaacatccccgtcatcgagtatgagcagttcatcgcagaatctggtgggccctttattgaccaggtttacgtcctgcaaagttacgcagaggggtggaaagaagggacctgggaagagaaggtggacgagcggccgtgtattgatcagctcctgtactcccaggacaagcacgagtactacagaggatggttttggggttatgaggagaccaggggtctaaacgtctcctgtctgtccgtccagggctcagcctccatcgtggcgcccctgctgctgagaaacacatcagcccggtccgtgatgttagacagagccgagaacctacttcacgaccactatggagggaaagaatactgggatacccgtcgcagcatggtgtttgccaggcacctgcgggaggtgggagacgagttcaggagcagacatctcaactccacggacgacgcagacaggatccccttccaggaggactggatgaagatgaaggtcaagctgggctccgcgctagggggcccctacctgggagtccacctgagaagaaaagatttcatctggggtcacagacaggatgtacccagtctggaaggggccgtgaggaagatccgcagcctcatgaagacccaccggctggacaaggtgtttgtggccacagatgccgtcagaaaggaatatgaagagctaaaaaagctgttacccgagatggtgaggtttgaacccacgtgggaggagctggagctctacaaggacggaggcgttgcgattattgaccagtggatctgcgcacacgccaggtgcctgcccacgtcactgtcggccgagagcgggtcgggtggctttcaaaggttcttctgtcccaagtactcggtgtcagagcagatggtcgcctgtgttcacagtggtcatttccatactgtttgcctcctcgtctgagtctcctgtagcatctggttcagtgtttccctgggctgaagttaattgttcatcttgcccctttagttctcatgcacagaattcctccatagcaggctgttggcatagctggcctcgtctcagaacctcttcttgtgtcgcattttcccatcattcccggtttctgcccctgtctgccccctgccctgagagttgcccgtgccctggacttgggcatgtccttgttgctgtgttgttgagcatccgtgagcgtccccgaggccgggagcgtgggccctcgtgtgatcattctcgtggggctgccatgagcgtccccaaggctgggagcatgggccctcgtgtgatcgttcttgtggggctgccgtgagcgtccccgaggccgggagcgtgggccctcgtgtgatcattctcgtggggctgccgtgagcgtcccagaggccgggagcgtgggccctgcgtgcagtcattcctctggggttgctgtgggaggtacgcctgggcctctgttcctccaaagacctgcctgcccatctgcataggagatgaaggctggggttagggtgaaacggtttgagttaaatggaaaatgaaagtagagggaatgatcttccccgtggttagcactgtgcacacgcgtgcgtctctgtgggttagtctgtctctctcctgcccgaggaatgctgagcgccctgagccggtgcctcttcacacatctgctatttcctgtggtgttctgggcatggtgtgtaagacccacagaggctccgggtgatgctgtctgctgggtgtgggtccctttccctgttaagcagacaggatgcagcgctgacttcttaggtcagggcggaggtgtgcaggagcccagtnacganctcacccctgcttctcaggtgtggccttgggattttgactgcgaccttggcggtgctgtctccgcagcccaggaagcctgctgtggggaggcttcgcactgagctctcagcctcctgccctcagctgcgcgaagcgctcggcccagctcactgaagctgccctgcctccgggccggcgcggcctgctctggcaggcccctgtgtgtggggtggtgagggtctccccaccagtgctgcaccccgcagcagcatacaggcctgtgtggcctgctggccctgtggctctgtgtacagcgctgtgcatgttacatttgctctggaaacatctctggggtttgcttgttcacgaagttcatgaagtgccgctggagagccagagaccagctgcgcaggagccggaggaacgggcaggccgctgacctgaggtctggagaaacccctggagaagggtgtccccaccagcccatacagcgtgtgtgtggagggggccttgacctccgtgatgtctactgtgcctcaggataaggacccgccatgccctggctagacagtgtgtggttagtaggaatctctcattgttcaccatgtgacccccaggaggtattcgacctgcactggcgtgcctggcctgggatttggtgacggagaggagggctcccagggggacatgcggtgggacaggagcgtggcggctgctgactgtggggtgtggatggggctgcagcaccaggcagagcccctcagggcgccgatgtcgagggcacctgagcgaggggtgccagcaagggggcggccggctggtgggtgctcgggggacggccgtgttggttccatgtaactgtggaactcatttcactcagctgctcctctcagttctccctgactctggaacctattccctatgaattcatggcataataggtgttaaaaaaaaaaaataaaggacctctgggcta

SEQ ID NO: 295877 - DNA, 1150 bp, Homo sapiens
agccggaagtgcgtggccgcccggggccatggcgacactcagcttcgtcttcctgctgctgggggcagtgtcctggcctccggcttctgcctccggccaggagttctggcccggacaatcggcggccgatattctgtcgggggcggcttcccgcagacggtatcttctgtatgacgtcaaccccccggaaggcttcaacctgcgcagggatgtctatatccgaatcgcctctctcctgaagactctgctgaagacggaggagtgggtgcttgtcctgcctccatggggccgcctctatcactggcagagtcctgacatccaccaggtccggattccctggtctgagttttttgatcttccaagtctcaataaaaacatccccgtcatcgagtatgagcagttcatcgcagaatctggtgggccctttattgaccaggtttacgtcctgcaaagttacgcagaggggtggaaagaagggacctgggaagagaaggtggacgagcggccgtgtattgatcagctcctgtactcccaggacaagcacgagtactacagaggatggttttggggttatgaggagaccaggggtctaaacgtctcctgtctgtccgtccagggctcagcctccatcgtggcgcccctgctgctgagaaacacatcagcccggtccgtgatgttagacagagccgagaacctacttcacgaccactatggagggaaagaatactgggatacccgtcgcagcatggtgtttgccaggcacctgcgggaggtgggagacgagttcaggagcagacatctcaactccacggacgacgcagacaggatccccttccaggaggactggatgaagatgaaggtcaagctgggctccgcgctagggggcccctacctgggagtccacctgagaagaaaagatttcatctggggtcacagacaggatgtacccagtctggaaggggccgtgaggaagatccgcagcctcatgaagacccaccggctggacaaggtgtttgtggccacagatgccgtcagaaaggaaacagtgcctttttcatcagttgcattttccaggctgagagctgtataaaacattttggactgtgaccatgtaccttcctttttaagaaaaataaactgctttatggaa

SEQ ID NO: 295878 - DNA, 913 bp, Homo sapiens
agccggaagtgcgtggccgcccggggccatggcgacactcagcttcgtcttcctgctgctgggggcagtgtcctggcctccggcttctgcctccggccaggagttctggcccggacaatcggcggccgatattctgtcgggggcggcttcccgcagacggtatcttctgtatgacgtcaaccccccggaaggcttcaacctgcgcagggatgtctatatccgaatcgcctctctcctgaagactctgctgaagacggaggagtgggtgcttgtcctgcctccatggggccgcctctatcactggcagagtcctgacatccaccaggtccggattccctggtctgagttttttgatcttccaagtctcaataaaaacatccccgtcatcgagtatgagcagttcatcgcagaatctggtgggccctttattgaccaggtttacgtcctgcaaagttacgcagaggggtggaaagaagggacctgggaagagaaggtggacgagcggccgtgtattgatcagctcctgtactcccaggacaagcacgagtactacagtcctcactgagcagccactttccacatctgctagaggaacagtgacatggacacctgtgacagagagaggacagttaggagggacagacagctcttcctttcggagcctggctagtctaggacatcaccttgctgtgtcttctcaagcttttaaaattgaccctgaacgtgtgacagggtcctatggtgttactcaaagctgtgcagggtaaatgatgacatatttattctttttccatttgttctagaaacagtgcctttttcatcagttgcattttccaggctgagagctgtataaaacattttggactgtgaccatgtaccttcctttttaagaaaaataaactgctttatggaa

SEQ ID NO: 295879 - DNA, 1323 bp, Homo sapiens
agccggaagtgcgtggccgcccggggccatggcgacactcagcttcgtcttcctgctgctgggggcagtgtcctggcctccggcttctgcctccggccaggagttctggcccggacaatcggcggccgatattctgtcgggggcggcttcccgcagacggtatcttctgtatgacgtcaaccccccggaaggcttcaacctgcgcagggatgtctatatccgaatcgcctctctcctgaagactctgctgaagacggaggagtgggtgcttgtcctgcctccatggggccgcctctatcactggcagagtcctgacatccaccaggtccggattccctggtctgagttttttgatcttccaagtctcaataaaaacatccccgtcatcgagtatgagcagttcatcgcagaatctggtgggccctttattgaccaggtttacgtcctgcaaagttacgcagaggggtggaaagaagggacctgggaagagaaggtggacgagcggccgtgtattgatcagctcctgtactcccaggacaagcacgagtactacagaggatggttttggggttatgaggagaccaggggtctaaacgtctcctgtctgtccgtccagggctcagcctccatcgtggcgcccctgctgctgagaaacacatcagcccggtccgtgatgttagacagagccgagaacctacttcacgaccactatggagggaaagaatactgggatgtgagtgtttcctcgggagcgtttttctcagttagtgtatgttgcccattatttagcttttgaaaatttaaaacagtcgacagctctttttgaaccttgctgattaaaaccatcattttaagccatggatttgggcaactgcggtgactgtgccacccccaagcctcacgtggctgcagagccaggtcctcgggagcccgcagggccacccagctctcccctctgatgccacaggccctgaatgcggtggcagcgccctggagtcagccccggagtcagtgactccgtcagtggctggaacgtagacccctcctttctcctctctttagctttgaaaggtgggactattctctgcagcgggtcttttccgttggcgttgatttccgcattgatggggtgacttcccatagccacccctggttctgtgagtgagtgggagcagagggcgggaagtggctgccccctcccgtggacacagcaggcctgctgacgtgttcaccagggcagcagcttgtaaagccggaacctgcctgcaggagacacagtccctgctcacgtgggactttgtgcaggtcagtcccaccccgttt

SEQ ID NO: 295880 - DNA, 285 bp, Homo sapiens
ccgtgaggaagatccgcagcctcatgaagacccaccggctggacaaggtgtttgtggccacagatgccgtcagaaagggtatggagcttcaatgctttcgtttctttcctttcttttaatttattttttttattgataattcttgggtgtttctcacagacggggattttggcagggtcatggaacaatagtggagggaaggtcagcagataaacaagtgaacaaaggtctctggttttcctaggcagaggaccctgcggccttccgcagtgtttgtgtccctga

SEQ ID NO: 295881 - DNA, 437 bp, Homo sapiens
ggcttcttttaaaattttactagaatgtcacgatctgcagtcacgatcagtaagttttcctaaagcagccgcgtttcatcaggagcaagccacagtgtgtgcgtgtctagacttgatttgttttccttgtgaaagcaaaataaactgatagagctgctgtgggttttgttttccagaggatggttttggggttatgaggagaccaggggtctaaacgtctcctgtctgtccgtccagggctcagcctccatcgtggcgcccctgctgctgagaaacacatcagcccggtgagtgccccaggccccccgggagcagcctggaggctgtggcgtctgctccgtgcatgctgggctgggggctctccgcccatactcccgcatccctggcccacccacctcacagacagcggaccctgggggccctggggggtggtggtt

SEQ ID NO: 295882 - DNA, 2083 bp, Homo sapiens
aagacttcctggaagaggtcccagcgtgagtgtcgcttctggcatctgtccttctggccagcctgtggtctggccaagtgatgtaaccctcctctccagcctgtgcacaggcagcctgggaacagctccatccccacccctcagctataaatagggcatcgtgacccggccagggaagaagctgccgttgttctgggtactacagcagaagggtatgcggaagcgagcaccccagtctgagatggctcctgccggtgtgagcctgagggccaccatcctctgcctcctggcctgggctggcctggctgcaggtgaccgggtgtacatacaccccttccacctcgtcatccacaatgagagtacctgtgagcagctggcaaaggccaatgccgggaagcccaaagaccccaccttcatacctgctccaattcaggccaagacatcccctgtggatgaaaaggccctacaggaccagctggtgctagtcgctgcaaaacttgacaccgaagacaagttgagggccgcaatggtcgggatgctggccaacttcttgggcttccgtatatatggcatgcacagtgagctatggggcgtggtccatggggccaccgtcctctccccaacggctgtctttggcaccctggcctctctctatctgggagccttggaccacacagctgacaggctacaggcaatcctgggtgttccttggaaggacaagaactgcacctcccggctggatgcgcacaaggtcctgtctgccctgcaggctgtacagggcctgctagtggcccagggcagggctgatagccaggcccagctgctgctgtccacggtggtgggcgtgttcacagccccaggcctgcacctgaagcagccgtttgtgcagggcctggctctctatacccctgtggtcctcccacgctctctggacttcacagaactggatgttgctgctgagaagattgacaggttcatgcaggctgtgacaggatggaagactggctgctccctgacgggagccagtgtggacagcaccctggctttcaacacctacgtccacttccaagggaagatgaagggcttctccctgctggccgagccccaggagttctgggtggacaacagcacctcagtgtctgttcccatgctctctggcatgggcaccttccagcactggagtgacatccaggacaacttctcggtgactcaagtgcccttcactgagagcgcctgcctgctgctgatccagcctcactatgcctctgacctggacaaggtggagggtctcactttccagcaaaactccctcaactggatgaagaaactgtctccccggaccatccacctgaccatgccccaactggtgctgcaaggatcttatgacctgcaggacctgctcgcccaggctgagctgcccgccattctgcacaccgagctgaacctgcaaaaattgagcaatgaccgcatcagggtgggggaggtgctgaacagcattttttttgagcttgaagcggatgagagagagcccacagagtctacccaacagcttaacaagcctgaggtcttggaggtgaccctgaaccgcccattcctgtttgctgtgtatgatcaaagcgccactgccctgcacttcctgggccgcgtggccaacccgctgagcacagcatgaggccagggccccagaacacagtgcctggcaaggcctctgcccctggcctttgaggcaaaggccagcagcagataacaaccccggacaaatcagcgatgtgtcacccccagtctcccaccttttcttctaatgagtcgactttgagctggaaagcagccgtttctccttggtctaagtgtgctgcatggagtgagcagtagaagcctgcagcggcacaaatgcacctcccagtttgctgggtttattttagagaatgggggtggggaggcaagaaccagtgtttagcgcgggactactgttccaaaaagaattccaaccgaccagcttgtttgtgaaacaaaaaagtgttcccttttcaagttgagaacaaaaattgggttttaaaattaaagtatacatttttgcattgcc

SEQ ID NO: 295883 - DNA, 2279 bp, Homo sapiens
aagacttcctggaagaggtcccagcgtgagtgtcgcttctggcatctgtccttctggccagcctgtggtctggccaagtgatgtaaccctcctctccagcctgtgcacaggcagcctgggaacagctccatccccacccctcagctataaatagggcatcgtgacccggccagggaagaagctgccgttgttctgggtactacagcagaagggtatgcggaagcgagcaccccagtctgagatggctcctgccggtgtgagcctgagggccaccatcctctgcctcctggcctgggctggcctggctgcaggtgaccgggtgtacatacaccccttccacctcgtcatccacaatgagagtacctgtgagcagctggcaaaggccaatgccgggaagcccaaagaccccaccttcatacctgctccaattcaggccaagacatcccctgtggatgaaaaggccctacaggaccagctggtgctagtcgctgcaaaacttgacaccgaagacaagttgagggccgcaatggtcgggatgctggccaacttcttgggcttccgtatatatggcatgcacagtgagctatggggcgtggtccatggggccaccgtcctctccccaacggctgtctttggcaccctggcctctctctatctgggagccttggaccacacagctgacaggctacaggcaatcctgggtgttccttggaaggacaagaactgcacctcccggctggatgcgcacaaggtcctgtctgccctgcaggctgtacagggcctgctagtggcccagggcagggctgatagccaggcccagctgctgctgtccacggtggtgggcgtgttcacagccccaggcctgcacctgaagcagccgtttgtgcagggcctggctctctatacccctgtggtcctcccacgctctctggacttcacagaactggatgttgctgctgagaagattgacaggttcatgcaggctgtgacaggatggaagactggctgctccctgacgggagccagtgtggacagcaccctggctttcaacacctacgtccacttccaagggaagatgaagggcttctccctgctggccgagccccaggagttctgggtggacaacagcacctcagtgtctgttcccatgctctctggcatgggcaccttccagcactggagtgacatccaggacaacttctcggtgactcaagtgcccttcactgagagcgcctgcctgctgctgatccagcctcactatgcctctgacctggacaaggtggagggtctcactttccagcaaaactccctcaactggatgaagaaactgtctccccggaccatccacctgaccatgccccaactggtgctgcaaggatcttatgacctgcaggacctgctcgcccaggctgagctgcccgccattctgcacaccgagctgaacctgcaaaaattgagcaatgaccgcatcagggtgggggaggtgctgaacagcattttttttgagcttgaagcggatgagagagagcccacagagtctacccaacagcttaacaagcctgaggtcttggaggtgaccctgaaccgcccattcctgtttgctgtgtatgatcaaagcgccactgccctgcacttcctgggccgcgtggccaacccgctgagcacagcatgaggccagggccccagaacacagtgcctggcaaggcctctgcccctggcctttgaggcaaaggccagcagcagataacaaccccggacaaatcagcgatgtgtcacccccagtctcccaccttttcttctaatgagtcgactttgagctggaaagcagccgtttctccttggtctaagtgtgctgcatggagtgagcagtagaagcctgcagcggcacaaatgcacctcccagtttgctgggtttattttagagaatgggggtggggaggcaagaaccagtgtttagcgcgggactactgttccaaaaagaattccaaccgaccagcttgtttgtgaaacaaaaaagtgttcccttttcaagttgagaacaaaaattgggttttaaaattaaagtatacatttttgcattgccttcggtttgtatttagtgtcttgaatgtaagaacatgacctccgtgtagtgtctgtaataccttagttttttccacagatgcttgtgatttttgaacaatacgtgaaagatgcaagcacctgaatttctgtttgaatgcggaacaatagctggttatttctcccttgtgttagtaataaacgtcttgccacaataa

SEQ ID NO: 295884 - DNA, 294 bp, Homo sapiens
  misc_feature (283)..(283): n is a, c, g, or t
gagctcggtacccaatcagtttacacaaaaaaaagtgttcccttttcaagttgagaacaaaaattgggttttaaaattaaagtatacatttttgcattgccttcggtttgtatttagtgtcttgaatgtaagaacatgacctccgtgtagtgtctgtaataccttagttttttccacagatgcttgtgatttttgaacaatacgtgaaagatgcaagcacctgaatttctgtttgaatgcggaacaatagctggttatttctcccttgtgtaaactgattggntccgagctcga

SEQ ID NO: 295885 - DNA, 317 bp, Homo sapiens
  misc_feature (30)..(30): n is a, c, g, or t
tctttttttgaatgtgagccaaagatttantccttcatttccttgcatttgaaatactcttcaatgacatccttggtctaagtgtgctgcatggagtgagcagtagaagcctgcagcggcacaaatgcacctcccagtttgctgggtttattttagagaatgggggtggggaggcaagaaccagtgtttagcgcgggactactgttccaaaaagaattccaaccgaccagcttgtttgtgaaacaaaaaagtgttcccttttcaagttgagaacaaaaattgggttttaaaattaaagtatacatttttgcattgcc

SEQ ID NO: 295886 - DNA, 842 bp, Homo sapiens
  misc_feature (1)..(1): n is a, c, g, or t
  misc_feature (12)..(13): n is a, c, g, or t
  misc_feature (20)..(20): n is a, c, g, or t
  misc_feature (32)..(32): n is a, c, g, or t
  misc_feature (842)..(842): n is a, c, g, or t
nttgctgctttnnccgggtncatggcatgtgncgacctcttggtcgagaggctcctgttgtgtccgacactgaggccaccatcctctgcctcctggcctgggctggcctggctgcaggtgaccgggtgtacatacaccccttccacctcgtcatccacaatgagagtacctgtgagcagctggcaaaggccaatgccgggaagcccaaagaccccaccttcatacctgctccaattcaggccaagacatcccctgtggatgaaaaggccctacaggaccttttttttgttttttggtggagaaggttgacaccgaatacaggtttggggggcggcccgggtcaatgaatctcccacaactgttgttgagaaaagagtaggggagggcatagcagagaagagtaatggagagagcggtgtaggggggatgacggcacgataggtaatatgagagagtgagagtaagagtgtgagtgtgtgaaaaagttgcgagagagaagaaaagagtgtaggttaggtatacggataactgatcgacacttggagtagtatgtagttgagggacaggacggaaggtgagggcggcagactgagtaattgggaaagaaaggtatcaatgattagtgtacggtgaacacgaaactacgaataagacacaatataactaacggcagtagttctttatatgattacacatgttaaatacaggaataaaggaatggaaggagaagagattcatggtggaacgactgagaggagtagaagagaacatgaagagagcgttatgtcgagaataaatgagaaagaataaatgaaatatagtattgagggaggcggggtgtn

SEQ ID NO: 295887 - DNA, 2029 bp, Homo sapiens
aagacttcctggaagaggtcccagcgtgagtgtcgcttctggcatctgtccttctggccagcctgtggtctggccaagtgatgtaaccctcctctccagcctgtgcacaggcagcctgggaacagctccatccccacccctcagctataaatagggcatcgtgacccggccagggaagaagctgccgttgttctgggtactacagcagaagggtatgcggaagcgagcaccccagtctgagatggctcctgccggtgtgagcctgagggccaccatcctctgcctcctggcctgggctggcctggctgcaggtgaccgggtgtacatacaccccttccacctcgtcatccacaatgagagtacctgtgagcagctggcaaaggccaatgccgggaagcccaaagaccccaccttcatacctgctccaattcaggccaagacatcccctgtggatgaaaaggccctacaggaccagctggtgctagtcgctgcaaaacttgacaccgaagacaagttgagggccgcaatggtcgggatgctggccaacttcttgggcttccgtatatatggcatgcacagtgagctatggggcgtggtccatggggccaccgtcctctccccaacggctgtctttggcaccctggcctctctctatctgggagccttggaccacacagctgacaggctacaggcaatcctgggtgttccttggaaggacaagaactgcacctcccggctggatgcgcacaaggtcctgtctgccctgcaggctgtacagggcctgctagtggcccagggcagggctgatagccaggcccagctgctgctgtccacggtggtgggcgtgttcacagccccaggcctgcacctgaagcagccgtttgtgcagggcctggctctctatacccctgtggtcctcccacgctctctggacttcacagaactggatgttgctgctgagaagattgacaggttcatgcaggctgtgacaggatggaagactggctgctccctgacgggagccagtgtggacagcaccctggctttcaacacctacgtccacttccaagggaagatgaagggcttctccctgctggccgagccccaggagttctgggtggacaacagcacctcagtgtctgttcccatgctctctggcatgggcaccttccagcactggagtgacatccaggacaacttctcggtgactcaagtgcccttcactgagagcgcctgcctgctgctgatccagcctcactatgcctctgacctggacaaggtggagggtctcactttccagcaaaactccctcaactggatgaagaaactgtctccccggaccatccacctgaccatgccccaactggtgctgcaaggatcttatgacctgcaggacctgctcgcccaggctgagctgcccgccattctgcacaccgagctgaacctgcatgagcttgaagcggatgagagagagcccacagagtctacccaacagcttaacaagcctgaggtcttggaggtgaccctgaaccgcccattcctgtttgctgtgtatgatcaaagcgccactgccctgcacttcctgggccgcgtggccaacccgctgagcacagcatgaggccagggccccagaacacagtgcctggcaaggcctctgcccctggcctttgaggcaaaggccagcagcagataacaaccccggacaaatcagcgatgtgtcacccccagtctcccaccttttcttctaatgagtcgactttgagctggaaagcagccgtttctccttggtctaagtgtgctgcatggagtgagcagtagaagcctgcagcggcacaaatgcacctcccagtttgctgggtttattttagagaatgggggtggggaggcaagaaccagtgtttagcgcgggactactgttccaaaaagaattccaaccgaccagcttgtttgtgaaacaaaaaagtgttcccttttcaagttgagaacaaaaattgggttttaaaattaaagtatacatttttgcattgcc

SEQ ID NO: 295888 - DNA, 2676 bp, Homo sapiens
aagacttcctggaagaggtcccagcgtgagtgtcgcttctggcatctgtccttctggccagcctgtggtctggccaagtgatgtaaccctcctctccagcctgtgcacaggcagcctgggaacagctccatccccacccctcagctataaatagggcatcgtgacccggccagggaagaagctgccgttgttctgggtactacagcagaagggtatgcggaagcgagcaccccagtctgagatggctcctgccggtgtgagcctgagggccaccatcctctgcctcctggcctgggctggcctggctgcaggtgaccgggtgtacatacaccccttccacctcgtcatccacaatgagagtacctgtgagcagctggcaaaggccaatgccgggaagcccaaagaccccaccttcatacctgctccaattcaggccaagacatcccctgtggatgaaaaggccctacaggaccagctggtgctagtcgctgcaaaacttgacaccgaagacaagttgagggccgcaatggtcgggatgctggccaacttcttgggcttccgtatatatggcatgcacagtgagctatggggcgtggtccatggggccaccgtcctctccccaacggctgtctttggcaccctggcctctctctatctgggagccttggaccacacagctgacaggctacaggcaatcctgggtgttccttggaaggacaagaactgcacctcccggctggatgcgcacaaggtcctgtctgccctgcaggctgtacagggcctgctagtggcccagggcagggctgatagccaggcccagctgctgctgtccacggtggtgggcgtgttcacagccccaggcctgcacctgaagcagccgtttgtgcagggcctggctctctatacccctgtggtcctcccacgctctctggacttcacagaactggatgttgctgctgagaagattgacaggttcatgcaggctgtgacaggatggaagactggctgctccctgacgggagccagtgtggacagcaccctggctttcaacacctacgtccacttccaagggaagatgaagggcttctccctgctggccgagccccaggagttctgggtggacaacagcacctcagtgtctgttcccatgctctctggcatgggcaccttccagcactggagtgacatccaggacaacttctcggtgactcaagtgcccttcactgagagcgcctgcctgctgctgatccagcctcactatgcctctgacctggacaaggtggagggtctcactttccagcaaaactccctcaactggatgaagaaactgtctccccggaccatccacctgaccatgccccaactggtgctgcaaggatcttatgacctgcaggacctgctcgcccaggctgagctgcccgccattctgcacaccgagctgaacctgcaaaaattgagcaatgaccgcatcagggtgggggaggtgctgaacagcattttttttgagcttgaagcggatgagagagagcccacagagtctacccaacagcttaacaagcctgaggtcttggaggtgaccctgaaccgcccattcctgtttgctgtgtatgatcaaagcgccactgccctgcacttcctgggccgcgtggccaacccgctgagcacagcatgaggccagggccccagaacacagtgcctggcaaggcctctgcccctggcctttgaggcaaaggccagcagcagataacaaccccggacaaatcagcgatgtgtcacccccagtctcccaccttttcttctaatgagtcgactttgagctggaaagcagccgtttctccttggtctaagtgtgctgcatggagtgagcagtagaagcctgcagcggcacaaatgcacctcccagtttgctgggtttattttagagaatgggggtggggaggcaagaaccagtgtttagcgcgggactactgttccaaaaagaattccaaccgaccagcttgtttgtgaaacaaaaaagtgttcccttttcaagttgagaacaaaaattgggttttaaaattaaagtatacatttttgcattgccttcggtttgtatttagtgtcttgaatgtaagaacatgacctccgtgtagtgtctgtaataccttagttttttccacagatgcttgtgatttttgaacaatacgtgaaagatgcaagcacctgaatttctgtttgaatgcggaacaatagctggttatttctcccttgtgttagtaataaacgtcttgccacaataagcctccaaaaaaattttatctttcatttagcagccaaacagatgtatacaattcagcagatagactgtgcaaacgaaagtgctttcctggactttggatggaatttccatgggaggtctgagccagtacttagcagtcctttgaagttttaggtgatgcttttctctggacacttccattggtaagcagtggtggccatctgtgtgatggacagggggcgggaagagggtgacagggaaggccccataccccatgtggcacctgggaaaggaaccaggcagatgggacttcttccgtcctggtgacacagggccagactgctgctggtattgtgccccgggagtggaaggtagagaaataaatcttcacaaataaatatttgcaattttcccccatc

SEQ ID NO: 295889 - DNA, 2276 bp, Homo sapiens
  misc_feature (2265)..(2265): n is a, c, g, or t
aagacttcctggaagaggtcccagcgtgagtgtcgcttctggcatctgtccttctggccagcctgtggtctggccaagtgatgtaaccctcctctccagcctgtgcacaggcagcctgggaacagctccatccccacccctcagctataaatagggcatcgtgacccggccagggaagaagctgccgttgttctgggtactacagcagaagggtatgcggaagcgagcaccccagtctgagatggctcctgccggtgtgagcctgagggccaccatcctctgcctcctggcctgggctggcctggctgcaggtgaccgggtgtacatacaccccttccacctcgtcatccacaatgagagtacctgtgagcagctggcaaaggccaatgccgggaagcccaaagaccccaccttcatacctgctccaattcaggccaagacatcccctgtggatgaaaaggccctacaggaccagctggtgctagtcgctgcaaaacttgacaccgaagacaagttgagggccgcaatggtcgggatgctggccaacttcttgggcttccgtatatatggcatgcacagtgagctatggggcgtggtccatggggccaccgtcctctccccaacggctgtctttggcaccctggcctctctctatctgggagccttggaccacacagctgacaggctacaggcaatcctgggtgttccttggaaggacaagaactgcacctcccggctggatgcgcacaaggtcctgtctgccctgcaggctgtacagggcctgctagtggcccagggcagggctgatagccaggcccagctgctgctgtccacggtggtgggcgtgttcacagccccaggcctgcacctgaagcagccgtttgtgcagggcctggctctctatacccctgtggtcctcccacgctctctggacttcacagaactggatgttgctgctgagaagattgacaggttcatgcaggctgtgacaggatggaagactggctgctccctgacgggagccagtgtggacagcaccctggctttcaacacctacgtccacttccaagggaagatgaagggcttctccctgctggccgagccccaggagttctgggtggacaacagcacctcagtgtctgttcccatgctctctggcatgggcaccttccagcactggagtgacatccaggacaacttctcggtgactcaagtgcccttcactgagagcgcctgcctgctgctgatccagcctcactatgcctctgacctggacaaggtggagggtctcactttccagcaaaactccctcaactggatgaagaaactgtctccccggaccatccacctgaccatgccccaactggtgctgcaaggatcttatgacctgcaggacctgctcgcccaggctgagctgcccgccattctgcacaccgagctgaacctgcaaaaattgagcaatgaccgcatcagggtgggggaggtgctgaacagcattttttttgagcttgaagcggatgagagagagcccacagagtctacccaacagcttaacaagcctgaggtcttggaggtgaccctgaaccgcccattcctgtttgctgtgtatgatcaaagcgccactgccctgcacttcctgggccgcgtggccaacccgctgagcacagcatgaggccagggccccagaacacagtgcctggcaaggcctctgcccctggcctttgaggcaaaggccagcagcagataacaaccccggacaaatcagcgatgtgtcacccccagtctcccaccttttcttctaatgagtcgactttgagctggaaagcagccgtttctccttggtctaagtgtgctgcatggagtgagcagtagaagcctgcagcggcacaaatgcacctcccagtttgctgggtttattttagagaatgggggtggggaggcaagaaccagtgtttagcgcgggactactgttccaaaaagaattccaaccgaccagcttgtttgtgaaacaaaaaagtgttcccttttcaagttgagaacaaaaattgggttttaaaattaaagtatacatttttgcattgccttcggtttgtatttagtgtcttgaatgtaagaacatgacctccgtgtagtgtctgtaataccttagttttttccacagatgcttgtgatttttgaacaatacgtgaaagatgcaagcacctgaatttctgtttgaatgcggaacaatagctggttatttctcccttgtgtaaactgattggntccgagctcga

SEQ ID NO: 295890 - DNA, 2622 bp, Homo sapiens
aagacttcctggaagaggtcccagcgtgagtgtcgcttctggcatctgtccttctggccagcctgtggtctggccaagtgatgtaaccctcctctccagcctgtgcacaggcagcctgggaacagctccatccccacccctcagctataaatagggcatcgtgacccggccagggaagaagctgccgttgttctgggtactacagcagaagggtatgcggaagcgagcaccccagtctgagatggctcctgccggtgtgagcctgagggccaccatcctctgcctcctggcctgggctggcctggctgcaggtgaccgggtgtacatacaccccttccacctcgtcatccacaatgagagtacctgtgagcagctggcaaaggccaatgccgggaagcccaaagaccccaccttcatacctgctccaattcaggccaagacatcccctgtggatgaaaaggccctacaggaccagctggtgctagtcgctgcaaaacttgacaccgaagacaagttgagggccgcaatggtcgggatgctggccaacttcttgggcttccgtatatatggcatgcacagtgagctatggggcgtggtccatggggccaccgtcctctccccaacggctgtctttggcaccctggcctctctctatctgggagccttggaccacacagctgacaggctacaggcaatcctgggtgttccttggaaggacaagaactgcacctcccggctggatgcgcacaaggtcctgtctgccctgcaggctgtacagggcctgctagtggcccagggcagggctgatagccaggcccagctgctgctgtccacggtggtgggcgtgttcacagccccaggcctgcacctgaagcagccgtttgtgcagggcctggctctctatacccctgtggtcctcccacgctctctggacttcacagaactggatgttgctgctgagaagattgacaggttcatgcaggctgtgacaggatggaagactggctgctccctgacgggagccagtgtggacagcaccctggctttcaacacctacgtccacttccaagggaagatgaagggcttctccctgctggccgagccccaggagttctgggtggacaacagcacctcagtgtctgttcccatgctctctggcatgggcaccttccagcactggagtgacatccaggacaacttctcggtgactcaagtgcccttcactgagagcgcctgcctgctgctgatccagcctcactatgcctctgacctggacaaggtggagggtctcactttccagcaaaactccctcaactggatgaagaaactgtctccccggaccatccacctgaccatgccccaactggtgctgcaaggatcttatgacctgcaggacctgctcgcccaggctgagctgcccgccattctgcacaccgagctgaacctgcaaaaattgagcaatgaccgcatcagggtgggggaggtgctgaacagcattttttttgagcttgaagcggatgagagagagcccacagagtctacccaacagcttaacaagcctgaggtcttggaggtgaccctgaaccgcccattcctgtttgctgtgtatgatcaaagcgccactgccctgcacttcctgggccgcgtggccaacccgctgagcacagcatgaggccagggccccagaacacagtgcctggcaaggcctctgcccctggcctttgaggcaaaggccagcagcagataacaaccccggacaaatcagcgatgtgtcacccccagtctcccaccttttcttctaatgagtcgactttgagctggaaagcagccgtttctccttggtctaagtgtgctgcatggagtgagcagtagaagcctgcagcggcacaaatgcacctcccagtttgctgggtttattttagagaatgggggtggggaggcaagaaccagtgtttagcgcgggactactgttccaaaaagaattccaaccgaccagcttgtttgtgaaacaaaaaagtgttcccttttcaagttgagaacaaaaattgggtttttgtaagaacatgacctccgtgtagtgtctgtaataccttagttttttccacagatgcttgtgatttttgaacaatacgtgaaagatgcaagcacctgaatttctgtttgaatgcggaacaatagctggttatttctcccttgtgttagtaataaacgtcttgccacaataagcctccaaaaaaattttatctttcatttagcagccaaacagatgtatacaattcagcagatagactgtgcaaacgaaagtgctttcctggactttggatggaatttccatgggaggtctgagccagtacttagcagtcctttgaagttttaggtgatgcttttctctggacacttccattggtaagcagtggtggccatctgtgtgatggacagggggcgggaagagggtgacagggaaggccccataccccatgtggcacctgggaaaggaaccaggcagatgggacttcttccgtcctggtgacacagggccagactgctgctggtattgtgccccgggagtggaaggtagagaaataaatcttcacaaataaatatttgcaattttcccccatc

SEQ ID NO: 295891 - DNA, 2228 bp, Homo sapiens
aagacttcctggaagaggtcccagcgtgagtgtcgcttctggcatctgtccttctggccagcctgtggtctggccaagtgatgtaaccctcctctccagcctgtgcacaggcagcctgggaacagctccatccccacccctcagctataaatagggcatcgtgacccggccagggaagaagctgccgttgttctgggtactacagcagaagggtatgcggaagcgagcaccccagtctgagatggctcctgccggtgtgagcctgagggccaccatcctctgcctcctggcctgggctggcctggctgcaggtgaccgggtgtacatacaccccttccacctcgtcatccacaatgagagtacctgtgagcagctggcaaaggccaatgccgggaagcccaaagaccccaccttcatacctgctccaattcaggccaagacatcccctgtggatgaaaaggccctacaggaccagctggtgctagtcgctgcaaaacttgacaccgaagacaagttgagggccgcaatggtcgggatgctggccaacttcttgggcttccgtatatatggcatgcacagtgagctatggggcgtggtccatggggccaccgtcctctccccaacggctgtctttggcaccctggcctctctctatctgggagccttggaccacacagctgacaggctacaggcaatcctgggtgttccttggaaggacaagaactgcacctcccggctggatgcgcacaaggtcctgtctgccctgcaggctgtacagggcctgctagtggcccagggcagggctgatagccaggcccagctgctgctgtccacggtggtgggcgtgttcacagccccaggcctgcacctgaagcagccgtttgtgcagggcctggctctctatacccctgtggtcctcccacgctctctggacttcacagaactggatgttgctgctgagaagattgacaggttcatgcaggctgtgacaggatggaagactggctgctccctgacgggagccagtgtggacagcaccctggctttcaacacctacgtccacttccaagggaagatgaagggcttctccctgctggccgagccccaggagttctgggtggacaacagcacctcagtgtctgttcccatgctctctggcatgggcaccttccagcactggagtgacatccaggacaacttctcggtgactcaagtgcccttcactgagagcgcctgcctgctgctgatccagcctcactatgcctctgacctggacaaggtggagggtctcactttccagcaaaactccctcaactggatgaagaaactgtctccccggaccatccacctgaccatgccccaactggtgctgcaaggatcttatgacctgcaggacctgctcgcccaggctgagctgcccgccattctgcacaccgagctgaacctgcaaaaattgagcaatgaccgcatcagggtgggggaggtgctgaacagcattttttttgagcttgaagcggatgagagagagcccacagagtctacccaacagcttaacaagcctgaggtcttggaggtgaccctgaaccgcccattcctgtttgctgtgtatgatcaaagcgccactgccctgcacttcctgggccgcgtggccaacccgctgagcacagcatgaggccagggccccagaacacagtgcctggcaaggcctctgcccctggcctttgaggccagtctcccaccttttcttctaatgagtcgactttgagctggaaagcagccgtttctccttggtctaagtgtgctgcatggagtgagcagtagaagcctgcagcggcacaaatgcacctcccagtttgctgggtttattttagagaatgggggtggggaggcaagaaccagtgtttagcgcgggactactgttccaaaaagaattccaaccgaccagcttgtttgtgaaacaaaaaagtgttcccttttcaagttgagaacaaaaattgggttttaaaattaaagtatacatttttgcattgccttcggtttgtatttagtgtcttgaatgtaagaacatgacctccgtgtagtgtctgtaataccttagttttttccacagatgcttgtgatttttgaacaatacgtgaaagatgcaagcacctgaatttctgtttgaatgcggaacaatagctggttatttctcccttgtgttagtaataaacgtcttgccacaataa

SEQ ID NO: 295892 - DNA, 1915 bp, Homo sapiens
gacccacgcgtccgcggacgcgtggggggtactacagcagaagggtatgcggaagcgagcaccccagtctgagatggctcctgccggtgtgagcctgagggccaccatcctctgcctcctggcctgggctggcctggctgcaggtgaccgggtgtacatacaccccttccacctcgtcatccacaatgagagtacctgtgagcagctggcaaaggccaatgccgggaagcccaaagaccccaccttcatacctgctccaattcaggccaagacatcccctgtggatgaaaaggccctacaggaccagctggtgctagtcgctgcaaaacttgacaccgaagacaagttgagggccgcaatggtcgggatgctggccaacttcttgggcttccgtatatatggcatgcacagtgagctatggggcgtggtccatggggccaccgtcctctccccaacggctgtctttggcaccctggcctctctctatctgggagccttggaccacacagctgacaggctacaggcaatcctgggtgttccttggaaggacaagaactgcacctcccggctggatgcgcacaaggtcctgtctgccctgcaggctgtacagggcctgctagtggcccagggcagggctgatagccaggcccagctgctgctgtccacggtggtgggcgtgttcacagccccaggcctgcacctgaagcagccgtttgtgcagggcctggctctctatacccctgtggtcctcccacgctctctggacttcacagaactggatgttgctgctgagaagattgacaggttcatgcaggctgtgacaggatggaagactggctgctccctgacgggagccagtgtggacagcaccctggctttcaacacctacgtccacttccaagggaagatgaagggcttctccctgctggccgagccccaggagttctgggtggacaacagcacctcagtgtctgttcccatgctctctggcatgggcaccttccagcactggagtgacatccaggacaacttctcggtgactcaagtgcccttcactgagagcgcctgcctgctgctgatccagcctcactatgcctctgacctggacaaggtggagggtctcactttccagcaaaactccctcaactggatgaagaaactgtctccccggaccatccacctgaccatgccccaactggtgctgcaaggatcttatgacctgcaggacctgctcgcccaggctgagctgcccgccattctgcacaccgagctgaacctgcaaaaattgagcaatgaccgcatcagggtgggggaggtgctgaacagcattttttttgagcttgaagcggatgagagagagcccacagagtctacccaacagcttaacaagcctgaggtcttggaggtgaccctgaaccgcccattcctgtttgctgtgtatgatcaaagcgccactgccctgcacttcctgggccgcgtggccaacccgctgagcacagcatgaggccagggccccagaacacagtgcctggcaaggcctctgcccctggcctttgaggcaaaggccagcagcagataacaaccccggacaaatcagcgatgtgtcacccccagtctcccaccttttcttctaatgagtcgactttgagctggaaagcagccgtttctccttggtctaagtgtgctgcatggagtgagcagtagaagcctgcagcggcacaaatgcacctcccagtttgctgggtttattttagagaatgggggtggggaggcaagaaccagtgtttagcgcgggactactgttccaaaaagaattccaaccgaccagcttgtttgtgaaacaaaaaagtgttcccttttcaagttgagaacaaaaattgggttttaaaattaaagtatacatttttgcattgcc

SEQ ID NO: 295893 - DNA, 2029 bp, Homo sapiens
aagacttcctggaagaggtcccagcgtgagtgtcgcttctggcatctgtccttctggccagcctgtggtctggccaagtgatgtaaccctcctctccagcctgtgcacaggcagcctgggaacagctccatccccacccctcagctataaatagggcatcgtgacccggccagggaagaagctgccgttgttctgggtactacagcagaagggtatgcggaagcgagcaccccagtctgagatggctcctgccggtgtgagcctgagggccaccatcctctgcctcctggcctgggctggcctggctgcaggtgaccgggtgtacatacaccccttccacctcgtcatccacaatgagagtacctgtgagcagctggcaaaggccaatgccgggaagcccaaagaccccaccttcatacctgctccaattcaggccaagacatcccctgtggatgaaaaggccctacaggaccagctggtgctagtcgctgcattcttgggcttccgtatatatggcatgcacagtgagctatggggcgtggtccatggggccaccgtcctctccccaacggctgtctttggcaccctggcctctctctatctgggagccttggaccacacagctgacaggctacaggcaatcctgggtgttccttggaaggacaagaactgcacctcccggctggatgcgcacaaggtcctgtctgccctgcaggctgtacagggcctgctagtggcccagggcagggctgatagccaggcccagctgctgctgtccacggtggtgggcgtgttcacagccccaggcctgcacctgaagcagccgtttgtgcagggcctggctctctatacccctgtggtcctcccacgctctctggacttcacagaactggatgttgctgctgagaagattgacaggttcatgcaggctgtgacaggatggaagactggctgctccctgacgggagccagtgtggacagcaccctggctttcaacacctacgtccacttccaagggaagatgaagggcttctccctgctggccgagccccaggagttctgggtggacaacagcacctcagtgtctgttcccatgctctctggcatgggcaccttccagcactggagtgacatccaggacaacttctcggtgactcaagtgcccttcactgagagcgcctgcctgctgctgatccagcctcactatgcctctgacctggacaaggtggagggtctcactttccagcaaaactccctcaactggatgaagaaactgtctccccggaccatccacctgaccatgccccaactggtgctgcaaggatcttatgacctgcaggacctgctcgcccaggctgagctgcccgccattctgcacaccgagctgaacctgcaaaaattgagcaatgaccgcatcagggtgggggaggtgctgaacagcattttttttgagcttgaagcggatgagagagagcccacagagtctacccaacagcttaacaagcctgaggtcttggaggtgaccctgaaccgcccattcctgtttgctgtgtatgatcaaagcgccactgccctgcacttcctgggccgcgtggccaacccgctgagcacagcatgaggccagggccccagaacacagtgcctggcaaggcctctgcccctggcctttgaggcaaaggccagcagcagataacaaccccggacaaatcagcgatgtgtcacccccagtctcccaccttttcttctaatgagtcgactttgagctggaaagcagccgtttctccttggtctaagtgtgctgcatggagtgagcagtagaagcctgcagcggcacaaatgcacctcccagtttgctgggtttattttagagaatgggggtggggaggcaagaaccagtgtttagcgcgggactactgttccaaaaagaattccaaccgaccagcttgtttgtgaaacaaaaaagtgttcccttttcaagttgagaacaaaaattgggttttaaaattaaagtatacatttttgcattgcc

SEQ ID NO: 295894 - DNA, 2216 bp, Homo sapiens
tcaccctcatggcctcatttaaacttaaccatctcttttaaagatcctgtctccaaataatggtcacattctgaggtcctggggttgaggacttcaacacgggcattatggccgttgggggaggtaggacataattcagctgatattggtgcattttgcacttggatcatgtagatattttccatggagctttgaatccatttcttcttttttttgtagacatgaatggatttattctgggctaaatggtgacagggaatattgagacaatgaaagatctggttagatggcacttaaaggtcagttaataaccacctttcaccctttgcaaaatgatatttcagggtatgcggaagcgagcaccccagtctgagatggctcctgccggtgtgagcctgagggccaccatcctctgcctcctggcctgggctggcctggctgcaggtgaccgggtgtacatacaccccttccacctcgtcatccacaatgagagtacctgtgagcagctggcaaaggccaatgccgggaagcccaaagaccccaccttcatacctgctccaattcaggccaagacatcccctgtggatgaaaaggccctacaggaccagctggtgctagtcgctgcaaaacttgacaccgaagacaagttgagggccgcaatggtcgggatgctggccaacttcttgggcttccgtatatatggcatgcacagtgagctatggggcgtggtccatggggccaccgtcctctccccaacggctgtctttggcaccctggcctctctctatctgggagccttggaccacacagctgacaggctacaggcaatcctgggtgttccttggaaggacaagaactgcacctcccggctggatgcgcacaaggtcctgtctgccctgcaggctgtacagggcctgctagtggcccagggcagggctgatagccaggcccagctgctgctgtccacggtggtgggcgtgttcacagccccaggcctgcacctgaagcagccgtttgtgcagggcctggctctctatacccctgtggtcctcccacgctctctggacttcacagaactggatgttgctgctgagaagattgacaggttcatgcaggctgtgacaggatggaagactggctgctccctgacgggagccagtgtggacagcaccctggctttcaacacctacgtccacttccaagggaagatgaagggcttctccctgctggccgagccccaggagttctgggtggacaacagcacctcagtgtctgttcccatgctctctggcatgggcaccttccagcactggagtgacatccaggacaacttctcggtgactcaagtgcccttcactgagagcgcctgcctgctgctgatccagcctcactatgcctctgacctggacaaggtggagggtctcactttccagcaaaactccctcaactggatgaagaaactgtctccccggaccatccacctgaccatgccccaactggtgctgcaaggatcttatgacctgcaggacctgctcgcccaggctgagctgcccgccattctgcacaccgagctgaacctgcaaaaattgagcaatgaccgcatcagggtgggggaggtgctgaacagcattttttttgagcttgaagcggatgagagagagcccacagagtctacccaacagcttaacaagcctgaggtcttggaggtgaccctgaaccgcccattcctgtttgctgtgtatgatcaaagcgccactgccctgcacttcctgggccgcgtggccaacccgctgagcacagcatgaggccagggccccagaacacagtgcctggcaaggcctctgcccctggcctttgaggcaaaggccagcagcagataacaaccccggacaaatcagcgatgtgtcacccccagtctcccaccttttcttctaatgagtcgactttgagctggaaagcagccgtttctccttggtctaagtgtgctgcatggagtgagcagtagaagcctgcagcggcacaaatgcacctcccagtttgctgggtttattttagagaatgggggtggggaggcaagaaccagtgtttagcgcgggactactgttccaaaaagaattccaaccgaccagcttgtttgtgaaacaaaaaagtgttcccttttcaagttgagaacaaaaattgggttttaaaattaaagtatacatttttgcattgcc

SEQ ID NO: 295895 - DNA, 1845 bp, Homo sapiens
aagacttcctggaagaggtcccagcgtgagtgtcgcttctggcatctgtccttctggccagcctgtggtctggccaagtgatgtaaccctcctctccagcctgtgcacaggcagcctgggaacagctccatccccacccctcagctataaatagggcatcgtgacccggccagggaagaagctgccgttgttctgggtactacagcagaagggtatgcggaagcgagcaccccagtctgagatggctcctgccggtgtgagcctgagggccaccatcctctgcctcctggcctgggctggcctggctgcaggtgaccgggtgtacatacaccccttccacctcgtcatccacaatgagagtacctgtgagcagctggcaaaggccaatgccgggaagcccaaagaccccaccttcatacctgctccaattcaggccaagacatcccctgtggatgaaaaggccctacaggaccagctggtgctagtcgctgcaaaacttgacaccgaagacaagttgagggccgcaatggtcgggatgctggccaacttcttgggcttccgtatatatggcatgcacagtgagctatggggcgtggtccatggggccaccgtcctctccccaacggctgtctttggcaccctggcctctctctatctgggagccttggaccacacagctgacaggctacaggcaatcctgggtgttccttggaaggacaagaactgcacctcccggctggatgcgcacaaggtcctgtctgccctgcaggctgtacagggcctgctagtggcccagggcagggctgatagccaggcccagctgctgctgtccacggtggtgggcgtgttcacagccccaggcctgcacctgaagcagccgtttgtgcagggcctggctctctatacccctgtggtcctcccacgctctctggacttcacagaactggatgttgctgctgagaagattgacaggttcatgcaggctgtgacaggatggaagactggctgctccctgacgggagccagtgtggacagcaccctggctttcaacacctacgtccacttccaagggaagatgaagggcttctccctgctggccgagccccaggagttctgggtggacaacagcacctcagtgtctgttcccatgctctctggcatgggcaccttccagcactggagtgacatccaggacaacttctcggtgactcaagtgcccttcactgagagcgcctgcctgctgctgatccagcctcactatgcctctgacctggacaaggtggagggtctcactttccagcaaaactccctcaactggatgaagaaactgtctccccggaccatccacctgaccatgccccaactggtgctgcaaggatcttatgacctgcaggacctgctcgcccaggctgagctgcccgccattctgcacaccgagctgaacctgcaaaaattgagcaatgaccgcatcagggtgggggaggtgctgaacagcattttttttgagcttgaagcggatgagagagagcccacagagtctacagtctcccaccttttcttctaatgagtcgactttgagctggaaagcagccgtttctccttggtctaagtgtgctgcatggagtgagcagtagaagcctgcagcggcacaaatgcacctcccagtttgctgggtttattttagagaatgggggtggggaggcaagaaccagtgtttagcgcgggactactgttccaaaaagaattccaaccgaccagcttgtttgtgaaacaaaaaagtgttcccttttcaagttgagaacaaaaattgggttttaaaattaaagtatacatttttgcattgcc

SEQ ID NO: 295896 - DNA, 1037 bp, Homo sapiens
ccctgtctcctgtctggatttcagggaagatgaagggcttctccctgctggccgagccccaggagttctgggtggacaacagcacctcagtgtctgttcccatgctctctggcatgggcaccttccagcactggagtgacatccaggacaacttctcggtgactcaagtgcccttcactgagagcgcctgcctgctgctgatccagcctcactatgcctctgacctggacaaggtggagggtctcactttccagcaaaactccctcaactggatgaagaaactgtctccccggaccatccacctgaccatgccccaactggtgctgcaaggatcttatgacctgcaggacctgctcgcccaggctgagctgcccgccattctgcacaccgagctgaacctgcaaaaattgagcaatgaccgcatcagggtgggggaggtgctgaacagcattttttttgagcttgaagcggatgagagagagcccacagagtctacccaacagcttaacaagcctgaggtcttggaggtgaccctgaaccgcccattcctgtttgctgtgtatgatcaaagcgccactgccctgcacttcctgggccgcgtggccaacccgctgagcacagcatgaggccagggccccagaacacagtgcctggcaaggcctctgcccctggcctttgaggcaaaggccagcagcagataacaaccccggacaaatcagcgatgtgtcacccccagtctcccaccttttcttctaatgagtcgactttgagctggaaagcagccgtttctccttggtctaagtgtgctgcatggagtgagcagtagaagcctgcagcggcacaaatgcacctcccagtttgctgggtttattttagagaatgggggtggggaggcaagaaccagtgtttagcgcgggactactgttccaaaaagaattccaaccgaccagcttgtttgtgaaacaaaaaagtgttcccttttcaagttgagaacaaaaattgggttttaaaattaaagtatacatttttgcattgcc

SEQ ID NO: 295897 - DNA, 781 bp, Homo sapiens
  misc_feature (2)..(2): n is a, c, g, or t
anttcggcacagctggatgaagaaactgtctccccggaccatccacctgaccatgccccaactggtgctgcaaggatcttatgacctgcaggacctgctcgcccaggctgagctgcccgccattctgcacaccgagctgaacctgcaaaaattgagcaatgaccgcatcagggtgggggaggtgctgaacagcattttttttgagcttgaagcggatgagagagagcccacagagtctacccaacagcttaacaagcctgaggtcttggaggtgaccctgaaccgcccattcctgtttgctgtgtatgatcaaagcgccactgccctgcacttcctgggccgcgtggccaacccgctgagcacagcatgaggccagggccccagaacacagtgcctggcaaggcctctgcccctggcctttgaggcaaaggccagcagcagataacaaccccggacaaatcagcgatgtgtcacccccagtctcccaccttttcttctaatgagtcgactttgagctggaaagcagccgtttctccttggtctaagtgtgctgcatggagtgagcagtagaagcctgcagcggcacaaatgcacctcccagtttgctgggtttattttagagaatgggggtggggaggcaagaaccagtgtttagcgcgggactactgttccaaaaagaattccaaccgaccagcttgtttgtgaaacaaaaaagtgttcccttttcaagttgagaacaaaaattgggttttaaaattaaagtatacatttttgcattgcc

SEQ ID NO: 295898 - DNA, 1144 bp, Homo sapiens
aagacttcctggaagaggtcccagcgtgagtgtcgcttctggcatctgtccttctggccagcctgtggtctggccaagtgatgtaaccctcctctccagcctgtgcacaggcagcctgggaacagctccatccccacccctcagctataaatagggcatcgtgacccggccagggaagaagctgccgttgttctgggtactacagcagaagggtatgcggaagcgagcaccccagtctgagatggctcctgccggtgtgagcctgagggccaccatcctctgcctcctggcctgggctggcctggctgcaggtgaccgggtgtacatacaccccttccacctcgtcatccacaatgagagtacctgtgagcagctggcaaaggccaatgccgggaagcccaaagaccccaccttcatacctgctccaattcaggccaagacatcccctgtggatgaaaaggccctacaggaccagctggtgctagtcgctgcaaaacttgacaccgaagacaagttgagggccgcaatggtcgggatgctggccaacttcttgggcttccgtatatatggcatgcacagtgagctatggggcgtggtccatggggccaccgtcctctccccaacggctgtctttggcaccctggcctctctctatctgggagccttggaccacacagctgacaggctacaggcaatcctgggccgcgtggccaacccgctgagcacagcatgaggccagggccccagaacacagtgcctggcaaggcctctgcccctggcctttgaggcaaaggccagcagcagataacaaccccggacaaatcagcgatgtgtcacccccagtctcccaccttttcttctaatgagtcgactttgagctggaaagcagccgtttctccttggtctaagtgtgctgcatggagtgagcagtagaagcctgcagcggcacaaatgcacctcccagtttgctgggtttattttagagaatgggggtggggaggcaagaaccagtgtttagcgcgggactactgttccaaaaagaattccaaccgaccagcttgtttgtgaaacaaaaaagtgttcccttttcaagttgagaacaaaaattgggttttaaaattaaagtatacatttttgcattgcc

SEQ ID NO: 295899 - DNA, 1069 bp, Homo sapiens
tcttcaagttctattttttaatcattcatacagccataacatgcatactagtcgaatatgagccttggataagggattagggtagataagcagcagagtggagtcctgaggtgacataagggctgaccccttatccatgtcatagtgcccactgggtcacaatgccaccaggttgcctaaacctctgccacccacctgtgaacttcactttgccacagggaggcactgaactgaaaaactgccttgtaagaggtgtcgcccctctgtctactccctttcttatatcaagaggggaaaaacacgtaactacctctacccgatctggtcaccatacgcctattacctttactgttacaagtaccggatcactctccgggagaagatgctgcctcgttgttataaaagcatcacttataaggaagaggaggacttgacactccagccccgttcctgcctccagtgctcctgagtccctagtaggcctccaggagggcaaaagcaccgagcagggtaaccacgaccagcttaaagaactgtattcggctgggaacttgacggtgctggctactgaccccctgctccaccaggacccagtacagttagactttcacttccgccttacctcccagacctctgcccattggcacggccttctctgtgaccgtcgactcttcctggatatcccatatcaggccttggatcaaggcaaccgggaaagtttgactgcaaccctggagtacgtggaagagaagacaaatgtggactctgtgtttgtgaacttccagaatgatcggaacgacagaggtgccctgctgcgggccttcagctacatgggctttgaggtggtcagaccagatcaccctgccctccctcccttggacaatgtcatctttatggtgtatccccttgaaagggatgttggccacctgcccagtgagcctccttgaacatgcttattccaacgctttgaggggctggaagccttgacacatggaatcaggggcccgggatgtgattcaggacactttccatcctaggaataaagggtagtgcaatcaaaaaaaaaaaa

SEQ ID NO: 295900 - DNA, 846 bp, Homo sapiens
cggccgcagtagctcctggacgcctccccgaagcagccgtccagcgcccgcccgcagcagagctctgcccggggccgtgacaacgggcgccgccatgttcacaggcacagaatgagacctgagggaggaccccggcgtcggcggcaggaaaggcccccgccagtgctgcctgcggcgcgccgcatcacttataaggaagaggaggacttgacactccagccccgttcctgcctccagtgctcctgagtccctagtaggcctccaggagggcaaaagcaccgagcagggtaaccacgaccagcttaaagaactgtattcggctgggaacttgacggtgctggctactgaccccctgctccaccaggacccagtacagttagactttcacttccgccttacctcccagacctctgcccattggcacggccttctctgtgaccgtcgactcttcctggatatcccatatcaggccttggatcaaggcaaccgggaaagtttgactgcaaccctggagtacgtggaagagaagacaaatgtggactctgtgtttgtgaacttccagaatgatcggaacgacagaggtgccctgctgcgggccttcagctacatgggctttgaggtggtcagaccagatcaccctgccctccctcccttggacaatgtcatctttatggtgtatccccttgaaagggatgttggccacctgcccagtgagcctccttgaacatgcttattccaacgctttgaggggctggaagccttgacacatggaatcaggggcccgggatgtgattcaggacactttccatcctaggaataaagggtagtgcaatcaaaaaaaaaaaa

SEQ ID NO: 295901 - DNA, 824 bp, Homo sapiens
ggatgagctccaggttttctttgggccgatgcttcgtgtcctccaccagcttatagacgcggtgtcgccggtgcaggcgcggcttccggccctccccggccagcggtaccttccaccagcgctccacgatgaccgtgccctggcggccaggaaagcgacgcatcacttataaggaagaggaggacttgacactccagccccgttcctgcctccagtgctcctgagtccctagtaggcctccaggagggcaaaagcaccgagcagggtaaccacgaccagcttaaagaactgtattcggctgggaacttgacggtgctggctactgaccccctgctccaccaggacccagtacagttagactttcacttccgccttacctcccagacctctgcccattggcacggccttctctgtgaccgtcgactcttcctggatatcccatatcaggccttggatcaaggcaaccgggaaagtttgactgcaaccctggagtacgtggaagagaagacaaatgtggactctgtgtttgtgaacttccagaatgatcggaacgacagaggtgccctgctgcgggccttcagctacatgggctttgaggtggtcagaccagatcaccctgccctccctcccttggacaatgtcatctttatggtgtatccccttgaaagggatgttggccacctgcccagtgagcctccttgaacatgcttattccaacgctttgaggggctggaagccttgacacatggaatcaggggcccgggatgtgattcaggacactttccatcctaggaataaagggtagtgcaatcaaaaaaaaaaaa

SEQ ID NO: 295902 - DNA, 517 bp, Homo sapiens
tcttcaagttctattttttaatcattcatacagccataacatgcatactagtcgaatatgagccttggataagggattagggtagataagcagcagagtggagtcctgaggtgacataagggctgaccccttatccatgtcatagtgcccactgggtcacaatgccaccaggttgcctaaacctctgccacccacctgtgaacttcactttgccacagggaggcactgaactgaaaaactgccttgtaagaggtgtcgcccctctgtctactccctttcttatatcaagaggggaaaaacacgtaactacctctacccgatctggtcaccatacgcctattacctttactgttacaagtaccggatcactctccgggagaagatgctgcctcgttgttataaaaggtacttgttttcatctctatttgtagttgtttatataaaatgtaaggaaaaagtaaaagaatttgaaagaatttcccaaatggcaagaaataacaacagaatagggggtgga

SEQ ID NO: 295903 - DNA, 584 bp, Homo sapiens
tcttcaagttctattttttaatcattcatacagccataacatgcatactagtcgaatatgagccttggataagggattagggtagataagcagcagagtggagtcctgaggtgacataagggctgaccccttatccatgtcatagtgcccactgggtcacaatgccaccaggttgcctaaacctctgccacccacctgtgaacttcactttgccacagggaggcactgaactgaaaaactgccttgtaagaggtgtcgcccctctgtctactccctttcttatatcaagaggggaaaaacacgtaactacctctacccgatctggtcaccatacgcctattacctttactgttacaagtaccggatcactctccgggagaagatgctgcctcgttgttataaaagcatcacttataaggaagaggaggacttgacactccagccccgttcctgcctccttgaacatgcttattccaacgctttgaggggctggaagccttgacacatggaatcaggggcccgggatgtgattcaggacactttccatcctaggaataaagggtagtgcaatcaaaaaaaaaaaa

SEQ ID NO: 295904 - DNA, 369 bp, Homo sapiens
cggccgcagtagctcctggacgcctccccgaagcagccgtccagcgcccgcccgcagcagagctctgcccggggccgtgacaacgggcgccgccatgttcacaggcacagaatgagacccagacctctgcccattggcacggccttctctgtgaccgtcgactcttcctggatatcccatatcaggccttggatcaaggcaaccgggaaagctcccggacggggcagctgccgggcggagacgcccctcacttcccagacgaggcggctgccgggcggaggggctcctcacttctcagacagggcggacgggcagagatgctcctcacctcccagatggggtcgcggctgggcagagacactcctcagt

SEQ ID NO: 295905 - DNA, 289 bp, Homo sapiens
cggccgcagtagctcctggacgcctccccgaagcagccgtccagcgcccgcccgcagcagagctctgcccggggccgtgacaacgggcgccgccatgttcacaggcacagaatgagacctgagggaggaccccggcgtcggcggcaggaaaggcccccgccagtgctgcctgcggcgcgccggtacggctgagcgaaagtatggggagcgggccggggaacagatggcaccgcggcttgcctatttttgctttttggcagaggtgacggacgcctagaattactgactg

SEQ ID NO: 295906 - DNA, 647 bp, Homo sapiens
attcggcacgagcggcacgagcccgttcctgcctccagtgctcctgagtccctagtaggcctccaggagggcaaaagcaccgagcagggtaaccacgaccagcttaaagaactgtattcggctgggaacttgacggtgctggctactgaccccctgctccaccaggacccagtacagttagactttcacttccgccttacctcccagacctctgcccattggcacggccttctctgtgaccgtcgactcttcctggatatcccatatcaggccttggatcaaggcaaccgggaaagtttgactgcaaccctggagtacgtggaagagaagacaaatgtggactctgtgtttgtgaacttccagaatgatcggaacgacagaggtgccctgctgcgggccttcagctacatgggctttgaggtggtcagaccagatcaccctgccctccctcccttggacaatgtcatctttatggtgtatccccttgaaagggatgttggccacctgcccagtgagcctccttgaacatgcttattccaacgctttgaggggctggaagccttgacacatggaatcaggggcccgggatgtgattcaggacactttccatcctaggaataaagggtagtgcaatcaaaaaaaaaaaa

SEQ ID NO: 295907 - DNA, 986 bp, Homo sapiens
tcttcaagttctattttttaatcattcatacagccataacatgcatactagtcgaatatgagccttggataagggattagggtagataagcagcagagtggagtcctgaggtgacataagggctgaccccttatccatgtcatagtgcccactgggtcacaatgccaccaggttgcctaaacctctgccacccacctgtgaacttcactttgccacagggaggcactgaactgaaaaactgccttgtaagaggtgtcgcccctctgtctactccctttcttatatcaagaggggaaaaacacgtaactacctctacccgatctggtcaccatacgcctattacctttactgttacaagtaccggatcactctccgggagaagatgctgcctcgttgttataaaagcatcacttataaggaagaggaggacttgacactccagccccgttcctgcctccagtgctcctgagtccctagtaggcctccaggagggcaaaagcaccgagcagggtaaccacgaccagcttaaagaactgtattcgccagacctctgcccattggcacggccttctctgtgaccgtcgactcttcctggatatcccatatcaggccttggatcaaggcaaccgggaaagtttgactgcaaccctggagtacgtggaagagaagacaaatgtggactctgtgtttgtgaacttccagaatgatcggaacgacagaggtgccctgctgcgggccttcagctacatgggctttgaggtggtcagaccagatcaccctgccctccctcccttggacaatgtcatctttatggtgtatccccttgaaagggatgttggccacctgcccagtgagcctccttgaacatgcttattccaacgctttgaggggctggaagccttgacacatggaatcaggggcccgggatgtgattcaggacactttccatcctaggaataaagggtagtgcaatcaaaaaaaaaaaa

SEQ ID NO: 295908 - DNA, 1006 bp, Homo sapiens
tcttcaagttctattttttaatcattcatacagccataacatgcatactagtcgaatatgagccttggataagggattagggtagataagcagcagagtggagtcctgaggtgacataagggctgaccccttatccatgtcatagtgcccactgggtcacaatgccaccaggttgcctaaacctctgccacccacctgtgaacttcactttgccacagggaggcactgaactgaaaaactgccttgtaagaggtgtcgcccctctgtctactccctttcttatatcaagaggggaaaaacacgtaactacctctacccgatctggtcaccatacgcctattacctttactgttacaagtaccggatcactctccgggagaagatgctgcctcgttgttataaaagcatcacttataaggaagaggaggacttgacactccagccccgttcctgcctccagtgctcctgagtccctagtaggcctccaggagggcaaaagcaccgagcagggtaaccacgaccagcttaaagaactgtattcggctgggaacttgacggtgctggctactgaccccctgctccaccaggacccagtacagttagactttcacttccgccttacctcccagacctctgcccattggcacggccttctctgtgaccgtcgactcttcctggatatcccatatcaggccttggatcaaggcaaccgggaaagtttgactgcaaccctggagtacgtggaagagaagacaaatgtggactctgtgtttgtgaacttccagaatgatcggaacgacagaggtggggatctgctgttcttcatctttatggtgtatccccttgaaagggatgttggccacctgcccagtgagcctccttgaacatgcttattccaacgctttgaggggctggaagccttgacacatggaatcaggggcccgggatgtgattcaggacactttccatcctaggaataaagggtagtgcaatcaaaaaaaaaaaa

SEQ ID NO: 295909 - DNA, 983 bp, Homo sapiens
tcttcaagttctattttttaatcattcatacagccataacatgcatactagtcgaatatgagccttggataagggattagggtagataagcagcagagtggagtcctgaggtgacataagggctgaccccttatccatgtcatagtgcccactgggtcacaatgccaccaggttgcctaaacctctgccacccacctgtgaacttcactttgccacagggaggcactgaactgaaaaactgccttgtaagaggtgtcgcccctctgtctactccctttcttatatcaagaggggaaaaacacgtaactacctctacccgatctggtcaccatacgcctattacctttactgttacaagtaccggatcactctccgggagaagatgctgcctcgttgttataaaagcatcacttataaggaagaggaggacttgacactccagccccgttcctgcctccagtgctcctgagtccctagtaggcctccaggagggcaaaagcaccgagcagggtaaccacgaccagcttaaagaactgtattcggctgggaacttgacggtgctggctactgaccccctgctccaccaggacccagtacagttagactttcacttccgccttacctcccagacctctgcccattggcacggccttctctgtgaccgtcgactcttcctggatatcccatatcaggccttggatcaaggcaaccgggaaaggtgccctgctgcgggccttcagctacatgggctttgaggtggtcagaccagatcaccctgccctccctcccttggacaatgtcatctttatggtgtatccccttgaaagggatgttggccacctgcccagtgagcctccttgaacatgcttattccaacgctttgaggggctggaagccttgacacatggaatcaggggcccgggatgtgattcaggacactttccatcctaggaataaagggtagtgcaatcaaaaaaaaaaaa

SEQ ID NO: 295910 - DNA, 459 bp, Homo sapiens
catatgtttggaggaaaggcagactaatgaagaagttatcacaatagcttccattgtcacatctttttgtcccaaaccttttattggaagttaataaagtaagaaaaataattcgggccaggcacagtggctcatgcctgtaatcccagcactttgggaagccaaggcaggaggatcaccgaagcccaagacttccagcctaggcaacatggcgagatcccgtctcttcaaaaaatacgaaaattagccgggtgtgggtggcatgcacctgtagttccagcaacttgggaggctgaggtgggaggattgtttgagccagggaagtcaaggctgcagtgacccgaggttgtgccgctgtgctccagcctgggtgacaaagtgagagaccctcttatccaaaaccacatcactcttcctgagttctaggaccttggaaagataccgacagagctcagcatt

SEQ ID NO: 295911 - DNA, 693 bp, Homo sapiens
catatgtttggaggaaaggcagactaatgaagaagttatcacaatagcttccattgtcacatctttttgtcccaaaccttttattggaagttaataaagtaagaaaaataattcgggccaggcacagtggctcatgcctgtaatcccagcactttgggaagccaaggcaggaggatcaccgaagcccaagacttccagcctaggcaacatggcgagatcccgtctcttcaaaaaatacgaaaattagccgggtgtgggtggcatgcacctgtagttccagcaacttgggaggctgaggtgggaggattgtttgagccagggaagtcaaggctgcagtgacccgaggttgtgccgctgtgctccagcctgggtgacaaagtgagagaccctctgaaacgccctcctgagtctcctccaattgttgaggaatggaatagcagagctgttacagcattttgtttggagccaggttttgcatggatggctatggtgacgcatcctttaggatcaactgccacaggacctaagggaggaagtggtctctctggttccttgctctggcttttacccttggtcgtcgcaccagccttcttaggcatctcggcgcaaagaagccgagcggagccccgagtattgggtgttgcccgaaggtgcctcagcccgctgcggagccgcagcatccccgcctgggaa

SEQ ID NO: 295912 - DNA, 448 bp, Homo sapiens
ttttaatttttaaattttttttaatggaaatgtctttaaaattgtacagattttcagaatgactgacactgccgaagctgttccaaagtttgaagagatgtttgctagtagattcacagaaaatgacaaggagtatcaggaatacctgaaacgccctcctgagtctcctccaattgttgaggaatggaatagcagagctgttacagcattttgtttggagccaggttttgcatggatggctatggtgacgcatcctttaggatcaactgccacaggacctaagggaggaagtggtctctctggttccttgctctggcttttacccttggtcgtcgcaccagccttcttaggcatctcggcgcaaagaagccgagcggagccccgagtattgggtgttgcccgaaggtgcctcagcccgctgcggagccgcagcatccccgcctgggaa

SEQ ID NO: 295913 - DNA, 705 bp, Homo sapiens
ttgataagacctgagctgcgactgaagcccttgctgcattgttcattttgttagtgcacttctccttattgtaggaataaggtgaagcgcttacacaagtttgcagcagaatagtcattccgaaatacttttgtagaaaccactccactgaatgtatacataataaatactacttgtataatgctgacttaaaattttctcacttgaatacacagacttaaattttgactatcatgatgggaaaaaaaaaagatggtctacacagtatgtttaacaaaaaagtagatagcctgaggaattaaattaatggttcaaaccgtcatcatgaaaaattgagatgctgttaccacacgtgatttgggaatcaatgtataagaagaccaagacagtcagacactaataatggcgttctgaaaccataagtgatacttgggccgggcgcggtggctcacgcctgttacagcattttgtttggagccaggttttgcatggatggctatggtgacgcatcctttaggatcaactgccacaggacctaagggaggaagtggtctctctggttccttgctctggcttttacccttggtcgtcgcaccagccttcttaggcatctcggcgcaaagaagccgagcggagccccgagtattgggtgttgcccgaaggtgcctcagcccgctgcggagccgcagcatccccgcctgggaa

SEQ ID NO: 295914 - DNA, 1768 bp, Homo sapiens
agcggggggtagctgaggggagccccagtctatggcaggagcagagatttctgaaagctgttggctccctctgccctggaggtaatgctgaaatttgactttgtgtataactgatgtgtgttacctttgtcatgtcttcagaataaactgtggtcattctttttctttcctcctctggtatatatatggactagttcatgggccttattaaaagacttgtttggagaggaaggcgctcggttacattggagaactggagtggtctggagttccacggtgtagtggaccagaggccacctctcctgggcttctcagtgtctcgccggcggggttcggcctgagctggattgacatagcccttggcggatttaaacaacctaaacattaagcagtacagctgcctcaaacctttgggattttcagaatgactgacactgccgaagctgttccaaagtttgaagagatgtttgctagtagattcacagaaaatgacaaggagtatcaggaatacctgaaacgccctcctgagtctcctccaattgttgaggaatggaatagcagagctggtgggaaccaaagaaacagaggcaatcggttgcaagacaacagacagttcagaggcagggacaacagatgggggtggccaagtgacaatcgatccaatcagtggcatggacgatcctggggtaacaactacccgcaacacagacaagaaccttactatccccagcaatatggacattatggttacaaccagcggcctccttacggttactactgatagaaatgttggcagcttttagtaaaagcatttactctgttaccatgagaaaagttgggtgtcttctgttggtcatagttttacatctgattttacagaatggattattgattttttggaagttgagactttaaaaaaaatagatcttacttgcgaaatgcgatggttgctgggaatacctgaaactgtggattatattgcttgacttctacctcagaatcttctttgtttcatgacttaatagtgctttaagtttggtatattatttgacctctaggaattctttgttttacacagaaataaaaattttaaaatagaaaatgcttttactttgtaaggtaagagagtatccatatgcttagatgtgctcgtttctaaaattctagaggttgatataatcagctcatgaatgcacagctatgctttttgtgatagattgtacataacatcagcagttgaaaggtaaaacaattgcttttttttttttttgcatttgttaagtgactatggtactttgtgattccttaatctatagatgagtcagctccacacttgagtctctttttagagggaaatcagtaataaagctgtaaaataaggaaggaatcattgtcagtttgtgtcttgatctggtggtggttgggataagggtacacatcattttatacaaacactaaagctttttgctaacaacatagcaggtcaaaattcacacataagaaagtttaactctgtactgttcacactttttaatcctgtaaataatgctgcattttgatggttcttacttttttggtatttaatgtgggctgattttacaatgttatattcacttccagatgcatacctctgctgctttctctcctataaatagtgatgctataaacttcctttcacagagatcattctatttcaaatcactttaatgattattacaatgatttcattcaaataaaaattttaaaatatttaagcatcttcactccc

SEQ ID NO: 295915 - DNA, 1384 bp, Homo sapiens
agcggggggtagctgaggggagccccagtctatggcaggagcagagatttctgaaagctgttggctccctctgccctggaggtaatgctgaaatttgactttgtgtataactgatgtgtgttacctttgtcatgtcttcagaataaactgtggtcattctttttctttcctcctctggtatatatatggactagttcatgggccttattaaaagacttgtttggagaggaaggcgctcggttacattggagaactggagtggtctggagttccacggtgtagtggaccagaggccacctctcctgggcttctcagtgtctcgccggcggggttcggcctgagctggattgacatagcccttggcggatttaaacaacctaaacattaagcagtacagctgcctcaaacctttgggattttcagaatgactgacactgccgaagctgttccaaagtttgaagagatgtttgctagtagattcacagaaaatgacaaggagtatcaggaatacctgaaacgccctcctgagtctcctccaattgttgaggaatggaatagcagagctggtgggaaccaaagaaacagaggcaatcggttgcaagacaacagacagttcagaggcagggacaacagatgggggtggccaagtgacaatcgatccaatcagtggcatggacgatcctggggtaacaactacccgcaacacagacaagaaccttactatccccagcaatatggacattatggttacaaccagcggcctccttacggttactactgatagaaatgttggcagcttttagtaaaagcatttactctgttaccatgagaaaagttgggtgtcttctgttggtcatagttttacatctgattttacagaatggattattgattttttggaagttgagactttaaaaaaaatagatcttacttgcgaaatgcgatggttgctgggaatacctgaaactgtggattatattgcttgacttctacctcagaatcttctttgtttcatgacttaatagtgctttaagtttggtatattatttgacctctaggaattctttgttttacacagaaataaaaattttaaaatagaaaatgcttttactttgtaaggtaagagagtatccatatgcttagatgtgctcgtttctaaaattctagaggttgatataatcagctcatgaatgcacagctatgctttttgtgatagattgtacataacatcagcagttgaaaggtaaaacaattgcttttttttttttttgcatttgttaagtgactatggtactttgtgattccttaatctatagatgagtcagctccacacttgagtctctttttagagggaaatcagtaataaagctgtaaaataaggaag

SEQ ID NO: 295916 - DNA, 1566 bp, Homo sapiens
agtcaggtggttgtcggattttagaggaaggcgctcggttacattggagaactggagtggtctggagttccacggtgtagtggaccagaggccacctctcctgggcttctcagtgtctcgccggcggggttcggcctgagctggattgacatagcccttggcggatttaaacaacctaaacattaagcagtacagctgcctcaaacctttgggattttcagaatgactgacactgccgaagctgttccaaagtttgaagagatgtttgctagtagattcacagaaaatgacaaggagtatcaggaatacctgaaacgccctcctgagtctcctccaattgttgaggaatggaatagcagagctggtgggaaccaaagaaacagaggcaatcggttgcaagacaacagacagttcagaggcagggacaacagatgggggtggccaagtgacaatcgatccaatcagtggcatggacgatcctggggtaacaactacccgcaacacagacaagaaccttactatccccagcaatatggacattatggttacaaccagcggcctccttacggttactactgatagaaatgttggcagcttttagtaaaagcatttactctgttaccatgagaaaagttgggtgtcttctgttggtcatagttttacatctgattttacagaatggattattgattttttggaagttgagactttaaaaaaaatagatcttacttgcgaaatgcgatggttgctgggaatacctgaaactgtggattatattgcttgacttctacctcagaatcttctttgtttcatgacttaatagtgctttaagtttggtatattatttgacctctaggaattctttgttttacacagaaataaaaattttaaaatagaaaatgcttttactttgtaaggtaagagagtatccatatgcttagatgtgctcgtttctaaaattctagaggttgatataatcagctcatgaatgcacagctatgctttttgtgatagattgtacataacatcagcagttgaaaggtaaaacaattgcttttttttttttttgcatttgttaagtgactatggtactttgtgattccttaatctatagatgagtcagctccacacttgagtctctttttagagggaaatcagtaataaagctgtaaaataaggaaggaatcattgtcagtttgtgtcttgatctggtggtggttgggataagggtacacatcattttatacaaacactaaagctttttgctaacaacatagcaggtcaaaattcacacataagaaagtttaactctgtactgttcacactttttaatcctgtaaataatgctgcattttgatggttcttacttttttggtatttaatgtgggctgattttacaatgttatattcacttccagatgcatacctctgctgctttctctcctataaatagtgatgctataaacttcctttcacagagatcattctatttcaaatcactttaatgattattacaatgatttcattcaaataaaaattttaaaatatttaagcatcttcactccc

SEQ ID NO: 295917 - DNA, 1426 bp, Homo sapiens
ctggatcgacagtagcgtctgcggatttaaacaacctaaacattaagcagtacagctgcctcaaacctttgggattttcagaatgactgacactgccgaagctgttccaaagtttgaagagatgtttgctagtagattcacagaaaatgacaaggagtatcaggaatacctgaaacgccctcctgagtctcctccaattgttgaggaatggaatagcagagctggtgggaaccaaagaaacagaggcaatcggttgcaagacaacagacagttcagaggcagggacaacagatgggggtggccaagtgacaatcgatccaatcagtggcatggacgatcctggggtaacaactacccgcaacacagacaagaaccttactatccccagcaatatggacattatggttacaaccagcggcctccttacggttactactgatagaaatgttggcagcttttagtaaaagcatttactctgttaccatgagaaaagttgggtgtcttctgttggtcatagttttacatctgattttacagaatggattattgattttttggaagttgagactttaaaaaaaatagatcttacttgcgaaatgcgatggttgctgggaatacctgaaactgtggattatattgcttgacttctacctcagaatcttctttgtttcatgacttaatagtgctttaagtttggtatattatttgacctctaggaattctttgttttacacagaaataaaaattttaaaatagaaaatgcttttactttgtaaggtaagagagtatccatatgcttagatgtgctcgtttctaaaattctagaggttgatataatcagctcatgaatgcacagctatgctttttgtgatagattgtacataacatcagcagttgaaaggtaaaacaattgcttttttttttttttgcatttgttaagtgactatggtactttgtgattccttaatctatagatgagtcagctccacacttgagtctctttttagagggaaatcagtaataaagctgtaaaataaggaaggaatcattgtcagtttgtgtcttgatctggtggtggttgggataagggtacacatcattttatacaaacactaaagctttttgctaacaacatagcaggtcaaaattcacacataagaaagtttaactctgtactgttcacactttttaatcctgtaaataatgctgcattttgatggttcttacttttttggtatttaatgtgggctgattttacaatgttatattcacttccagatgcatacctctgctgctttctctcctataaatagtgatgctataaacttcctttcacagagatcattctatttcaaatcactttaatgattattacaatgatttcattcaaataaaaattttaaaatatttaagcatcttcactccc

SEQ ID NO: 295918 - DNA, 1838 bp, Homo sapiens
atgggtggggagtcgtgggagaacatatgagaacataaaaatggagtagcaccttttccttgccttatgatttttactgcccatctggattaggtatgggtcatctttttagtgatttctgtgatcccactagaattctagacatgatttttaattagctgaatttatttaaaactcattccttggatttgagaatttgatatagtttgccaatcccagacacattgaaagtctgatatttggtatttgataaagcatactaagagcaatagcctgaaagataagagtgtcaggctgggcgcggtggcttatgcctgttatcccagtactttgggaggctgaggcaggcagatcacctgaggtcaggagttcaagatcagcctggccaacatgatgaaaccctgtctctactaaaaatacaaaaattaggaaaattagccgggtgtgggtggcatgcacctgtagttccagcaacttgggaggctgaggtgggaggattgtttgagccagggaagtcaaggctgcagtgacccgaggttgtgccgctgtgctccagcctgggtgacaaagtgagagaccctctgaaacgccctcctgagtctcctccaattgttgaggaatggaatagcagagctggtgggaaccaaagaaacagaggcaatcggttgcaagacaacagacagttcagaggcagggacaacagatgggggtggccaagtgacaatcgatccaatcagtggcatggacgatcctggggtaacaactacccgcaacacagacaagaaccttactatccccagcaatatggacattatggttacaaccagcggcctccttacggttactactgatagaaatgttggcagcttttagtaaaagcatttactctgttaccatgagaaaagttgggtgtcttctgttggtcatagttttacatctgattttacagaatggattattgattttttggaagttgagactttaaaaaaaatagatcttacttgcgaaatgcgatggttgctgggaatacctgaaactgtggattatattgcttgacttctacctcagaatcttctttgtttcatgacttaatagtgctttaagtttggtatattatttgacctctaggaattctttgttttacacagaaataaaaattttaaaatagaaaatgcttttactttgtaaggtaagagagtatccatatgcttagatgtgctcgtttctaaaattctagaggttgatataatcagctcatgaatgcacagctatgctttttgtgatagattgtacataacatcagcagttgaaaggtaaaacaattgcttttttttttttttgcatttgttaagtgactatggtactttgtgattccttaatctatagatgagtcagctccacacttgagtctctttttagagggaaatcagtaataaagctgtaaaataaggaaggaatcattgtcagtttgtgtcttgatctggtggtggttgggataagggtacacatcattttatacaaacactaaagctttttgctaacaacatagcaggtcaaaattcacacataagaaagtttaactctgtactgttcacactttttaatcctgtaaataatgctgcattttgatggttcttacttttttggtatttaatgtgggctgattttacaatgttatattcacttccagatgcatacctctgctgctttctctcctataaatagtgatgctataaacttcctttcacagagatcattctatttcaaatcactttaatgattattacaatgatttcattcaaataaaaattttaaaatatttaagcatcttcactccc

SEQ ID NO: 295919 - DNA, 1647 bp, Homo sapiens
catatgtttggaggaaaggcagactaatgaagaagttatcacaatagcttccattgtcacatctttttgtcccaaaccttttattggaagttaataaagtaagaaaaataattcgggccaggcacagtggctcatgcctgtaatcccagcactttgggaagccaaggcaggaggatcaccgaagcccaagacttccagcctaggcaacatggcgagatcccgtctcttcaaaaaatacgaaaattagccgggtgtgggtggcatgcacctgtagttccagcaacttgggaggctgaggtgggaggattgtttgagccagggaagtcaaggctgcagtgacccgaggttgtgccgctgtgctccagcctgggtgacaaagtgagagaccctctgaaacgccctcctgagtctcctccaattgttgaggaatggaatagcagagctggtgggaaccaaagaaacagaggcaatcggttgcaagacaacagacagttcagaggcagggacaacagatgggggtggccaagtgacaatcgatccaatcagtggcatggacgatcctggggtaacaactacccgcaacacagacaagaaccttactatccccagcaatatggacattatggttacaaccagcggcctccttacggttactactgatagaaatgttggcagcttttagtaaaagcatttactctgttaccatgagaaaagttgggtgtcttctgttggtcatagttttacatctgattttacagaatggattattgattttttggaagttgagactttaaaaaaaatagatcttacttgcgaaatgcgatggttgctgggaatacctgaaactgtggattatattgcttgacttctacctcagaatcttctttgtttcatgacttaatagtgctttaagtttggtatattatttgacctctaggaattctttgttttacacagaaataaaaattttaaaatagaaaatgcttttactttgtaaggtaagagagtatccatatgcttagatgtgctcgtttctaaaattctagaggttgatataatcagctcatgaatgcacagctatgctttttgtgatagattgtacataacatcagcagttgaaaggtaaaacaattgcttttttttttttttgcatttgttaagtgactatggtactttgtgattccttaatctatagatgagtcagctccacacttgagtctctttttagagggaaatcagtaataaagctgtaaaataaggaaggaatcattgtcagtttgtgtcttgatctggtggtggttgggataagggtacacatcattttatacaaacactaaagctttttgctaacaacatagcaggtcaaaattcacacataagaaagtttaactctgtactgttcacactttttaatcctgtaaataatgctgcattttgatggttcttacttttttggtatttaatgtgggctgattttacaatgttatattcacttccagatgcatacctctgctgctttctctcctataaatagtgatgctataaacttcctttcacagagatcattctatttcaaatcactttaatgattattacaatgatttcattcaaataaaaattttaaaatatttaagcatcttcactccc

SEQ ID NO: 295920 - DNA, 872 bp, Homo sapiens
agcggggggtagctgaggggagccccagtctatggcaggagcagagatttctgaaagctgttggctccctctgccctggaggtaatgctgaaatttgactttgtgtataactgatgtgtgttacctttgtcatgtcttcagaataaactgtggtcattctttttctttcctcctctggtatatatatggactagttcatgggccttattaaaagacttgtttggagaggaaggcgctcggttacattggagaactggagtggtctggagttccacggtgtagtggaccagaggccacctctcctgggcttctcagtgtctcgccggcggggttcggcctgagctggattgacatagcccttggcggatttaaacaacctaaacattaagcagtacagctgcctcaaacctttgggattttcagaatgactgacactgccgaagctgttccaaagtttgaagagatgtttgctagtagattcacagaaaatgacaaggagtatcaggaatacctgaaacgccctcctgagtctcctccaattgttgaggaatggaatagcagagctggtgggaaccaaagaaacagaggcaatcggttgcaagacaacagacagttcagaggcagggacaacagatgggggtggccaagtgacaatcgatccaatcagtggcatggacgatcctggggtaacaactacccgcaacacagacaagaaccttactatccccagcaatatggacattatggttacaaccagcggcctcggagtgtctcccccagtataggatatgcttgtatccccccgtcactcctccgcctgtttttttaaacttttccaccacctgcgtccaaaaagaatgttatggcgagtc

SEQ ID NO: 295921 - DNA, 192 bp, Homo sapiens
taacaagggaagtttaaagatcttttttgttttattgttgtaggttgcaagacaacagacagttcagaggcagggacaacagatgggggtggccaagtgacaatcgatccaatcagtggcatggacgatcctggggtaacaactacccgcaacacagacaagaaccttactatccccagcaatatggacatt

SEQ ID NO: 295922 - DNA, 844 bp, Homo sapiens
agcggaagtcaggtggttgtcggattttagaggaaggcgctcggttacattggagaactggagtggtctggagttccacggtgtagtggaccagaggccacctctcctgggcttctcagtgtctcgccggcggggttcggcctgagctggattgacatagcccttggcgggtgagtcgccccggacgcccgggaggagggagcggggcggccgagctgggtggccagcgaggtgtcctccccctgtgcggtgatctgtactctttgctagaccgaagcccgtttacttctcacggcccataatttccctcacttctggaggtataaggtgcttcggaagggagcaaatctgccagaaccttggtaagcaagctgtgatgtgccttgaggacggactggaaaacgcagttgttttcagtctgcatcttcgtctgttccccgggctcacctcccagggcagcgaaaccccattctggttggttatttccagggttagtcgcccgcagccaaagttctttgtggttttatttgtggtgaataaattagcagtattcaagtacaaatctgaaaggcttaccctaaaagaacatacatactttatgaagtttgtattcatacttgaactattttgcttttgaaggcccagaggacaaatcttgtagcttcttgctcttgagaaccagttccctctttggaatattagctttggaagtctttagagcgtttttttggtttgttttttgttttttttttgagacggagtctcgctctgtcgcccaggctggagtgcagtggcgcgatctccgcctcccaagttcaagcgattctcctgcctcagcctcccg

SEQ ID NO: 295923 - DNA, 1635 bp, Homo sapiens
gaccccttgcctgagtgtgacgtcagaatcaccatggccagctatccttaccggcagggctgcccaggagctgcaggacaagcaccaggagcccctccgggtagctactaccctggaccccccaatagtggagggcagtatggtagtgggctaccccctggtggtggttatgggggtcctgcccctggagggccttatggaccaccagctggtggagggccctatggacaccccaatcctgggatgttcccctctggaactccaggaggaccatatggcggtgcagctcccgggggcccctatggtcagccacctccaagttcctacggtgcccagcagcctgggctttatggacagggtggcgcccctcccaatgtggatcctgaggcctactcctggttccagtcggtggactcagatcacagtggctatatctccatgaaggagctaaagcaggccctggtcaactgcaattggtcttcattcaatgatgagacctgcctcatgatgataaacatgtttgacaagaccaagtcaggccgcatcgatgtctacggcttctcagccctgtggaaattcatccagcagtggaagaacctcttccagcagtatgaccgggaccgctcgggctccattagctacacagagctgcagcaagctctgtcccaaatgggctacaacctgagcccccagttcacccagcttctggtctcccgctactgcccacgctctgccaatcctgccatgcagcttgaccgcttcatccaggtgtgcacccagctgcaggtgctgacagaggccttccgggagaaggacacagctgtacaaggcaacattcggctcagcttcgaggacttcgtcaccatgacagcttctcggatgctatgacccaaccatctgtggagagtggagtgcaccagggacctttcctggcttcttagagtgagagaagtatgtggacatctcttcttttcctgtccctctagaagaacattctcccttgcttgatgcaacactgttccaaaagagggtggagagtcctgcatcatagccaccaaatagtgaggaccggggctgaggccacacagataggggcctgatggaggagaggatagaagttgaatgtcctgatggccatgagcagttgagtggcacagcctggcaccaggagcaggtccttgtaatggagttagtgtccagtcagctgagctccaccctgatgccagtggtgagtgttcatcggcctgttaccgttagtacctgtgttccctcaccaggccatcctgtcaaacgagcccattttctccaaagtggaatctgaccaagcatgagagagatctgtctatgggaccagtggcttggattctgccacacccataaatccttgtgtgttaacttctagctgcctggggctggccctgctcagacaaatctgctccctgggcatctttggccaggcttctgccctctgcagctgggacccctcacttgcctgccatgctctgctcggcttcagtctccaggagacagtggtcacctctccctgccaatactttttttaatttgcattttttttcatttggggccaaaagtccagtgaaattgtaagcttcaataaaaggatgaaactctgga

SEQ ID NO: 295924 - DNA, 423 bp, Homo sapiens
gagatctgtctatgggaccagtggcttggattctgccacacccataaatccttgtgtgttaacttctagctgcctggtcagatcccattttctccaaagtggaatctgaccaagcatgagagagatctgtctatgggaccagtggcttggattctgccacacccataaatccttgtgtgttaacttctagctgcctggggctggccctgctcagacaaatctgctccctgggcatctttggccaggcttctgccctctgcagctgggacccctcacttgcctgccatgctctgctcggcttcagtctccaggagacagtggtcacctctccctgccaatactttttttaatttgcattttttttcatttggggccaaaagtccagtgaaattgtaagcttcaataaaaggatgaaactctgga

SEQ ID NO: 295925 - DNA, 2141 bp, Homo sapiens
gaccccttgcctgagtgtgacgtcagaatcaccatggccagctatccttaccggcagggctgcccaggagctgcaggacaagcaccaggagcccctccgggtagctactaccctggaccccccaatagtggagggcagtatggtagtgggctaccccctggtggtggttatgggggtcctgcccctggagggccttatggaccaccagctggtggagggccctatggacaccccaatcctgggatgttcccctctggaactccaggaggaccatatggcggtgcagctcccgggggcccctatggtcagccacctccaagttcctacggtgcccagcagcctgggctttatggacagggtggcgcccctcccaatgtggatcctgaggcctactcctggttccagtcggtggactcagatcacagtggctatatctccatgaaggagctaaagcaggccctggtcaactgcaattggtcttcattcaatgatgagacctgcctcatgatgataaacatgtttgacaagaccaagtcaggccgcatcgatgtctacggcttctcagccctgtggaaattcatccagcagtggaagaacctcttccagcagtatgaccgggaccgctcgggctccattagctacacagagctgcagcaagctctgtcccaaatgggctacaacctgagcccccagttcacccagcttctggtctcccgctactgcccacgctctgccaatcctgccatgcagcttgaccgcttcatccaggtgtgcacccagctgcaggtgctgacagaggccttccgggagaaggacacagctgtacaaggcaacattcggctcagcttcgaggacttcgtcaccatgacagcttctcggatgctatgacccaaccatctgtggagagtggagtgcaccagggacctttcctggcttcttagagtgagagaagtatgtggacatctcttcttttcctgtccctctagaagaacattctcccttgcttgatgcaacactgttccaaaagagggtggagagtcctgcatcatagccaccaaatagtgaggaccggggctgaggccacacagataggggcctgatggaggagaggatagaagttgaatgtcctgatggccatgagcagttgagtggcacagcctggcaccaggagcaggtccttgtaatggagttagtgtccagtcagctgagctccaccctgatgccagtggtgagtgttcatcggcctgttaccgttagtacctgtgttccctcaccaggccatcctgtcaaacgagcccattttctccaaagtggaatctgaccaagcatgagagagatctgtctatgggaccagtggcttggattctgccacacccataaatccttgtgtgttaacttctagctgcctggggctggccctgctcagacaaatctgctccctgggcatctttggccaggcttctgccctctgcagctgggacccctcacttgcctgccatgctctgctcggcttcagtctccaggagacagtggtcacctctccctgccaatactttttttaatttgcattttttttcatttggggccaaaagtccagtgaaattgtaagcttcaataaaaggatgaaactctggaaaaaaaaaacaaaaaaaaaaaaaaaaaaaaaaaaaaaaacaaaaaagaaaaaagaaaaaaaaaaaaaacaaggggggggggcgcgcaaaaaataccccccgggggggcgccatgaggcgcccacgagttttggaagaagggggtcccccaggaatggaggacgtctgttaaaaaaagcagacacgccgcgggggccgcatgattaaaacaagcggcgttgccgcgggaggaaaacaaccgcgctatcactgctagacaacacatctgtttggggagagcaaccccccaaccaatcaccgggcgaggggggaacccaaccatgtggggggaacacagcacctacccccaagaagggtagttgaaggcgccgccccgagacgaacaagctataaagacggggagggggatgtactataggtggtcacaacccacggccgcacaactgctcacgtcggatagaaaagtattggtccacacggcgagctagttttacgaaccaaagtacc

SEQ ID NO: 295926 - DNA, 2416 bp, Homo sapiens
  misc_feature (1723)..(1723): n is a, c, g, or t
gaccccttgcctgagtgtgacgtcagaatcaccatggccagctatccttaccggcagggctgcccaggagctgcaggacaagcaccaggagcccctccgggtagctactaccctggaccccccaatagtggagggcagtatggtagtgggctaccccctggtggtggttatgggggtcctgcccctggagggccttatggaccaccagctggtggagggccctatggacaccccaatcctgggatgttcccctctggaactccaggaggaccatatggcggtgcagctcccgggggcccctatggtcagccacctccaagttcctacggtgcccagcagcctgggctttatggacagggtggcgcccctcccaatgtggatcctgaggcctactcctggttccagtcggtggactcagatcacagtggctatatctccatgaaggagctaaagcaggccctggtcaactgcaattggtcttcattcaatgatgagacctgcctcatgatgataaacatgtttgacaagaccaagtcaggccgcatcgatgtctacggcttctcagccctgtggaaattcatccagcagtggaagaacctcttccagcagtatgaccgggaccgctcgggctccattagctacacagagctgcagcaagctctgtcccaaatgggctacaacctgagcccccagttcacccagcttctggtctcccgctactgcccacgctctgccaatcctgccatgcagcttgaccgcttcatccaggtgtgcacccagctgcaggtgctgacagaggccttccgggagaaggacacagctgtacaaggcaacattcggctcagcttcgaggacttcgtcaccatgacagcttctcggatgctatgacccaaccatctgtggagagtggagtgcaccagggacctttcctggcttcttagagtgagagaagtatgtggacatctcttcttttcctgtccctctagaagaacattctcccttgcttgatgcaacactgttccaaaagagggtggagagtcctgcatcatagccaccaaatagtgaggaccggggctgaggccacacagataggggcctgatggaggagaggatagaagttgaatgtcctgatggccatgagcagttgagtggcacagcctggcaccaggagcaggtccttgtaatggagttagtgtccagtcagctgagctccaccctgatgccagtggtgagtgttcatcggcctgttaccgttagtacctgtgttccctcaccaggccatcctgtcaaacgagcccattttctccaaagtggaatctgaccaagcatgagagagatctgtctatgggaccagtggcttggattctgccacacccataaatccttgtgtgttaacttctagctgcctggggctggccctgctcagacaaatctgctccctgggcatctttggccaggcttctgccctctgcagctgggacccctcacttgcctgccatgctctgctcggcttcagtctccaggagacagtggtcacctctccctgccaatactttttttaatttgcattttttttcatttggggccaaaagtccagtgaaattgtaagcttcaataaaaggatgaaactctggaaaaaaaaaaaaaaaaaaaaaaaaaaaaaaaaaaaaaaaaaaaaaaacaaaaaaaaaaaaaaaaaaaaaaaaaaaaacaaaaaagaaanaaaaaacacaaccacaaacatttgctccccccccccccccaaactcaaacccacatccatgtggaggggcggcagaccacacaaaaagaaaaagaagaaccaggtctgacaccggctggcctccatgcgcacaggcaaccccagtgtgaccaaatagactggatgttggtcatacccccaaaacaaacaaaagaaggagcgggcgggggggaacgagcgaccttactaggacaaaaacaccaggacgtgtggacgtcgggtgccaacacgtggaacatctacgacaggggcgaacacacgagagcagatattaaatatacccccgccggcggtgagtgcaaacaaaactgcataagacatcgcacacctaagacagttaacacgaacggatgtgagaaagagtggagacgatccaaaacgacggactgccgcagagacaggggagagctgctcgcaggcaccgagcagcggtgggccagggaggcgctgggcgcgggaaggagcacggcgaggccggggcagcctccgcacacgagggtcaggtacagcacgcgcaacggtacggagccggtagaacaggacgaagcgtccagtgagcgggagcgggggagggcgacagagggaggcgaacgggcgtagcagcgaaaggcgggacgacgcggtagagaagaacacgcggaagcgggggggggc

SEQ ID NO: 295927 - DNA, 1862 bp, Homo sapiens
gaccccttgcctgagtgtgacgtcagaatcaccatggccagctatccttaccggcagggctgcccaggagctgcaggacaagcaccaggagcccctccgggtagctactaccctggaccccccaatagtggagggcagtatggtagtgggctaccccctggtggtggttatgggggtcctgcccctggagggccttatggaccaccagctggtggagggccctatggacaccccaatcctgggatgttcccctctggaactccaggaggaccatatggcggtgcagctcccgggggcccctatggtcagccacctccaagttcctacggtgcccagcagcctgggctttatggacagggtggcgcccctcccaatgtggatcctgaggcctactcctggttccagtcggtggactcagatcacagtggctatatctccatgaaggagctaaagcaggccctggtcaactgcaattggtcttcattcaatgatgagacctgcctcatgatgataaacatgtttgacaagaccaagtcaggccgcatcgatgtctacggcttctcagccctgtggaaattcatccagcagtggaagaacctcttccagcagtatgaccgggaccgctcgggctccattagctacacagagctgcagcaagctctgtcccaaatgggctacaacctgagcccccagttcacccagcttctggtctcccgctactgcccacgctctgccaatcctgccatgcagcttgaccgcttcatccaggtgtgcacccagctgcaggtgctgacagaggccttccgggagaaggacacagctgtacaaggcaacattcggctcagcttcgaggacttcgtcaccatgacagcttctcggatgctatgacccaaccatctgtggagagtggagtgcaccagggacctttcctggcttcttagagtgagagaagtatgtggacatctcttcttttcctgtccctctagaagaacattctcccttgcttgatgcaacactgttccaaaagagggtggagagtcctgcatcatagccaccaaatagtgaggaccggggctgaggccacacagataggggcctgatggaggagaggatagaagttgaatgtcctgatggccatgagcagttgagtggcacagcctggcaccaggagcaggtccttgtaatggagttagtgtccagtcagctgagctccaccctgatgccagtggtgagtgttcatcggcctgttaccgttagtacctgtgttccctcaccaggccatcctgtcaaacgagcccattttctccaaagtggaatctgaccaagcatgagagagatctgtctatgggaccagtggcttggattctgccacacccataaatccttgtgtgttaacttctagctgcctggggctggccctgctcagacaaatctgctccctgggcatctttggccaggcttctgccctctgcagctgggacccctcacttgcctgccatgctctgctcggcttcagtctccaggagacagtggtcacctctccctgccaatactttttttaatttgcattttttttcatttggggccaaaagtccagtgaaattgtaagcttcaataaaaggatgaaactctggaaaaaaaaaaaaaaaacaaaaaaggtttgcggccgcggcggacggcggcctctgcaccaggcggtagccctcggcgagcatcaggtggtcggccatggcggcaggccggctgcctgcggggacagcgcgcggtggtcagcgccggctcccccggcccgggccagcggctcctctgcggcgggagacccgggcaccgtgcggtccctgcagctcggccgggcggagcaa

SEQ ID NO: 295928 - DNA, 1576 bp, Homo sapiens
gaccccttgcctgagtgtgacgtcagaatcaccatggccagctatccttaccggcagggctgcccaggagctgcaggacaagcaccaggagcccctccgggtagctactaccctggaccccccaatagtggagggcagtatggtagtgggctaccccctggtggtggttatgggggtcctgcccctggagggccttatggaccaccagctggtggagggccctatggacaccccaatcctgggatgttcccctctggaactccaggaggaccatatggcggtgcagctcccgggggcccctatggtcagccacctccaagttcctacggtgcccagcagcctgggctttatggacagggtggcgcccctcccaatgtggatcctgaggcctactcctggttccagtcggtggactcagatcacagtggctatatctccatgaaggagctaaagcaggccctggtcaactgcaattggtcttcattcaatgatgagacctgcctcatgatgataaacatgtttgacaagaccaagtcaggccgcatcgatgtctacggcttctcagccctgtggaaattcatccagcagtggaagaacctcttccagcagtatgaccgggaccgctcgggctccattagctacacagagctgcagcaagctctgtcccaaatgggctacaacctgagcccccagttcacccagcttctggtctcccgctactgcccacgctctgccaatcctgccatgcagcttgaccgcttcatccaggtgtgcacccagctgcaggtgctgacagaggccttccgggagaaggacacagctgtacaaggcaacattcggctcagcttcgaggacttcgtcaccatgacagcttctcggatgctatgacccaaccatctgtggagagtggagtgcaccagggacctttcctggcttcttagagtgagagaagtatgtggacatctcttcttttcctgtccctctagaagaacattctcccttgcttgatgcaacactgttccaaaagagggtggagagtcctgcatcatagccaccaaatagtgaggaccggggctgaggccacacagataggggcctgatggaggagaggatagaagttgaatgtcctgatggccatgagcagttgagtggcacagcctggcaccaggagcaggtccttgtaatggagttagtgtccagtcagctgagctccaccctgatgccagtggtgagtgttcatcggcctgttaccgttagtacctgtgttccctcaccaggccatcctgtcaaacgagcccattttctccaaagtggaatctgaccaagcatgagagagatctgtctatgggaccagtggcttggattctgccacacccataaatccttgtgtgttaacttctagctgcctggggctggccctgctcagacaaatctgctccctgggcatctttggccaggcttctgccctctgcagctgggacccctcacttgcctgccatgctctgctcggcttcagtctccaggagacagtggtcacctgtcgacgcggccgcgaatttagtagtagtagtcgacc

SEQ ID NO: 295929 - DNA, 1628 bp, Homo sapiens
cacgcgtcggaccacgcgtcgacccacgcgtcggctatccttaccggcagggctgcccaggagctgcaggacaagcaccaggagcccctccgggtagctactaccctggaccccccaatagtggagggcagtatggtagtgggctaccccctggtggtggttatgggggtcctgcccctggagggccttatggaccaccagctggtggagggccctatggacaccccaatcctgggatgttcccctctggaactccaggaggaccatatggcggtgcagctcccgggggcccctatggtcagccacctccaagttcctacggtgcccagcagcctgggctttatggacagggtggcgcccctcccaatgtggatcctgaggcctactcctggttccagtcggtggactcagatcacagtggctatatctccatgaaggagctaaagcaggccctggtcaactgcaattggtcttcattcaatgatgagacctgcctcatgatgataaacatgtttgacaagaccaagtcaggccgcatcgatgtctacggcttctcagccctgtggaaattcatccagcagtggaagaacctcttccagcagtatgaccgggaccgctcgggctccattagctacacagagctgcagcaagctctgtcccaaatgggctacaacctgagcccccagttcacccagcttctggtctcccgctactgcccacgctctgccaatcctgccatgcagcttgaccgcttcatccaggtgtgcacccagctgcaggtgctgacagaggccttccgggagaaggacacagctgtacaaggcaacattcggctcagcttcgaggacttcgtcaccatgacagcttctcggatgctatgacccaaccatctgtggagagtggagtgcaccagggacctttcctggcttcttagagtgagagaagtatgtggacatctcttcttttcctgtccctctagaagaacattctcccttgcttgatgcaacactgttccaaaagagggtggagagtcctgcatcatagccaccaaatagtgaggaccggggctgaggccacacagataggggcctgatggaggagaggatagaagttgaatgtcctgatggccatgagcagttgagtggcacagcctggcaccaggagcaggtccttgtaatggagttagtgtccagtcagctgagctccaccctgatgccagtggtgagtgttcatcggcctgttaccgttagtacctgtgttccctcaccaggccatcctgtcaaacgagcccattttctccaaagtggaatctgaccaagcatgagagagatctgtctatgggaccagtggcttggattctgccacacccataaatccttgtgtgttaacttctagctgcctggggctggccctgctcagacaaatctgctccctgggcatctttggccaggcttctgccctctgcagctgggacccctcacttgcctgccatgctctgctcggcttcagtctccaggagacagtggtcacctctccctgccaatactttttttaatttgcattttttttcatttggggccaaaagtccagtgaaattgtaagcttcaataaaaggatgaaactctgga

SEQ ID NO: 295930 - DNA, 1795 bp, Homo sapiens
cttggaccccacaggtccaggctggcgctggcctgggctccacagcctcccaaggccctcatgggggccttgggcgggggcatcagccatgaccggaggtttagagttctggttccgccgatctcatttggggcgtcggataaaaatccaggcttccggacccaccccacactgcatcagagtcatcaggaaactctggttgtagcaggcgccacaaggctgcccaggagctgcaggacaagcaccaggagcccctccgggtagctactaccctggaccccccaatagtggagggcagtatggtagtgggctaccccctggtggtggttatgggggtcctgcccctggagggccttatggaccaccagctggtggagggccctatggacaccccaatcctgggatgttcccctctggaactccaggaggaccatatggcggtgcagctcccgggggcccctatggtcagccacctccaagttcctacggtgcccagcagcctgggctttatggacagggtggcgcccctcccaatgtggatcctgaggcctactcctggttccagtcggtggactcagatcacagtggctatatctccatgaaggagctaaagcaggccctggtcaactgcaattggtcttcattcaatgatgagacctgcctcatgatgataaacatgtttgacaagaccaagtcaggccgcatcgatgtctacggcttctcagccctgtggaaattcatccagcagtggaagaacctcttccagcagtatgaccgggaccgctcgggctccattagctacacagagctgcagcaagctctgtcccaaatgggctacaacctgagcccccagttcacccagcttctggtctcccgctactgcccacgctctgccaatcctgccatgcagcttgaccgcttcatccaggtgtgcacccagctgcaggtgctgacagaggccttccgggagaaggacacagctgtacaaggcaacattcggctcagcttcgaggacttcgtcaccatgacagcttctcggatgctatgacccaaccatctgtggagagtggagtgcaccagggacctttcctggcttcttagagtgagagaagtatgtggacatctcttcttttcctgtccctctagaagaacattctcccttgcttgatgcaacactgttccaaaagagggtggagagtcctgcatcatagccaccaaatagtgaggaccggggctgaggccacacagataggggcctgatggaggagaggatagaagttgaatgtcctgatggccatgagcagttgagtggcacagcctggcaccaggagcaggtccttgtaatggagttagtgtccagtcagctgagctccaccctgatgccagtggtgagtgttcatcggcctgttaccgttagtacctgtgttccctcaccaggccatcctgtcaaacgagcccattttctccaaagtggaatctgaccaagcatgagagagatctgtctatgggaccagtggcttggattctgccacacccataaatccttgtgtgttaacttctagctgcctggggctggccctgctcagacaaatctgctccctgggcatctttggccaggcttctgccctctgcagctgggacccctcacttgcctgccatgctctgctcggcttcagtctccaggagacagtggtcacctctccctgccaatactttttttaatttgcattttttttcatttggggccaaaagtccagtgaaattgtaagcttcaataaaaggatgaaactctgga

SEQ ID NO: 295931 - DNA, 1636 bp, Homo sapiens
tgctagtaagaggccgggtgttaatcggccgaggcatggccagctatccttaccggcaggctgcccaggagctgcaggacaagcaccaggagcccctccgggtagctactaccctggaccccccaatagtggagggcagtatggtagtgggctaccccctggtggtggttatgggggtcctgcccctggagggccttatggaccaccagctggtggagggccctatggacaccccaatcctgggatgttcccctctggaactccaggaggaccatatggcggtgcagctcccgggggcccctatggtcagccacctccaagttcctacggtgcccagcagcctgggctttatggacagggtggcgcccctcccaatgtggatcctgaggcctactcctggttccagtcggtggactcagatcacagtggctatatctccatgaaggagctaaagcaggccctggtcaactgcaattggtcttcattcaatgatgagacctgcctcatgatgataaacatgtttgacaagaccaagtcaggccgcatcgatgtctacggcttctcagccctgtggaaattcatccagcagtggaagaacctcttccagcagtatgaccgggaccgctcgggctccattagctacacagagctgcagcaagctctgtcccaaatgggctacaacctgagcccccagttcacccagcttctggtctcccgctactgcccacgctctgccaatcctgccatgcagcttgaccgcttcatccaggtgtgcacccagctgcaggtgctgacagaggccttccgggagaaggacacagctgtacaaggcaacattcggctcagcttcgaggacttcgtcaccatgacagcttctcggatgctatgacccaaccatctgtggagagtggagtgcaccagggacctttcctggcttcttagagtgagagaagtatgtggacatctcttcttttcctgtccctctagaagaacattctcccttgcttgatgcaacactgttccaaaagagggtggagagtcctgcatcatagccaccaaatagtgaggaccggggctgaggccacacagataggggcctgatggaggagaggatagaagttgaatgtcctgatggccatgagcagttgagtggcacagcctggcaccaggagcaggtccttgtaatggagttagtgtccagtcagctgagctccaccctgatgccagtggtgagtgttcatcggcctgttaccgttagtacctgtgttccctcaccaggccatcctgtcaaacgagcccattttctccaaagtggaatctgaccaagcatgagagagatctgtctatgggaccagtggcttggattctgccacacccataaatccttgtgtgttaacttctagctgcctggggctggccctgctcagacaaatctgctccctgggcatctttggccaggcttctgccctctgcagctgggacccctcacttgcctgccatgctctgctcggcttcagtctccaggagacagtggtcacctctccctgccaatactttttttaatttgcattttttttcatttggggccaaaagtccagtgaaattgtaagcttcaataaaaggatgaaactctgga

SEQ ID NO: 295932 - DNA, 2052 bp, Homo sapiens
cttggaccccacaggtccaggctggcgctggcctgggctccacagcctcccaaggccctcatgggggccttgggcgggggcatcagccatgaccggaggtttagagttctggttccgccgatctcatttggggcgtcggataaaaatccaggcttccggacccaccccacactgcatcagagtcatcaggaaactctggttgtagcaggcgccacaagtgagctggtttgaccactgacttagttcaacaccgccatttcgcgtgtagaaaagtgaaccccgagaagacacagaacttacctgaagtcaccaggcagttaggcagcagggccgaggtcagaacccgggctatcttcagatgcctcttccccagcgtatcttgattcagtcaggaataccgcagcaaggtgattctgtggccagaattctttgttgggtgatagtagggtgttgaagtgcactttggtgtcagagggctgcccaggagctgcaggacaagcaccaggagcccctccgggtagctactaccctggaccccccaatagtggagggcagtatggtagtgggctaccccctggtggtggttatgggggtcctgcccctggagggccttatggaccaccagctggtggagggccctatggacaccccaatcctgggatgttcccctctggaactccaggaggaccatatggcggtgcagctcccgggggcccctatggtcagccacctccaagttcctacggtgcccagcagcctgggctttatggacagggtggcgcccctcccaatgtggatcctgaggcctactcctggttccagtcggtggactcagatcacagtggctatatctccatgaaggagctaaagcaggccctggtcaactgcaattggtcttcattcaatgatgagacctgcctcatgatgataaacatgtttgacaagaccaagtcaggccgcatcgatgtctacggcttctcagccctgtggaaattcatccagcagtggaagaacctcttccagcagtatgaccgggaccgctcgggctccattagctacacagagctgcagcaagctctgtcccaaatgggctacaacctgagcccccagttcacccagcttctggtctcccgctactgcccacgctctgccaatcctgccatgcagcttgaccgcttcatccaggtgtgcacccagctgcaggtgctgacagaggccttccgggagaaggacacagctgtacaaggcaacattcggctcagcttcgaggacttcgtcaccatgacagcttctcggatgctatgacccaaccatctgtggagagtggagtgcaccagggacctttcctggcttcttagagtgagagaagtatgtggacatctcttcttttcctgtccctctagaagaacattctcccttgcttgatgcaacactgttccaaaagagggtggagagtcctgcatcatagccaccaaatagtgaggaccggggctgaggccacacagataggggcctgatggaggagaggatagaagttgaatgtcctgatggccatgagcagttgagtggcacagcctggcaccaggagcaggtccttgtaatggagttagtgtccagtcagctgagctccaccctgatgccagtggtgagtgttcatcggcctgttaccgttagtacctgtgttccctcaccaggccatcctgtcaaacgagcccattttctccaaagtggaatctgaccaagcatgagagagatctgtctatgggaccagtggcttggattctgccacacccataaatccttgtgtgttaacttctagctgcctggggctggccctgctcagacaaatctgctccctgggcatctttggccaggcttctgccctctgcagctgggacccctcacttgcctgccatgctctgctcggcttcagtctccaggagacagtggtcacctctccctgccaatactttttttaatttgcattttttttcatttggggccaaaagtccagtgaaattgtaagcttcaataaaaggatgaaactctgga

SEQ ID NO: 295933 - DNA, 1985 bp, Homo sapiens
cttggaccccacaggtccaggctggcgctggcctgggctccacagcctcccaaggccctcatgggggccttgggcgggggcatcagccatgaccggaggtttagagttctggttccgccgatctcatttggggcgtcggataaaaatccaggcttccggacccaccccacactgcatcagagtcatcaggaaactctggttgtagcaggcgccacaagtgagctggtttgaccactgacttagttcaacaccgccatttcgcgtgtagaaaagtgaaccccgagaagacacagaacttacctgaagtcaccaggcagttaggcagcagggccgaggtcagaacccgggctatcttcagatgcctcttccccagcgtatcttgattcagtcaggaataccgcagcaagggctgcccaggagctgcaggacaagcaccaggagcccctccgggtagctactaccctggaccccccaatagtggagggcagtatggtagtgggctaccccctggtggtggttatgggggtcctgcccctggagggccttatggaccaccagctggtggagggccctatggacaccccaatcctgggatgttcccctctggaactccaggaggaccatatggcggtgcagctcccgggggcccctatggtcagccacctccaagttcctacggtgcccagcagcctgggctttatggacagggtggcgcccctcccaatgtggatcctgaggcctactcctggttccagtcggtggactcagatcacagtggctatatctccatgaaggagctaaagcaggccctggtcaactgcaattggtcttcattcaatgatgagacctgcctcatgatgataaacatgtttgacaagaccaagtcaggccgcatcgatgtctacggcttctcagccctgtggaaattcatccagcagtggaagaacctcttccagcagtatgaccgggaccgctcgggctccattagctacacagagctgcagcaagctctgtcccaaatgggctacaacctgagcccccagttcacccagcttctggtctcccgctactgcccacgctctgccaatcctgccatgcagcttgaccgcttcatccaggtgtgcacccagctgcaggtgctgacagaggccttccgggagaaggacacagctgtacaaggcaacattcggctcagcttcgaggacttcgtcaccatgacagcttctcggatgctatgacccaaccatctgtggagagtggagtgcaccagggacctttcctggcttcttagagtgagagaagtatgtggacatctcttcttttcctgtccctctagaagaacattctcccttgcttgatgcaacactgttccaaaagagggtggagagtcctgcatcatagccaccaaatagtgaggaccggggctgaggccacacagataggggcctgatggaggagaggatagaagttgaatgtcctgatggccatgagcagttgagtggcacagcctggcaccaggagcaggtccttgtaatggagttagtgtccagtcagctgagctccaccctgatgccagtggtgagtgttcatcggcctgttaccgttagtacctgtgttccctcaccaggccatcctgtcaaacgagcccattttctccaaagtggaatctgaccaagcatgagagagatctgtctatgggaccagtggcttggattctgccacacccataaatccttgtgtgttaacttctagctgcctggggctggccctgctcagacaaatctgctccctgggcatctttggccaggcttctgccctctgcagctgggacccctcacttgcctgccatgctctgctcggcttcagtctccaggagacagtggtcacctctccctgccaatactttttttaatttgcattttttttcatttggggccaaaagtccagtgaaattgtaagcttcaataaaaggatgaaactctgga

SEQ ID NO: 295934 - DNA, 1913 bp, Homo sapiens
cttggaccccacaggtccaggctggcgctggcctgggctccacagcctcccaaggccctcatgggggccttgggcgggggcatcagccatgaccggaggtttagagttctggttccgccgatctcatttggggcgtcggataaaaatccaggcttccggacccaccccacactgcatcagagtcatcaggaaactctggttgtagcaggcgccacaagtgagctggtttgaccactgacttagttcaacaccgccatttcgcgtgtagaaaagtgaaccccgagaagacacagaacttacctgaagtcaccaggcagttaggcagcagggccgagggctgcccaggagctgcaggacaagcaccaggagcccctccgggtagctactaccctggaccccccaatagtggagggcagtatggtagtgggctaccccctggtggtggttatgggggtcctgcccctggagggccttatggaccaccagctggtggagggccctatggacaccccaatcctgggatgttcccctctggaactccaggaggaccatatggcggtgcagctcccgggggcccctatggtcagccacctccaagttcctacggtgcccagcagcctgggctttatggacagggtggcgcccctcccaatgtggatcctgaggcctactcctggttccagtcggtggactcagatcacagtggctatatctccatgaaggagctaaagcaggccctggtcaactgcaattggtcttcattcaatgatgagacctgcctcatgatgataaacatgtttgacaagaccaagtcaggccgcatcgatgtctacggcttctcagccctgtggaaattcatccagcagtggaagaacctcttccagcagtatgaccgggaccgctcgggctccattagctacacagagctgcagcaagctctgtcccaaatgggctacaacctgagcccccagttcacccagcttctggtctcccgctactgcccacgctctgccaatcctgccatgcagcttgaccgcttcatccaggtgtgcacccagctgcaggtgctgacagaggccttccgggagaaggacacagctgtacaaggcaacattcggctcagcttcgaggacttcgtcaccatgacagcttctcggatgctatgacccaaccatctgtggagagtggagtgcaccagggacctttcctggcttcttagagtgagagaagtatgtggacatctcttcttttcctgtccctctagaagaacattctcccttgcttgatgcaacactgttccaaaagagggtggagagtcctgcatcatagccaccaaatagtgaggaccggggctgaggccacacagataggggcctgatggaggagaggatagaagttgaatgtcctgatggccatgagcagttgagtggcacagcctggcaccaggagcaggtccttgtaatggagttagtgtccagtcagctgagctccaccctgatgccagtggtgagtgttcatcggcctgttaccgttagtacctgtgttccctcaccaggccatcctgtcaaacgagcccattttctccaaagtggaatctgaccaagcatgagagagatctgtctatgggaccagtggcttggattctgccacacccataaatccttgtgtgttaacttctagctgcctggggctggccctgctcagacaaatctgctccctgggcatctttggccaggcttctgccctctgcagctgggacccctcacttgcctgccatgctctgctcggcttcagtctccaggagacagtggtcacctctccctgccaatactttttttaatttgcattttttttcatttggggccaaaagtccagtgaaattgtaagcttcaataaaaggatgaaactctgga

SEQ ID NO: 295935 - DNA, 1397 bp, Homo sapiens
gaccccttgcctgagtgtgacgtcagaatcaccatggccagctatccttaccggcagggctgcccaggagctgcaggacaagcaccaggagcccctccgggtagctactaccctggaccccccaatagtggagggcagtatggtagtgggctaccccctggtggtggttatgggggtcctgcccctggagggccttatggaccaccagctggtggagggccctatggacaccccaatcctgggatgttcccctctggaactccaggaggaccatatggcggtgcagctcccgggggcccctatggtcagccacctccaagttcctacggtgcccagcagcctgggctttatggacagggtggcgcccctcccaatgtggatcctgaggcctactcctggttccagtcggtggactcagatcacagtggctatatctccatgaaggagctaaagcaggccctggtcaactgcaattggtcttcattcaatgatgagacctgcctcatgatgataaacatgtttgacaagaccaagtcaggccgcatcgatgtctacggcttctcagccctgtggaaattcatccagcagtggaagaacctcttccagcagtatgaccgggaccgctcgggctccattagctacacagagctgcagcaagctctgtcccaaatgggctacaacctgagcccccagttcacccagcttctggtctcccgctactgcccacgctctgccaatcctgccatgcagcttgaccgcttcatccaggtgtgcacccagctgcaggtgctgacagaggccttccgggagaaggacacagctgtacaaggcaacattcggctcagcttcgaggacttcgtcaccatgacagcttctcggatgctatgacccaaccatctgtggagagtggagtgcaccagggacctttcctggcttcttagagtgagagaagtatgtggacatctcttcttttcctgtccctctagaagaacattctcccttgcttgatgcaacactgttccaaaagagggtggagagtcctgcatcatagccaccaaatagtgaggaccggggctgaggccacacagataggggcctgatggaggagaggatagaagttgaatgtcctgatggccatgagcagttgagtggcacagcctggcaccaggagcaggtccttgtaatggagttagtgtccagtcagctgagctccaccctgatgccagtggtgagtgttcatcggcctgttaccgttagtacctgtgttccctcaccaggccatcctgtcaaacgagcccattttctccaaagtggaatctgaccaagcatgagagagatctgtctatgggaccagtggcttggattctgccacacccgtagctgtaccaacccggccc

SEQ ID NO: 295936 - DNA, 1745 bp, Homo sapiens
gaccccttgcctgagtgtgacgtcagaatcaccatggccagctatccttaccggcagggctgcccaggagctgcaggacaagcaccaggagcccctccgggtagctactaccctggaccccccaatagtggagggcagtatggtagtgggctaccccctggtggtggttatgggggtcctgcccctggagggccttatggaccaccagctggtggagggccctatggacaccccaatcctgggatgttcccctctggaactccaggaggaccatatggcggtgcagctcccgggggcccctatggtcagccacctccaagttcctacggtgcccagcagcctgggctttatggacaggggatacatgctgaaggagcagctcctgtttgggatatgttatctttgtggcagagagaaggagcaggagagctagcaagaatgcacaatgcctcttaaagcttctctgaagtggcgcccctcccaatgtggatcctgaggcctactcctggttccagtcggtggactcagatcacagtggctatatctccatgaaggagctaaagcaggccctggtcaactgcaattggtcttcattcaatgatgagacctgcctcatgatgataaacatgtttgacaagaccaagtcaggccgcatcgatgtctacggcttctcagccctgtggaaattcatccagcagtggaagaacctcttccagcagtatgaccgggaccgctcgggctccattagctacacagagctgcagcaagctctgtcccaaatgggctacaacctgagcccccagttcacccagcttctggtctcccgctactgcccacgctctgccaatcctgccatgcagcttgaccgcttcatccaggtgtgcacccagctgcaggtgctgacagaggccttccgggagaaggacacagctgtacaaggcaacattcggctcagcttcgaggacttcgtcaccatgacagcttctcggatgctatgacccaaccatctgtggagagtggagtgcaccagggacctttcctggcttcttagagtgagagaagtatgtggacatctcttcttttcctgtccctctagaagaacattctcccttgcttgatgcaacactgttccaaaagagggtggagagtcctgcatcatagccaccaaatagtgaggaccggggctgaggccacacagataggggcctgatggaggagaggatagaagttgaatgtcctgatggccatgagcagttgagtggcacagcctggcaccaggagcaggtccttgtaatggagttagtgtccagtcagctgagctccaccctgatgccagtggtgagtgttcatcggcctgttaccgttagtacctgtgttccctcaccaggccatcctgtcaaacgagcccattttctccaaagtggaatctgaccaagcatgagagagatctgtctatgggaccagtggcttggattctgccacacccataaatccttgtgtgttaacttctagctgcctggggctggccctgctcagacaaatctgctccctgggcatctttggccaggcttctgccctctgcagctgggacccctcacttgcctgccatgctctgctcggcttcagtctccaggagacagtggtcacctctccctgccaatactttttttaatttgcattttttttcatttggggccaaaagtccagtgaaattgtaagcttcaataaaaggatgaaactctgga

SEQ ID NO: 295937 - DNA, 1334 bp, Homo sapiens
gaccccttgcctgagtgtgacgtcagaatcaccatggccagctatccttaccggcaggtggcgcccctcccaatgtggatcctgaggcctactcctggttccagtcggtggactcagatcacagtggctatatctccatgaaggagctaaagcaggccctggtcaactgcaattggtcttcattcaatgatgagacctgcctcatgatgataaacatgtttgacaagaccaagtcaggccgcatcgatgtctacggcttctcagccctgtggaaattcatccagcagtggaagaacctcttccagcagtatgaccgggaccgctcgggctccattagctacacagagctgcagcaagctctgtcccaaatgggctacaacctgagcccccagttcacccagcttctggtctcccgctactgcccacgctctgccaatcctgccatgcagcttgaccgcttcatccaggtgtgcacccagctgcaggtgctgacagaggccttccgggagaaggacacagctgtacaaggcaacattcggctcagcttcgaggacttcgtcaccatgacagcttctcggatgctatgacccaaccatctgtggagagtggagtgcaccagggacctttcctggcttcttagagtgagagaagtatgtggacatctcttcttttcctgtccctctagaagaacattctcccttgcttgatgcaacactgttccaaaagagggtggagagtcctgcatcatagccaccaaatagtgaggaccggggctgaggccacacagataggggcctgatggaggagaggatagaagttgaatgtcctgatggccatgagcagttgagtggcacagcctggcaccaggagcaggtccttgtaatggagttagtgtccagtcagctgagctccaccctgatgccagtggtgagtgttcatcggcctgttaccgttagtacctgtgttccctcaccaggccatcctgtcaaacgagcccattttctccaaagtggaatctgaccaagcatgagagagatctgtctatgggaccagtggcttggattctgccacacccataaatccttgtgtgttaacttctagctgcctggggctggccctgctcagacaaatctgctccctgggcatctttggccaggcttctgccctctgcagctgggacccctcacttgcctgccatgctctgctcggcttcagtctccaggagacagtggtcacctctccctgccaatactttttttaatttgcattttttttcatttggggccaaaagtccagtgaaattgtaagcttcaataaaaggatgaaactctgga

SEQ ID NO: 295938 - DNA, 993 bp, Homo sapiens
gaccccttgcctgagtgtgacgtcagaatcaccatggccagctatccttaccggcagggctgcccaggagctgcaggacaagcaccaggagcccctccgggtagctactaccctggaccccccaatagtggagggcagtatggtagtgggctaccccctggtggtggttatgggggtcctgcccctggagggccttatggaccaccagctggtggagggccctatggacaccccaatcctgggatgttcccctctggaactccaggaggaccatatggcggtgcagctcccgggggcccctatggtcagccacctccaagttcctacggtgcccagcagcctgggctttatggacagggtggcgcccctcccaatgtggatcctgaggcctactcctggttccagtcggtggactcagatcacagtggctatatctccatgaaggagctaaagcaggccctggtcaactgcaattggtcttcattcaatgatgagacctgcctcatgatgataaacatgtttgacaagaccaagtcaggccgcatcgatgtctacggcttctcagccctgtggaaattcatccagcagtggaagaacctcttccagcagtatgaccgggaccgctcgggctccattagctacacagagctgcagcaagctctgtcccaaatgggctacaacctgagcccccagttcacccagcttctggtctcccgctactgcccacgctctgccaatcctgccatgcagcttgaccgcttcatccaggtgtgcacccagctgcaggtgctgacagaggccttccgggagaaggacacagctgtacaaggcaacattcggctcagcttcgaggacttcgtcaccatgacagcttctcggatgctatgacccaaccatctgtggagagtggagtgcaccagggacctttcccgggatctaagaggaaacacctgggcccttttccggccgaaaaaattccccgcggcgctggca

SEQ ID NO: 295939 - DNA, 1012 bp, Homo sapiens
gaccccttgcctgagtgtgacgtcagaatcaccatggccagctatccttaccggcagggctgcccaggagctgcaggacaagcaccaggagcccctccgggtagctactaccctggaccccccaatagtggagggcagtatggtagtgggctaccccctggtggtggttatgggggtcctgcccctggagggccttatggaccaccagctggtggagggccctatggacaccccaatcctgggatgttcccctctggaactccaggaggaccatatggcggtgcagctcccgggggcccctatggtcagccacctccaagttcctacggtgcccagcagcctgggctttatggacagggtggcgcccctcccaatgtggatcctgaggcctactcctggttccagtcggtggactcagatcacagtggctatatctccatgaaggagctaaagcaggccctggtcaactgcaattggtcttcattcaatgatgagacctgcctcatgatgataaacatgtttgacaagaccaagtcaggccgcatcgatgtctacggcttctcagccctgtggaaattcatccagcagtggaagaacctcttccagcagtatgaccgggaccgctcgggctccattagctacacagagctgcagcaagctctgtcccaaatgggctacaacctgagcccccagttcacccagcttctggtctcccgctactgcccacgctctgccaatcctgccatgcagcttgaccgcttcatccaggtgtgcacccagctgcaggtgctgacagaggccttccgggagaaggacacagctgtacaaggcaacattcggctcagcttcgaggacttcgtcaccatgacagcttctcggatgctatgacccaaccatctgtggagagtggagtgcaccagggacctttcgagcaagccaggcctggattgctcaggtctgagtagctagggtttgaatactaccaacttctctgaactacagagtcagatgc

SEQ ID NO: 295940 - DNA, 1129 bp, Homo sapiens
  misc_feature (24)..(24): n is a, c, g, or t
  misc_feature (57)..(57): n is a, c, g, or t
  misc_feature (78)..(78): n is a, c, g, or t
  misc_feature (112)..(112): n is a, c, g, or t
aatcgcatcttttgtgagtagccnaagttttgtccaaagttgggatggcaggccagntgcaccattggggtggcccanaaagcagtaccagcacatcatcccctggagcggncaggtgttcccggatcatgtcggcagtcacaaagcccttgctgtaggcccaatcttttgggggatgatccagagtgaaccccagcttctggtctcccgctactgcccacgctctgccaatcctgccatgcagcttgaccgcttcatccaggtgtgcacccagctgcaggtgctgacagaggccttccgggagaaggacacagctgtacaaggcaacattcggctcagcttcgaggacttcgtcaccatgacagcttctcggatgctatgacccaaccatctgtggagagtggagtgcaccagggacctttcctggcttcttagagtgagagaagtatgtggacatctcttcttttcctgtccctctagaagaacattctcccttgcttgatgcaacactgttccaaaagagggtggagagtcctgcatcatagccaccaaatagtgaggaccggggctgaggccacacagataggggcctgatggaggagaggatagaagttgaatgtcctgatggccatgagcagttgagtggcacagcctggcaccaggagcaggtccttgtaatggagttagtgtccagtcagctgagctccaccctgatgccagtggtgagtgttcatcggcctgttaccgttagtacctgtgttccctcaccaggccatcctgtcaaacgagcccattttctccaaagtggaatctgaccaagcatgagagagatctgtctatgggaccagtggcttggattctgccacacccataaatccttgtgtgttaacttctagctgcctggggctggccctgctcagacaaatctgctccctgggcatctttggccaggcttctgccctctgcagctgggacccctcacttgcctgccatgctctgctcggcttcagtctccaggagacagtggtcacctctccctgccaatactttttttaatttgcattttttttcatttggggccaaaagtccagtgaaattgtaagcttcaataaaaggatgaaactctgga

SEQ ID NO: 295941 - DNA, 942 bp, Homo sapiens
  misc_feature (234)..(234): n is a, c, g, or t
tttttatccaaaatgtgtttattgagatggtttcccactcatcttgactcagagtgcttttagtgctgcttcctcctgaaggaacatccttctgtaagccttgcttttcctcctgtaggctggcagaggacagtggagcagccaacacacaaaactaccgtttgtgcatggctaaagaccgtggtgattttatagcatcctgggcatttcacctcgtgccgaattcggcagagnctctggcttcttagagtgagagaagtatgtggacatctcttcttttcctgtccctctagaagaacattctcccttgcttgatgcaacactgttccaaaagagggtggagagtcctgcatcatagccaccaaatagtgaggaccggggctgaggccacacagataggggcctgatggaggagaggatagaagttgaatgtcctgatggccatgagcagttgagtggcacagcctggcaccaggagcaggtccttgtaatggagttagtgtccagtcagctgagctccaccctgatgccagtggtgagtgttcatcggcctgttaccgttagtacctgtgttccctcaccaggccatcctgtcaaacgagcccattttctccaaagtggaatctgaccaagcatgagagagatctgtctatgggaccagtggcttggattctgccacacccataaatccttgtgtgttaacttctagctgcctggggctggccctgctcagacaaatctgctccctgggcatctttggccaggcttctgccctctgcagctgggacccctcacttgcctgccatgctctgctcggcttcagtctccaggagacagtggtcacctctccctgccaatactttttttaatttgcattttttttcatttggggccaaaagtccagtgaaattgtaagcttcaataaaaggatgaaactctgga

SEQ ID NO: 295942 - DNA, 1459 bp, Homo sapiens
gatgcctggtgctggtggaacccctgcacagagacggacacaggatgagctctaagtacccgcggtctgtccggcgctgcctgcccctctgggccctaacactggaagcagctctcattctcctcttctatttttttacccactatgacgcttccttagaggatcaaaaggggctcgtggcatcctatcaagttggccaagatctgaccgtgatggcggccattggcttgggcttcctcacctcgagtttccggagacacagctggagcagtgtggccttcaacctcttcatgctggcgcttggtgtgcagtgggcaatcctgctggacggcttcctgagccagttcccttctgggaaggtggtcatcacactgttcagtattcggctggccaccatgagtgctttgtcggtgctgatctcagtggatgctgtcttggggaaggtcaacttggcgcagttggtggtgatggtgctggtggaggtgacagctttaggcaacctgaggatggtcatcagtaatatcttcaacacagactaccacatgaacatgatgcacatctacgtgttcgcagcctattttgggctgtctgtggcctggtgcctgccaaagcctctacccgagggaacggaggataaagatcagacagcaacgatacccagtttgtctgccatgctgggcgccctcttcttgtggatgttctggccaagtgtcaactctgctctgctgagaagtccaatccaaaggaagaatgccatgttcaacacctactatgctctagcagtcagtgtggtgacagccatctcagggtcatccttggctcacccccaaaggaagatcagcaagacttatgtgcacagtgcggtgttggcaggaggcgtggctgtgggtacctcgtgtcacctgatcccttctccgtggcttgccatggtgctgggtcttgtggctgggctgatctccgtcgggggagccaagtacctgccggggtgttgtaaccgagtgctggggattccccacagctccatcatgggctacaacttcagcttgctgggtctgcttggagagatcatctacattgtgctgctggtgcttgataccgtctggagccggcaatggcatgattggcttccaggtcctcctcagcattggggaactcagcttggccatcgtgatagctctcacgtctggtctcctgacaggtttgctcctaaatctcaaaatatggaaagcacctcatgtggctaaatattttgatgaccaagttttctggaagtttcctcatttggctgttggattttaagcaaaagcatccaagaaaaacaaggcctgttcaaaaacaagacaacttcctctcactgttgcctgcatttgtacgtgagaaacgctcatgacagcaaagtctccttatgtataatgaaacaaggtcagagacagatttgatattaaaaaattaaagacta

SEQ ID NO: 295943 - DNA, 1297 bp, Homo sapiens
agaggagacctaagaaggctcttcgaacacttgaaagaccggcatgtaggccgggcgcagtgactcacgcctgtaatcccagcagttttggaggtcgaggcgggtggatcacctgagtttgggagtttgataccagcctgaccaacaaggtgaaaccccgtctctactaaaaaatacaaacattagctgggcatggtggcgggtgcctgtaatcccagctactccggtggttgaggcagaattgcttgaacccgggaggcagaggttgcagtgagctgagattgcatcactgcactccagcctgagacaagagcgaaactccatctcaaacaaaacaaacaaccaaccaaacaaaaccaaaaaaaaaactggcatgtagaagaaaaatactttttctctacacttctccaaagaatttaactaggcccaggggaggtgcagtataaatttctaacaatctcaactgtctgccaaatggaatgagctacttcatatggcagtagtgagtcctctgtctttggaggcattcaaataaaagccagatggccatttatcaacaatccatgtaaaacgttagatgaaataaaacctatatatccaagatctcttccaattcagattttatgaaagaatttctaaggtctttgtaatgagacatttaggctgtttcaagagatcaagccaaaatcagtatgtgggttcatctgcaataaaaatgtttgttttgcttttacagtttcctcatttggctgttggattttaagcaaaagcatccaagaaaaacaaggcctgttcaaaaacaagacaacttcctctcactgttgcctgcatttgtacgtgagaaacgctcatgacagcaaagtctccttatgtataatgaaacaaggtcagagacagatttgatattaaaaaattaaagactaaaaacttagtttaagagtcaatttaataagtttaaaataaatgtttagtttcattaggatgatgctatcaatattttcttggttacagacacattattaaagttttgggttaattttattgacaattcttaagattctttctcatgcttaataaagcatgctactcagttaactcttgtctacatcagcaaagcagataatacaaaacaggaaaattacaaatcactgatacttagtccttgtgggaatcatgcttttctcccagcagttttacaaggtggctggcattccctgagcatattctgaattgcactgtggggaaagaggttgtgctcagttgtagggtggggggatgcactgcctgaggataaaaa

SEQ ID NO: 295944 - DNA, 1833 bp, Homo sapiens
gatgcctggtgctggtggaacccctgcacagagacggacacaggatgagctctaagtacccgcggtctgtccggcgctgcctgcccctctgggccctaacactggaagcagctctcattctcctcttctatttttttacccactatgacgcttccttagaggatcaaaaggggctcgtggcatcctatcaagttggccaagatctgaccgtgatggcggccattggcttgggcttcctcacctcgagtttccggagacacagctggagcagtgtggccttcaacctcttcatgctggcgcttggtgtgcagtgggcaatcctgctggacggcttcctgagccagttcccttctgggaaggtggtcatcacactgttcagtattcggctggccaccatgagtgctttgtcggtgctgatctcagtggatgctgtcttggggaaggtcaacttggcgcagttggtggtgatggtgctggtggaggtgacagctttaggcaacctgaggatggtcatcagtaatatcttcaacacagactaccacatgaacatgatgcacatctacgtgttcgcagcctattttgggctgtctgtggcctggtgcctgccaaagcctctacccgagggaacggaggataaagatcagacagcaacgatacccagtttgtctgccatgctgggcgccctcttcttgtggatgttctggccaagtgtcaactctgctctgctgagaagtccaatccaaaggaagaatgccatgttcaacacctactatgctctagcagtcagtgtggtgacagccatctcagggtcatccttggctcacccccaaaggaagatcagcaagacttatgtgcacagtgcggtgttggcaggaggcgtggctgtgggtacctcgtgtcacctgatcccttctccgtggcttgccatggtgctgggtcttgtggctgggctgatctccgtcgggggagccaagtacctgccggggtgttgtaaccgagtgctggggattccccacagctccatcatgggctacaacttcagcttgctgggtctgcttggagagatcatctacattgtgctgctggtgcttgataccgtctggagccggcaatggcatgattggcttccaggtcctcctcagcattggggaactcagcttggccatcgtgatagctctcacgtctggtctcctgacaggtttgctcctaaatctcaaaatatggaaagcacctcatgtggctaaatattttgatgaccaagttttctggaagtttcctcatttggctgttggattttaagcaaaagcatccaagaaaaacaaggcctgttcaaaaacaagacaacttcctctcactgttgcctgcatttgtacgtgagaaacgctcatgacagcaaagtctccttatgtataatgaaacaaggtcagagacagatttgatattaaaaaattaaagactaaaaacttagtttaagagtcaatttaataagtttaaaataaatgtttagtttcattaggatgatgctatcaatattttcttggttacagacacattattaaagttttgggttaattttattgacaattcttaagattctttctcatgcttaataaagcatgctactcagttaactcttgtctacatcagcaaagcagataatacaaaacaggaaaattacaaatcactgatacttagtccttgtgggaatcatgcttttctcccagcagttttacaaggtggctggcattccctgagcatattctgaattgcactgtggggaaagaggttgtgctcagttgtagggtggggggatgcactgcctgaggataaaaa

SEQ ID NO: 295945 - DNA, 1577 bp, Homo sapiens
gatgcctggtgctggtggaacccctgcacagagacggacacaggatgagctctaagtacccgcggtctgtccggcgctgcctgcccctctgggccctaacactggaagcagctctcattctcctcttctatttttttacccactatgacgcttccttagaggatcaaaaggggctcgtggcatcctatcaagttggccaagatctgaccgtgatggcggccattggcttgggcttcctcacctcgagtttccggagacacagctggagcagtgtggccttcaacctcttcatgctggcgcttggtgtgcagtgggcaatcctgctggacggcttcctgagccagttcccttctgggaaggtggtcatcacactgttcagtattcggctggccaccatgagtgctttgtcggtgctgatctcagtggatgctgtcttggggaaggtcaacttggcgcagttggtggtgatggtgctggtggaggtgacagctttaggcaacctgaggatggtcatcagtaatatcttcaacacagactaccacatgaacatgatgcacatctacgtgttcgcagcctattttgggctgtctgtggcctggtgcctgccaaagcctctacccgagggaacggaggataaagatcagacagcaacgatacccagtttgtctgccatgctgggcgccctcttcttgtggatgttctggccaagtgtcaactctgctctgctgagaagtccaatccaaaggaagaatgccatgttcaacacctactatgctctagcagtcagtgtggtgacagccatctcagggtcatccttggctcacccccaaaggaagatcagcaagacttatgtgcacagtgcggtgttggcaggaggcgtggctgtgggtacctcgtgtcacctgatcccttctccgtggcttgccatggtgctgggtcttgtggctgggctgatctccgtcgggggagccaagtacctgccggggtgttgtaaccgagtgctggggattccccacagctccatcatgggctacaacttcagcttgctgggtctgcttggagagatcatctacattgtgctgctggtgcttgataccgtctggagccggcaatggcatgattggcttccaggtcctcctcagcattggggaactcagcttggccatcgtgatagctctcacgtctggtctcctgacaggtttgctcctaaatctcaaaatatggaaagcacctcatgtggctaaatattttgatgaccaagttttctggaagtttcctcatttggctgttggattttaagcaaaagcatccaagaaaaacaaggcctgttcaaaaacaagacaacttcctctcactgttgcctgcatttgtacgtgagaaacgctcatgacagcaaagtctccttatgtataatgaaacaaggtcagagacagatttgatattaaaaaattaaagactaaaaacttagtttaagagtcaatttaataagtttaaaataaatgtttagtttcattaggatgatgctatcaatattttcttggttacagacacattattaaagttttgggttaatttta

SEQ ID NO: 295946 - DNA, 1544 bp, Homo sapiens
gatgcctggtgctggtggaacccctgcacagagacggacacaggatgagctctaagtacccgcggtctgtccggcgctgcctgcccctctgggccctaacactggaagcagctctcattctcctcttctatttttttacccactatgacgcttccttagaggatcaaaaggggctcgtggcatcctatcaagttggccaagatctgaccgtgatggcggccattggcttgggcttcctcacctcgagtttccggagacacagctggagcagtgtggccttcaacctcttcatgctggcgcttggtgtgcagtgggcaatcctgctggacggcttcctgagccagttcccttctgggaaggtggtcatcacactgttcagtattcggctggccaccatgagtgctttgtcggtgctgatctcagtggatgctgtcttggggaaggtcaacttggcgcagttggtggtgatggtgctggtggaggtgacagctttaggcaacctgaggatggtcatcagtaatatcttcaacacagactaccacatgaacatgatgcacatctacgtgttcgcagcctattttgggctgtctgtggcctggtgcctgccaaagcctctacccgagggaacggaggataaagatcagacagcaacgatacccagtttgtctgccatgctgggcgccctcttcttgtggatgttctggccaagtgtcaactctgctctgctgagaagtccaatccaaaggaagaatgccatgttcaacacctactatgctctagcagtcagtgtggtgacagccatctcagggtcatccttggctcacccccaaaggaagatcagcaagacttatgtgcacagtgcggtgttggcaggaggcgtggctgtgggtacctcgtgtcacctgatcccttctccgtggcttgccatggtgctgggtcttgtggctgggctgatctccgtcgggggagccaagtacctgccgtttcctcatttggctgttggattttaagcaaaagcatccaagaaaaacaaggcctgttcaaaaacaagacaacttcctctcactgttgcctgcatttgtacgtgagaaacgctcatgacagcaaagtctccttatgtataatgaaacaaggtcagagacagatttgatattaaaaaattaaagactaaaaacttagtttaagagtcaatttaataagtttaaaataaatgtttagtttcattaggatgatgctatcaatattttcttggttacagacacattattaaagttttgggttaattttattgacaattcttaagattctttctcatgcttaataaagcatgctactcagttaactcttgtctacatcagcaaagcagataatacaaaacaggaaaattacaaatcactgatacttagtccttgtgggaatcatgcttttctcccagcagttttacaaggtggctggcattccctgagcatattctgaattgcactgtggggaaagaggttgtgctcagttgtagggtggggggatgcactgcctgaggataaaaa

SEQ ID NO: 295947 - DNA, 426 bp, Homo sapiens
aggttagattttctgaaggacatctgggggaatactatgttctataatgtctaccgagtgaatatttttctctttatttatatacaaaagtactattttttgggacagggactcactctgccagccaggttcgtgtgcagcaatatgatcattgctcacttgcagcctcaaactcctgggctcaagtgagccccctgccttaacctcccaagtagctgggggactacaggcatgagccaccacacccaactcaatatttatgtacaaaataaataggactagcatgcatggaataggaatctcatacataaggaagagagagaatggggcagaaaaaaaactgaagaaaatttccacatttggtgtgaaaagaagttcaaagaccaagatagacaagggaaaaattacaccttagcaaattgtagc

SEQ ID NO: 295948 - DNA, 599 bp, Homo sapiens
cttttgtcctatcttgatagacacaagctggatgttgtttcctgtggcaagtccacagtccgagtgcagaaggccatctgcagtgggttcttccgtaatgctgccaagaaagacccgcaggagggttaccggacactgatcgaccagcaggtggtctatatccatccttccagtgccctcttcaacagacagccagaatggtaggtggacatgtcccagggtctaggggcttttctgggcagagaaaaacctgtaaatttcctggtattttgtgattgtgtcttcactactcccaatatgtcctagtataacactgcttgcctttctagagcagcagaaacctgaattaggcacaatgtatcaaaccctatgagagaattaaaatcataggggtgagacctagttgaaaatcccagcactttgggaggctgaggtgggcagatcagccgaggtcgggagttcaagaccagcctgaccaacatggagaaaccctgtctctactaatacttagccaggtatggtggcgcatgcctgtaatcccagctacttgggaggctgagacaggacaatcgcttgaacccaggaggtggaggttgcag

SEQ ID NO: 295949 - DNA, 2055 bp, Homo sapiens
cagacccgaatctttgacccagctccaccaggcagcagaaaggttgtgattgccaccaatatcgcagagacatcgctgactattgatggtatctactatgtggtggacccaggattcgtgaaacagaaagtttacaattccaagacagggattgaccagctcgtggtgacgcctatttctcaggctcaggcaaagcaacgagctggcagagctgggagaacaggcccagggaagtgttacaggttgtacacagaacgtgcctaccgagatgaaatgctgaccaccaacgtgccggaaatccagagaaccaacttagcaagcacagtgctgtcactcaaggccatgggtatcaatgatctgctgtcctttgatttcatggatgccccacctatggaaactttgatcacagccatggagcagctgtacacactgggggccctggatgacgagggcctgctcactcgcttgggccgccggatggcagagttccctctggagccaatgctatgcaaaatgctcatcatgtctgtgcatctgggctgcagtgaggaaatgctgaccattgtatccatgctgtctgtgcagaacgtcttctataggcccaaggataaacaagcccttgcagatcagaagaaggccaaattccaccagactgaaggggaccacctcaccctgctagctgtgtacaactcctggaagaacaacaagttctccaacccatggtgctatgagaactttatccaggctcgttccctgcgccgggcccaggacattcgcaagcagatgttaggcataatggacagacacaagctggatgttgtttcctgtggcaagtccacagtccgagtgcagaaggccatctgcagtgggttcttccgtaatgctgccaagaaagacccgcaggagggttaccggacactgatcgaccagcaggtggtctatatccatccttccagtgccctcttcaacagacagccagaatgggtggtgtaccatgagctggtgctcaccaccaaggaatacatgcgtgaagttaccaccatcgaccctcggtggcttgtggagtttgccccagccttcttcaaggtctcagacccaactaagctaagcaaacagaagaagcaacagcgtcttgaacccttgtacaaccgctatgaggaacccaatgcctggagaatatctcgagctttccgacggcgctgaaaggcaagattgttcctttgcctctccagcagcagtagccagggcttggacttatcgatgacaggctggtcctgaggatacagctgtcccgtgactgactgtcttaactgagcattttctcaactcgactctcatttcttccctgctggtaaaatagaaacagggatttaaacctggctttggcaagagcctgcagcctccatcaccccaagtccttgggcccagttgggagctcatatctaacacagagacacattgcatcaacttcaagaaagggacaatttgtgcagctccaggatgggaaggtggagtgggtgagcatcttgtgcagggacatggtgagtgccctgatgccccagctagcaggagctactgtgctcatctaaagtgtttgccccacttcccaccccgtctccagcccctgtactttggcttgacctcgtggaaatatttattttcttaaggaaacaaaaaaaaaaaaaaaaaaaaaaaaaaaaaaaaaaaaaaaacaaaactaaaaacaaagaggggggggcccgcacatcaaaaaatcatccccgggaggggcaccccactatcacgctcgatacaccaggctttctgtggacaaagggggccccacaaagggggcacgcaaataaaaaacgacagagacgacggggcgcggaggtaacaacaacacggcggagagcgggaaaaaccagcgcgacacacggaggaaacctcgtggggaagaagcacaccctaacagagcggggggggggagcaaaaataggggggacacaccaacacccaacagagacaattagaccacgcccagagggcaaaaacataaaacatcgacgcggccaa

SEQ ID NO: 295950 - DNA, 2538 bp, Homo sapiens
cagacccgaatctttgacccagctccaccaggcagcagaaaggttgtgattgccaccaatatcgcagagacatcgctgactattgatggtatctactatgtggtggacccaggattcgtgaaacagaaagtttacaattccaagacagggattgaccagctcgtggtgacgcctatttctcaggctcaggcaaagcaacgagctggcagagctgggagaacaggcccagggaagtgttacaggttgtacacagaacgtgcctaccgagatgaaatgctgaccaccaacgtgccggaaatccagagaaccaacttagcaagcacagtgctgtcactcaaggccatgggtatcaatgatctgctgtcctttgatttcatggatgccccacctatggaaactttgatcacagccatggagcagctgtacacactgggggccctggatgacgagggcctgctcactcgcttgggccgccgggtaagggacagactcaacttcctgtgcttttgggaagattccctggtcagcctttcacatccttcggtctgtacaaaatcaggctgaggccgtggataagctttgagtaaaattctaaatgtttgtttttaacctgaatttctccactgtcactttaaactgtttcttctttatacaaaaaggtgttctgttcataattttgcctgaggatgtattactgaatgtagccttaattagaaacggcatctgcaaaattctcatctaccccaacagtagttatatgcttggtcacatacatcccgttggagtttatttgggaaaagaataaacaacagcattcttctgatagagaaaggcatcccaaggcatcattatgctttgggaaaatctgtgttgttacccactctgaccaaggtcttgctctggtgaatccaaatgtgtcttccacagggaagcagttgtagtctttttttgtccctctagatggcagagttccctctggagccaatgctatgcaaaatgctcatcatgtctgtgcatctgggctgcagtgaggaaatgctgaccattgtatccatgctgtctgtgcagaacgtcttctataggcccaaggataaacaagcccttgcagatcagaagaaggccaaattccaccagactgaaggggaccacctcaccctgctagctgtgtacaactcctggaagaacaacaagttctccaacccatggtgctatgagaactttatccaggctcgttccctgcgccgggcccaggacattcgcaagcagatgttaggcataatggacagacacaagctggatgttgtttcctgtggcaagtccacagtccgagtgcagaaggccatctgcagtgggttcttccgtaatgctgccaagaaagacccgcaggagggttaccggacactgatcgaccagcaggtggtctatatccatccttccagtgccctcttcaacagacagccagaatgggtggtgtaccatgagctggtgctcaccaccaaggaatacatgcgtgaagttaccaccatcgaccctcggtggcttgtggagtttgccccagccttcttcaaggtctcagacccaactaagctaagcaaacagaagaagcaacagcgtcttgaacccttgtacaaccgctatgaggaacccaatgcctggagaatatctcgagctttccgacggcgctgaaaggcaagattgttcctttgcctctccagcagcagtagccagggcttggacttatcgatgacaggctggtcctgaggatacagctgtcccgtgactgactgtcttaactgagcattttctcaactcgactctcatttcttccctgctggtaaaatagaaacagggatttaaacctggctttggcaagagcctgcagcctccatcaccccaagtccttgggcccagttgggagctcatatctaacacagagacacattgcatcaacttcaagaaagggacaatttgtgcagctccaggatgggaaggtggagtgggtgagcatcttgtgcagggacatggtgagtgccctgatgccccagctagcaggagctactgtgctcatctaaagtgtttgccccacttcccaccccgtctccagcccctgtactttggcttgacctcgtggaaatatttattttcttaaggaaacaaaaaaaaaaaaaaaaaaaaaaaaaaaaaaaaaaaaaaaacaaaactaaaaacaaagaggggggggcccgcacatcaaaaaatcatccccgggaggggcaccccactatcacgctcgatacaccaggctttctgtggacaaagggggccccacaaagggggcacgcaaataaaaaacgacagagacgacggggcgcggaggtaacaacaacacggcggagagcgggaaaaaccagcgcgacacacggaggaaacctcgtggggaagaagcacaccctaacagagcggggggggggagcaaaaataggggggacacaccaacacccaacagagacaattagaccacgcccagagggcaaaaacataaaacatcgacgcggccaa

SEQ ID NO: 295951 - DNA, 1582 bp, Homo sapiens
aaaaaaacttgttttaaagtagcatttttaaaaaattggactctatctagaaccctaatataaaactgatttaaaaccaccatgttatcacagtagaagggttagaaatgtggctccttgcatgtttggccttctccatcccttgtggcagtgtgaggcccctcttcagagccctagaattctgtggaaacattctaataaacatcctcacattttatagagcaagaaacagattagagaagggatgtgattggctccatgtcacttaactagttagagccagagccaggactagaatacattctcctgagacctttcttgtggttagaggtgtgcgggtgcttcagtattggggtgtggctgtcataaacagactgcagtcttataggtgtcaggcaggagaggtaatagtataaaatgtaagctcagctgaggcctactagggaccaggttgactgtagagtggggcctatatccagaggcttgagtactatctctgtcccccctcagggtggtgtaccatgagctggtgctcaccaccaaggaatacatgcgtgaagttaccaccatcgaccctcggtggcttgtggagtttgccccagccttcttcaaggtctcagacccaactaagctaagcaaacagaagaagcaacagcgtcttgaacccttgtacaaccgctatgaggaacccaatgcctggagaatatctcgagctttccgacggcgctgaaaggcaagattgttcctttgcctctccagcagcagtagccagggcttggacttatcgatgacaggctggtcctgaggatacagctgtcccgtgactgactgtcttaactgagcattttctcaactcgactctcatttcttccctgctggtaaaatagaaacagggatttaaacctggctttggcaagagcctgcagcctccatcaccccaagtccttgggcccagttgggagctcatatctaacacagagacacattgcatcaacttcaagaaagggacaatttgtgcagctccaggatgggaaggtggagtgggtgagcatcttgtgcagggacatggtgagtgccctgatgccccagctagcaggagctactgtgctcatctaaagtgtttgccccacttcccaccccgtctccagcccctgtactttggcttgacctcgtggaaatatttattttcttaaggaaacaaaaaaaaaaaaaaaaaaaaaaaaaaaaaaaaaaaaaaaacaaaactaaaaacaaagaggggggggcccgcacatcaaaaaatcatccccgggaggggcaccccactatcacgctcgatacaccaggctttctgtggacaaagggggccccacaaagggggcacgcaaataaaaaacgacagagacgacggggcgcggaggtaacaacaacacggcggagagcgggaaaaaccagcgcgacacacggaggaaacctcgtggggaagaagcacaccctaacagagcggggggggggagcaaaaataggggggacacaccaacacccaacagagacaattagaccacgcccagagggcaaaaacataaaacatcgacgcggccaa

SEQ ID NO: 295952 - DNA, 1819 bp, Homo sapiens
cttcccatagagatgggttcccactgtgctgcccaggctgctctccaatccctggcgtcaagcaatcctcctgcctctgcctcccaaagcgctgggattacagttgagagccactgtcctctgcactgaggaggctccttacctggcggaacatcaggcaggtcttgccaggccaggtttcggaacttacggaaagctggtctggatgtagtgcttgtagagaagcttctgagagattgggcacatcctgttacgttgctgcttctcctgtccttatgttattagtaagttctgaagtgatgtaaatgctagaactactgtagaactgtatgccagacactaagagagactatgtaacattccaggatataaaggaatgtatgttgtcactgggcagcaaaccacaccctaaagacaattcagaaagagtccgagggagaggaatataggccaggcaatctgctggctgcagatccctgccccttcattaagctgagtgcctcctgattctgtctgagtattcgcctttgtaagcccaggccagtaatcaaggggcagggcattgttgtgtgttaaccttgaaggccttctggggagagacagtacagggacctcaaatgaaaccaaaggggaaacggggactgggcacccacctccccaatctcgttttgtttttgtttttgttaagacaggatcttgccatcttgcctaggctggcatcaaactcctgagctcaagtgatcttcctgcctcagcctcctgagtagctgggactacaggtgcatgccaccacacctggctcccagtcctaattccagcctaaattttccccattcagaaacactcctggatatagtggcccagcctgtcctgactgagtgcccagcactgacaatgttgacacctggggagggagggttgggtttcaagctgaggttgaaaagggatgttgaatgggctaaggataagagacagcagggttcgttatcttttctggctcaggtggaggaaaaagaaggatccccattctgtgggtgttccttgaccatctctctacgctagagctgaggtcacttctctgctatgacaacatagctgggttctgaccttttgaccatcaggaaagcaatgtcagcagctgagctgagcctgctctgagggagaaggggggggtcctgtccagatgcagaaggggagcttgcctgctgctctcacacaatggagcccttgtttctcttccttgaaccagtatttcccaagattgagtgacagcccaggagaggatgtgggtctcatgcagagagctgggatcttcttggccattaaagtatattgttcacccccaccccgcgagaaccaagctcaggagttgcctgcctctgcacacatgctgagtgtgctgtttgtgtatatggcaggaccgtccctatggggcatgtgtgagctccgcagctgggtcaggctcctcggtccaggtttacttcatcccgcctggacgtgatttggctttgactgtctctcctgcagcccaaagcacttcctccctgtggttgctgtagctgtctcattggagcagtgcctctccaagtttgaggatttgaacaaagaactgggactggtgacttgttaatgaacagttcagagggcagagggccatcatctcagcttgtggagacctttctttccctggatgctgcttctcagctaactccctctctcttcgtgtgtgtactcggccttcagggtttccaccgatttttacaccttcttcccaccacgatagcttggctttaatgtggaattaaattatatattttta

SEQ ID NO: 295953 - DNA, 1880 bp, Homo sapiens
cttcccatagagatgggttcccactgtgctgcccaggctgctctccaatccctggcgtcaagcaatcctcctgcctctgcctcccaaagcgctgggattacagttgagagccactgtcctctgcactgaggaggctccttacctggcggaacatcaggcaggtcttgccaggccaggtttcggaacttacggaaagctggtctggatgtagtgcttgtagagaagcttctgagagattgggcacatcctgttacgttgctgcttctcctgtccttatgttattagtaagttctgaagtgatgtaaatgctagaactactgtagaactgtatgccagacactaagagagactatgtaacattccaggatataaaggaatgtatgttgtcactgggcagcaaaccacaccctaaagacaattcagaaagagtccgagggagaggaatataggccaggcaatctgctggctgcagatccctgccccttcattaagctgagtgcctcctgattctgtctgagtattcgcctttgtaagcccaggccagtaatcaaggggcagggcattgttgtgtgttaaccttgaaggccttctggggagagacagtacagggacctcaaatgaaaccaaaggggaaacggggactgggcacccacctccccaatctcgttttgtttttgtttttgttaagacaggatcttgccatcttgcctaggctggcatcaaactcctgagctcaagtgatcttcctgcctcagcctcctgagtagctgggactacaggtgcatgccaccacacctggctcccagtcctaattccagcctaaattttccccattcagaaacactcctggatatagtggcccagcctgtcctgactgagtgcccagcactgacaatgttgacacctggggagggagggttgggtttcaagctgaggttgaaaagggatgttgaatgggctaaggataagagacagcagggttcgttatcttttctggctcaggtggaggaaaaagaaggatccccattctgtgggtgttccttgaccatctctctacgctagagctgaggtcacttctctgctatgacaacatagctgggttctgaccttttgaccatcaggaaagcaatgtcagcagctgagctgagcctgctctgagggagaaggggggggtcctgtccagatgcagaaggggagcttgcctgctgctctcacacaatggagcccttgtttctcttccttgaaccagtatttcccaagattgagtgacagcccaggagaggatgtgggtctcatgcagagagctgggatcttcttggccattaaagtatattgttcacccccaccccgcgagaaccaagctcaggagttgcctgcctctgcacacatgctgagtgtgctgtttgtgtatatggcaggaccgtccctatggggcatgtgtgagctccgcagctgggtcaggctcctcggtccaggtttacttcatcccgcctggacgtgatttggctttgactgtctctcctgcagcccaaagcacttcctccctgtggttgctgtagctgtctcattggagcagtgcctctccaagtttgaggatttgaacaaagaactgggactggtgacttgttaatgaacagttcagagggcagagggccatcatctcagcttgtggagacctttctttccctggatgctgcttctcagctaactccctctctcttcgtgtgtgtactcggccttcagggtttccaccgatttttacaccttcttcccaccacgatagcttggctttaatgtggaattaaattatatatttttaaaacctgtttttaaaattttgtttcttgcactaaattatgtcagtacattgatattttgtg

SEQ ID NO: 295954 - DNA, 1840 bp, Homo sapiens
gagatggggccttgctctgtcgcccagtttggagtgcagtggtgcaatctcagctcactgcaacctcggcctcctgggttcaacaatcctcctgcctctgcctcccaaagcgctgggattacagttgagagccactgtcctctgcactgaggaggctccttacctggcggaacatcaggcaggtcttgccaggccaggtttcggaacttacggaaagctggtctggatgtagtgcttgtagagaagcttctgagagattgggcacatcctgttacgttgctgcttctcctgtccttatgttattagtaagttctgaagtgatgtaaatgctagaactactgtagaactgtatgccagacactaagagagactatgtaacattccaggatataaaggaatgtatgttgtcactgggcagcaaaccacaccctaaagacaattcagaaagagtccgagggagaggaatataggccaggcaatctgctggctgcagatccctgccccttcattaagctgagtgcctcctgattctgtctgagtattcgcctttgtaagcccaggccagtaatcaaggggcagggcattgttgtgtgttaaccttgaaggccttctggggagagacagtacagggacctcaaatgaaaccaaaggggaaacggggactgggcacccacctccccaatctcgttttgtttttgtttttgttaagacaggatcttgccatcttgcctaggctggcatcaaactcctgagctcaagtgatcttcctgcctcagcctcctgagtagctgggactacaggtgcatgccaccacacctggctcccagtcctaattccagcctaaattttccccattcagaaacactcctggatatagtggcccagcctgtcctgactgagtgcccagcactgacaatgttgacacctggggagggagggttgggtttcaagctgaggttgaaaagggatgttgaatgggctaaggataagagacagcagggttcgttatcttttctggctcaggtggaggaaaaagaaggatccccattctgtgggtgttccttgaccatctctctacgctagagctgaggtcacttctctgctatgacaacatagctgggttctgaccttttgaccatcaggaaagcaatgtcagcagctgagctgagcctgctctgagggagaaggggggggtcctgtccagatgcagaaggggagcttgcctgctgctctcacacaatggagcccttgtttctcttccttgaaccagtatttcccaagattgagtgacagcccaggagaggatgtgggtctcatgcagagagctgggatcttcttggccattaaagtatattgttcacccccaccccgcgagaaccaagctcaggagttgcctgcctctgcacacatgctgagtgtgctgtttgtgtatatggcaggaccgtccctatggggcatgtgtgagctccgcagctgggtcaggctcctcggtccaggtttacttcatcccgcctggacgtgatttggctttgactgtctctcctgcagcccaaagcacttcctccctgtggttgctgtagctgtctcattggagcagtgcctctccaagtttgaggatttgaacaaagaactgggactggtgacttgttaatgaacagttcagagggcagagggccatcatctcagcttgtggagacctttctttccctggatgctgcttctcagctaactccctctctcttcgtgtgtgtactcggccttcagggtttccaccgatttttacaccttcttcccaccacgatagcttggctttaatgtggaattaaattatatattttta

SEQ ID NO: 295955 - DNA, 2001 bp, Homo sapiens
cagacccgaatctttgacccagctccaccaggcagcagaaaggttgtgattgccaccaatatcgcagagacatcgctgactattgatggtatctactatgtggtggacccaggattcgtgaaacagaaagtttacaattccaagacagggattgaccagctcgtggtgacgcctatttctcaggctcaggcaaagcaacgagctggcagagctgggagaacaggcccagggaagtgttacaggttgtacacagaacgtgcctaccgagatgaaatgctgaccaccaacgtgccggaaatccagagaaccaacttagcaagcacagtgctgtcactcaaggccatgggtatcaatgatctgctgtcctttgatttcatggatgccccacctatggaaactttgatcacagccatggagcagctgtacacactgggggccctggatgacgagggcctgctcactcgcttgggccgccggatggcagagttccctctggagccaatgctatgcaaaatgctcatcatgtctgtgcatctgggctgcagtgaggaaatgctgaccattgtatccatgctgtctgtgcagaacgtcttctataggcccaaggataaacaagcccttgcagatcagaagaaggccaaattccaccagactgaaggggaccacctcaccctgctagctgtgtacaactcctggaagaacaacaagttctccaacccatggtgctatgagaactttatccaggctcgttccctgcgccgggcccaggacattcgcaagcagatgttaggcataatggacagacacaagctggatgttgtttcctgtggcaagtccacagtccgagtgcagaaggccatctgcagtgggttcttccgtaatgctgccaagaaagacccgcaggagggttaccggacactgatcgaccagcaggtggtctatatccatccttccagtgccctcttcaacagacagccagaatgggtggtgtaccatgagctggtgctcaccaccaaggaatacatgcgtgaagttaccaccatcgaccctcggtggcttgtggagtttgccccagccttcttcaaggtctcagacccaactaagctaagcaaacagaagaagcaacagcgtcttgaacccttgtacaaccgctatgaggaacccaatgcctggagaatatctcgagctttccgacggcgctgaaaggcaagattgttcctttgcctctccagcagcagtagccagggcttggacttatcgatgacaggctggtcctgaggatacagctgtcccgtgactgactgtcttaactgagcattttctcaactcgactctcatttcttccctgctggtaacccaagtccttgggcccagttgggagctcatatctaacacagagacacattgcatcaacttcaagaaagggacaatttgtgcagctccaggatgggaaggtggagtgggtgagcatcttgtgcagggacatggtgagtgccctgatgccccagctagcaggagctactgtgctcatctaaagtgtttgccccacttcccaccccgtctccagcccctgtactttggcttgacctcgtggaaatatttattttcttaaggaaacaaaaaaaaaaaaaaaaaaaaaaaaaaaaaaaaaaaaaaaacaaaactaaaaacaaagaggggggggcccgcacatcaaaaaatcatccccgggaggggcaccccactatcacgctcgatacaccaggctttctgtggacaaagggggccccacaaagggggcacgcaaataaaaaacgacagagacgacggggcgcggaggtaacaacaacacggcggagagcgggaaaaaccagcgcgacacacggaggaaacctcgtggggaagaagcacaccctaacagagcggggggggggagcaaaaataggggggacacaccaacacccaacagagacaattagaccacgcccagagggcaaaaacataaaacatcgacgcggccaa

SEQ ID NO: 295956 - DNA, 1379 bp, Homo sapiens
cagacccgaatctttgacccagctccaccaggcagcagaaaggttgtgattgccaccaatatcgcagagacatcgctgactattgatggtatctactatgtggtggacccaggattcgtgaaacagaaagtttacaattccaagacagggattgaccagctcgtggtgacgcctatttctcaggctcaggcaaagcaacgagctggcagagctgggagaacaggcccagggaagtgttacaggttgtacacagaacgtgcctaccgagatgaaatgctgaccaccaacgtgccggaaatccagagaaccaacttagcaagcacagtgctgtcactcaaggccatgggtatcaatgatctgctgtcctttgatttcatggatgccccacctatggaaactttgatcacagccatggagcagctgtacacactgggggccctggatgacgagggcctgctcactcgcttgggccgccggatggcagagttccctctggagccaatgctatgcaaaatgctcatcatgtctgtgcatctgggctgcagtgaggaaatgctgaccattgtatccatgctgtctgtgcagaacgtcttctataggcccaaggataaacaagcccttgcagatcagaagaaggccaaattccaccagactgaaggggaccacctcaccctgctagctgtgtacaactcctggaagaacaacaagttctccaacccatggtgctatgagaactttatccaggctcgttccctgcgccgggcccaggacattcgcaagcagatgttaggcataatggacagacacaagctggatgttgtttcctgtggcaagtccacagtccgagtgcagaaggccatctgcagtgggttcttccgtaatgctgccaagaaagacccgcaggagggttaccggacactgatcgaccagcaggtggtctatatccatccttccagtgccctcttcaacagacagccagaatgggacctctactcacggttttctgaatggaaatcaggaacaaactgctcatcactgtctggtacctgagctgcagagagaagtcagagccccaccagcgacaccctcaggccccaccaaaacgcactgaagaatccaaccaggaaacctcctgaacacaccacttccccatcagacccagccacggacccagccacggaccccaccccagccagctcacagctaactccccagcacacaggaaggggggaatttgcctggaggcagaggtattcaagcgggatggaagagggaggaacacttgctattagaattacaatcaaggctatttggggagggagccctgggctctctgtgccaaaggactgccgaaaagaattatttaaacttttgttgtt

SEQ ID NO: 295957 - DNA, 1272 bp, Homo sapiens
cagacccgaatctttgacccagctccaccaggcagcagaaaggttgtgattgccaccaatatcgcagagacatcgctgactattgatggtatctactatgtggtggacccaggattcgtgaaacagaaagtttacaattccaagacagggattgaccagctcgtggtgacgcctatttctcaggctcaggcaaagcaacgagctggcagagctgggagaacaggcccagggaagtgttacaggttgtacacagaacgtgcctaccgagatgaaatgctgaccaccaacgtgccggaaatccagagaaccaacttagcaagcacagtgctgtcactcaaggccatgggtatcaatgatctgctgtcctttgatttcatggatgccccacctatggaaactttgatcacagccatggagcagctgtacacactgggggccctggatgacgagggcctgctcactcgcttgggccgccggatggcagagttccctctggagccaatgctatgcaaaatgctcatcatgtctgtgcatctgggctgcagtgaggaaatgctgaccattgtatccatgctgtctgtgcagaacgtcttctataggcccaaggataaacaagcccttgcagatcagaagaaggccaaattccaccagactgaaggggaccacctcaccctgctagctgtgtacaactcctggaagaacaacaagttctccaacccatggtgctatgagaactttatccaggctcgttccctgcgccgggcccaggacattcgcaagcagatgttaggcataatggacagacacaagctggatgttgtttcctgtggcaagtccacagtccgagtgcagaaggccatctgcagtgggttcttccgtaatgctgccaagaaagacccgcaggagggttaccggacactgatcgaccagcaggtggtctatatccatccttccagtgccctcttcaacagacagccagaatgaaagcacttcctccctgtggttgctgtagctgtctcattggagcagtgcctctccaagtttgaggatttgaacaaagaactgggactggtgacttgttaatgaacagttcagagggcagagggccatcatctcagcttgtggagacctttctttccctggatgctgcttctcagctaactccctctctcttcgtgtgtgtactcggccttcagggtttccaccgatttttacaccttcttcccaccacgatagcttggctttaatgtggaattaaattatatattttta

SEQ ID NO: 295958 - DNA, 1445 bp, Homo sapiens
cagacccgaatctttgacccagctccaccaggcagcagaaaggttgtgattgccaccaatatcgcagagacatcgctgactattgatggtatctactatgtggtggacccaggattcgtgaaacagaaagtttacaattccaagacagggattgaccagctcgtggtgacgcctatttctcaggctcaggcaaagcaacgagctggcagagctgggagaacaggcccagggaagtgttacaggttgtacacagaacgtgcctaccgagatgaaatgctgaccaccaacgtgccggaaatccagagaaccaacttagcaagcacagtgctgtcactcaaggccatgggtatcaatgatctgctgtcctttgatttcatggatgccccacctatggaaactttgatcacagccatggagcagctgtacacactgggggccctggatgacgagggcctgctcactcgcttgggccgccggatggcagagttccctctggagccaatgctatgcaaaatgctcatcatgtctgtgcatctgggctgcagtgaggaaatgctgaccattgtatccatgctgtctgtgcagaacgtcttctataggcccaaggataaacaagcccttgcagatcagaagaaggccaaattccaccagactgaaggggaccacctcaccctgctagctgtgtacaactcctggaagaacaacaagttctccaacccatggtgctatgagaactttatccaggctcgttccctgcgccgggcccaggacattcgcaagcagatgttaggcataatggacagacacaagctggatgttgtttcctgtggcaagtccacagtccgagtgcagaaggccatctgcagtgggttcttccgtaatgctgccaagaaagacccgcaggagggttaccggacactgatcgaccagcaggtggtctatatccatccttccagtgccctcttcaacagacagccagaatggaccgtccctatggggcatgtgtgagctccgcagctgggtcaggctcctcggtccaggtttacttcatcccgcctggacgtgatttggctttgactgtctctcctgcagcccaaagcacttcctccctgtggttgctgtagctgtctcattggagcagtgcctctccaagtttgaggatttgaacaaagaactgggactggtgacttgttaatgaacagttcagagggcagagggccatcatctcagcttgtggagacctttctttccctggatgctgcttctcagctaactccctctctcttcgtgtgtgtactcggccttcagggtttccaccgatttttacaccttcttcccaccacgatagcttggctttaatgtggaattaaattatatatttttaaaacctgtttttaaaattttgtttcttgcactaaattatgtcagtacattgatattttgtg

SEQ ID NO: 295959 - DNA, 832 bp, Homo sapiens
cttcccatagagatgggttcccactgtgctgcccaggctgctctccaatccctggcgtcaagcaatcctcctgcctctgcctcccaaagcgctgggattacagttgagagccactgtcctctgcactgaggaggctccttacctggcggaacatcaggcaggtcttgccaggccaggtttcggaacttacggaaagctggtctggatgtagtgcttgtagagaagcttctgagagattgggcacatcctgttacgttgctgcttctcctgtccttatgttattagtaagttctgaagtgatgtaaatgctagaactactgtagaactgtatgccagacactaagagagactatgtaacattccaggatataaaggaatgtatgttgtcactgggcagcaaaccacaccctaaagacaattcagaaagagtccgagggagaggaatataggccaggcaatctgctggctgcagatccctgccccttcattaagctgagtgcctcctgattctgtctgagtattcgcctttgtaagcccaggccagtaatcaaggggcagggcattgttgtgtgttaaccttgaaggccttctggggagagacagtacagggacctcaaatgaaaccaaaggggaaacggggactgggcacccacctccccaatctcgttttgtttttgtttttgttaagacaggatcttgccatcttgcctaggctggcatcaaactcctgaggcaggagaatcgcttgaacccgggaggtggaggttgcagtgagccaagatagcaccaatgcactccagcctgggcaacagagtgagaccctgtctcaaat

SEQ ID NO: 295960 - DNA, 896 bp, Homo sapiens
cttcccatagagatgggttcccactgtgctgcccaggctgctctccaatccctggcgtcaagcaatcctcctgcctctgcctcccaaagcgctgggattacagttgagagccactgtcctctgcactgaggaggctccttacctggcggaacatcaggcaggtcttgccaggccaggtttcggaacttacggaaagctggtctggatgtagtgcttgtagagaagcttctgagagattgggcacatcctgttacgttgctgcttctcctgtccttatgttattagtaagttctgaagtgatgtaaatgctagaactactgtagaactgtatgccagacactaagagagactatgtaacattccaggatataaaggaatgtatgttgtcactgggcagcaaaccacaccctaaagacaattcagaaagagtccgagggagaggaatataggccaggcaatctgctggctgcagatccctgccccttcattaagctgagtgcctcctgattctgtctctccccagaaggccttcaaggtaacacacaaaaagcacttcctccctgtggttgctgtagctgtctcattggagcagtgcctctccaagtttgaggatttgaacaaagaactgggactggtgacttgttaatgaacagttcagagggcagagggccatcatctcagcttgtggagacctttctttccctggatgctgcttctcagctaactccctctctcttcgtgtgtgtactcggccttcagggtttccaccgatttttacaccttcttcccaccacgatagcttggctttaatgtggaattaaattatatatttttaaaacctgtttttaaaattttgtttcttgcactaaattatgtcagtacattgatattttgtg

SEQ ID NO: 295961 - DNA, 456 bp, Homo sapiens
tcgacccggattccggttccggtgggcctccatcagcaagctccagtgctacgtgtccctggcattttaggtgtcggttgggtaggcagtcatggatcaggtaatgcagtttgttgagccaagtcggcagtttgtaaaggactccattcggctggttaaaagatgcactaaacctgatagaaaagaattccagaagattgccatggcaacagcaataggatttgctataatgggattcattggcttctttgtgaaattgatccatattcctattaataacatcattgttggtggctgaatacattttggaagagagtttttcatcttagagattggtgaacaagtgtgagggtgtgagaaactcacagaatacaaatttgcctgtatgttttgtgggtttttttttttcctttcaagatgttttctatttctaaattaaagtaatttcaaagtaaa

SEQ ID NO: 295962 - DNA, 834 bp, Homo sapiens
tcgacccggattccggttccggtgggcctccatcagcaagctccagtgctacgtgtccctggcattttaggtgtcggttgggtaggcagtcatggatcaggtaatgcagtttgttgagccaagtcggcagtttgtaaaggactccattcggctggttaaaagatgcactaaacctgatagaaaagaattccagaagattgccatggcaacagcaataggatttgctataatgggattcattggcttctttgtgaaattgatccatattcctattaataacatcattgttggtggctgaatacattttggaagagagtttttcatcttagagattggtgaacaagtgtgagggtgtgagaaactcacagaatacaaatttgcctgtatgttttgtgggtttttttttttcctttcaagatgttttctatttctaaattaaagtaatttcaaagtaaaaaaaaaaaaaaaaaaaaaaaaaacaaaaaaaaaaaaaaaaaaaaaaaaaaaaaaatttatatttaaaaaaattatatatataattaattaactcaattcttattttgcctaatccacctttttttgtgccctattactattgactcgcttggccattaccccttttaggaggggtgaaaaccccttctttggcccatattattcacctttcagcaatttccacatctttgcggttccccttcttatcggtatggccaaaattttcgtcttttcccatcagcttgtataactttaggccacatgccattttcaattccttttgcctcataccttaggtcacaggtaattcaacgccttaattttttatccaatacctct

SEQ ID NO: 295963 - DNA, 538 bp, Homo sapiens
ctgctggtgtgttctactggtgtgtcaactttatcaacttgaaaagcttctcaactaaccatcctgtcatgtagttgatattttttgttgtgttcagaaaggcgttatgctagactattccaaaatggcatttcctgaatgagcattgtgagtttacacatagacctcttccagtagccacatcatcttttcaggtccaggattttaaagttcattgtgccattcttttatgccatctttagatgaagttaggtgggattcacataattggtcttgagccgttaaagttatagcatactgcatttcaaataataataattattaaaatcttatctatgctcagaagtaataatttttctttcttttacagtggtggctgaatacattttggaagagagtttttcatcttagagattggtgaacaagtgtgagggtgtgagaaactcacagaatacaaatttgcctgtatgttttgtgggtttttttttttcctttcaagatgttttctatttctaaattaaagtaatttcaaagtaaa

SEQ ID NO: 295964 - DNA, 473 bp, Homo sapiens
tgatttttaggtgtcggttgggtaggaggtggaattgacccatgttagacgtgaattcagtggctggtctcatttacatctttatataaatgagcaagtgcttattgtatgagaaccaataccagtgagtatcttttttgttttaaacaggcagtcatggatcaggtaatgcagtttgttgagccaagtcggcagtttgtaaaggactccattcggctggttaaaagatgcactaaacctgatagaaaaggattcattggcttctttgtgaaattgatccatattcctattaataacatcattgttggtggctgaatacattttggaagagagtttttcatcttagagattggtgaacaagtgtgagggtgtgagaaactcacagaatacaaatttgcctgtatgttttgtgggtttttttttttcctttcaagatgttttctatttctaaattaaagtaatttcaaagtaaa

SEQ ID NO: 295965 - DNA, 773 bp, Homo sapiens
tcgacccggattccggttccggtgggcctccatcagcaagctccagtgctacgtgtccctggcattttaggtgtcggttgggtaggcagtcatggatcaggtaatgcagtttgttgagccaagtcggcagtttgtaaaggactccattcggctggttaaaagatgcactaaacctgatagaaaagaattccagaagattgccatggcaacagcaataggatttgctataatgggattcattggcttctttgtgaaattgatccatattcctattaataacatcattgttggtggctgaatacattttggaagagagtttttcatcttagagattggtgaacaagtgtgagggtgtgagaaactcacagaatacaaatttgcctgtatgttttgtgggtttttttttttcctttcaagatgttttctatttctaaattaaagtaatttcaaagtaaaaaaaaaaaaaaaaaaaaaaaaaacaaaaaaaaaaaaaaaaaaacaacccaacaaaaaccccacaaaaaaaaaaaaaaaaacctgaggggggccccggtacccatttgccttatagagagcgatttacatttactggccggcgtttacaacgtcggacttggaaaaccctgcgtacccacctaaacgccttgaagactatccctttcggcagttggcgtaataccaaaaggcccgacccgtggcctttccaacaatgccaccctgaatgcaaaatggaaattgaaccgtaatatttggaaaattccggtaaactttgt

SEQ ID NO: 295966 - DNA, 576 bp, Homo sapiens
tcgacccggattccggttccggtgggcctccatcagcaagctccagtgctacgtgtccctggcattttaggtgtcggttgggtaggtgagtttcttcccaccggtcggtacgggcgaacggggcggccacacctttgcgactcttgggggcagcgggcgtgggcgagccggcgtgtctccccgggcggccgtcgcggggcgggcggcagtcatggatcaggtaatgcagtttgttgagccaagtcggcagtttgtaaaggactccattcggctggttaaaagatgcactaaacctgatagaaaagaattccagaagattgccatggcaacagcaataggatttgctataatgggattcattggcttctttgtgaaattgatccatattcctattaataacatcattgttggtggctgaatacattttggaagagagtttttcatcttagagattggtgaacaagtgtgagggtgtgagaaactcacagaatacaaatttgcctgtatgttttgtgggtttttttttttcctttcaagatgttttctatttctaaattaaagtaatttcaaagtaaa

SEQ ID NO: 295967 - DNA, 764 bp, Homo sapiens
tcgacccggattccggttccggtgggcctccatcagcaagctccagtgctacgtgtccctggcattttaggtgtcggttgggtaggcagtcatggatcaggtaatgcagtttgttgagccaagtcggcagtttgtaaaggactccattcggctggttaaaagatgcactaaacctgatagaaaagaattccagaagattgccatggcaacagcaataggatttgctataatgggattcattggcttctttgtgaaattgatccatattcctattaataacatcattgttggtggctgaatacattttggaagagagtttttcatcttagagattggtgaacaagtgtgagggtgtgagaaactcacagaatacaaatttgcctgtaaaaaaaaaaaaaaaaaaaaaaaacaaaaaaaaaaaaaaaaaaaaaaaaaaaaaaatttatatttaaaaaaattatatatataattaattaactcaattcttattttgcctaatccacctttttttgtgccctattactattgactcgcttggccattaccccttttaggaggggtgaaaaccccttctttggcccatattattcacctttcagcaatttccacatctttgcggttccccttcttatcggtatggccaaaattttcgtcttttcccatcagcttgtataactttaggccacatgccattttcaattccttttgcctcataccttaggtcacaggtaattcaacgccttaattttttatccaatacctct

SEQ ID NO: 295968 - DNA, 1004 bp, Homo sapiens
ggcggccgcggcgcggagcagccgacgcacgctagtgggtccgcccgccaccgccccttcctcggcgtccgctcccgcccttgccgtcccccgcgcggctccgcgcctcgggccccgggcgcagccagccctccagacgcccgcggtcccggcggcgtgtgctgctcttcctccgcccgcggtttccagcgccgctccttcccccgcttgggcagggagggggcattgatcttcgatcgcgaagatggctgctggctgcctgctggccttgactctgacacttttccaatctttgctcatcggcccctcgtcggaggagccgttcccttcggccgtcactatcaaatcatgggtggataagatgcaagaagaccttgtcacactggcaaaaacagcaagtggagtcaatcagcttgttgatatttatgagaaatatcaagatttgtatactgtggaaccaaataatgcacgccagctggtagaaattgcagccagggatattgagaaacttctgagcaacagatctaaagccctggtggtctcagtgtgaagatcaaaatagcctgcttgacgatgttgtttaaatcagacacccacccctattgttattctgaatgagagacacctacctgtattatcttcagagcaatgatcacagatcggtcatgattcaagtttttgtttgtttcattgtctcctaactggtaaaatccatacgcgcccatttcagttcatatttatcttcatacctgttgggcctaacatcgttcctgatatatagtgggtgttctataaatatttactgaatgaataagttggttaatgagtaaaatataggttttttccctttataagctctctaatattttctgattttctataatcctattaatttagggctgtagaaatcaattatgtttatctgattgctactcatataataaaactcgatgcgcccaattccacttcaacttaaacataatcttatatatagtatgtaatca

SEQ ID NO: 295969 - DNA, 920 bp, Homo sapiens
gcttggacaaggtgctgaaaacagcttacatcctgagcattgctgttaaatgaagctacattcacgaaatcatcatctgagagggtttctaacatttcggagacagatgttcggatcagtttaagtgtcaatccactaacacttccactcacatccaccagaataagcatgtctttaggagatgcagctccttggatgtaccatggtcttctgcgtacatcataaaggtcaatcttatttggagttctactattatatcaaatcatgggtggataagatgcaagaagaccttgtcacactggcaaaaacagcaagtggagtcaatcagcttgttgatatttatgagaaatatcaagatttgtatactgtggaaccaaataatgcacgccagctggtagaaattgcagccagggatattgagaaacttctgagcaacagatctaaagccctggtggtctcagtgtgaagatcaaaatagcctgcttgacgatgttgtttaaatcagacacccacccctattgttattctgaatgagagacacctacctgtattatcttcagagcaatgatcacagatcggtcatgattcaagtttttgtttgtttcattgtctcctaactggtaaaatccatacgcgcccatttcagttcatatttatcttcatacctgttgggcctaacatcgttcctgatatatagtgggtgttctataaatatttactgaatgaataagttggttaatgagtaaaatataggttttttccctttataagctctctaatattttctgattttctataatcctattaatttagggctgtagaaatcaattatgtttatctgattgctactcatataataaaactcgatgcgcccaattccacttcaacttaaacataatcttatatatagtatgtaatca

SEQ ID NO: 295970 - DNA, 944 bp, Homo sapiens
ggcggccgcggcgcggagcagccgacgcacgctagtgggtccgcccgccaccgccccttcctcggcgtccgctcccgcccttgccgtcccggcggcgtgtgctgctcttcctccgcccgcggtttccagcgccgctccttcccccgcttgggcagggagggggcattgatcttcgatcgcgaagatggctgctggctgcctgctggccttgactctgacacttttccaatctttgctcatcggcccctcgtcggaggagccgttcccttcggccgtcactatcaaatcatgggtggataagatgcaagaagaccttgtcacactggcaaaaacagcaagtggagtcaatcagcttgttgatatttatgagaaatatcaagatttgtatactgtggaaccaaataatgcacgccagctggtagaaattgcagccagggatattgagaaacttctgagcaacagatctaaagccctggtggtctcagtgtgaagatcaaaatagcctgcttgacgatgttgtttaaatcagacacccacccctattgttattctgaatgagagacacctacctgtattatcttcagagcaatgatcacagatcggtcatgattcaagtttttgtttgtttcattgtctcctaactggtaaaatccatacgcgcccatttcagttcatatttatcttcatacctgttgggcctaacatcgttcctgatatatagtgggtgttctataaatatttactgaatgaataagttggttaatgagtaaaatataggttttttccctttataagctctctaatattttctgattttctataatcctattaatttagggctgtagaaatcaattatgtttatctgattgctactcatataataaaactcgatgcgcccaattccacttcaacttaaacataatcttatatatagtatgtaatca

SEQ ID NO: 295971 - DNA, 783 bp, Homo sapiens
  misc_feature (725)..(725): n is a, c, g, or t
  misc_feature (727)..(727): n is a, c, g, or t
ggcggccgcggcgcggagcagccgacgcacgctagtgggtccgcccgccaccgccccttcctcggcgtccgctcccgcccttgccgtcccccgcgcggctccgcgcctcgggccccgggcgcagccagccctccagacgcccgcggtcccggcggcgtgtgctgctcttcctccgcccgcggtttccagcgccgctccttcccccgcttgggcagggagggggcattgatcttcgatcgcgaagatggctgctggctgcctgctggccttgactctgacacttttccaatctttgctcatcggcccctcgtcggaggagccgttcccttcggccgtcactatcaaatcatgggtggataagatgcaagaagaccttgtcacactggcaaaaacagcaagtggagtcaatcagcttgttgatatttatgagaaatatcaagatttgtatactgtggaaccaaataatgcacgccagctggtagaaattgcagccagggatattgagaaacttctgagcaacagatctaaagccctggtgaagatgaaaatgaagctgaaagaaaaaatatatctcaggagctcaacatggaacagaaaaatccaaagaaataaaagattttctgtagtgtttttgaaaagtttgcagcttatgtaatagcagataaaatttctaattgtaaaatgttaaattgtaaaatctaatttgcaaaatgtctcaataaagncngatcggccgaaaattattttaactatacacacacacgcattaacagaaaaaactaa

SEQ ID NO: 295972 - DNA, 865 bp, Homo sapiens
ggcggccgcggcgcggagcagccgacgcacgctagtgggtccgcccgccaccgccccttcctcggcgtccgctcccgcccttgccgtcccccgcgcggctccgcgcctcgggccccgggcgcagccagccctccagacgcccgcggtcccggcggcgtgtgctgctcttcctccgcccgcggtttccagcgccgctccttcccccgcttgggcagggagggggcattgatcttcgatcgcgaagatggctgctggctgcctgctggccttgactctgacacttttccaatctttgctcatcggcccctcgtcggaggagccgttcccttcggccgtcactatcaaatcatgggtggataagatgcaagaagaccttgtcacactggcaaaaacagcaagtggagtcaatcagcttgttgatatttatgagaaatatcaagatttgtatactgtggaaccaaataatgcacgccagctggtagaaattgcagccagggatattgagaaacttctgagcaacagatctaaagccctggtggaagctactggaggaagtgctccaacaaaacaaggaaacaaacagtaaaaggaatacatggattgttttaaagaaacaggaaattggaaacgaagaagcaaggcaattactgatgtcagcagagcagcaagcaaggagtttaatcccatcaaataggtgcagggtgatggagttatccaggacttatgtctccaaggaaaacatgaggcagatggattgctgaatatatttgatcctgttgaagtgactaagttttcctttagagaacctgagaatgtataactccagggaaatcaataagttgtaaaataaaggaagtgtcacagc

SEQ ID NO: 295973 - DNA, 411 bp, Homo sapiens
ggaagcggcggcaggcgccatgtccggccgcgaaggtggcaagaagaagccactgaaacagcccaagaagtcaggccaaggagatggacgaggaagataaggctttcaagcagaaacaaaaagaggagcagaagaaactcgaggagctaaaagcgaaggccgcggggaagggcgccttggccacaggtggaattaagaaatctggcaaaaagtaagctgttccttgtgcctgaggagatggtgaccctttatttcatctgtatttaaacctctctattccctgccataacatcttttgccacgtatagctggaattaagtgttgtcttggagctgttgtacatttaagaataaacttttgtaaaaataaataaataaataaaaaataaacttaacttcctagtaaagcaac

SEQ ID NO: 295974 - DNA, 356 bp, Homo sapiens
agagacaaggtcttgctaagttgccagcctgaaactcctgggctcaagcagtcctcccaactcagccccccgagtagttgggattacaggtacatgccactgcacctggctaagagaactttttataaaaacatccaggaccatttatctcagtttaactaattcctagggaaatctacttttcattttgtttccatctcaatttacatttacatcagaagtctgttgccataacatcttttgccacgtatagctggaattaagtgttgtcttggagctgttgtacatttaagaataaacttttgtaaaaataaataaataaataaaaaataaacttaacttcctagtaaagcaac

SEQ ID NO: 295975 - DNA, 364 bp, Homo sapiens
ggaagcggcggcaggcgccatgtccggccgcgaaggtggcaagaagaagccactgaaacagcccaagaagtcaggccaaggagatggacgaggaagataaggctttcaagcagaaacaaaaagaggagcagaagaaactcgaggagctaaaagcgaaggccgcggggaagggcgccttggccacaggtggaattaagaaatctggcaaaaagtaagctgttccttgtgcctgaggagatggtgaccctttatttcatctgtatttaaacctctctattccctgccataacatcttttgccacgtatagctggaattaagtgttgtcttggcctgccatatgcaagggatcctctagatcacctg

SEQ ID NO: 295976 - DNA, 448 bp, Homo sapiens
cctttcaaatgagttggtttaatttcaggtgatacaaagtttagggtagaacaaggaccaaagaacagactctggcaagattctgagctggttttactttaaattcacagttatggtaggaatgacttagtgaaaacaactaaagagatgatgagccactgtaagatttttctttttttacaaaagtgttgtcttggagctgttgtacatttaagaataaacttaattccagctaaatctggcaaaaagtaagctgttccttgtgcctgaggagatggtgaccctttatttcatctgtatttaaacctctctattccctgccataacatcttttgccacgtatagctggaattaagtgttgtcttggagctgttgtacatttaagaataaacttttgtaaaaataaataaataaataaaaaataaacttaacttcctagtaaagcaac

SEQ ID NO: 295977 - DNA, 426 bp, Homo sapiens
gagatcagaggaatgcttctagaaactgaaaaacataaagattaatagccaaccaccagaagttaatgaagaggcatgaagagattctttctcacagagaaggaaccaactccgctgacccctccatcttggacttctagcctccaaaattgtgatacaccattcctctcttctgagctcctctctggccaactttaactcatcgattggttctgccacccgcaacgttggctccaaaggcctgtagcgttgttctaatacttcggtgatatctcggaagggcccctgacaagacaggatgaggaacatattttatatggaagatttttttgaggttatcactaacaagacacagctggagttactgcaagcactgagtgaagactgtggggctaataaaaagaaatgattcacgcctcatttatg

SEQ ID NO: 295978 - DNA, 287 bp, Homo sapiens
attcgcggccgcgtcgacgggagtagtcctgtttgtggtttgctgatgtgtaaatttatgtctttccgatgatttggaagtttactgctatgatttcttcaagatttttttctttccaatcttagccttatactgattcctacacagaattaagctagcctttcttctgcttttttcccccactataagatttcccccttactctcccaaaaagatgagggtttttttttttaggagttttatctaccaatgctgatgttctcctctgtgactaaaacctctcattg

SEQ ID NO: 295979 - DNA, 890 bp, Homo sapiens
gcacactgacccgacgcgaccttcggtcaggggccgccagcctgggccacctatacaacgacagcctgctccggggcttcctgaggaggtgcctgccccgccgaggttcaacagctttggagagcaggacatcttttcctctcagcctggccctctgcaatggaggccataaataggccagtagtggaagctacagaacacgtgagcatggcaggggctgagctccatttcaagatatgggtaagaggagggatgctgttgccttggagctgccaggctgcatggcagacaagcaggattcctgctgcctcccatggagactatactggaacgcaggtcttgccctgtcatccaggctggagtgcaatggatcttggatcactgcaacctccaccttccaggctcaagtgatcctcctgcctcaacctcccaagtagctgggactacagttcaaggaaagaagcaaacttattatttaagagcaatgcaaaatgaaagccaaggccaaggacttactttcccggatctggcatctgagtgcacagcaaccgcagagactgaaaactcctccgaatagaatgaatgtttgccatccccataaacacaacttcacagtttgggtaatactctggagagagtaacaataaagagaacacaaatacgttgaacttaaagcccacatggccaaatttaaaagcaaactggctataaaacaaacccactgcagcttctgattaacgaaactgaaatgttttgaaatgcttaactattagcccaatcctttataataagaggaacacactgaattttagctatcttttcaaaaagcgtgaaaagggaaggttagatttgtaaagaagatactgacataaaataaaagctattatttt

SEQ ID NO: 295980 - DNA, 811 bp, Homo sapiens
gcacactgacccgacgcgaccttcggtcaggggccgccagcctgggccacctatacaacgacagcctgctccggggcttcctgaggaggtgcctgccccgccgaggttcaacagctttggagagcaggacatcttttcctctcagcctggccctctgcaatggaggccataaataggccagtagtggaagctacagaacacgtgagcatggcaggggctgagctccatttcaagatatgggtaagaggagggatgctgttgccttggagctgccaggctgcatggcagacaagcaggattcctgctgcctcccatggagactatactggaacgcaggtcttgccctgtcatccaggctggagtgcaatggatcttggatcactgcaacctccaccttccaggctcaagtgatcctcctgcctcaacctcccaagtagctgggactacaggtatgtgccaccacgcttggttagtttttgcattttgggtagaaacagagtttcaacacattgcccaggctggtctggaactcctgggctcaagcgatcctcccaccttggcctcccaaagtgctgggattacaggcatgagccaccaagcctggccccaaagcaaaattttctgtcatctgacagcatctgccttttaagcctcagaagacaaatcatggcaaataggcaggagcacagagcactggggaaaacacaaaccagggggtcacagaaaaactggaggatttgctctatcactgaggagcggctcagtgtatgcaaaacaacatgaagcaacagggcctaactcactcccagaa

SEQ ID NO: 295981 - DNA, 378 bp, Homo sapiens
tgagttgactttaagtgaagttgacacaagtggaagggtaactttattatagttccaccgtgcttctcacttccgtttgacaaatgaagaagtggatacttgcactcgtcaagagggtatccattgtttctaagattacccacaaaataatttggtgcattattttgatacttcataatatagtcatataaaagtacaagtgtattctgagttaattcttgataaattacaaacaagaaatagaaatactgcatggatatttgaagtaattagctcaattatatttagctttgggatgcattcatcaagatccatcatttttctttgggtcattgtgcactgtgagaaaaattgagctagggacgatggctaagattt

SEQ ID NO: 295982 - DNA, 1299 bp, Homo sapiens
gatgatagacgggggtcccacaaatgtgtagttgtgtatatgtcatagtatacgaaggccagggaaatacatagtgccacctgacctaaccagctgttaagcataattactgtggttttgccagaaaggaattctaaatgcaggaaggtttgccattagtgggccacagaacatgaaagacttccctgcaaaccttttagaaaatttatgctagtttatatttcaggaggtaatacccattggatatactctaatttgggaaacatgggatgattaatgaattgatacaacctctagaccaggggaacagaagaaagtttggcttgcaaaatcacaggctccacctggtcagcgcttatcttctttgtttagctcaagttaggtaagtttacctagtttaaaaggagtattttaaatttatgtttgacatttaatgatttcagatagttcttggacatcaggataaacaaattcagtgtagcacatacgtagtataagaattctgttgatataatgccgcagtcatagttgtagcccattattccaggtaataatgatgctacaattagaaagttttccaattgtagttttgatttgcacagtagtaattgctgtttctattttcataggcaaggagaatccacacatgaattagaggctttccatattaggctttttggagacatagacatggtggtgatcgcatggggtgtttgagaaaatggagactaattgaatgcaaagtattctgtggggcaagcagagtaaagaatccagtcaaatgatgtcagccaaggatggcaagcccatgcccgaaaaactggcagcagctcacccataccaagccacctgagacatttcctgggctggaaacaacgttacggaaattgaacttccgtgccaaatttaccacacctcgccaaagcctgggcacctctcttattcatgggtgcctcaggagtaattacagctttatagcatatctactaagaactttagtgaaagtgaaaaggagtcggtaaccttgaattttagcaaactagagaaggaagatgtgggtgtcctttcctcacgcgttaacaaggatgctgttaggttgtctatctactctgaatccctacttaggaggaaagtcacgtatctggttgtgcaaatcaaagagctttgacagtttgttttttgtttgtttttatttgggtgcaatttttctagaagactaaataacctgtaaaagattaaaaaccatgattgagtgtgcctagaaataaagaccacccttgactgggctttttctaccca

SEQ ID NO: 295983 - DNA, 753 bp, Homo sapiens
cccggtcggcggagcccgctgcagctcccgctcgctccggacgcggaatcgggcagcagcgggaggcggcccggagagccgaggcaaggagaatccacacatgaattagaggctttccatattaggctttttggagacatagacatggtggtgatcgcatggggtgtttgagaaaatggagactaattgaatgcaaagtattctgtggggcaagcagagtaaagaatccagtcaaatgatgtcagccaaggatggcaagcccatgcccgaaaaactggcagcagctcacccataccaagccacctgagacatttcctgggctggaaacaacgttacggaaattgaacttccgtgccaaatttaccacacctcgccaaagcctgggcacctctcttattcatgggtgcctcaggagtaattacagctttatagcatatctactaagaactttagtgaaagtgaaaaggagtcggtaaccttgaattttagcaaactagagaaggaagatgtgggtgtcctttcctcacgcgttaacaaggatgctgttaggttgtctatctactctgaatccctacttaggaggaaagtcacgtatctggttgtgcaaatcaaagagctttgacagtttgttttttgtttgtttttatttgggtgcaatttttctagaagactaaataacctgtaaaagattaaaaaccatgattgagtgtgcctagaaataaagaccacccttgactgggctttttctaccca

SEQ ID NO: 295984 - DNA, 2875 bp, Homo sapiens
  misc_feature (3)..(3): n is a, c, g, or t
  misc_feature (23)..(23): n is a, c, g, or t
agntccaaataggagtgaattangctggccacatagtgttacttccacagacttgtaagaaccagttctgaggagaacaggtgattttctcccaaaagcacttttcctttttttctgaacttctaggccttctctttccagaactggtggaagacaaatgaaacggccaagatggtaaggtgagtagttcctgggaacgcttgtgctctaaccccaagttatgtgggatggacactcgaggggtgatggcattcctcattttacaagttacttgcttggctgcggctgctccaccaagatagcaaacattctcgatcttttgaacttcatgagactgacatttctgagtctgtttgcgaacaggacactagagggctcccaggggttaaaaataagtggaaatttatttgaatgaaaactgattctctacggcatttcttttttccgaatttaaaattaaagtttattttgttaactattgtttttaaaagctttgtatctcttaaaaccatgcagcagtcagtttccaagttttgctttgcaatcagtagttttcaagggagcttttaaagctgaactgaaatgtttgaaatgtggaacactcttgaccatgaaatatgttctacttacatgcctcagcctttaaaagttctttgcattagagtcaaggattacattcttcctggagccaagcatggggccagctgtgtaagaaacaagccgcatttctccttggggagactgataatttaaaaggtttgttgtgtcagaaacattcccagcttcatcaccaaccctttccttccacctctgcccactggagaccacttatatcccgaagcggacgcggcagctgaagtcaggaaaccatgcatcacattagcaggagccaactgcagactttaaactccgttcaacatgtggatgcggcagagaaatgacctgtccagacaagccggggcagctcataaactggttcatctgctccctgtgcgtcccgcgggtgcgtaagctctggagcagccggcgtccaaggacccggagaaaccttctgctgggcactgcgtgtgccatctacttgggcttcctggtgagccaggtggggagggcctctctccagcatggacaggcggctgagaaggggccacatcgcagccgcgacaccgccgagccatccttccctgagatacccctggatggtaccctggcccctccagagtcccagggcaatgggtccactctgcagcccaatgtggtgtacattaccctacgctccaagcgcagcaagccggccaatatccgtggcaccgtgaagcccaagcgcaggaaaaagcatgcagtggcatcggctgccccagggcaggaggctttggtcggaccatcccttcagccgcaggaagcggcaagggaagctgatgctgtagcacctgggtacgctcagggagcaaacctggttaagattggagagcgaccctggaggttggtgcggggtccgggagtgcgagccgggggcccagacttcctgcagcccagctccagggagagcaacattaggatctacagcgagagcacccctcctggctgagcaaagatgacatccgaagaatgcgactcttggcggacagcgcagtggcagggctccggcctgtgtcctctaggagcggagcccgtttgctggtgctggaggggggcgcacctggcgctgtgctccgctgtggccctagcccctgtgggcttctcaagcagcccttggacatgagtgaggtgtttgccttccacctagacaggatcctggggctcaacaggaccctgccgtctgtgagcaggaaagcagagttcatccaagatggccgcccatgccccatcattctttgggatgcatctttatcttcagcaagtaatgacacccattcttctgttaagctcacctggggaacttatcagcagttgctgaaacagaaatgctggcagaatggccgagtacccaagcctgaatcaggttgtactgaaatacatcatcatgagtggtccaagatggcactctttgattttttgttacagatttataatcgcttagatacaaattgctgtggattcagacctcgcaaggaagatgcctgtgtacagaatggattgaggccaaaatgtgatgaccaaggttctgcggctctagcacacattatccagcgaaagcatgacccaaggcatttggtttttatagacaacaagggtttctttgacaggagtgaagataacttaaacttcaaattgttagaaggcatcaaagagtttccagcttctgcagtttctgttttgaagagccagcacttacggcagaaacttcttcagtctctgtttcttgataaagtgtattgggaaagtcaaggaggtagacaaggaattgaaaagcttatcgatgtaatagaacacagagccaaaattcttatcacctatatcaatgcacacggggtcaaagtattacctatgaatgaatgacaaaagaatcttctggctagggtgttagatatatttatgcatttttggttttgtttttaaatcaagcacatcaacctcaagcccgtttagcaatgaggcagtgtagatgaatacgtaaaataaatgactttaaccaagtagctataatgggacttagcactgtatgcatacttaaaaaggttttgaaaaacaaactacttgagaaatatttgtttatatttttctctaacatcatgctatgtgtcagtctgaacatctgacaacagaaatttcagttattattctagctaagttttgaaaacatttgtcatgctgtttaatagaaaactgcaaaccagagatactgactccattaataaaccatattttgtgccgtttt

SEQ ID NO: 295985 - DNA, 2350 bp, Homo sapiens
cttttgtgaactgttgcaccgtgcaattgcacactataaatgtctttccttatctgtgtgtactcttatctcactgttctattttttctcctcatttatattaactctttcttacctttttttctgaacttctaggccttctctttccagaactggtggaagacaaatgaaacggccaagatggtaagaaacaagccgcatttctccttggggagactgataatttaaaaggtttgttgtgtcagaaacattcccagcttcatcaccaaccctttccttccacctctgcccactggagaccacttatatcccgaagcggacgcggcagctgaagtcaggaaaccatgcatcacattagcaggagccaactgcagactttaaactccgttcaacatgtggatgcggcagagaaatgacctgtccagacaagccggggcagctcataaactggttcatctgctccctgtgcgtcccgcgggtgcgtaagctctggagcagccggcgtccaaggacccggagaaaccttctgctgggcactgcgtgtgccatctacttgggcttcctggtgagccaggtggggagggcctctctccagcatggacaggcggctgagaaggggccacatcgcagccgcgacaccgccgagccatccttccctgagatacccctggatggtaccctggcccctccagagtcccagggcaatgggtccactctgcagcccaatgtggtgtacattaccctacgctccaagcgcagcaagccggccaatatccgtggcaccgtgaagcccaagcgcaggaaaaagcatgcagtggcatcggctgccccagggcaggaggctttggtcggaccatcccttcagccgcaggaagcggcaagggaagctgatgctgtagcacctgggtacgctcagggagcaaacctggttaagattggagagcgaccctggaggttggtgcggggtccgggagtgcgagccgggggcccagacttcctgcagcccagctccagggagagcaacattaggatctacagcgagagcacccctcctggctgagcaaagatgacatccgaagaatgcgactcttggcggacagcgcagtggcagggctccggcctgtgtcctctaggagcggagcccgtttgctggtgctggaggggggcgcacctggcgctgtgctccgctgtggccctagcccctgtgggcttctcaagcagcccttggacatgagtgaggtgtttgccttccacctagacaggatcctggggctcaacaggaccctgccgtctgtgagcaggaaagcagagttcatccaagatggccgcccatgccccatcattctttgggatgcatctttatcttcagcaagtaatgacacccattcttctgttaagctcacctggggaacttatcagcagttgctgaaacagaaatgctggcagaatggccgagtacccaagcctgaatcaggttgtactgaaatacatcatcatgagtggtccaagatggcactctttgattttttgttacagatttataatcgcttagatacaaattgctgtggattcagacctcgcaaggaagatgcctgtgtacagaatggattgaggccaaaatgtgatgaccaaggttctgcggctctagcacacattatccagcgaaagcatgacccaaggcatttggtttttatagacaacaagggtttctttgacaggagtgaagataacttaaacttcaaattgttagaaggcatcaaagagtttccagcttctgcagtttctgttttgaagagccagcacttacggcagaaacttcttcagtctctgtttcttgataaagtgtattgggaaagtcaaggaggtagacaaggaattgaaaagcttatcgatgtaatagaacacagagccaaaattcttatcacctatatcaatgcacacggggtcaaagtattacctatgaatgaatgacaaaagaatcttctggctagggtgttagatatatttatgcatttttggttttgtttttaaatcaagcacatcaacctcaagcccgtttagcaatgaggcagtgtagatgaatacgtaaaataaatgactttaaccaagtagctataatgggacttagcactgtatgcatacttaaaaaggttttgaaaaacaaactacttgagaaatatttgtttatatttttctctaacatcatgctatgtgtcagtctgaacatctgacaacagaaatttcagttattattctagctaagttttgaaaacatttgtcatgctgtttaatagaaaactgcaaaccagagatactgactccattaataaaccatattttgtgccgtttt

SEQ ID NO: 295986 - DNA, 2994 bp, Homo sapiens
  misc_feature (3)..(3): n is a, c, g, or t
  misc_feature (23)..(23): n is a, c, g, or t
agntccaaataggagtgaattangctggccacatagtgttacttccacagacttgtaagaaccagttctgaggagaacaggtgattttctcccaaaagcacttttcctttttttctgaacttctaggccttctctttccagaactggtggaagacaaatgaaacggccaagatggtaaggtgagtagttcctgggaacgcttgtgctctaaccccaagttatgtgggatggacactcgaggggtgatggcattcctcattttacaagttacttgcttggctgcggctgctccaccaagatagcaaacattctcgatcttttgaacttcatgagactgacatttctgagtctgtttgcgaacaggacactagagggctcccaggggttaaaaataagtggaaatttatttgaatgaaaactgattctctacggcatttcttttttccgaatttaaaattaaagtttattttgttaactattgtttttaaaagctttgtatctcttaaaaccatgcagcagtcagtttccaagttttgctttgcaatcagtagttttcaagggagcttttaaagctgaactgaaatgtttgaaatgtggaacactcttgaccatgaaatatgttctacttacatgcctcagcctttaaaagttctttgcattagagtcaaggattacattcttcctggagccaagcatggggccagctgtgtaagaaacaagccgcatttctccttggggagactgataatttaaaaggtttgttgtgtcagaaacattcccagcttcatcaccaaccctttccttccacctctgcccactggagaccacttatatcccgaagcggacgcggcagctgaagtcaggaaaccatgcatcacattagcaggagccaactgcagactttaaactccgttcaacatgtggatgcggcagagaaatgacctgtccagacaagccggggcagctcataaactggttcatctgctccctgtgcgtcccgcgggtgcgtaagctctggagcagccggcgtccaaggacccggagaaaccttctgctgggcactgcgtgtgccatctacttgggcttcctggtgagccaggtggggagggcctctctccagcatggacaggcggctgagaaggggccacatcgcagccgcgacaccgccgagccatccttccctgagatacccctggatggtaccctggcccctccagagtcccagggcaatgggtccactctgcagcccaatgtggtgtacattaccctacgctccaagcgcagcaagccggccaatatccgtggcaccgtgaagcccaagcgcaggaaaaagcatgcagtggcatcggctgccccagggcaggaggctttggtcggaccatcccttcagccgcaggaagcggcaagggaagctgatgctgtagcacctgggtacgctcagggagcaaacctggttaagattggagagcgaccctggaggttggtgcggggtccgggagtgcgagccgggggcccagacttcctgcagcccagctccagggagagcaacattaggatctacagcgagagcacccctcctggctgagcaaagatgacatccgaagaatgcgactcttggcggacagcgcagtggcagggctccggcctgtgtcctctaggagcggagcccgtttgctggtgctggaggggggcgcacctggcgctgtgctccgctgtggccctagcccctgtgggcttctcaagcagcccttggacatgagtgaggtgtttgccttccacctagacaggatcctggggctcaacaggaccctgccgtctgtgagcaggaaagcagagttcatccaagatggccgcccatgccccatcattctttgggatgcatctttatcttcagcaagtaatgacacccattcttctgttaagctcacctggggaacttatcagcagttgctgaaacagaaatgctggcagaatggccgagtacccaagcctgaatcaggttgtactgaaatacatcatcatgagtggtccaagatggcactctttgattttttgttacagatttataatcgcttagatacaaattgctgtggattcagacctcgcaaggaagatgcctgtgtacagaatggattgaggccaaaatgtgatgaccaaggttctgcggctctagcacacattatccagcgaaagcatgacccaaggcatttggtttttatagacaacaagggtttctttgacaggagtgaagataacttaaacttcaaattgttagaaggcatcaaagagtttccagcttctgcagtttctgttttgaagagccagcacttacggcagaaacttcttcagtctctgtttcttgataaagtgtattgggaaagtcaaggaggtagacaaggaattgaaaagcttatcgatgtaatagaacacagagccaaaattcttatcacctatatcaatgcacacggggtcaaagtattacctatgaatgaatgacaaaagaatcttctggctagggtgttagatatatttatgcatttttggttttgtttttaaatcaagcacatcaacctcaagcccgtttagcaatgaggcagtgtagatgaatacgtaaaataaatgactttaaccaagtagctataatgggacttagcactgtatgcatacttaaaaaggttttgaaaaacaaactacttgagaaatatttgtttatatttttctctaacatcatgctatgtgtcagtctgaacatctgacaacagaaatttcagttattattctagctaagttttgaaaacatttgtcatgctgtttaatagaaaactgcaaaccagagatactgactccattaataaaccatattttgtgccgttttgactgttctgaccaaatactaatgggaacaattcttgacgtttttctgttgctgattgttaacatagagcagtctctacactaccctgaggcaactctacattgcaacacggtctctca

SEQ ID NO: 295987 - DNA, 2940 bp, Homo sapiens
  misc_feature (3)..(3): n is a, c, g, or t
  misc_feature (23)..(23): n is a, c, g, or t
agntccaaataggagtgaattangctggccacatagtgttacttccacagacttgtaagaaccagttctgaggagaacaggtgattttctcccaaaagcacttttcctttttttctgaacttctaggccttctctttccagaactggtggaagacaaatgaaacggccaagatggtaaggtgagtagttcctgggaacgcttgtgctctaaccccaagttatgtgggatggacactcgaggggtgatggcattcctcattttacaagttacttgcttggctgcggctgctccaccaagatagcaaacattctcgatcttttgaacttcatgagactgacatttctgagtctgtttgcgaacaggacactagagggctcccaggggttaaaaataagtggaaatttatttgaatgaaaactgattctctacggcatttcttttttccgaatttaaaattaaagtttattttgttaactattgtttttaaaagctttgtatctcttaaaaccatgcagcagtcagtttccaagttttgctttgcaatcagtagttttcaagggagcttttaaagctgaactgaaatgtttgaaatgtggaacactcttgaccatgaaatatgttctacttacatgcctcagcctttaaaagttctttgcattagagtcaaggattacattcttcctggagccaagcatggggccagctgtgtaagaaacaagccgcatttctccttggggagactgataatttaaaaggtttgttgtgtcagaaacattcccagcttcatcaccaaccctttccttccacctctgcccactggagaccacttatatcccgaagcggacgcggcagctgaagtcaggaaaccatgcatcacattagcaggagccaactgcagactttaaactccgttcaacatgtggatgcggcagagaaatgacctgtccagacaagccggggcagctcataaactggttcatctgctccctgtgcgtcccgcgggtgcgtaagctctggagcagccggcgtccaaggacccggagaaaccttctgctgggcactgcgtgtgccatctacttgggcttcctggtgagccaggtggggagggcctctctccagcatggacaggcggctgagaaggggccacatcgcagccgcgacaccgccgagccatccttccctgagatacccctggatggtaccctggcccctccagagtcccagggcaatgggtccactctgcagcccaatgtggtgtacattaccctacgctccaagcgcagcaagccggccaatatccgtggcaccgtgaagcccaagcgcaggaaaaagcatgcagtggcatcggctgccccagggcaggaggctttggtcggaccatcccttcagccgcaggaagcggcaagggaagctgatgctgtagcacctgggtacgctcagggagcaaacctggttaagattggagagcgaccctggaggttggtgcggggtccgggagtgcgagccgggggcccagacttcctgcagcccagctccagggagagcaacattaggatctacagcgagagcacccctcctggctgagcaaagatgacatccgaagaatgcgactcttggcggacagcgcagtggcagggctccggcctgtgtcctctaggagcggagcccgtttgctggtgctggaggggggcgcacctggcgctgtgctccgctgtggccctagcccctgtgggcttctcaagcagcccttggacatgagtgaggtgtttgccttccacctagacaggatcctggggctcaacaggaccctgccgtctgtgagcaggaaagcagagttcatccaagatggccgcccatgccccatcattctttgggatgcatctttatcttcagcaagtaatgacacccattcttctgttaagctcacctggggaacttatcagcagttgctgaaacagaaatgctggcagaatggccgagtacccaagcctgaatcaggttgtactgaaatacatcatcatgagtggtccaagatggcactctttgattttttgttacagatttataatcgcttagatacaaattgctgtggattcagacctcgcaaggaagatgcctgtgtacagaatggattgaggcctgacccaaggcatttggtttttatagacaacaagggtttctttgacaggagtgaagataacttaaacttcaaattgttagaaggcatcaaagagtttccagcttctgcagtttctgttttgaagagccagcacttacggcagaaacttcttcagtctctgtttcttgataaagtgtattgggaaagtcaaggaggtagacaaggaattgaaaagcttatcgatgtaatagaacacagagccaaaattcttatcacctatatcaatgcacacggggtcaaagtattacctatgaatgaatgacaaaagaatcttctggctagggtgttagatatatttatgcatttttggttttgtttttaaatcaagcacatcaacctcaagcccgtttagcaatgaggcagtgtagatgaatacgtaaaataaatgactttaaccaagtagctataatgggacttagcactgtatgcatacttaaaaaggttttgaaaaacaaactacttgagaaatatttgtttatatttttctctaacatcatgctatgtgtcagtctgaacatctgacaacagaaatttcagttattattctagctaagttttgaaaacatttgtcatgctgtttaatagaaaactgcaaaccagagatactgactccattaataaaccatattttgtgccgttttgactgttctgaccaaatactaatgggaacaattcttgacgtttttctgttgctgattgttaacatagagcagtctctacactaccctgaggcaactctacattgcaacacggtctctca

SEQ ID NO: 295988 - DNA, 1319 bp, Homo sapiens
agcggaattcacatgaacacccacatatcttttaaaacccgctttctcaccactgtgacagaattttatctcttcacttgttgagatttctctagagagtccagtactgcatcattttgacaaacctgaatgtggagagatgaatgcttctcatctctgaaacacttcaggatggccgcccatgccccatcattctttgggatgcatctttatcttcagcaagtaatgacacccattcttctgttaagctcacctggggaacttatcagcagttgctgaaacagaaatgctggcagaatggccgagtacccaagcctgaatcaggttgtactgaaatacatcatcatgagtggtccaagatggcactctttgattttttgttacagatttataatcgcttagatacaaattgctgtggattcagacctcgcaaggaagatgcctgtgtacagaatggattgaggccaaaatgtgatgaccaaggttctgcggctctagcacacattatccagcgaaagcatgacccaaggcatttggtttttatagacaacaagggtttctttgacaggagtgaagataacttaaacttcaaattgttagaaggcatcaaagagtttccagcttctgcagtttctgttttgaagagccagcacttacggcagaaacttcttcagtctctgtttcttgataaagtgtattgggaaagtcaaggaggtagacaaggaattgaaaagcttatcgatgtaatagaacacagagccaaaattcttatcacctatatcaatgcacacggggtcaaagtattacctatgaatgaatgacaaaagaatcttctggctagggtgttagatatatttatgcatttttggttttgtttttaaatcaagcacatcaacctcaagcccgtttagcaatgaggcagtgtagatgaatacgtaaaataaatgactttaaccaagtagctataatgggacttagcactgtatgcatacttaaaaaggttttgaaaaacaaactacttgagaaatatttgtttatatttttctctaacatcatgctatgtgtcagtctgaacatctgacaacagaaatttcagttattattctagctaagttttgaaaacatttgtcatgctgtttaatagaaaactgcaaaccagagatactgactccattaataaaccatattttgtgccgttttgactgttctgaccaaatactaatgggaacaattcttgacgtttttctgttgctgattgttaacatagagcagtctctacactaccctgaggcaactctacattgcaacacggtctctca

SEQ ID NO: 295989 - DNA, 1231 bp, Homo sapiens
cccggtcggcggagcccgctgcagctcccgctcgctccggacgcggaatcgggcagcagcgggaggcggcccggagagccgagatggccgcccatgccccatcattctttgggatgcatctttatcttcagcaagtaatgacacccattcttctgttaagctcacctggggaacttatcagcagttgctgaaacagaaatgctggcagaatggccgagtacccaagcctgaatcaggttgtactgaaatacatcatcatgagtggtccaagatggcactctttgattttttgttacagatttataatcgcttagatacaaattgctgtggattcagacctcgcaaggaagatgcctgtgtacagaatggattgaggccaaaatgtgatgaccaaggttctgcggctctagcacacattatccagcgaaagcatgacccaaggcatttggtttttatagacaacaagggtttctttgacaggagtgaagataacttaaacttcaaattgttagaaggcatcaaagagtttccagcttctgcagtttctgttttgaagagccagcacttacggcagaaacttcttcagtctctgtttcttgataaagtgtattgggaaagtcaaggaggtagacaaggaattgaaaagcttatcgatgtaatagaacacagagccaaaattcttatcacctatatcaatgcacacggggtcaaagtattacctatgaatgaatgacaaaagaatcttctggctagggtgttagatatatttatgcatttttggttttgtttttaaatcaagcacatcaacctcaagcccgtttagcaatgaggcagtgtagatgaatacgtaaaataaatgactttaaccaagtagctataatgggacttagcactgtatgcatacttaaaaaggttttgaaaaacaaactacttgagaaatatttgtttatatttttctctaacatcatgctatgtgtcagtctgaacatctgacaacagaaatttcagttattattctagctaagttttgaaaacatttgtcatgctgtttaatagaaaactgcaaaccagagatactgactccattaataaaccatattttgtgccgttttgactgttctgaccaaatactaatgggaacaattcttgacgtttttctgttgctgattgttaacatagagcagtctctacactaccctgaggcaactctacattgcaacacggtctctca

SEQ ID NO: 295990 - DNA, 174 bp, Homo sapiens
tctgttaagctcacctggggaacttatcagcagttgctgaaacagaaatgctggcagaatggccgagtacccaagcctgaatcaggttgtactgaaatacatcatcatgagtggtccaagatggcactctttgattttttgttacaggtaagtttatcaaatcaagcaaatagt

SEQ ID NO: 295991 - DNA, 918 bp, Homo sapiens
ttagtgattgtatcacataggtgccacagggaagtccgggaagatggttgttatgggccatcaagagcaggctatcattcctggggctctcggagacaagggctgacccagggccgcctccctccactctgtgtctgccaggcctttggagcagcaggcctgagcagcgactacccactggctcagttcttcacctgggcccgagccctgcgctttgccgacggccctgacgaggtgcaccgggccacggtggccaagctagagctgaagcaccgcatttagagccttggggctgcagtggctcaatgtcctggctggtccagctgtgcccagatctgtcactgatgtgcctcgaaagatccggtgtttgtggctcctgcaccctgctcagcagctctgtcccgggacagtcagggtggactcaatctttctggttctccacagaagacgtctctgcaagaagcctggagtctgtttcaggccaggaggaggggatttgctgagggccaagggggttctgggacagagtctggaaagctggtcttcaggctctcagtcccaggctgggcaggcacggtcacttcacttcagcctttcagtccctctctctctgcctgtgggaatctggacacattttgggaggcctcccaaggctgtgggacgtgcttgctctggcagctgcagggttcctgtctggcctccctggtgagcagaggggcggccacggcgggcggtggcctagagacccaggacctgggcgcctgggaaaatggaatgcaacccacattgtaaagccactggcatctgattatctccatttgaacacacagcacagaacaatcatttaaatgttattttggaaaggggttttggggacacagaagaataagtaaacacatctcggaggcaatgtggaat

SEQ ID NO: 295992 - DNA, 2820 bp, Homo sapiens
  misc_feature (5)..(7): n is a, c, g, or t
  misc_feature (13)..(14): n is a, c, g, or t
  misc_feature (19)..(19): n is a, c, g, or t
  misc_feature (21)..(21): n is a, c, g, or t
  misc_feature (23)..(23): n is a, c, g, or t
  misc_feature (28)..(28): n is a, c, g, or t
  misc_feature (30)..(31): n is a, c, g, or t
  misc_feature (34)..(34): n is a, c, g, or t
  misc_feature (43)..(44): n is a, c, g, or t
  misc_feature (46)..(46): n is a, c, g, or t
  misc_feature (51)..(51): n is a, c, g, or t
  misc_feature (64)..(64): n is a, c, g, or t
  misc_feature (68)..(70): n is a, c, g, or t
  misc_feature (75)..(75): n is a, c, g, or t
  misc_feature (82)..(84): n is a, c, g, or t
  misc_feature (86)..(86): n is a, c, g, or t
  misc_feature (108)..(108): n is a, c, g, or t
  misc_feature (131)..(132): n is a, c, g, or t
  misc_feature (138)..(138): n is a, c, g, or t
  misc_feature (171)..(172): n is a, c, g, or t
  misc_feature (177)..(177): n is a, c, g, or t
  misc_feature (187)..(187): n is a, c, g, or t
  misc_feature (198)..(198): n is a, c, g, or t
  misc_feature (201)..(201): n is a, c, g, or t
  misc_feature (205)..(205): n is a, c, g, or t
  misc_feature (213)..(213): n is a, c, g, or t
  misc_feature (225)..(225): n is a, c, g, or t
gagannnagtctnnctctntngnccagncnngantgcagtggnncnatctnggctcactgcaanctcnnnctccngggttcnnncnattctcctgcctcagcctcccnagtagctgggactacaggcgccnngctaantttttgtatttttagtagagacggggtttcacnntgttngccaggatgntctcgatctcntgncctngtgatccncccaccttggcntcccaaagtgctgggattacaggcgtgagccaccacgcctggctggtttgctctttagagtaatgaaaatgtcctaaaattgatggcagtgatggttgcacaactttgtaaatatattaaaaaccattgaattgtactctttaaataggtgacttgcatggcatgtgaattagagttcagtaaagctgttctaaaatctgtgtgtgtatatgtatatataaaacagcagacttgcctttgcagattttgaaatgtgataatataagagttttctttctttctttctttctttctttttttttttttttttgagacggagtcttgctctgttgcccaggctggagtgcagtggcatgatcttggctcactgcaacctccgtctcctgggttcaagcaattctcctgcctcagcctccccagtagctgggactacaggtgcgtgccaccacgcctggctaattttttgcatttttagtagataaggggtttcaccatgttagccaggatggtctcgatctcctgacctcgtgatctgcctgcctcagcctcccaaagtgctgggattacaggtgtgagccactgcgcccagccttataagagttttcaaaacccacacagattgaatttaaaaacaagaaaaaaattgatcagaaactaaagttcataatggtgatactgaggcaatataaaaagcattaaatgacttctcaatcattaaaaattaaattacatatacttcatatacttttagatttcactgtatcctcttatgatatgctgttttttttttcaactagcaatccatgagcagaataaagaactcatttaattgtaatattgatataaatagctccattccctactgtgttgctcaggctagagtgcaatggcttgatcatagctcactgcagctccaatctcccaggctcaagccatcctcccacctcagcctcctgagtagctgggaccacaggtatgtgccaccaagcctagctaagttaaaaaaaaattttttttagatctcactttgttgcccaggctggtgtcaaaatcctgagctcaagcagtcttcccacctcagcctcccacagtgctgggattacaggtgtgagccactgtgcccagcctataactctagtcctggataacttttaaaaaccttatatgagagttcagcacaggggctgaggaacacagttcctgcaggcagcaagctatgagcctgggctcttgtagcagagagcagaaggacgccaggaataagcattttttttttctgttggccatgagtgtttgtcactcttaatgattgctgttctcctgtgccctctcctgttcttagttaaagacctccgtgcctgtggactcatttttctctctgttgaccagtgagcgagtggcaaagcagttcccagtgatgactgaggccataactcaaattcgggcaaaaggtcttcagactgcagtcttgagcaataatttttatcttcccaaccagaaaagctttttgcccctggaccggaaacagtttgatgtgattgtggagtcctgcatggaagggatctgtaagccagaccctaggatctacaagctgtgcttggagcagctcggcctgcagccctctgagtccatctttcttgatgaccttggaacaaatctaaaagaagctgccagacttggtattcacaccattaaggtaatagtcactaatttttgaactccctcccatgcaccagccactaatgcaatgtttctctgtaatctttttacatttgtagctctagctttccttagggtttccccctgtgtttccatagtcatcttattttgtgttaattatgaaatctatgtgactagctgcttgtattttcaatgggaagcaagacaaacaggtactgcgaaggcaggttgagaaaagagatgggaaaggaggtgaatggcaggcttaagacctttgtgggggtgttcacactgtcctcatgatccagtgatgctgccttaagtggggagccagtggccaccagccatgcaggccatgcagctcactgctgtaaagcacgagaagccatgtgagggggtctcatgccaacttttttctattctttttttttttttttctcatacagggtcttgttatgtcacccaggctggagtgcagtggtgcaatcatagctcactgtagcctcaacctcctgggcttaagtgatcctcctacctcagtctcctgagtagctgaccagaggcatacaccaccacacccgactaatttttgtattttttgtagagacagggttttgccgtgttgcccaagctggtgtcaaactcctgggctcatgcctgtaatcctaccactttgtgaggctgaggtgggcagatcacttgaggccaggagtttgagaccagcctggtcaacatggcgaaactccatctctactaaaaatacaaaaattagccgagtgtggtggcgcatgcctgtagtcccagctactggggaggctaaggcagaatcgcttgatcccaggaagcagaggttgcagtgagctgagatcacgccactgcactccagcctggacgacagagggagagtccatctca

SEQ ID NO: 295993 - DNA, 1241 bp, Homo sapiens
actgctcttccggacgcaattttgaggaggtcggagcggaaggacgtcgtggagattgcttgcgctggggtgccacacttaggctgagctgcaggttttcgcacagtcgcgagttaacctctgcttgctccagaggcctcgtcctaatccacctcggctgacggcgcgggatccctggctccgcgagcctcagcctcaccatgtgtgtcaggagctgtttccagtccccccgtctccagtgggtgtggagaacagccttcctgaaacacacccagcgcaggcaccaggggtcccaccgatggacacaccttggaggcagcacctacagagcggtgattttcgacatgggcggagttctcattccttctccagggagagtcgctgcagaatgggaggtacagaatcgtatcccttctggaactatattaaaggccttgatggaaggtggtgaaaatgggccctggatgagatttatgagagcagaaataacagcagagggttttttacgagaatttgggagactttgctctgaaatgttaaagacctccgtgcctgtggactcatttttctctctgttgaccagtgagcgagtggcaaagcagttcccagtgatgactgaggccataactcaaattcgggcaaaaggtcttcagactgcagtcttgagcaataatttttatcttcccaaccagaaaagctttttgcccctggaccggaaacagtttgatgtgattgtggagtcctgcatggaagggatctgtaagccagaccctaggatctacaagctgtgcttggagcagctcggcctgcagccctctgagtccatctttcttgatgaccttggaacaaatctaaaagaagctgccagacttggtattcacaccattaaggttaatgacccagagactgcagtaaaggaattagaagctctcttgggttttacattgagagtaggtgttccaaacactcggcctgtgaaaaagacgatggaaattccgaaagattccttgcagaagtacctcaaagacttactgggtatccagaccacaggattatgaaagcccttgcaaatgctggagtacctgtccctaacgttcttgatctctgtgaagattcaaggtaaagttcagatgtttttgctattgcactttcaagctacaggagagaaaagcccatatgctaacacaaattccaatttgttaaagacaaataaaatttgggtaggagggaaaagaaacttt

SEQ ID NO: 295994 - DNA, 567 bp, Homo sapiens
ccacagcacatccagaaaactttattcggccataatcctaccacccccaaagtttggaaacctaggttaaaagacagctgcttccaggacaggaattcaaattggtgattatcaatttcagaaaggtgacgcaaaccctgagaccaaaaccagtgtctcacaagaactgctattgaaagaacagaggcagtctgaattttttattaccgagcaaacctgtgatttacacccttttgagttaagactgaccagttattttttctttctaagtaaaacgctcctgtctatggactcaggtatggtgcttcagccccacatggaattaaattcagccttctggcagaataattggactgaatgagtcagacagaagtctccagaaagtgcatagcatgaacatggcacctccactgaagacttggttggagtaattaggaatctacaaaagatttgctacaaggaggttcaccacagtgcttattgaaatagcaaaattctgaacaacctataaggctaacaatgactgttggccaaataaaacacaagatggcatacagtgagacttta

SEQ ID NO: 295995 - DNA, 641 bp, Homo sapiens
ccacagcacatccagaaaactttattcggccataatcctaccacccccaaagtttggaaacctaggttaaaagacagctgcttccaggacaggaattcaaattggtgattatcaatttcagaaaggtgacgcaaaccctgagaccaaaaccagtgtctcacaagaactgctattgaaagaacagaggcagtctgaattttttattaccgagcaaacctgtgatttacacccttttgagttaagactgaccagttattttttctttctaagtaaaacgctcctgtctatggactcaggtatggtgcttcagccccacatggaattaaattcagccttctggcagaataattggactgaatgagtcagacagaagtctccagaaagtgcatagcatgaacatggcacctccactgaagacttggttggagtaattaggaatctacaaaagatttgctacaaggaggttcaccacagtgcttattgaaatagcaaaattctgaacaacctataaggctaacaatgactgttggccaaataaaacacaagatggcatacagtgagactttaaatgatgctgtggaaatctattccttaacatggagaaattgctcactatatacacttaaatttaaaaaaaaaaa

SEQ ID NO: 295996 - DNA, 324 bp, Homo sapiens
ctccctaaaccccagcatgtatcaatgtattccacttttgcatattttgcttcctatagaatgggaggtacagaatcgtatcccttctggaactatattaaaggccttgatggaaggtggtgaaaatgggccctggatgagatttatgagagcagaaataacagcagagggttttttacgagaatttgggagactttgctctgaaatgttaaagacctccgtgcctgtggactcatttttctctctgttgaccagtgagcgagtggcaaagcagttcccagtgatgactgaggccatgatcacgcctgtttgtagctgctacac

SEQ ID NO: 295997 - DNA, 3713 bp, Homo sapiens
actgctcttccggacgcaattttgaggaggtcggagcggaaggacgtcgtggagattgcttgcgctggggtgccacacttaggctgagctgcaggttttcgcacagtcgcgagttaacctctgcttgctccagaggcctcgtcctaatccacctcggctgacggcgcgggatccctggctccgcgagcctcagcctcaccatgtgtgtcaggagctgtttccagtccccccgtctccagtgggtgtggagaacagccttcctgaaacacacccagcgcaggcaccaggggtcccaccgatggacacaccttggaggcagcacctacagagcggtgattttcgacatgggcggagttctcattccttctccagggagagtcgctgcagaatgggaggtacagaatcgtatcccttctggaactatattaaaggccttgatggaaggtggtgaaaatgggccctggatgagatttatgagagcagaaataacagcagagggttttttacgagaatttgggagactttgctctgaaatgttaaagacctccgtgcctgtggactcatttttctctctgttgaccagtgagcgagtggcaaagcagttcccagtgatgactgaggccataactcaaattcgggcaaaaggtcttcagactgcagtcttgagcaataatttttatcttcccaaccagaaaagctttttgcccctggaccggaaacagtttgatgtgattgtggagtcctgcatggaagggatctgtaagccagaccctaggatctacaagctgtgcttggagcagctcggcctgcagccctctgagtccatctttcttgatgaccttggaacaaatctaaaagaagctgccagacttggtattcacaccattaaggttaatgacccagagactgcagtaaaggaattagaagctctcttgggttttacattgagagtaggtgttccaaacactcggcctgtgaaaaagacgatggaaattccgaaagattccttgcagaagtacctcaaagacttactgggtatccagaccacaggcccattggaactacttcagtttgatcacgggcagtcaaatccaacttactacatcaggctggctaatcgtgatctagttctgaggaagaagcccccagggacactccttccatctgcccatgccatagagagggagttcaggattatgaaagcccttgcaaatgctggagtacctgtccctaacgttcttgatctctgtgaagattcaagtgtcattggcacccccttctatgtgatggagtactgcccaggtctcatctacaaagacccttccctgccaggcttggagcccagccacagacgagccatatacactgccatgaacacagtcctgtgcaaaattcacagtgtggatctgcaggctgtgggacttgaagactatgggaagcaaggggactatattccacgccaggtacgaacctgggttaagcagtatcgagcttccgaaactagcaccatcccagccatggagaggctgatcgaatggctgcccctccatcttccccgtcagcagaggaccacagtggtgcacggggacttcaggctcgacaacctggtgtttcatccagaagagccagaggtgcttgctgtccttgactgggaactttctaccttgggcgacccccttgctgatgtggcctacagctgcctggctcattacctgccatccagttttcccgtgctgagaggtattaatgactgtgacttgacacagctgggaatccctgctgcagaggagtatttcaggatgtactgtctccaaatggggctccctcccactgagaactggaacttctatatggctttttcctttttccgtgtggctgcaatcctacagggagtctacaagcgatcactcacagggcaagcaagctccacatatgcggaacaaactggaaagctgaccgaatttgtgtctaacctggcgtgggatttcgcagtcaaagaagggttccgggttttcaaagagatgcccttcacaaatccgttaacaaggtcctaccacacgtgggccaggccccagtcccagtggtgccccacaggcagcaggagttatagctccgttccagaagcttccccagctcatacctcaaggggaggtctggttatctctccagagagcctctctccacctgtcagagagctgtatcaccggctgaagcacttcatggagcaacgtgtgtaccctgcagagccagagctgcagagtcaccaggcctcagcagccaggtggagcccctccccactgatcgaagacctcaaggagaaagccaaagctgaaggactttggaaccttttcctacccttagaggctgatcccgagaaaaaatacggagcaggactgaccaatgtggaatatgcacatctgtgtgagctcatgggcacgtccctgtatgcccccgaggtatgtaactgctctgcgcctgacacgggcaacatggagctgctggtgaggtatggcaccgaagcgcagaaggctcgctggctgattcctctgctggaggggaaagcccgctcctgttttgctatgaccgagccccaggttgcctcttcagatgccaccaacattgaggcttccatcagagaggaggacagcttctatgtcataaacggtcacaaatggtggatcacaggcatcctggatcctcgttgccaactctgtgtgtttatgggaaaaacagacccacatgcaccaagacaccggcagcagtctgtgctcttggttcccatggataccccagggataaaaatcatccggcctctgacggtgtatggactggaagatgcaccaggtggccatggtgaagtccgatttgagcacgtgcgtgtgcccaaagagaacatggtcctgggccctggccgaggctttgagatcgcccagggcagactgggccccggcaggatccatcactgcatgaggctgatcgggttctcagagagggccctggcactcatgaaggcccgcgtgaagtcccgcttggcttttgggaagcccctggtggagcagggcacagtgctggcggacatcgcacagtcgcgcgtggagattgagcaggcacggctgctggtgctgagagctgcccacctcatggacctggcaggaaacaaggctgcagccttggatatagccatgattaaaatggtcgccccgtccatggcctcccgagtgattgatcgtgcgattcagaagacgtctctgcaagaagcctggagtctgtttcaggccaggaggaggggatttgctgagggccaagggggttctgggacagagtctggaaagctggtcttcaggctctcagtcccaggctgggcaggcacggtcacttcacttcagcctttcagtccctctctctctgcctgtgggaatctggacacattttgggaggcctcccaaggctgtgggacgtgcttgctctggcagctgcagggttcctgtctggcctccctggtgagcagaggggcggccacggcgggcggtggcctagagacccaggacctgggcgcctgggaaaatggaatgcaacccacattgtaaagccactggcatctgattatctccatttgaacacacagcacagaacaatcatttaaatgttattttggaaaggggttttggggacacagaagaataagtaaacacatctcggaggcaatgtggaat

SEQ ID NO: 295998 - DNA, 4016 bp, Homo sapiens
actgctcttccggacgcaattttgaggaggtcggagcggaaggacgtcgtggagattgcttgcgctggggtgccacacttaggctgagctgcaggttttcgcacagtcgcgagttaacctctgcttgctccagaggcctcgtcctaatccacctcggctgacggcgcgggatccctggctccgcgagcctcagcctcaccatgtgtgtcaggagctgtttccagtccccccgtctccagtgggtgtggagaacagccttcctgaaacacacccagcgcaggcaccaggggtcccaccgatggacacaccttggaggcagcacctacagagcggtgattttcgacatgggcggagttctcattccttctccagggagagtcgctgcagaatgggaggtacagaatcgtatcccttctggaactatattaaaggccttgatggaaggtggtgaaaatgggccctggatgagatttatgagagcagaaataacagcagagggttttttacgagaatttgggagactttgctctgaaatgttaaagacctccgtgcctgtggactcatttttctctctgttgaccagtgagcgagtggcaaagcagttcccagtgatgactgaggccataactcaaattcgggcaaaaggtcttcagactgcagtcttgagcaataatttttatcttcccaaccagaaaagctttttgcccctggaccggaaacagtttgatgtgattgtggagtcctgcatggaagggatctgtaagccagaccctaggatctacaagctgtgcttggagcagctcggcctgcagccctctgagtccatctttcttgatgaccttggaacaaatctaaaagaagctgccagacttggtattcacaccattaaggttaatgacccagagactgcagtaaaggaattagaagctctcttgggttttacattgagagtaggtgttccaaacactcggcctgtgaaaaagacgatggaaattccgaaagattccttgcagaagtacctcaaagacttactgggtatccagaccacaggcccattggaactacttcagtttgatcacgggcagtcaaatccaacttactacatcaggctggctaatcgtgatctagttctgaggaagaagcccccagggacactccttccatctgcccatgccatagagagggagttcaggattatgaaagcccttgcaaatgctggagtacctgtccctaacgttcttgatctctgtgaagattcaagtgtcattggcacccccttctatgtgatggagtactgcccaggtctcatctacaaagacccttccctgccaggcttggagcccagccacagacgagccatatacactgccatgaacacagtcctgtgcaaaattcacagtgtggatctgcaggctgtgggacttgaagactatgggaagcaaggggactatattccacgccaggtacgaacctgggttaagcagtatcgagcttccgaaactagcaccatcccagccatggagaggctgatcgaatggctgcccctccatcttccccgtcagcagaggaccacagtggtgcacggggacttcaggctcgacaacctggtgtttcatccagaagagccagaggtgcttgctgtccttgactgggaactttctaccttgggcgacccccttgctgatgtggcctacagctgcctggctcattacctgccatccagttttcccgtgctgagaggtattaatgactgtgacttgacacagctgggaatccctgctgcagaggagtatttcaggatgtactgtctccaaatggggctccctcccactgagaactggaacttctatatggctttttcctttttccgtgtggctgcaatcctacagggagtctacaagcgatcactcacagggcaagcaagctccacatatgcggaacaaactggaaagctgaccgaatttgtgtctaacctggcgtgggatttcgcagtcaaagaagggttccgggttttcaaagagatgcccttcacaaatccgttaacaaggtcctaccacacgtgggccaggccccagtcccagtggtgccccacaggcagcaggagttatagctccgttccagaagcttccccagctcatacctcaaggggaggtctggttatctctccagagagcctctctccacctgtcagagagctgtatcaccggctgaagcacttcatggagcaacgtgtgtaccctgcagagccagagctgcagagtcaccaggcctcagcagccaggtggagcccctccccactgatcgaagacctcaaggagaaagccaaagctgaaggactttggaaccttttcctacccttagaggctgatcccgagaaaaaatacggagcaggactgaccaatgtggaatatgcacatctgtgtgagctcatgggcacgtccctgtatgcccccgaggtatgtaactgctctgcgcctgacacgggcaacatggagctgctggtgaggtatggcaccgaagcgcagaaggctcgctggctgattcctctgctggaggggaaagcccgctcctgttttgctatgaccgagccccaggttgcctcttcagatgccaccaacattgaggcttccatcagagaggaggacagcttctatgtcataaacggtcacaaatggtggatcacaggcatcctggatcctcgttgccaactctgtgtgtttatgggaaaaacagacccacatgcaccaagacaccggcagcagtctgtgctcttggttcccatggataccccagggataaaaatcatccggcctctgacggtgtatggactggaagatgcaccaggtggccatggtgaagtccgatttgagcacgtgcgtgtgcccaaagagaacatggtcctgggccctggccgaggctttgagatcgcccagggcagactgggccccggcaggatccatcactgcatgaggctgatcgggttctcagagagggccctggcactcatgaaggcccgcgtgaagtcccgcttggcttttgggaagcccctggtggagcagggcacagtgctggcggacatcgcacagtcgcgcgtggagattgagcaggcacggctgctggtgctgagagctgcccacctcatggacctggcaggaaacaaggctgcagccttggatatagccatgattaaaatggtcgccccgtccatggcctcccgagtgattgatcgtgcgattcaggcctttggagcagcaggcctgagcagcgactacccactggctcagttcttcacctgggcccgagccctgcgctttgccgacggccctgacgaggtgcaccgggccacggtggccaagctagagctgaagcaccgcatttagagccttggggctgcagtggctcaatgtcctggctggtccagctgtgcccagatctgtcactgatgtgcctcgaaagatccggtgtttgtggctcctgcaccctgctcagcagctctgtcccgggacagtcagggtggactcaatctttctggttctccacagaagacgtctctgcaagaagcctggagtctgtttcaggccaggaggaggggatttgctgagggccaagggggttctgggacagagtctggaaagctggtcttcaggctctcagtcccaggctgggcaggcacggtcacttcacttcagcctttcagtccctctctctctgcctgtgggaatctggacacattttgggaggcctcccaaggctgtgggacgtgcttgctctggcagctgcagggttcctgtctggcctccctggtgagcagaggggcggccacggcgggcggtggcctagagacccaggacctgggcgcctgggaaaatggaatgcaacccacattgtaaagccactggcatctgattatctccatttgaacacacagcacagaacaatcatttaaatgttattttggaaaggggttttggggacacagaagaataagtaaacacatctcggaggcaatgtggaat

SEQ ID NO: 295999 - DNA, 3242 bp, Homo sapiens
actgctcttccggacgcaattttgaggaggtcggagcggaaggacgtcgtggagattgcttgcgctggggtgccacacttaggctgagctgcaggttttcgcacagtcgcgagttaacctctgcttgctccagaggcctcgtcctaatccacctcggctgacggcgcgggatccctggctccgcgagcctcagcctcaccatgtgtgtcaggagctgtttccagtccccccgtctccagtgggtgtggagaacagccttcctgaaacacacccagcgcaggcaccaggggtcccaccgatggacacaccttggaggcagcacctacagagcggtgattttcgacatgggcggagttctcattccttctccagggagagtcgctgcagaatgggaggtacagaatcgtatcccttctggaactatattaaaggccttgatggaaggtggtgaaaatgggccctggatgagatttatgagagcagaaataacagcagagggttttttacgagaatttgggagactttgctctgaaatgttaaagacctccgtgcctgtggactcatttttctctctgttgaccagtgagcgagtggcaaagcagttcccagtgatgactgaggccataactcaaattcgggcaaaaggtcttcagactgcagtcttgagcaataatttttatcttcccaaccagaaaagctttttgcccctggaccggaaacagtttgatgtgattgtggagtcctgcatggaagggatctgtaagccagaccctaggatctacaagctgtgcttggagcagctcggcctgcagccctctgagtccatctttcttgatgaccttggaacaaatctaaaagaagctgccagacttggtattcacaccattaaggttaatgacccagagactgcagtaaaggaattagaagctctcttgggttttacattgagagtaggtgttccaaacactcggcctgtgaaaaagacgatggaaattccgaaagattccttgcagaagtacctcaaagacttactgggtatccagaccacaggcccattggaactacttcagtttgatcacgggcagtcaaatccaacttactacatcaggctggctaatcgtgatctagttctgaggaagaagcccccagggacactccttccatctgcccatgccatagagagggagttcaggattatgaaagcccttgcaaatgctggagtacctgtccctaacgttcttgatctctgtgaagattcaagtgtcattggcacccccttctatgtgatggagtactgcccaggtctcatctacaaagacccttccctgccaggcttggagcccagccacagacgagccatatacactgccatgaacacagtcctgtgcaaaattcacagtgtggatctgcaggctgtgggacttgaagactatgggaagcaagggcaagcaagctccacatatgcggaacaaactggaaagctgaccgaatttgtgtctaacctggcgtgggatttcgcagtcaaagaagggttccgggttttcaaagagatgcccttcacaaatccgttaacaaggtcctaccacacgtgggccaggccccagtcccagtggtgccccacaggcagcaggagttatagctccgttccagaagcttccccagctcatacctcaaggggaggtctggttatctctccagagagcctctctccacctgtcagagagctgtatcaccggctgaagcacttcatggagcaacgtgtgtaccctgcagagccagagctgcagagtcaccaggcctcagcagccaggtggagcccctccccactgatcgaagacctcaaggagaaagccaaagctgaaggactttggaaccttttcctacccttagaggctgatcccgagaaaaaatacggagcaggactgaccaatgtggaatatgcacatctgtgtgagctcatgggcacgtccctgtatgcccccgaggtatgtaactgctctgcgcctgacacgggcaacatggagctgctggtgaggtatggcaccgaagcgcagaaggctcgctggctgattcctctgctggaggggaaagcccgctcctgttttgctatgaccgagccccaggttgcctcttcagatgccaccaacattgaggcttccatcagagaggaggacagcttctatgtcataaacggtcacaaatggtggatcacaggcatcctggatcctcgttgccaactctgtgtgtttatgggaaaaacagacccacatgcaccaagacaccggcagcagtctgtgctcttggttcccatggataccccagggataaaaatcatccggcctctgacggtgtatggactggaagatgcaccaggtggccatggtgaagtccgatttgagcacgtgcgtgtgcccaaagagaacatggtcctgggccctggccgaggctttgagatcgcccagggcagactgggccccggcaggatccatcactgcatgaggctgatcgggttctcagagagggccctggcactcatgaaggcccgcgtgaagtcccgcttggcttttgggaagcccctggtggagcagggcacagtgctggcggacatcgcacagtcgcgcgtggagattgagcaggcacggctgctggtgctgagagctgcccacctcatggacctggcaggaaacaaggctgcagccttggatatagccatgattaaaatggtcgccccgtccatggcctcccgagtgattgatcgtgcgattcagaagacgtctctgcaagaagcctggagtctgtttcaggccaggaggaggggatttgctgagggccaagggggttctgggacagagtctggaaagctggtcttcaggctctcagtcccaggctgggcaggcacggtcacttcacttcagcctttcagtccctctctctctgcctgtgggaatctggacacattttgggaggcctcccaaggctgtgggacgtgcttgctctggcagctgcagggttcctgtctggcctccctggtgagcagaggggcggccacggcgggcggtggcctagagacccaggacctgggcgcctgggaaaatggaatgcaacccacattgtaaagccactggcatctgattatctccatttgaacacacagcacagaacaatcatttaaatgttattttggaaaggggttttggggacacagaagaataagtaaacacatctcggaggcaatgtggaat

SEQ ID NO: 296000 - DNA, 2966 bp, Homo sapiens
actgctcttccggacgcaattttgaggaggtcggagcggaaggacgtcgtggagattgcttgcgctggggtgccacacttaggctgagctgcaggttttcgcacagtcgcgagttaacctctgcttgctccagaggcctcgtcctaatccacctcggctgacggcgcgggatccctggctccgcgagcctcagcctcaccatgtgtgtcaggagctgtttccagtccccccgtctccagtgggtgtggagaacagccttcctgaaacacacccagcgcaggcaccaggggtcccaccgatggacacaccttggaggcagcacctacagagcggtgattttcgacatgggcggagttctcattccttctccagggagagtcgctgcagaatgggaggtacagaatcgtatcccttctggaactatattaaaggccttgatggaaggtggtgaaaatgggccctggatgagatttatgagagcagaaataacagcagagggttttttacgagaatttgggagactttgctctgaaatgttaaagacctccgtgcctgtggactcatttttctctctgttgaccagtgagcgagtggcaaagcagttcccagtgatgactgaggccataactcaaattcgggcaaaaggtcttcagactgcagtcttgagcaataatttttatcttcccaaccagaaaagctttttgcccctggaccggaaacagtttgatgtgattgtggagtcctgcatggaagggatctgtaagccagaccctaggatctacaagctgtgcttggagcagctcggcctgcagccctctgagtccatctttcttgatgaccttggaacaaatctaaaagaagctgccagacttggtattcacaccattaaggttaatgacccagagactgcagtaaaggaattagaagctctcttgggttttacattgagagtaggtgttccaaacactcggcctgtgaaaaagacgatggaaattccgaaagattccttgcagaagtacctcaaagacttactgggtatccagaccacaggcccattggaactacttcagtttgatcacgggcagtcaaatccaacttactacatcaggctggctaatcgtgatctagttctgaggaagaagcccccagggacactccttccatctgcccatgccatagagagggagttcaggattatgaaagcccttgcaaatgctggagtacctgtccctaacgttcttgatctctgtgaagattcaagtgtcattggcacccccttctatgtgatggagtactgcccaggtctcatctacaaagacccttccctgccaggcttggagcccagccacagacgagccatatacactgccatgaacacagtcctgtgcaaaattcacagtgtggatctgcaggctgtgggacttgaagactatgggaagcaaggggactatattccacgccaggtacgaacctgggttaagcagtatcgagcttccgaaactagcaccatcccagccatggagaggctgatcgaatggctgcccctccatcttccccgtcagcagaggaccacagtggtgcacggggacttcagatcacgccactgcactccagcctgcgcaacaaagtgagaccccgtctccaaaaaaataataaaaaaaagaaggaaaaagaataaataaaacaagaaaaaaaaaggaatacttagaaccttttctgatgccttgtgactttcagaatttaaaatcccccttgcagataaggccacccacggcggaaggccgggagcgagacggggctgaggggaccttgctcccattggagctgcagggcaggaaggggtgctgcggtcagcagagggcacccttcgcctgcgccgtgtgcagtgcctgcagtcactccctcattcccaggagtagccttgggtcagatgctggctcagatctataactgctcctgtctggtagccaggcctgcccagatgtgcaatggctggaataaagggttcttggaagcaatttgttacaggcaccctgtgggctgtggctggctgtggcacacgtgaaggttgtgtgtcagacctactccctggacatggcgcatggctgcacacaggcaccttggctgagaagatgcacagtcctggtttcactctcctcccctgccctgtcctgtctgcttccacccagctctgcaggccaccagcccccgcctctcgtggccacccccagcccagcatgtcctcagccgcacatctcctgtgtcgacaggtgaagtcccgcttggcttttgggaagcccctggtggagcagggcacagtgctggcggacatcgcacagtcgcgcgtggagattgagcaggcacggctgctggtgctgagagctgcccacctcatggacctggcaggaaacaaggctgcagccttggatatagccatgattaaaatggtcgccccgtccatggcctcccgagtgattgatcgtgcgattcagaagacgtctctgcaagaagcctggagtctgtttcaggccaggaggaggggatttgctgagggccaagggggttctgggacagagtctggaaagctggtcttcaggctctcagtcccaggctgggcaggcacggtcacttcacttcagcctttcagtccctctctctctgcctgtgggaatctggacacattttgggaggcctcccaaggctgtgggacgtgcttgctctggcagctgcagggttcctgtctggcctccctggtgagcagaggggcggccacggcgggcggtggcctagagacccaggacctgggcgcctgggaaaatggaatgcaacccacattgtaaagccactggcatctgattatctccatttgaacacacagcacagaacaatcatttaaatgttattttggaaaggggttttggggacacagaagaataagtaaacacatctcggaggcaatgtggaat

SEQ ID NO: 296001 - DNA, 2307 bp, Homo sapiens
caaatagtgagctgagtgatgctggtgttgattccctccagagacagtggtgtctagaagttggctcttcctttagtcagttgtggcattgctgttatcaattttgtagcaagggtggtctaggatgcaggacttcttatagcccactggcaacggcagaggtgatctggggtgttactgattaaatgtagtcttttaggaaagcagagatcaagagcagggagcaggcagacctaagttggactctggcccccagccccctaacttccagctcgtccaagtcacctccttctctaagactcagttttcttgcgtgcaaagtgcaggtgaaagcagttgtattgctttggggattcagtgagctatagtggctcttagcacagtgtttggtacttagcaagtgctcagcaaatggcaatagctgctgaagtgacagtgtcatcacatgttaacatccctatgatgggtcgtgtgggagtaatcactgtttttctttgattctgcttagggcaagcaagctccacatatgcggaacaaactggaaagctgaccgaatttgtgtctaacctggcgtgggatttcgcagtcaaagaagggttccgggttttcaaagagatgcccttcacaaatccgttaacaaggtcctaccacacgtgggccaggccccagtcccagtggtgccccacaggcagcaggagttatagctccgttccagaagcttccccagctcatacctcaaggggaggtctggttatctctccagagagcctctctccacctgtcagagagctgtatcaccggctgaagcacttcatggagcaacgtgtgtaccctgcagagccagagctgcagagtcaccaggcctcagcagccaggtggagcccctccccactgatcgaagacctcaaggagaaagccaaagctgaaggactttggaaccttttcctacccttagaggctgatcccgagaaaaaatacggagcaggactgaccaatgtggaatatgcacatctgtgtgagctcatgggcacgtccctgtatgcccccgaggtatgtaactgctctgcgcctgacacgggcaacatggagctgctggtgaggtatggcaccgaagcgcagaaggctcgctggctgattcctctgctggaggggaaagcccgctcctgttttgctatgaccgagccccaggttgcctcttcagatgccaccaacattgaggcttccatcagagaggaggacagcttctatgtcataaacggtcacaaatggtggatcacaggcatcctggatcctcgttgccaactctgtgtgtttatgggaaaaacagacccacatgcaccaagacaccggcagcagtctgtgctcttggttcccatggataccccagggataaaaatcatccggcctctgacggtgtatggactggaagatgcaccaggtggccatggtgaagtccgatttgagcacgtgcgtgtgcccaaagagaacatggtcctgggccctggccgaggctttgagatcgcccagggcagactgggccccggcaggatccatcactgcatgaggctgatcgggttctcagagagggccctggcactcatgaaggcccgcgtgaagtcccgcttggcttttgggaagcccctggtggagcagggcacagtgctggcggacatcgcacagtcgcgcgtggagattgagcaggcacggctgctggtgctgagagctgcccacctcatggacctggcaggaaacaaggctgcagccttggatatagccatgattaaaatggtcgccccgtccatggcctcccgagtgattgatcgtgcgattcagaagacgtctctgcaagaagcctggagtctgtttcaggccaggaggaggggatttgctgagggccaagggggttctgggacagagtctggaaagctggtcttcaggctctcagtcccaggctgggcaggcacggtcacttcacttcagcctttcagtccctctctctctgcctgtgggaatctggacacattttgggaggcctcccaaggctgtgggacgtgcttgctctggcagctgcagggttcctgtctggcctccctggtgagcagaggggcggccacggcgggcggtggcctagagacccaggacctgggcgcctgggaaaatggaatgcaacccacattgtaaagccactggcatctgattatctccatttgaacacacagcacagaacaatcatttaaatgttattttggaaaggggttttggggacacagaagaataagtaaacacatctcggaggcaatgtggaat

SEQ ID NO: 296002 - DNA, 1440 bp, Homo sapiens
cagctactcaggtggctgaggtaggaagattgcttgagcccgggaggcggaggttgcagtgagccaagatcacgccactgcactccagcctgcgcaacaaagtgagaccccgtctccaaaaaaataataaaaaaaagaaggaaaaagaataaataaaacaagaaaaaaaaaggaatacttagaaccttttctgatgccttgtgactttcagaatttaaaatcccccttgcagataaggccacccacggcggaaggccgggagcgagacggggctgaggggaccttgctcccattggagctgcagggcaggaaggggtgctgcggtcagcagagggcacccttcgcctgcgccgtgtgcagtgcctgcagtcactccctcattcccaggagtagccttgggtcagatgctggctcagatctataactgctcctgtctggtagccaggcctgcccagatgtgcaatggctggaataaagggttcttggaagcaatttgttacaggcaccctgtgggctgtggctggctgtggcacacgtgaaggttgtgtgtcagacctactccctggacatggcgcatggctgcacacaggcaccttggctgagaagatgcacagtcctggtttcactctcctcccctgccctgtcctgtctgcttccacccagctctgcaggccaccagcccccgcctctcgtggccacccccagcccagcatgtcctcagccgcacatctcctgtgtcgacaggtgaagtcccgcttggcttttgggaagcccctggtggagcagggcacagtgctggcggacatcgcacagtcgcgcgtggagattgagcaggcacggctgctggtgctgagagctgcccacctcatggacctggcaggaaacaaggctgcagccttggatatagccatgattaaaatggtcgccccgtccatggcctcccgagtgattgatcgtgcgattcagaagacgtctctgcaagaagcctggagtctgtttcaggccaggaggaggggatttgctgagggccaagggggttctgggacagagtctggaaagctggtcttcaggctctcagtcccaggctgggcaggcacggtcacttcacttcagcctttcagtccctctctctctgcctgtgggaatctggacacattttgggaggcctcccaaggctgtgggacgtgcttgctctggcagctgcagggttcctgtctggcctccctggtgagcagaggggcggccacggcgggcggtggcctagagacccaggacctgggcgcctgggaaaatggaatgcaacccacattgtaaagccactggcatctgattatctccatttgaacacacagcacagaacaatcatttaaatgttattttggaaaggggttttggggacacagaagaataagtaaacacatctcggaggcaatgtggaat

SEQ ID NO: 296003 - DNA, 1296 bp, Homo sapiens
caggaagtggaccccaaacctactcttccaggccccagtgtgaacagctgacctctaggccacagccctggtttggtccgctcccagtttggttctctgctaatagtgttcacatttttactttcagtgttttcataggatcactacattgtcacaaaccactaggagcttcagcttaaggtggcattattatgtttttataaaaggaatcacagaatagtcatttgccattataaatcagtgattcattttctgtgtttaacaggctgtttcctgccgtccttttccctttaaccatgtcccagtaagaaggctaaataaagggcagggacattgccagcagataacccagactgaggtgaggaataaacacatccaaggaaaatgactatggctattgctcacagtgatcgtttgggtctttcaggtggccatggtgaagtccgatttgagcacgtgcgtgtgcccaaagagaacatggtcctgggccctggccgaggctttgagatcgcccagggcagactgggccccggcaggatccatcactgcatgaggctgatcgggttctcagagagggccctggcactcatgaaggcccgcgtgaagtcccgcttggcttttgggaagcccctggtggagcagggcacagtgctggcggacatcgcacagtcgcgcgtggagattgagcaggcacggctgctggtgctgagagctgcccacctcatggacctggcaggaaacaaggctgcagccttggatatagccatgattaaaatggtcgccccgtccatggcctcccgagtgattgatcgtgcgattcagaagacgtctctgcaagaagcctggagtctgtttcaggccaggaggaggggatttgctgagggccaagggggttctgggacagagtctggaaagctggtcttcaggctctcagtcccaggctgggcaggcacggtcacttcacttcagcctttcagtccctctctctctgcctgtgggaatctggacacattttgggaggcctcccaaggctgtgggacgtgcttgctctggcagctgcagggttcctgtctggcctccctggtgagcagaggggcggccacggcgggcggtggcctagagacccaggacctgggcgcctgggaaaatggaatgcaacccacattgtaaagccactggcatctgattatctccatttgaacacacagcacagaacaatcatttaaatgttattttggaaaggggttttggggacacagaagaataagtaaacacatctcggaggcaatgtggaat

SEQ ID NO: 296004 - DNA, 3314 bp, Homo sapiens
actgctcttccggacgcaattttgaggaggtcggagcggaaggacgtcgtggagattgcttgcgctggggtgccacacttaggctgagctgcaggttttcgcacagtcgcgagttaacctctgcttgctccagaggcctcgtcctaatccacctcggctgacggcgcgggatccctggctccgcgagcctcagcctcaccatgtgtgtcaggagctgtttccagtccccccgtctccagtgggtgtggagaacagccttcctgaaacacacccagcgcaggcaccaggggtcccaccgatggacacaccttggaggcagcacctacagagcggtgattttcgacatgggcggagttctcattccttctccagggagagtcgctgcagaatgggaggtacagaatcgtatcccttctggaactatattaaaggccttgatggaaggtggtgaaaatgggccctggatgagatttatgagagcagaaataacagcagagggttttttacgagaatttgggagactttgctctgaaatgttaaagacctccgtgcctgtggactcatttttctctctgttgaccagtgagcgagtggcaaagcagttcccagtgatgactgaggccataactcaaattcgggcaaaaggtcttcagactgcagtcttgagcaataatttttatcttcccaaccagaaaagctttttgcccctggaccggaaacagtttgatgtgattgtggagtcctgcatggaagggatctgtaagccagaccctaggatctacaagctgtgcttggagcagctcggcctgcagccctctgagtccatctttcttgatgaccttggaacaaatctaaaagaagctgccagacttggtattcacaccattaaggttaatgacccagagactgcagtaaaggaattagaagctctcttgggttttacattgagagtaggtgttccaaacactcggcctgtgaaaaagacgatggaaattccgaaagattccttgcagaagtacctcaaagacttactgggtatccagaccacaggcccattggaactacttcagtttgatcacgggcagtcaaatccaacttactacatcaggctggctaatcgtgatctagttctgaggaagaagcccccagggacactccttccatctgcccatgccatagagagggagttcaggattatgaaagcccttgcaaatgctggagtacctgtccctaacgttcttgatctctgtgaagattcaagtgtcattggcacccccttctatgtgatggagtactgcccaggtctcatctacaaagacccttccctgccaggcttggagcccagccacagacgagccatatacactgccatgaacacagtcctgtgcaaaattcacagtgtggatctgcaggctgtgggacttgaagactatgggaagcaaggggactatattccacgccaggtacgaacctgggttaagcagtatcgagcttccgaaactagcaccatcccagccatggagaggctgatcgaatggctgcccctccatcttccccgtcagcagaggaccacagtggtgcacggggacttcaggctcgacaacctggtgtttcatccagaagagccagaggtgcttgctgtccttgactgggaactttctaccttgggcgacccccttgctgatgtggcctacagctgcctggctcattacctgccatccagttttcccgtgctgagaggtattaatgactgtgacttgacacagctgggaatccctgctgcagaggagtatttcaggatgtactgtctccaaatggggctccctcccactgagaactggaacttctatatggctttttcctttttccgtgtggctgcaatcctacagggagtctacaagcgatcactcacagggcaagcaagctccacatatgcggaacaaactggaaagctgaccgaatttgtgtctaacctggcgtgggatttcgcagtcaaagaagggttccgggttttcaaagagatgcccttcacaaatccgttaacaaggtcctaccacacgtgggccaggccccagtcccagtggtgccccacaggcagcaggagttatagctccgttccagaagcttccccagctcatacctcaaggggaggtctggttatctctccagagagcctctctccacctgtcagagagctgtatcaccggctgaagcacttcatggagcaacgtgtgtaccctgcagagccagagctgcagagtcaccaggcctcagcagccaggtggagcccctccccactgatcgaagacctcaaggagaaagccaaagctgaaggactttggaaccttttcctacccttagaggctgatcccgagaaaaaatacggagcaggactgaccaatgtggaatatgcacatctgtgtgagctcatgggcacgtccctgtatgcccccgaggtatgtaactgctctgcgcctgacacgggcaacatggagctgctggtgaggtatggcaccgaagcgcagaaggctcgctggctgattcctctgctggaggggaaagcccgctcctgttttgctatgaccgagccccaggttgcctcttcagatgccaccaacattgaggcttccatcagagaggaggacagcttctatgtcataaacggtcacaaatggtggatcacaggcatcctggatcctcgttgccaactctgtgtgtttatgggaaaaacagacccacatgcaccaagacaccggcagcagtctgtgctcttggttcccatggataccccagggataaaaatcatccggcctctgacggtgtatggactggaagatgcaccaggtggccatggtgaagtccgatttgagcacgtgcgtgtgcccaaagagaacatggtcctgggccctggccgaggctttgagatcgcccagggcagactgggccccggcaggatccatcactgcatgaggctgatcgggttctcagagagggccctggcactcatgaaggcccgctaaaacgctcctgtctatggactcaggtatggtgcttcagccccacatggaattaaattcagccttctggcagaataattggactgaatgagtcagacagaagtctccagaaagtgcatagcatgaacatggcacctccactgaagacttggttggagtaattaggaatctacaaaagatttgctacaaggaggttcaccacagtgcttattgaaatagcaaaattctgaacaacctataaggctaacaatgactgttggccaaataaaacacaagatggcatacagtgagacttta

SEQ ID NO: 296005 - DNA, 2814 bp, Homo sapiens
actgctcttccggacgcaattttgaggaggtcggagcggaaggacgtcgtggagattgcttgcgctggggtgccacacttaggctgagctgcaggttttcgcacagtcgcgagttaacctctgcttgctccagaggcctcgtcctaatccacctcggctgacggcgcgggatccctggctccgcgagcctcagcctcaccatgtgtgtcaggagctgtttccagtccccccgtctccagtgggtgtggagaacagccttcctgaaacacacccagcgcaggcaccaggggtcccaccgatggacacaccttggaggcagcacctacagagcggtgattttcgacatgggcggagttctcattccttctccagggagagtcgctgcagaatgggaggtacagaatcgtatcccttctggaactatattaaaggccttgatggaaggtggtgaaaatgggccctggatgagatttatgagagcagaaataacagcagagggttttttacgagaatttgggagactttgctctgaaatgttaaagacctccgtgcctgtggactcatttttctctctgttgaccagtgagcgagtggcaaagcagttcccagtgatgactgaggccataactcaaattcgggcaaaaggtcttcagactgcagtcttgagcaataatttttatcttcccaaccagaaaagctttttgcccctggaccggaaacagtttgatgtgattgtggagtcctgcatggaagggatctgtaagccagaccctaggatctacaagctgtgcttggagcagctcggcctgcagccctctgagtccatctttcttgatgaccttggaacaaatctaaaagaagctgccagacttggtattcacaccattaaggttaatgacccagagactgcagtaaaggaattagaagctctcttgggttttacattgagagtaggtgttccaaacactcggcctgtgaaaaagacgatggaaattccgaaagattccttgcagaagtacctcaaagacttactgggtatccagaccacaggcccattggaactacttcagtttgatcacgggcagtcaaatccaacttactacatcaggctggctaatcgtgatctagttctgaggaagaagcccccagggacactccttccatctgcccatgccatagagagggagttcaggattatgaaagcccttgcaaatgctggagtacctgtccctaacgttcttgatctctgtgaagattcaagtgtcattggcacccccttctatgtgatggagtactgcccaggtctcatctacaaagacccttccctgccaggcttggagcccagccacagacgagccatatacactgccatgaacacagtcctgtgcaaaattcacagtgtggatctgcaggctgtgggacttgaagactatgggaagcaaggggactatattccacgccaggtacgaacctgggttaagcagtatcgagcttccgaaactagcaccatcccagccatggagaggctgatcgaatggctgcccctccatcttccccgtcagcagaggaccacagtggtgcacggggacttcaggctcgacaacctggtgtttcatccagaagagccagaggtgcttgctgtccttgactgggaactttctaccttgggcgacccccttgctgatgtggcctacagctgcctggctcattacctgccatccagttttcccgtgctgagaggtattaatgactgtgacttgacacagctgggaatccctgctgcagaggagtatttcaggatgtactgtctccaaatggggctccctcccactgagaactggaacttctatatggctttttcctttttccgtgtggctgcaatcctacagggagtctacaagcgatcactcacagggcaagcaagctccacatatgcggaacaaactggaaagctgaccgaatttgtgtctaacctggcgtgggatttcgcagtcaaagaagggttccgggttttcaaagagatgcccttcacaaatccgttaacaaggtcctaccacacgtgggccaggccccagtcccagtggtgccccacaggcagcaggagttatagctccgttccagaagcttccccagctcatacctcaaggggaggtctggttatctctccagagagcctctctccacctgtcagagagctgtatcaccggctgaagcacttcatggagcaacgtgtgtaccctgcagagccagagctgcagagtcaccaggcctcagcagccaggtggagcccctccccactgatcgaagacctcaaggtaaagcagccatggtgaggtggtaagaccccaataccatggcataccctccccgaccccaccgggctcacctgaaccatcccaggcagtgaagatacaggagctccgagttgaatgatctttgcttccatcgtctcagaaagagccagctcttcatgactcagtttccatctcttgctcttgctgtgcctgtgtcacaggcagatggctcaggtgtgactgcacagcccaggcagtggaatgcttggccttagaaagccagggcaggttaggcctatctgatgggtatttgaattatgtaaatttgaaacagtgctgtatcagctaataaatctctctctagagaacccgtaatatcacagctagagggccagatccactgtgagctgagtttctgtgttgtctcccagtgctgtcacttcagctgataaacagaaacacccgctgttccttatcacgtgaaccttggattgtgttagttttgaaattacttgagatc

SEQ ID NO: 296006 - DNA, 3671 bp, Homo sapiens
actgctcttccggacgcaattttgaggaggtcggagcggaaggacgtcgtggagattgcttgcgctggggtgccacacttaggctgagctgcaggttttcgcacagtcgcgagttaacctctgcttgctccagaggcctcgtcctaatccacctcggctgacggcgcgggatccctggctccgcgagcctcagcctcaccatgtgtgtcaggagctgtttccagtccccccgtctccagtgggtgtggagaacagccttcctgaaacacacccagcgcaggcaccaggggtcccaccgatggacacaccttggaggcagcacctacagagcggtgattttcgacatgggcggagttctcattccttctccagggagagtcgctgcagaatgggaggtacagaatcgtatcccttctggaactatattaaaggccttgatggaaggtggtgaaaatgggccctggatgagatttatgagagcagaaataacagcagagggttttttacgagaatttgggagactttgctctgaaatgttaaagacctccgtgcctgtggactcatttttctctctgttgaccagtgagcgagtggcaaagcagttcccagtgatgactgaggccataactcaaattcgggcaaaaggtcttcagactgcagtcttgagcaataatttttatcttcccaaccagaaaagctttttgcccctggaccggaaacagtttgatgtgattgtggagtcctgcatggaagggatctgtaagccagaccctaggatctacaagctgtgcttggagcagctcggcctgcagccctctgagtccatctttcttgatgaccttggaacaaatctaaaagaagctgccagacttggtattcacaccattaaggttaatgacccagagactgcagtaaaggaattagaagctctcttgggttttacattgagagtaggtgttccaaacactcggcctgtgaaaaagacgatggaaattccgaaagattccttgcagaagtacctcaaagacttactgggtatccagaccacaggcccattggaactacttcagtttgatcacgggcagtcaaatccaacttactacatcaggctggctaatcgtgatctagttctgaggaagaagcccccagggacactccttccatctgcccatgccatagagagggagttcaggattatgaaagcccttgcaaatgctggagtacctgtccctaacgttcttgatctctgtgaagattcaagtgtcattggcacccccttctatgtgatggagtactgcccaggtctcatctacaaagacccttccctgccaggcttggagcccagccacagacgagccatatacactgccatgaacacagtcctgtgcaaaattcacagtgtggatctgcaggctgtgggacttgaagactatgggaagcaaggggactatattccacgccaggtacgaacctgggttaagcagtatcgagcttccgaaactagcaccatcccagccatggagaggctgatcgaatggctgcccctccatcttccccgtcagcagaggaccacagtggtgcacggggacttcaggctcgacaacctggtgtttcatccagaagagccagaggtgcttgctgtccttgactgggaactttctaccttgggcgacccccttgctgatgtggcctacagctgcctggctcattacctgccatccagttttcccgtgctgagaggtattaatgactgtgacttgacacagctgggaatccctgctgcagaggagtatttcaggatgtactgtctccaaatggggctccctcccactgagaactggaacttctatatggctttttcctttttccgtgtggctgcaatcctacagggagtctacaagcgatcactcacagggcaagcaagctccacatatgcggaacaaactggaaagctgaccgaatttgtgtctaacctggcgtgggatttcgcagtcaaagaagggttccgggttttcaaagagatgcccttcacaaatccgttaacaaggtcctaccacacgtgggccaggccccagtcccagtggtgccccacaggcagcaggagttatagctccgttccagaagcttccccagctcatacctcaaggggaggtctggttatctctccagagagcctctctccacctgtcagagagctgtatcaccggctgaagcacttcatggagcaacgtgtgtaccctgcagagccagagctgcagagtcaccaggcctcagcagccaggtggagcccctccccactgatcgaagacctcaaggagaaagccaaagctgaaggactttggaaccttttcctacccttagaggctgatcccgagaaaaaatacggagcaggactgaccaatgtggaatatgcacatctgtgtgagctcatgggcacgtccctgtatgcccccgaggtatgtaactgctctgcgcctgacacgggcaacatggagctgctggtgaggtatggcaccgaagcgcagaaggctcgctggctgattcctctgctggaggggaaagcccgctcctgttttgctatgaccgagccccaggttgcctcttcagatgccaccaacattgaggcttccatcagagaggaggacagcttctatgtcataaacggtcacaaatggtggatcacaggcatcctggatcctcgttgccaactctgtgtgtttatgggaaaaacagacccacatgcaccaagacaccggcagcagtctgtgctcttggttcccatggataccccagggataaaaatcatccggcctctgacggtgtatggactggaagatgcaccaggtggccatggtgaagtccgatttgagcacgtgcgtgtgcccaaagagaacatggtcctgggccctggccgaggctttgagatcgcccagggcagactgggccccggcaggatccatcactgcatgaggctgatcgggttctcagagagggccctggcactcatgaaggcccgcgtgaagtcccgcttggcttttgggaagcccctggtggagcagggcacagtgctggcggacatcgcacagtcgcgcgtggagattgagcaggcacggctgctggtgctgagagctgcccacctcatggacctggcaggaaacaaggctgcagccttggatatagccatgattaaaatggtcgccccgtccatggcctcccgagtgattgatcgtgcgattcaggtgagcacagaccagacagttggcttatttgaaccatcaatactagatgccaaactctcctatcttcagccgcccagcctcccatagaccctggcagatgccctgtgtcacccactcaccatgcatgcaactttccttttcctcttcagaatgacccagcaaggtgggaggtgccatcgtacccccattttgaatgtgaggaaacaggcacagaaaagtgaagtgacttgtccaggtcactgagcttgcaagtagctgacctcaaattcacatgaacttgggttttcataagcccagagcccaggctctttcccatgcaggggggccgcctccttagatcctaacccccggccccagcacagggcagaaggcacctgcagagtgggcctggggagtctggaggccgtgggatggcaggtgtggccccatgga

SEQ ID NO: 296007 - DNA, 3388 bp, Homo sapiens
actgctcttccggacgcaattttgaggaggtcggagcggaaggacgtcgtggagattgcttgcgctggggtgccacacttaggctgagctgcaggttttcgcacagtcgcgagttaacctctgcttgctccagaggcctcgtcctaatccacctcggctgacggcgcgggatccctggctccgcgagcctcagcctcaccatgtgtgtcaggagctgtttccagtccccccgtctccagtgggtgtggagaacagccttcctgaaacacacccagcgcaggcaccaggggtcccaccgatggacacaccttggaggcagcacctacagagcggtgattttcgacatgggcggagttctcattccttctccagggagagtcgctgcagaatgggaggtacagaatcgtatcccttctggaactatattaaaggccttgatggaaggtggtgaaaatgggccctggatgagatttatgagagcagaaataacagcagagggttttttacgagaatttgggagactttgctctgaaatgttaaagacctccgtgcctgtggactcatttttctctctgttgaccagtgagcgagtggcaaagcagttcccagtgatgactgaggccataactcaaattcgggcaaaaggtcttcagactgcagtcttgagcaataatttttatcttcccaaccagaaaagctttttgcccctggaccggaaacagtttgatgtgattgtggagtcctgcatggaagggatctgtaagccagaccctaggatctacaagctgtgcttggagcagctcggcctgcagccctctgagtccatctttcttgatgaccttggaacaaatctaaaagaagctgccagacttggtattcacaccattaaggttaatgacccagagactgcagtaaaggaattagaagctctcttgggttttacattgagagtaggtgttccaaacactcggcctgtgaaaaagacgatggaaattccgaaagattccttgcagaagtacctcaaagacttactgggtatccagaccacaggcccattggaactacttcagtttgatcacgggcagtcaaatccaacttactacatcaggctggctaatcgtgatctagttctgaggaagaagcccccagggacactccttccatctgcccatgccatagagagggagttcaggattatgaaagcccttgcaaatgctggagtacctgtccctaacgttcttgatctctgtgaagattcaagtgtcattggcacccccttctatgtgatggagtactgcccaggtctcatctacaaagacccttccctgccaggcttggagcccagccacagacgagccatatacactgccatgaacacagtcctgtgcaaaattcacagtgtggatctgcaggctgtgggacttgaagactatgggaagcaaggggactatattccacgccaggtacgaacctgggttaagcagtatcgagcttccgaaactagcaccatcccagccatggagaggctgatcgaatggctgcccctccatcttccccgtcagcagaggaccacagtggtgcacggggacttcaggctcgacaacctggtgtttcatccagaagagccagaggtgcttgctgtccttgactgggaactttctaccttgggcgacccccttgctgatgtggcctacagctgcctggctcattacctgccatccagttttcccgtgctgagaggtattaatgactgtgacttgacacagctgggaatccctgctgcagaggagtatttcaggatgtactgtctccaaatggggctccctcccactgagaactggaacttctatatggctttttcctttttccgtgtggctgcaatcctacagggagtctacaagcgatcactcacagggcaagcaagctccacatatgcggaacaaactggaaagctgaccgaatttgtgtctaacctggcgtgggatttcgcagtcaaagaagggttccgggttttcaaagagatgcccttcacaaatccgttaacaaggtcctaccacacgtgggccaggccccagtcccagtggtgccccacaggcagcaggagttatagctccgttccagaagcttccccagctcatacctcaaggggaggtctggttatctctccagagagcctctctccacctgtcagagagctgtatcaccggctgaagcacttcatggagcaacgtgtgtaccctgcagagccagagctgcagagtcaccaggcctcagcagccaggtggagcccctccccactgatcgaagacctcaaggagaaagccaaagctgaaggactttggaaccttttcctacccttagaggctgatcccgagaaaaaatacggagcaggactgaccaatgtggaatatgcacatctgtgtgagctcatgggcacgtccctgtatgcccccgaggtatgtaactgctctgcgcctgacacgggcaacatggagctgctggtgaggtatggcaccgaagcgcagaaggctcgctggctgattcctctgctggaggggaaagcccgctcctgttttgctatgaccgagccccaggttgcctcttcagatgccaccaacattgaggcttccatcagagaggaggacagcttctatgtcataaacggtcacaaatggtggatcacaggcatcctggatcctcgttgccaactctgtgtgtttatgggaaaaacagacccacatgcaccaagacaccggcagcagtctgtgctcttggttcccatggataccccagggataaaaatcatccggcctctgacggtgtatggactggaagatgcaccaggtggccatggtgaagtccgatttgagcacgtgcgtgtgcccaaagagaacatggtcctgggccctggccgaggctttgagatcgcccagggcagactgggccccggcaggatccatcactgcatgaggctgatcgggttctcagagagggccctggcactcatgaaggcccgctaaaacgctcctgtctatggactcaggtatggtgcttcagccccacatggaattaaattcagccttctggcagaataattggactgaatgagtcagacagaagtctccagaaagtgcatagcatgaacatggcacctccactgaagacttggttggagtaattaggaatctacaaaagatttgctacaaggaggttcaccacagtgcttattgaaatagcaaaattctgaacaacctataaggctaacaatgactgttggccaaataaaacacaagatggcatacagtgagactttaaatgatgctgtggaaatctattccttaacatggagaaattgctcactatatacacttaaatttaaaaaaaaaaa

SEQ ID NO: 296008 - DNA, 2924 bp, Homo sapiens
actgctcttccggacgcaattttgaggaggtcggagcggaaggacgtcgtggagattgcttgcgctggggtgccacacttaggctgagctgcaggttttcgcacagtcgcgagttaacctctgcttgctccagaggcctcgtcctaatccacctcggctgacggcgcgggatccctggctccgcgagcctcagcctcaccatgtgtgtcaggagctgtttccagtccccccgtctccagtgggtgtggagaacagccttcctgaaacacacccagcgcaggcaccaggggtcccaccgatggacacaccttggaggcagcacctacagagcggtgattttcgacatgggcggagttctcattccttctccagggagagtcgctgcagaatgggaggtacagaatcgtatcccttctggaactatattaaaggccttgatggaaggtggtgaaaatgggccctggatgagatttatgagagcagaaataacagcagagggttttttacgagaatttgggagactttgctctgaaatgttaaagacctccgtgcctgtggactcatttttctctctgttgaccagtgagcgagtggcaaagcagttcccagtgatgactgaggccataactcaaattcgggcaaaaggtcttcagactgcagtcttgagcaataatttttatcttcccaaccagaaaagctttttgcccctggaccggaaacagtttgatgtgattgtggagtcctgcatggaagggatctgtaagccagaccctaggatctacaagctgtgcttggagcagctcggcctgcagccctctgagtccatctttcttgatgaccttggaacaaatctaaaagaagctgccagacttggtattcacaccattaaggttaatgacccagagactgcagtaaaggaattagaagctctcttgggttttacattgagagtaggtgttccaaacactcggcctgtgaaaaagacgatggaaattccgaaagattccttgcagaagtacctcaaagacttactgggtatccagaccacaggcccattggaactacttcagtttgatcacgggcagtcaaatccaacttactacatcaggctggctaatcgtgatctagttctgaggaagaagcccccagggacactccttccatctgcccatgccatagagagggagttcaggattatgaaagcccttgcaaatgctggagtacctgtccctaacgttcttgatctctgtgaagattcaagtgtcattggcacccccttctatgtgatggagtactgcccaggtctcatctacaaagacccttccctgccaggcttggagcccagccacagacgagccatatacactgccatgaacacagtcctgtgcaaaattcacagtgtggatctgcaggctgtgggacttgaagactatgggaagcaaggggactatattccacgccaggtacgaacctgggttaagcagtatcgagcttccgaaactagcaccatcccagccatggagaggctgatcgaatggctgcccctccatcttccccgtcagcagaggaccacagtggtgcacggggacttcagatcacgccactgcactccagcctgcgcaacaaagtgagaccccgtctccaaaaaaataataaaaaaaagaaggaaaaagaataaataaaacaagaaaaaaaaaggaatacttagaaccttttctgatgccttgtgactttcagaatttaaaatcccccttgcagataaggccacccacggcggaaggccgggagcgagacggggctgaggggaccttgctcccattggagctgcagggcaggaaggggtgctgcggtcagcagagggcacccttcgcctgcgccgtgtgcagtgcctgcagtcactccctcattcccaggagtagccttgggtcagatgctggctcagatctataactgctcctgtctggtagccaggcctgcccagatgtgcaatggctggaataaagggttcttggaagcaatttgttacaggcaccctgtgggctgtggctggctgtggcacacgtgaaggttgtgtgtcagacctactccctggacatggcgcatggctgcacacaggcaccttggctgagaagatgcacagtcctggtttcactctcctcccctgccctgtcctgtctgcttccacccagctctgcaggccaccagcccccgcctctcgtggccacccccagcccagcatgtcctcagccgcacatctcctgtgtcgacaggtgaagtcccgcttggcttttgggaagcccctggtggagcagggcacagtgctggcggacatcgcacagtcgcgcgtggagattgagcaggcacggctgctggtgctgagagctgcccacctcatggacctggcaggaaacaaggctgcagccttggatatagccatgattaaaatggtcgccccgtccatggcctcccgagtgattgatcgtgcgattcaggtgagcacagaccagacagttggcttatttgaaccatcaatactagatgccaaactctcctatcttcagccgcccagcctcccatagaccctggcagatgccctgtgtcacccactcaccatgcatgcaactttccttttcctcttcagaatgacccagcaaggtgggaggtgccatcgtacccccattttgaatgtgaggaaacaggcacagaaaagtgaagtgacttgtccaggtcactgagcttgcaagtagctgacctcaaattcacatgaacttgggttttcataagcccagagcccaggctctttcccatgcaggggggccgcctccttagatcctaacccccggccccagcacagggcagaaggcacctgcagagtgggcctggggagtctggaggccgtgggatggcaggtgtggccccatgga

SEQ ID NO: 296009 - DNA, 2066 bp, Homo sapiens
actgctcttccggacgcaattttgaggaggtcggagcggaaggacgtcgtggagattgcttgcgctggggtgccacacttaggctgagctgcaggttttcgcacagtcgcgagttaacctctgcttgctccagaggcctcgtcctaatccacctcggctgacggcgcgggatccctggctccgcgagcctcagcctcaccatgtgtgtcaggagctgtttccagtccccccgtctccagtgggtgtggagaacagccttcctgaaacacacccagcgcaggcaccaggggtcccaccgatggacacaccttggaggcagcacctacagagcggtgattttcgacatgggcggagttctcattccttctccagggagagtcgctgcagaatgggaggtacagaatcgtatcccttctggaactatattaaaggccttgatggaaggtggtgaaaatgggccctggatgagatttatgagagcagaaataacagcagagggttttttacgagaatttgggagactttgctctgaaatgttaaagacctccgtgcctgtggactcatttttctctctgttgaccagtgagcgagtggcaaagcagttcccagtgatgactgaggccataactcaaattcgggcaaaaggtcttcagactgcagtcttgagcaataatttttatcttcccaaccagaaaagctttttgcccctggaccggaaacagtttgatgtgattgtggagtcctgcatggaagggatctgtaagccagaccctaggatctacaagctgtgcttggagcagctcggcctgcagccctctgagtccatctttcttgatgaccttggaacaaatctaaaagaagctgccagacttggtattcacaccattaaggttaatgacccagagactgcagtaaaggaattagaagctctcttgggttttacattgagagtaggtgttccaaacactcggcctgtgaaaaagacgatggaaattccgaaagattccttgcagaagtacctcaaagacttactgggtatccagaccacaggcccattggaactacttcagtttgatcacgggcagtcaaatccaacttactacatcaggctggctaatcgtgatctagttctgaggaagaagcccccagggacactccttccatctgcccatgccatagagagggagttcaggattatgaaagcccttgcaaatgctggagtacctgtccctaacgttcttgatctctgtgaagattcaagtgtcattggcacccccttctatgtgatggagtactgcccaggtctcatctacaaagacccttccctgccaggcttggagcccagccacagacgagccatatacactgccatgaacacagtcctgtgcaaaattcacagtgtggatctgcaggctgtgggacttgaagactatgggaagcaaggggactatattccacgccaggtacgaacctgggttaagcagtatcgagcttccgaaactagcaccatcccagccatggagaggctgatcgaatggctgcccctccatcttccccgtcagcagaggaccacagtggtgcacggggacttcagatcacgccactgcactccagcctgcgcaacaaagtgagaccccgtctccaaaaaaataataaaaaaaagttgcatgattttaaaacgcaacaaattgtctccatttcttggagacaagttttctctttcctccttcacattcccccctcagaaaaccaggtgccttgtgtgctttagaggacacttttgggccaggagtggtggctcatgcctgtaatcccagcattttgggaggccgagatgggcagatcacttgaggtcaggagttcgagaccagcctggtcaacatggtgaaaccccatctctactaaaaatgcaaaaattggccaggctggtggcatgtgtctgtggtcccagctgcttgggaggctgagacaagagttgcctgaacccgggaggtggaggttgcagtgagctgagatcgcgccactgtactccagcctgggcaacagagcaagactctgtctcaaaa

SEQ ID NO: 296010 - DNA, 1486 bp, Homo sapiens
actgctcttccggacgcaattttgaggaggtcggagcggaaggacgtcgtggagattgcttgcgctggggtgccacacttaggctgagctgcaggttttcgcacagtcgcgagttaacctctgcttgctccagaggcctcgtcctaatccacctcggctgacggcgcgggatccctggctccgcgagcctcagcctcaccatgtgtgtcaggagctgtttccagtccccccgtctccagtgggtgtggagaacagccttcctgaaacacacccagcgcaggcaccaggggtcccaccgatggacacaccttggaggcagcacctacagagcggtgattttcgacatgggcggagttctcattccttctccagggagagtcgctgcagaatgggaggtacagaatcgtatcccttctggaactatattaaaggccttgatggaaggtggtgaaaatgggccctggatgagatttatgagagcagaaataacagcagagggttttttacgagaatttgggagactttgctctgaaatgttaaagacctccgtgcctgtggactcatttttctctctgttgaccagtgagcgagtggcaaagcagttcccagtgatgactgaggccataactcaaattcgggcaaaaggtcttcagactgcagtcttgagcaataatttttatcttcccaaccagaaaagctttttgcccctggaccggaaacagtttgatgtgattgtggagtcctgcatggaagggatctgtaagccagaccctaggatctacaagctgtgcttggagcagctcggcctgcagccctctgagtccatctttcttgatgaccttggaacaaatctaaaagaagctgccagacttggtattcacaccattaaggttaatgacccagagactgcagtaaaggaattagaagctctcttgggttttacattgagagtaggtgttccaaacactcggcctgtgaaaaagacgatggaaattccgaaagattccttgcagaagtacctcaaagacttactgggtatccagaccacaggcccattggaactacttcagtttgatcacgggcagtcaaatccaacttactacatcaggctggctaatcgtgatctagttctgaggaagaagcccccagggacactccttccatctgcccatgccatagagagggagttcaggattatgaaagcccttgcaaatgctggagtacctgtccctaacgttcttgatctctgtgaagattcaaggtaaagttcagatgtttttgctattgcactttcaagctacaggagagaaaagcccatatgctaacacaaattccaatttgttaaagacaaataaaatttgggtaggagggaaaagaaactttatcacaacctctcccagaagttctcagatatttaagttatcctgcaagataagtatatgcctgctttagggataattggtagaaaacatcttttttaacattc

SEQ ID NO: 296011 - DNA, 382 bp, Homo sapiens
ctcatctacaaagacccttccctgccaggcttggagcccagccacagacgagccatatacactgccatgaacacagtcctgtgcaaaattcacagtgtggatctgcaggctgtgggacttgaagactatgggaagcaaggtgagcaggaggccacgtctcccatgctggttgtttcatcactagtgcttctgcttttaggatctgaatcgttttgggtcgttttgagtattagcacaccaagcgtaaggcagacttagcttcttccttggaaatccagtttagttttaatggaggtgttgctgacttaggcatttgggccttcaataaatccctttatgaactacacagtctttcttccctgcaacttttttttttcatttt

SEQ ID NO: 296012 - DNA, 637 bp, Homo sapiens
ccttatatgagagttcagcacaggggctgaggaacacagttcctgcaggcagcaagctatgagcctgggctcttgtagcagagagcagaaggacgccaggaataagcattttttttttctgttggccatgagtgtttgtcactcttaatgattgctgttctcctgtgccctctcctgttcttagttaaagacctccgtgcctgtggactcatttttctctctgttgaccagtgagcgagtggcaaagcagttcccagtgatgactgaggccataactcaaattcgggcaaaaggtcttcagactgcagtcttgagcaataatttttatcttcccaaccagaaaagctttttgcccctggaccggaaacagtttgatgtggtaagcttgagctaattgaaaaccattggaacagaatctgtgccctcgcttcagggtgcaatgttaaatgctatcttccagcaggtcttgagtgagggagtttttccttcagccacttgactaagttaggtttaaatgcaatatgttgaaaacagaccctttaagatatcactgtgttcttagcaaggtcagacatttatggcatttgattactggttgacacttcagctttacattctaaattcgaaccttagtctt

SEQ ID NO: 296013 - DNA, 3316 bp, Homo sapiens
gtttttgtgttgctagccggggccagcggcggtggcggcggcggcggaggcgtcggtggaggaggggaggcggcgaggaggcgcagctcccgctgcaccgcgatcgacgctgcggagcgagcccacccgccccgggagctcgcctccccggtgctcccccgccctccccgcccccccagcggcgctgcctcctccaaatgagcgattcgcccgctggatctaacccaaggacacccgaaagcagcggcagcggcagcggcggcggcgggaagaggccggcggtgccggcagcggtgtccctcttgccaccggcggaccccctgcgccaggcgaaccggctcccgatcagggtcctgaagatgctgagcgctcacaccggtcacctcctgcacccggagtacctgcagccgctgtcctccactcccgtcagccccattgagctggacgccaagaagagccccttggcgctgctggctcagacctgctcgcagatcggcaagccggacccgccgccctcctccaaactcaactcggtggcggcggcggccaacgggctgggagcggagaaggaccccggccgctcagccccgggcgccgcctccgcagccgcggccctgaagcagctgggggactcaccggccgaggacaagtccagcttcaagccctactccaagggctccggcggcggcgactcccgcaaagacagcggctcctcctcggtgtcttccacctcctcctcgtcctcctcgtccccgggagacaaggcgggcttcagggtccccagcgccgcctgcccgccctttcccccgcatggagcgccggtctccgcatcctcgtcctcgtcgtcgcccggcggctcccgcggcggctccccgcaccactctgactgcaagaacggcggcggggttggcggcggggagctggacaagaaagaccaggagcccaagcccagcccggagccggcagccgtgagccgcggcggcggtggggagcccggggcgcacggtggcgccgagtccggggcctccgggcgcaagtccgagccgccctcggcgctggtgggggccggccacgtggcgccggtgtctccctacaagccgggccactcggtgttcccgctgccgccctccagcattggctaccacggctccatcgtgggcgcctacgccggctacccgtctcagttcgtgcctggcctggatcctagcaagtccggcctcgtgggaggccagctgtctgggggcctgggcctgccgccgggcaagccccccagctccagcccgctcaccggggcctccccgccctccttcctgcagggattatgccgcgacccctattgcttgggaggttaccacggcgcctcgcacctcggcggctccagctgctccacctgcagcgcgcacgaccctgccgggcccagcctgaaggcggggggctacccgctggtgtaccccgggcacccgctgcagcccgccgcgctctcgtccagcgccgcccaggccgcgctccccggccacccgctctacacctacggcttcatgctgcagaacgaaccgctgccgcacagctgcaactgggtggcagccagtgggccgtgcgacaagcgcttcgccacctcggaggagctgctcagccacctacggacccacacggccctgccgggagccgagaaacttctggccgcctaccccggggcctcgggcctgggcagcgccgccgccgccgccgccgccgccgcctcctgccatctgcacctccccccgcccgccgccccggcagccccgggtcgctgtccttgcggaatccacacactttgggcctaagccggtaccacccctatggcaagagccacttatccacagcggggggcctggccgtgccgtccctccccacagccggaccctactattcgccatacgcgctgtatggacagagactagcttcagcctcggcgctgggataccagtaactacagctcttcctccaccccagccccctcaccctcctccctctccctcctcctccctccccacctgccgtcgccgctgcaacctccactactgcttgaccctgccgggattccccacccagcccttccccaccggactgtgtatttatttactataatgttagcttacaagctgggaatataagtgcattaacggcccacatgagtcaatggtatgcaaaaagtctgtgttctcccaaataataatattaatcccacaaataacgacatgatccccgcccctgttcctttctgttattttttcttagatataagttttacattttttattccttttcctctttttttggttttgattggtttggtttgagggagagttggggtctttgggttcttctagacgttttgttttcccttcctggggagtttcttgcatgagtcttaacttaaaactacgtttccgccttctctttttccctcttcccccttcattccctcttgtttccttccatttgcggttctgtttttgttttttgttttgttttgttttgttttttcctttgttgtacaagtaacagagaggaggttttttttgtaactcattttgggggtggagggggccacctgggtggcaggggccctggagctctattgacctggtacactgctccgggactcctcccccgccaccctccgcgcatagggtccttggtctggaccctgccccccaaaagtagggccttgctcctctaccttgctctgagcacggagagccctgaccccaccagtaggctcgcccccagaagggcccaagtggccgtctaccgtcaccttccagactcccgcccctaacacccagtggctacagtgcgcctgtcggggcacctggagcgctcacctggttgaattcaaagtcccagaaggccccgctggcgtgaagccggccccttacattttgcgaagtgcattatagtccttgtttttctctccctcgtgggggcaacgacccctcccctggcagtaggggtggggtaggtgactctcgctagatccctccaaagcagaccggtggcgatgtcagcggatgtcacgagctcgttagctgcgttcggggaaggttggggcgtcagggagctctcggatcacagcagcccccgccctctcctaggcctggcccggcagagcccccagagtggaccccccagcgactggggtcttctccccactcctccctccttctggtctgatgcggcagcgcgggggctgcggggcctgtttgggacgaacagagctctcccttggtaagacttattttgttaataaatggaatacttggctataatcaaa

SEQ ID NO: 296014 - DNA, 3695 bp, Homo sapiens
gtttttgtgttgctagccggggccagcggcggtggcggcggcggcggaggcgtcggtggaggaggggaggcggcgaggaggcgcagctcccgctgcaccgcgatcgacgctgcggagcgagcccacccgccccgggagctcgcctccccggtgctcccccgccctccccgcccccccagcggcgctgcctcctccaaatgagcgattcgcccgctggatctaacccaaggacacccgaaagcagcggcagcggcagcggcggcggcgggaagaggccggcggtgccggcagcggtgtccctcttgccaccggcggaccccctgcgccaggcgaaccggctcccgatcagggtcctgaagatgctgagcgctcacaccggtcacctcctgcacccggagtacctgcagccgctgtcctccactcccgtcagccccattgagctggacgccaagaagagccccttggcgctgctggctcagacctgctcgcagatcggcaagccggacccgccgccctcctccaaactcaactcggtggcggcggcggccaacgggctgggagcggagaaggaccccggccgctcagccccgggcgccgcctccgcagccgcggccctgaagcagctgggggactcaccggccgaggacaagtccagcttcaagccctactccaagggctccggcggcggcgactcccgcaaagacagcggctcctcctcggtgtcttccacctcctcctcgtcctcctcgtccccgggagacaaggcgggcttcagggtccccagcgccgcctgcccgccctttcccccgcatggagcgccggtctccgcatcctcgtcctcgtcgtcgcccggcggctcccgcggcggctccccgcaccactctgactgcaagaacggcggcggggttggcggcggggagctggacaagaaagaccaggagcccaagcccagcccggagccggcagccgtgagccgcggcggcggtggggagcccggggcgcacggtggcgccgagtccggggcctccgggcgcaagtccgagccgccctcggcgctggtgggggccggccacgtggcgccggtgtctccctacaagccgggccactcggtgttcccgctgccgccctccagcattggctaccacggctccatcgtgggcgcctacgccggctacccgtctcagttcgtgcctggcctggatcctagcaagtccggcctcgtgggaggccagctgtctgggggcctgggcctgccgccgggcaagccccccagctccagcccgctcaccggggcctccccgccctccttcctgcagggattatgccgcgacccctattgcttgggaggttaccacggcgcctcgcacctcggcggctccagctgctccacctgcagcgcgcacgaccctgccgggcccagcctgaaggcggggggctacccgctggtgtaccccgggcacccgctgcagcccgccgcgctctcgtccagcgccgcccaggccgcgctccccggccacccgctctacacctacggcttcatgctgcagaacgaaccgctgccgcacagctgcaactgggtggcagccagtgggccgtgcgacaagcgcttcgccacctcggaggagctgctcagccacctacggacccacacggccctgccgggagccgagaaacttctggccgcctaccccggggcctcgggcctgggcagcgccgccgccgccgccgccgccgccgcctcctgccatctgcacctccccccgcccgccgccccggcagccccgggtcgctgtccttgcggaatccacacactttgggcctaagccggtaccacccctatggcaagagccacttatccacagcggggggcctggccgtgccgtccctccccacagccggaccctactattcgccatacgcgctgtatggacagagactagcttcagcctcggcgctgggataccagtaactacagctcttcctccaccccagccccctcaccctcctccctctccctcctcctccctccccacctgccgtcgccgctgcaacctccactactgcttgaccctgccgggattccccacccagcccttccccaccggactgtgtatttatttactataatgttagcttacaagctgggaatataagtgcattaacggcccacatgagtcaatggtatgcaaaaagtctgtgttctcccaaataataatattaatcccacaaataacgacatgatccccgcccctgttcctttctgttattttttcttagatataagttttacattttttattccttttcctctttttttggttttgattggtttggtttgagggagagttggggtctttgggttcttctagacgttttgttttcccttcctggggagtttcttgcatgagtcttaacttaaaactacgtttccgccttctctttttccctcttcccccttcattccctcttgtttccttccatttgcggttctgtttttgttttttgttttgttttgttttgttttttcctttgttgtacaagtaacagagaggaggttttttttgtaactcattttgggggtggagggggccacctgggtggcaggggccctggagctctattgacctggtacactgctccgggactcctcccccgccaccctccgcgcatagggtccttggtctggaccctgccccccaaaagtagggccttgctcctctaccttgctctgagcacggagagccctgaccccaccagtaggctcgcccccagaagggcccaagtggccgtctaccgtcaccttccagactcccgcccctaacacccagtggctacagtgcgcctgtcggggcacctggagcgctcacctggttgaattcaaagtcccagaaggccccgctggcgtgaagccggccccttacattttgcgaagtgcattatagtccttgtttttctctccctcgtgggggcaacgacccctcccctggcagtaggggtggggtaggtgactctcgctagatccctccaaagcagaccggtggcgatgtcagcggatgtcacgagctcgttagctgcgttcggggaaggttggggcgtcagggagctctcggatcacagcagcccccgccctctcctaggcctggcccggcagagcccccagagtggaccccccagcgactggggtcttctccccactcctccctccttctggtctgatgcggcagcgcgggggctgcggggcctgtttgggacgaacagagctctcccttggtaagacttattttgttaataaatggaatacttggctataatcaaaaaaaaaaaaaagcaaaacacaacaagagagacacaacaacaagagaaaaacgaagcaaagaaagacacaagaagcaaacgccaacaggcacagcggacgaggcacagaacgcaaggaagcgaaaggagaaagagcacacagcgcgcgcgagcgaggggggagaggagggggcaccaagagggagcacgccccgcggcgaagcgagagcgagaagacggcaggaacgtcgctcgcggcagccagggcagccaccgagagacagagcagcggcaaagagaagaagggggtgaggggcgcggcagacagccagagggtcggaagcgagcgccacacgcacgagggggcggcgcggcgagggaagagaacgaggcaggagaac

SEQ ID NO: 296015 - DNA, 2958 bp, Homo sapiens
gccagaaacccgtcccaagcgaagttcccccaaactaaaggaataagttttttcctgggcctggaggagggggacattagagctggacgccaagaagagccccttggcgctgctggctcagacctgctcgcagatcggcaagccggacccgccgccctcctccaaactcaactcggtggcggcggcggccaacgggctgggagcggagaaggaccccggccgctcagccccgggcgccgcctccgcagccgcggccctgaagcagctgggggactcaccggccgaggacaagtccagcttcaagccctactccaagggctccggcggcggcgactcccgcaaagacagcggctcctcctcggtgtcttccacctcctcctcgtcctcctcgtccccgggagacaaggcgggcttcagggtccccagcgccgcctgcccgccctttcccccgcatggagcgccggtctccgcatcctcgtcctcgtcgtcgcccggcggctcccgcggcggctccccgcaccactctgactgcaagaacggcggcggggttggcggcggggagctggacaagaaagaccaggagcccaagcccagcccggagccggcagccgtgagccgcggcggcggtggggagcccggggcgcacggtggcgccgagtccggggcctccgggcgcaagtccgagccgccctcggcgctggtgggggccggccacgtggcgccggtgtctccctacaagccgggccactcggtgttcccgctgccgccctccagcattggctaccacggctccatcgtgggcgcctacgccggctacccgtctcagttcgtgcctggcctggatcctagcaagtccggcctcgtgggaggccagctgtctgggggcctgggcctgccgccgggcaagccccccagctccagcccgctcaccggggcctccccgccctccttcctgcagggattatgccgcgacccctattgcttgggaggttaccacggcgcctcgcacctcggcggctccagctgctccacctgcagcgcgcacgaccctgccgggcccagcctgaaggcggggggctacccgctggtgtaccccgggcacccgctgcagcccgccgcgctctcgtccagcgccgcccaggccgcgctccccggccacccgctctacacctacggcttcatgctgcagaacgaaccgctgccgcacagctgcaactgggtggcagccagtgggccgtgcgacaagcgcttcgccacctcggaggagctgctcagccacctacggacccacacggccctgccgggagccgagaaacttctggccgcctaccccggggcctcgggcctgggcagcgccgccgccgccgccgccgccgccgcctcctgccatctgcacctccccccgcccgccgccccggcagccccgggtcgctgtccttgcggaatccacacactttgggcctaagccggtaccacccctatggcaagagccacttatccacagcggggggcctggccgtgccgtccctccccacagccggaccctactattcgccatacgcgctgtatggacagagactagcttcagcctcggcgctgggataccagtaactacagctcttcctccaccccagccccctcaccctcctccctctccctcctcctccctccccacctgccgtcgccgctgcaacctccactactgcttgaccctgccgggattccccacccagcccttccccaccggactgtgtatttatttactataatgttagcttacaagctgggaatataagtgcattaacggcccacatgagtcaatggtatgcaaaaagtctgtgttctcccaaataataatattaatcccacaaataacgacatgatccccgcccctgttcctttctgttattttttcttagatataagttttacattttttattccttttcctctttttttggttttgattggtttggtttgagggagagttggggtctttgggttcttctagacgttttgttttcccttcctggggagtttcttgcatgagtcttaacttaaaactacgtttccgccttctctttttccctcttcccccttcattccctcttgtttccttccatttgcggttctgtttttgttttttgttttgttttgttttgttttttcctttgttgtacaagtaacagagaggaggttttttttgtaactcattttgggggtggagggggccacctgggtggcaggggccctggagctctattgacctggtacactgctccgggactcctcccccgccaccctccgcgcatagggtccttggtctggaccctgccccccaaaagtagggccttgctcctctaccttgctctgagcacggagagccctgaccccaccagtaggctcgcccccagaagggcccaagtggccgtctaccgtcaccttccagactcccgcccctaacacccagtggctacagtgcgcctgtcggggcacctggagcgctcacctggttgaattcaaagtcccagaaggccccgctggcgtgaagccggccccttacattttgcgaagtgcattatagtccttgtttttctctccctcgtgggggcaacgacccctcccctggcagtaggggtggggtaggtgactctcgctagatccctccaaagcagaccggtggcgatgtcagcggatgtcacgagctcgttagctgcgttcggggaaggttggggcgtcagggagctctcggatcacagcagcccccgccctctcctaggcctggcccggcagagcccccagagtggaccccccagcgactggggtcttctccccactcctccctccttctggtctgatgcggcagcgcgggggctgcggggcctgtttgggacgaacagagctctcccttggtaagacttattttgttaataaatggaatacttggctataatcaaa

SEQ ID NO: 296016 - DNA, 3078 bp, Homo sapiens
aggggccactgcgttcagctctggcggtccacagcccgaagcgcggcttaggaagttcgtgtcagcgctgcctgagctcgtcccctggatgtccgggtctccccaggcggccacccgccggctcccatcgtgacctccagccgcagcgcctcccacgccggccgccgcgcgaggggagcgctcgggcgcgccgggtgtggttgggggaaggggttgtgccgcgcgcgggctgcgtgctgtgcccactcaaaaggttccgggcgcgcaggagggaagaggcagtgcccgccactcccactgagattgagagacgcggcaaggaggcagcctgtggaggaactgggtaggatttaggaacgcaccgtgcacatgcttggtggtcttgttaagtggaaactgctgctttagagtttgtttggaaggtccgggtgactcatcccaacatttacatccttaattgttaaagcgctgcctccgagcgcacgcatcctgagatcctgagcctttggttaagaccgagctctattaagctgaaaagataaaaactctccagatgtcttccagtaatgtcgaagtttttatcccagtgtcacaaggaaacaccaatggcttccccgcgacagcttccaatgacctgaaggcatttactgaaggagctgtgttaagttttcataacatctgctatcgagtaaaactgaagagtggctttctaccttgtcgaaaaccagttgagaaagaaatattatcgaatatcaatgggatcatgaaacctggtctcaacgccatcctgggacccacaggtggaggcaaatcttcgttattagatgtcttagctgcaaggaaagatccaagtggattatctggagatgttctgataaatggagcaccgcgacctgccaatttcaaatgtaattcaggttacgtggtacaagatgatgttgtgatgggcactctgacggtgagagaaaacttacagttctcagcagctcttcggcttgcaacaactatgacgaatcatgaaaaaaacgaacggattaacagggtcattcaagagttaggtctggataaagtggcagactccaaggttggaactcagtttatccgtggtgtgtctggaggagaaagaaaaaggactagtataggaatggagcttatcactgatccttccatcttgttcttggatgagcctacaactggcttagactcaagcacagcaaatgctgtccttttgctcctgaaaaggatgtctaagcagggacgaacaatcatcttctccattcatcagcctcgatattccatcttcaagttgtttgatagcctcaccttattggcctcaggaagacttatgttccacgggcctgctcaggaggccttgggatactttgaatcagctggttatcactgtgaggcctataataaccctgcagacttcttcttggacatcattaatggagattccactgctgtggcattaaacagagaagaagactttaaagccacagagatcatagagccttccaagcaggataagccactcatagaaaaattagcggagatttatgtcaactcctccttctacaaagagacaaaagctgaattacatcaactttccgggggtgagaagaagaagaagatcacagtcttcaaggagatcagctacaccacctccttctgtcatcaactcagatgggtttccaagcgttcattcaaaaacttgctgggtaatccccaggcctctatagctcagatcattgtcacagtcgtactgggactggttataggtgccatttactttgggctaaaaaatgattctactggaatccagaacagagctggggttctcttcttcctgacgaccaaccagtgtttcagcagtgtttcagccgtggaactctttgtggtagagaagaagctcttcatacatgaatacatcagcggatactacagagtgtcatcttatttccttggaaaactgttatctgatttattacccatgaggatgttaccaagtattatatttacctgtatagtgtacttcatgttaggattgaagccaaaggcagatgccttcttcgttatgatgtttacccttatgatggtggcttattcagccagttccatggcactggccatagcagcaggtcagagtgtggtttctgtagcaacacttctcatgaccatctgttttgtgtttatgatgattttttcaggtctgttggtcaatctcacaaccattgcatcttggctgtcatggcttcagtacttcagcattccacgatatggatttacggctttgcagcataatgaatttttgggacaaaacttctgcccaggactcaatgcaacaggaaacaatccttgtaactatgcaacatgtactggcgaagaatatttggtaaagcagggcatcgatctctcaccctggggcttgtggaagaatcacgtggccttggcttgtatgattgttattttcctcacaattgcctacctgaaattgttatttcttaaaaaatattcttaaatttccccttaattcagtatgatttatcctcacataaaaaagaagcactttgattgaagtattcaatcaagtttttttgttgttttctgttcccttgccatcacactgttgcacagcagcaattgttttaaagagatacatttttagaaatcacaacaaactgaattaaacatgaaagaacccaagacatcatgtatcgcatattagttaatctcctcagacagtaaccatggggaagaaatctggtctaatttattaatctaaaaaaggagaattgaattctggaaactcctgacaagttattactgtctctggcatttgtttcctcatctttaaaatgaataggtaggttagtagcccttcagtcttaatactttatgatgctatggtttgccattatttaataaatgacaaatgtattaatgctatactggaaatgtaaaattgaaaatatgttggaaaaaagattctgtcttatagggtaaaaaaagccaccggtgatagaaaaaaaatctttttgataagcacattaaagttaatagaacttaaaaatattc

SEQ ID NO: 296017 - DNA, 3067 bp, Homo sapiens
aggggccactgcgttcagctctggcggtccacagcccgaagcgcggcttaggaagttcgtgtcagcgctgcctgagctcgtcccctggatgtccgggtctccccaggcggccacccgccggctcccatcgtgacctccagccgcagcgcctcccacgccggccgccgcgcgaggggagcgctcgggcgcgccgggtgtggttgggggaaggggttgtgccgcgcgcgggctgcgtgctgtgcccactcaaaaggttccgggcgcgcaggagggaagaggcagtgcccgccactcccactgagattgagagacgcggcaaggaggcagcctgtggaggaactgggtaggatttaggaacgcaccgtgcacatgcttggtggtcttgttaagtggaaactgctgctttagagtttgtttggaaggtccgggtgactcatcccaacatttacatccttaattgttaaagcgctgcctccgagcgcacgcatcctgagatcctgagcctttggttaagaccgagctctattaagctgaaaagataaaaactctccagatgtcttccagtaatgtcgaagtttttatcccagtgtcacaaggaaacaccaatggcttccccgcgacagcttccaatgacctgaaggcatttactgaaggagctgtgttaagttttcataacatctgctatcgagtaaaactgaagagtggctttctaccttgtcgaaaaccagttgagaaagaaatattatcgaatatcaatgggatcatgaaacctggtctcaacgccatcctgggacccacaggtggaggcaaatcttcgttattagatgtcttagctgcaaggaaagatccaagtggattatctggagatgttctgataaatggagcaccgcgacctgccaatttcaaatgtaattcaggttacgtggtacaagatgatgttgtgatgggcactctgacggtgagagaaaacttacagttctcagcagctcttcggcttgcaacaactatgacgaatcatgaaaaaaacgaacggattaacagggtcattcaagagttaggtctggataaagtggcagactccaaggttggaactcagtttatccgtggtgtgtctggaggagaaagaaaaaggactagtataggaatggagcttatcactgatccttccatcttgttcttggatgagcctacaactggcttagactcaagcacagcaaatgctgtccttttgctcctgaaaaggatgtctaagcagggacgaacaatcatcttctccattcatcagcctcgatattccatcttcaagttgtttgatagcctcaccttattggcctcaggaagacttatgttccacgggcctgctcaggaggccttgggatactttgaatcagctggttatcactgtgaggcctataataaccctgcagacttcttcttggacatcattaatggagattccactgctgtggcattaaacagagaagaagactttaaagccacagagatcatagagccttccaagcaggataagccactcatagaaaaattagcggagatttatgtcaactcctccttctacaaagagacaaaagctgaattacatcaactttccgggggtgagaagaagaagaagatcacagtcttcaaggagatcagctacaccacctccttctgtcatcaactcagatgggtttccaagcgttcattcaaaaacttgctgggtaatccccaggcctctatagctcagatcattgtcacagtcgtactgggactggttataggtgccatttactttgggctaaaaaatgattctactggaatccagaacagagctggggttctcttcttcctgacgaccaaccagtgtttcagcagtgtttcagccgtggaactctttgtggtagagaagaagctcttcatacatgaatacatcagcggatactacagagtgtcatcttatttccttggaaaactgttatctgatttattacccatgaggatgttaccaagtattatatttacctgtatagtgtacttcatgttaggattgaagccaaaggcagatgccttcttcgttatgatgtttacccttatgatggtggcttattcagccagttccatggcactggccatagcagcaggtcagagtgtggtttctgtagcaacacttctcatgaccatctgttttgtgtttatgatgattttttcaggtctgttggtcaatctcacaaccattgcatcttggctgtcatggcttcagtacttcagcattccacgatatggatttacggctttgcagcataatgaatttttgggacaaaacttctgcccaggactcaatgcaacaggaaacaatccttgtaactatgcaacatgtactggcgaagaatatttggtaaagcagggcatcgatctctcaccctggggcttgtggaagaatcacgtggccttggcttgtatgattgttattttcctcacaattgcctacctgaaattgttatttcttaaaaaatattcttaaatttccccttaattcagtatgatttatcctcacataaaaaagaagcactttgattgaagtattcaatcaagtttttttgttgttttctgttcccttgccatcacactgttgcacagcagcaattgttttaaagagatacatttttagaaatcacaacaaactgaattaaacatgaaagaacccaagacatcatgtatcgcatattagttaatctcctcagacagtaaccatggggaagaaatctggtctaatttattaatctaaaaaaggagaattgaattctggaaactcctgacaagttattactgtctctggcatttgtttcctcatctttaaaatgaataggtaggttagtagcccttcagtcttaatactttatgatgctatggtttgccattatttaataaatgacaaatgtattaatgctatactggaaatgtaaaattgaaaatatgttggaaaaaagattctgtcttatagggtaaaaaaagccaccggtgatagaaagtataatatctcaggaatcttggctgagggtttggaact

SEQ ID NO: 296018 - DNA, 2592 bp, Homo sapiens
aggggccactgcgttcagctctggcggtccacagcccgaagcgcggcttaggaagttcgtgtcagcgctgcctgagctcgtcccctggatgtccgggtctccccaggcggccacccgccggctcccatcgtgacctccagccgcagcgcctcccacgccggccgccgcgcgaggggagcgctcgggcgcgccgggtgtggttgggggaaggggttgtgccgcgcgcgggctgcgtgctgtgcccactcaaaaggttccgggcgcgcaggagggaagaggcagtgcccgccactcccactgagattgagagacgcggcaaggaggcagcctgtggaggaactgggtaggatttaggaacgcaccgtgcacatgcttggtggtcttgttaagtggaaactgctgctttagagtttgtttggaaggtccgggtgactcatcccaacatttacatccttaattgttaaagcgctgcctccgagcgcacgcatcctgagatcctgagcctttggttaagaccgagctctattaagctgaaaagataaaaactctccagatgtcttccagtaatgtcgaagtttttatcccagtgtcacaaggaaacaccaatggcttccccgcgacagcttccaatgacctgaaggcatttactgaaggagctgtgttaagttttcataacatctgctatcgagtaaaactgaagagtggctttctaccttgtcgaaaaccagttgagaaagaaatattatcgaatatcaatgggatcatgaaacctggtctcaacgccatcctgggacccacaggtggaggcaaatcttcgttattagatgtcttagctgcaaggaaagatccaagtggattatctggagatgttctgataaatggagcaccgcgacctgccaatttcaaatgtaattcaggttacgtggtacaagatgatgttgtgatgggcactctgacggtgagagaaaacttacagttctcagcagctcttcggcttgcaacaactatgacgaatcatgaaaaaaacgaacggattaacagggtcattcaagagttaggtctggataaagtggcagactccaaggttggaactcagtttatccgtggtgtgtctggaggagaaagaaaaaggactagtataggaatggagcttatcactgatccttccatcttgttcttggatgagcctacaactggcttagactcaagcacagcaaatgctgtccttttgctcctgaaaaggatgtctaagcagggacgaacaatcatcttctccattcatcagcctcgatattccatcttcaagttgtttgatagcctcaccttattggcctcaggaagacttatgttccacgggcctgctcaggaggccttgggatactttgaatcagctggttatcactgtgaggcctataataaccctgcagacttcttcttggacatcattaatggagattccactgctgtggcattaaacagagaagaagactttaaagccacagagatcatagagccttccaagcaggataagccactcatagaaaaattagcggagatttatgtcaactcctccttctacaaagagacaaaagctgaattacatcaactttccgggggtgagaagaagaagaagatcacagtcttcaaggagatcagctacaccacctccttctgtcatcaactcagatgggtttccaagcgttcattcaaaaacttgctgggtaatccccaggcctctatagctcagatcattgtcacagtcgtactgggactggttataggtgccatttactttgggctaaaaaatgattctactggaatccagaacagagctggggttctcttcttcctgacgaccaaccagtgtttcagcagtgtttcagccgtggaactctttgtggtagagaagaagctcttcatacatgaatacatcagcggatactacagagtgtcatcttatttccttggaaaactgttatctgatttattacccatgaggatgttaccaagtattatatttacctgtatagtgtacttcatgttaggattgaagccaaaggcagatgccttcttcgttatgatgtttacccttatgatggtggcttattcagccagttccatggcactggccatagcagcaggtcagagtgtggtttctgtagcaacacttctcatgaccatctgttttgtgtttatgatgattttttcaggtctgttggtcaatctcacaaccattgcatcttggctgtcatggcttcagtacttcagcattccacgatatggatttacggctttgcagcataatgaatttttgggacaaaacttctgcccaggactcaatgcaacaggaaacaatccttgtaactatgcaacatgtactggcgaagaatatttggtaaagcagggcatcgatctctcaccctggggcttgtggaagaatcacgtggccttggcttgtatgattgttattttcctcacaattgcctacctgaaattgttatttcttaaaaaatattcttaaatttccccttaattcagtatgatttatcctcacataaaaaagaagcactttgattgaagtattcaatcaag

SEQ ID NO: 296019 - DNA, 2781 bp, Homo sapiens
cgcggataatgttagtcacagagtataagtttcagtcagacaggaggaagaagttttagtcatctcgtgcacatgcttggtggtcttgttaagtggaaactgctgctttagagtttgtttggaaggtccgggtgactcatcccaacatttacatccttaattgttaaagcgctgcctccgagcgcacgcatcctgagatcctgagcctttggttaagaccgagctctattaagctgaaaagataaaaactctccagatgtcttccagtaatgtcgaagtttttatcccagtgtcacaaggaaacaccaatggcttccccgcgacagcttccaatgacctgaaggcatttactgaaggagctgtgttaagttttcataacatctgctatcgagtaaaactgaagagtggctttctaccttgtcgaaaaccagttgagaaagaaatattatcgaatatcaatgggatcatgaaacctggtctcaacgccatcctgggacccacaggtggaggcaaatcttcgttattagatgtcttagctgcaaggaaagatccaagtggattatctggagatgttctgataaatggagcaccgcgacctgccaatttcaaatgtaattcaggttacgtggtacaagatgatgttgtgatgggcactctgacggtgagagaaaacttacagttctcagcagctcttcggcttgcaacaactatgacgaatcatgaaaaaaacgaacggattaacagggtcattcaagagttaggtctggataaagtggcagactccaaggttggaactcagtttatccgtggtgtgtctggaggagaaagaaaaaggactagtataggaatggagcttatcactgatccttccatcttgttcttggatgagcctacaactggcttagactcaagcacagcaaatgctgtccttttgctcctgaaaaggatgtctaagcagggacgaacaatcatcttctccattcatcagcctcgatattccatcttcaagttgtttgatagcctcaccttattggcctcaggaagacttatgttccacgggcctgctcaggaggccttgggatactttgaatcagctggttatcactgtgaggcctataataaccctgcagacttcttcttggacatcattaatggagattccactgctgtggcattaaacagagaagaagactttaaagccacagagatcatagagccttccaagcaggataagccactcatagaaaaattagcggagatttatgtcaactcctccttctacaaagagacaaaagctgaattacatcaactttccgggggtgagaagaagaagaagatcacagtcttcaaggagatcagctacaccacctccttctgtcatcaactcagatgggtttccaagcgttcattcaaaaacttgctgggtaatccccaggcctctatagctcagatcattgtcacagtcgtactgggactggttataggtgccatttactttgggctaaaaaatgattctactggaatccagaacagagctggggttctcttcttcctgacgaccaaccagtgtttcagcagtgtttcagccgtggaactctttgtggtagagaagaagctcttcatacatgaatacatcagcggatactacagagtgtcatcttatttccttggaaaactgttatctgatttattacccatgaggatgttaccaagtattatatttacctgtatagtgtacttcatgttaggattgaagccaaaggcagatgccttcttcgttatgatgtttacccttatgatggtggcttattcagccagttccatggcactggccatagcagcaggtcagagtgtggtttctgtagcaacacttctcatgaccatctgttttgtgtttatgatgattttttcaggtctgttggtcaatctcacaaccattgcatcttggctgtcatggcttcagtacttcagcattccacgatatggatttacggctttgcagcataatgaatttttgggacaaaacttctgcccaggactcaatgcaacaggaaacaatccttgtaactatgcaacatgtactggcgaagaatatttggtaaagcagggcatcgatctctcaccctggggcttgtggaagaatcacgtggccttggcttgtatgattgttattttcctcacaattgcctacctgaaattgttatttcttaaaaaatattcttaaatttccccttaattcagtatgatttatcctcacataaaaaagaagcactttgattgaagtattcaatcaagtttttttgttgttttctgttcccttgccatcacactgttgcacagcagcaattgttttaaagagatacatttttagaaatcacaacaaactgaattaaacatgaaagaacccaagacatcatgtatcgcatattagttaatctcctcagacagtaaccatggggaagaaatctggtctaatttattaatctaaaaaaggagaattgaattctggaaactcctgacaagttattactgtctctggcatttgtttcctcatctttaaaatgaataggtaggttagtagcccttcagtcttaatactttatgatgctatggtttgccattatttaataaatgacaaatgtattaatgctatactggaaatgtaaaattgaaaatatgttggaaaaaagattctgtcttatagggtaaaaaaagccaccggtgatagaaaaaaaatctttttgataagcacattaaagttaatagaacttaaaaatattc

SEQ ID NO: 296020 - DNA, 2887 bp, Homo sapiens
aggggccactgcgttcagctctggcggtccacagcccgaagcgcggcttaggaagttcgtgtcagcgctgcctgagctcgtcccctggatgtccgggtctccccaggcggccacccgccggctcccatcgtgacctccagccgcagcgcctcccacgccggccgccgcgcgaggggagcgctcgggcgcgccgggtgtggttgggggaaggggttgtgccgcgcgcgggctgcgtgctgtgcccactcaaaaggttccgggcgcgcaggagggaagaggcagtgcccgccactcccactgagattgagagacgcggcaaggaggcagcctgtggaggaactggaaagataaaaactctccagatgtcttccagtaatgtcgaagtttttatcccagtgtcacaaggaaacaccaatggcttccccgcgacagcttccaatgacctgaaggcatttactgaaggagctgtgttaagttttcataacatctgctatcgagtaaaactgaagagtggctttctaccttgtcgaaaaccagttgagaaagaaatattatcgaatatcaatgggatcatgaaacctggtctcaacgccatcctgggacccacaggtggaggcaaatcttcgttattagatgtcttagctgcaaggaaagatccaagtggattatctggagatgttctgataaatggagcaccgcgacctgccaatttcaaatgtaattcaggttacgtggtacaagatgatgttgtgatgggcactctgacggtgagagaaaacttacagttctcagcagctcttcggcttgcaacaactatgacgaatcatgaaaaaaacgaacggattaacagggtcattcaagagttaggtctggataaagtggcagactccaaggttggaactcagtttatccgtggtgtgtctggaggagaaagaaaaaggactagtataggaatggagcttatcactgatccttccatcttgttcttggatgagcctacaactggcttagactcaagcacagcaaatgctgtccttttgctcctgaaaaggatgtctaagcagggacgaacaatcatcttctccattcatcagcctcgatattccatcttcaagttgtttgatagcctcaccttattggcctcaggaagacttatgttccacgggcctgctcaggaggccttgggatactttgaatcagctggttatcactgtgaggcctataataaccctgcagacttcttcttggacatcattaatggagattccactgctgtggcattaaacagagaagaagactttaaagccacagagatcatagagccttccaagcaggataagccactcatagaaaaattagcggagatttatgtcaactcctccttctacaaagagacaaaagctgaattacatcaactttccgggggtgagaagaagaagaagatcacagtcttcaaggagatcagctacaccacctccttctgtcatcaactcagatgggtttccaagcgttcattcaaaaacttgctgggtaatccccaggcctctatagctcagatcattgtcacagtcgtactgggactggttataggtgccatttactttgggctaaaaaatgattctactggaatccagaacagagctggggttctcttcttcctgacgaccaaccagtgtttcagcagtgtttcagccgtggaactctttgtggtagagaagaagctcttcatacatgaatacatcagcggatactacagagtgtcatcttatttccttggaaaactgttatctgatttattacccatgaggatgttaccaagtattatatttacctgtatagtgtacttcatgttaggattgaagccaaaggcagatgccttcttcgttatgatgtttacccttatgatggtggcttattcagccagttccatggcactggccatagcagcaggtcagagtgtggtttctgtagcaacacttctcatgaccatctgttttgtgtttatgatgattttttcaggtctgttggtcaatctcacaaccattgcatcttggctgtcatggcttcagtacttcagcattccacgatatggatttacggctttgcagcataatgaatttttgggacaaaacttctgcccaggactcaatgcaacaggaaacaatccttgtaactatgcaacatgtactggcgaagaatatttggtaaagcagggcatcgatctctcaccctggggcttgtggaagaatcacgtggccttggcttgtatgattgttattttcctcacaattgcctacctgaaattgttatttcttaaaaaatattcttaaatttccccttaattcagtatgatttatcctcacataaaaaagaagcactttgattgaagtattcaatcaagtttttttgttgttttctgttcccttgccatcacactgttgcacagcagcaattgttttaaagagatacatttttagaaatcacaacaaactgaattaaacatgaaagaacccaagacatcatgtatcgcatattagttaatctcctcagacagtaaccatggggaagaaatctggtctaatttattaatctaaaaaaggagaattgaattctggaaactcctgacaagttattactgtctctggcatttgtttcctcatctttaaaatgaataggtaggttagtagcccttcagtcttaatactttatgatgctatggtttgccattatttaataaatgacaaatgtattaatgctatactggaaatgtaaaattgaaaatatgttggaaaaaagattctgtcttatagggtaaaaaaagccaccggtgatagaaaaaaaatctttttgataagcacattaaagttaatagaacttaaaaatattc

SEQ ID NO: 296021 - DNA, 2624 bp, Homo sapiens
gggcaacctgtgcgtcagcgtccccggtgcttcggcgctccggccagtgacggcgaccaaacccagctaggtcagacgagaaagataaaaactctccagatgtcttccagtaatgtcgaagtttttatcccagtgtcacaaggaaacaccaatggcttccccgcgacagcttccaatgacctgaaggcatttactgaaggagctgtgttaagttttcataacatctgctatcgagtaaaactgaagagtggctttctaccttgtcgaaaaccagttgagaaagaaatattatcgaatatcaatgggatcatgaaacctggtctcaacgccatcctgggacccacaggtggaggcaaatcttcgttattagatgtcttagctgcaaggaaagatccaagtggattatctggagatgttctgataaatggagcaccgcgacctgccaatttcaaatgtaattcaggttacgtggtacaagatgatgttgtgatgggcactctgacggtgagagaaaacttacagttctcagcagctcttcggcttgcaacaactatgacgaatcatgaaaaaaacgaacggattaacagggtcattcaagagttaggtctggataaagtggcagactccaaggttggaactcagtttatccgtggtgtgtctggaggagaaagaaaaaggactagtataggaatggagcttatcactgatccttccatcttgttcttggatgagcctacaactggcttagactcaagcacagcaaatgctgtccttttgctcctgaaaaggatgtctaagcagggacgaacaatcatcttctccattcatcagcctcgatattccatcttcaagttgtttgatagcctcaccttattggcctcaggaagacttatgttccacgggcctgctcaggaggccttgggatactttgaatcagctggttatcactgtgaggcctataataaccctgcagacttcttcttggacatcattaatggagattccactgctgtggcattaaacagagaagaagactttaaagccacagagatcatagagccttccaagcaggataagccactcatagaaaaattagcggagatttatgtcaactcctccttctacaaagagacaaaagctgaattacatcaactttccgggggtgagaagaagaagaagatcacagtcttcaaggagatcagctacaccacctccttctgtcatcaactcagatgggtttccaagcgttcattcaaaaacttgctgggtaatccccaggcctctatagctcagatcattgtcacagtcgtactgggactggttataggtgccatttactttgggctaaaaaatgattctactggaatccagaacagagctggggttctcttcttcctgacgaccaaccagtgtttcagcagtgtttcagccgtggaactctttgtggtagagaagaagctcttcatacatgaatacatcagcggatactacagagtgtcatcttatttccttggaaaactgttatctgatttattacccatgaggatgttaccaagtattatatttacctgtatagtgtacttcatgttaggattgaagccaaaggcagatgccttcttcgttatgatgtttacccttatgatggtggcttattcagccagttccatggcactggccatagcagcaggtcagagtgtggtttctgtagcaacacttctcatgaccatctgttttgtgtttatgatgattttttcaggtctgttggtcaatctcacaaccattgcatcttggctgtcatggcttcagtacttcagcattccacgatatggatttacggctttgcagcataatgaatttttgggacaaaacttctgcccaggactcaatgcaacaggaaacaatccttgtaactatgcaacatgtactggcgaagaatatttggtaaagcagggcatcgatctctcaccctggggcttgtggaagaatcacgtggccttggcttgtatgattgttattttcctcacaattgcctacctgaaattgttatttcttaaaaaatattcttaaatttccccttaattcagtatgatttatcctcacataaaaaagaagcactttgattgaagtattcaatcaagtttttttgttgttttctgttcccttgccatcacactgttgcacagcagcaattgttttaaagagatacatttttagaaatcacaacaaactgaattaaacatgaaagaacccaagacatcatgtatcgcatattagttaatctcctcagacagtaaccatggggaagaaatctggtctaatttattaatctaaaaaaggagaattgaattctggaaactcctgacaagttattactgtctctggcatttgtttcctcatctttaaaatgaataggtaggttagtagcccttcagtcttaatactttatgatgctatggtttgccattatttaataaatgacaaatgtattaatgctatactggaaatgtaaaattgaaaatatgttggaaaaaagattctgtcttatagggtaaaaaaagccaccggtgatagaaaaaaaatctttttgataagcacattaaagttaatagaacttaaaaatattc

SEQ ID NO: 296022 - DNA, 2840 bp, Homo sapiens
aggggccactgcgttcagctctggcggtccacagcccgaagcgcggcttaggaagttcgtgtcagcgctgcctgagctcgtcccctggatgtccgggtctccccaggcggccacccgccggctcccatcgtgacctccagccgcagcgcctcccacgccggccgccgcgcgaggggagcgctcgggcgcgccgggtgtggttgggggaaggggttgtgccgcgcgcgggctgcgtgctgtgcccactcaaaaggttccgggcgcgcaggagggaagaggcagtgcccgccactcccactgagattgagagacgcggcaaggaggcagcctgtggaggaactgggtaggatttaggaacgcaccgtgcacatgcttggtggtcttgttaagtggaaactgctgctttagagtttgtttggaaggtccgggtgactcatcccaacatttacatccttaattgttaaagcgctgcctccgagcgcacgcatcctgagatcctgagcctttggttaagaccgagctctattaagctgaaaagataaaaactctccagatgtcttccagtaatgtcgaagtttttatcccagtgtcacaaggaaacaccaatggcttccccgcgacagcttccaatgacctgaaggcatttactgaaggagctgtgttaagttttcataacatctgctatcgagtaaaactgaagagtggctttctaccttgtcgaaaaccagttgagaaagaaatattatcgaatatcaatgggatcatgaaacctggtctcaacgccatcctgggacccacaggtggaggcaaatcttcgttattagatgtcttagctgcaaggaaagatccaagtggattatctggagatgttctgataaatggagcaccgcgacctgccaatttcaaatgtaattcaggttacgtggtacaagatgatgttgtgatgggcactctgacggtgagagaaaacttacagttctcagcagctcttcggcttgcaacaactatgacgaatcatgaaaaaaacgaacggattaacagggtcattcaagagttaggtctggataaagtggcagactccaaggttggaactcagtttatccgtggtgtgtctggaggagaaagaaaaaggactagtataggaatggagcttatcactgatccttccatcttgttcttggatgagcctacaactggcttagactcaagcacagcaaatgctgtccttttgctcctgaaaaggatgtctaagcagggacgaacaatcatcttctccattcatcagcctcgatattccatcttcaagttgtttgatagcctcaccttattggcctcaggaagacttatgttccacgggcctgctcaggaggccttgggatactttgaatcagctggttatcactgtgaggcctataataaccctgcagacttcttcttggacatcattaatggagattccactgctgtggcattaaacagagaagaagactttaaagccacagagatcatagagccttccaagcaggataagccactcatagaaaaattagcggagatttatgtcaactcctccttctacaaagagacaaaagctgaattacatcaactttccgggggtgagaagaagaagaagatcacagtcttcaaggagatcagctacaccacctccttctgtcatcaactcagatgggtttccaagcgttcattcaaaaacttgctgggtaatccccaggcctctatagctcagatcattgtcacagtcgtactgggactggttataggtgccatttactttgggctaaaaaatgattctactggaatccagaacagagctggggttctcttcttcctgacgaccaaccagtgtttcagcagtgtttcagccgtggaactctttgtggtagagaagaagctcttcatacatgaatacatcagcggatactacagagtgtcatcttatttccttggaaaactgttatctgatttattacccatgaggatgttaccaagtattatatttacctgtatagtgtacttcatgttaggattgaagccaaaggcagatgccttcttcgttatgatgtttacccttatgatggtggcttattcagccagttccatggcactggccatagcagcaggtcagagtgtggtttctgtagcaacacttctcatgaccatctgttttgtgtttatgatgattttttcaggtctgttggtcaatctcacaaccattgcatcttggctgtcatggcttcagtacttcagcattccacgatatggatttacggctttgcagcataatgaatttttgggacaaaacttctgcccaggactcaatgcaacaggaaacatttttttgttgttttctgttcccttgccatcacactgttgcacagcagcaattgttttaaagagatacatttttagaaatcacaacaaactgaattaaacatgaaagaacccaagacatcatgtatcgcatattagttaatctcctcagacagtaaccatggggaagaaatctggtctaatttattaatctaaaaaaggagaattgaattctggaaactcctgacaagttattactgtctctggcatttgtttcctcatctttaaaatgaataggtaggttagtagcccttcagtcttaatactttatgatgctatggtttgccattatttaataaatgacaaatgtattaatgctatactggaaatgtaaaattgaaaatatgttggaaaaaagattctgtcttatagggtaaaaaaagccaccggtgatagaaaaaaaatctttttgataagcacattaaagttaatagaacttaaaaatattc

SEQ ID NO: 296023 - DNA, 2509 bp, Homo sapiens
aggggccactgcgttcagctctggcggtccacagcccgaagcgcggcttaggaagttcgtgtcagcgctgcctgagctcgtcccctggatgtccgggtctccccaggcggccacccgccggctcccatcgtgacctccagccgcagcgcctcccacgccggccgccgcgcgaggggagcgctcgggcgcgccgggtgtggttgggggaaggggttgtgccgcgcgcgggctgcgtgctgtgcccactcaaaaggttccgggcgcgcaggagggaagaggcagtgcccgccactcccactgagattgagagacgcggcaaggaggcagcctgtggaggaactgggtaggatttaggaacgcaccgtgcacatgcttggtggtcttgttaagtggaaactgctgctttagagtttgtttggaaggtccgggtgactcatcccaacatttacatccttaattgttaaagcgctgcctccgagcgcacgcatcctgagatcctgagcctttggttaagaccgagctctattaagctgaaaagataaaaactctccagatgtcttccagtaatgtcgaagtttttatcccagtgtcacaaggaaacaccaatggcttccccgcgacagcttccaatgacctgaaggcatttactgaaggagctgtgttaagttttcataacatctgctatcgagtaaaactgaagagtggctttctaccttgtcgaaaaccagttgagaaagaaatattatcgaatatcaatgggatcatgaaacctggtctcaacgccatcctgggacccacaggtggaggcaaatcttcgttattagatgtcttagctgcaaggaaagatccaagtggattatctggagatgttctgataaatggagcaccgcgacctgccaatttcaaatgtaattcaggttacgtggtacaagatgatgttgtgatgggcactctgacggtgagagaaaacttacagttctcagcagctcttcggcttgcaacaactatgacgaatcatgaaaaaaacgaacggattaacagggtcattcaagagttaggtctggataaagtggcagactccaaggttggaactcagtttatccgtggtgtgtctggaggagaaagaaaaaggactagtataggaatggagcttatcactgatccttccatcttgttcttggatgagcctacaactggcttagactcaagcacagcaaatgctgtccttttgctcctgaaaaggatgtctaagcagggacgaacaatcatcttctccattcatcagcctcgatattccatcttcaagttgtttgatagcctcaccttattggcctcaggaagacttatgttccacgggcctgctcaggaggccttgggatactttgaatcagctggttatcactgtgaggcctataataaccctgcagacttcttcttggacatcattaatggagattccactgctgtggcattaaacagagaagaagactttaaagccacagagatcatagagccttccaagcaggataagccactcatagaaaaattagcggagatttatgtcaactcctccttctacaaagagacaaaagctgaattacatcaactttccgggggtgagaagaagaagaagatcacagtcttcaaggagatcagctacaccacctccttctgtcatcaactcagatgggtttccaagcgttcattcaaaaacttgctgggtaatccccaggcctctatagctcagatcattgtcacagtcgtactgggactggttataggtgccatttactttgggctaaaaaatgattctactggaatccagaacagagctggggttctcttcttcctgacgaccaaccagtgtttcagcagtgtttcagccgtggaactctttgtggtagagaagaagctcttcatacatgaatacatcagcggatactacagagtgtcatcttatttccttggaaaactgttatctgatttattacccatgaggatgttaccaagtattatatttacctgtatagtgtacttcatgttaggattgaagccaaaggcagatgccttcttcgttatgatgtttacccttatgatggtggcttattcagccagttccatggcactggccatagcagcaggtcagagtgtggtttctgtagcaacacttctcatgaccatctgttttgtgtttatgatgattttttcaggtctgttggtcaatctcacaaccattgcatcttggctgtcatggcttcagtacttcagcattccacgatatggatttacgatgtactggcgaagaatatttggtaaagcagggcatcgatctctcaccctggggcttgtggaagaatcacgtggccttggcttgtatgattgttattttcctcacaattgcctacctgaaattgttatttcttaaaaaatattcttaaatttccccttaattcagtatgatttatcctcacataaaaaagaagcactttgattgaagtattcaatcaag

SEQ ID NO: 296024 - DNA, 1296 bp, Homo sapiens
ggccacgaccagggacgcccagcacccagtgcagggcctgccctggaagaggtcagtagtgcaaagttagggctggaactgggaggaaattcgagcatgcgtcccagccggaggctgagcttgcgggcgaagaacacggcagcgctgggaaccgggctagggctttccgtgtgggccgcgcctgccggccctctctgttgtcccacttggcacggactgggctaccgccacggtttgacttccgccaccagcaaccaagggaaccagatcccaagggaaccagcacccctgggcgctcgcggcccgaagcctgaggttcccgccccgccccggcagggcggccccgccgacacccgtagcggtcccgccccccgcggccgcaccgcctcctgcctggtctcgggtgccagcgccgccggcggagaacaggagcatggagggcgggctggggcgtgctgtgtgcttgctgaccggggcctcccgcggcttcggccggacgctggccccgctcctggcctcgctgctgtcgcccggctccgtgcttgtccttagcgcccgcaacgacgaggcactgcgccagctggaggccgagctgggcgccgagcggtctggcctgcgcgtggtgcgggtgcccgccgacctgggcgccgaggccggcttgcagcagctgctcggcgccctgcgcgagctcccccggcccaaggggctgcagcgactgctgcttatcaacaacgcgggctctcttggggatgtgtccaaaggcttcgtggacctgagtgactccactcaagtgaacaactactgggcactgaacttgacctccatgctctgcctgacttccagcgtcctgaaggccttcccggacagtcctggcctcaacagaaccgtggttaacatctcgtccctctgtgccctgcaacctttcaaaggctgggcgctgtactgtgcaggaaaggctgctcgtgatatgctgttccaggtcctggcgctggaggaacctaatgtgagggtgctgaactatgccccaggtcctctggacacagacatgcagcagttggcccgggagacctccgtggacccagacatgcgaaaagggctgcaggagctgaaggcaaaggggaagctggtggattgcaaggtgtcagcccagaaactgctgagcttactggaaaaggacgagttcaagtctggagcccacgtggacttctatgacaaataagccagttttggtcctaactttggccccttgaataccgaactgggtccaaccgcaggggcccttcactaacattcggc

SEQ ID NO: 296025 - DNA, 1841 bp, Homo sapiens
ggccacgaccagggacgcccagcacccagtgcagggcctgccctggaagaggtcagtagtgcaaagttagggctggaactgggaggaaattcgagcatgcgtcccagccggaggctgagcttgcgggcgaagaacacggcagcgctgggaaccgggctagggctttccgtgtgggccgcgcctgccggccctctctgttgtcccacttggcacggactgggctaccgccacggtttgacttccgccaccagcaaccaagggaaccagatcccaagggaaccagcacccctgggcgctcgcggcccgaagcctgaggttcccgccccgccccggcagggcggccccgccgacacccgtagcggtcccgccccccgcggccgcaccgcctcctgcctggtctcgggtgccagcgccgccggcggagaacaggagcatggagggcgggctggggcgtgctgtgtgcttgctgaccggggcctcccgcggcttcggccggacgctggccccgctcctggcctcgctgctgtcgcccggctccgtgcttgtccttagcgcccgcaacgacgaggcactgcgccagctggaggccgagctgggcgccgagcggtctggcctgcgcgtggtgcgggtgcccgccgacctgggcgccgaggccggcttgcagcagctgctcggcgccctgcgcgagctcccccggcccaaggggctgcagcgactgctgcttatcaacaacgcgggctctcttggggatgtgtccaaaggcttcgtggacctgagtgactccactcaagtgaacaactactgggcactgaacttgacctccatgctctgcctgacttccagcgtcctgaaggccttcccggacagtcctggcctcaacagaaccgtggttaacatctcgtccctctgtgccctgcaacctttcaaaggctgggcgctgtactgtgcaggaaaggctgctcgtgatatgctgttccaggtcctggcgctggaggaacctaatgtgagggtgctgaactatgccccaggtcctctggacacagacatgcagcagttggcccgggagacctccgtggacccagacatgcgaaaagggctgcaggagctgaaggcaaaggggaagctggtggattgcaaggtgtcagcccagaaactgctgagcttactggaaaaggacgagttcaagtctggagcccacgtggacttctatgacaaataagcccatgtttttggcttcctgaacctttttgcccccacttttagacataccccagagccctgtggctccccacaccctgccataggggcagtcctgccttacacatagaagcattcatgcctgctgccctgccctcaggcacagccagctgtgagctcccaggtcattggccttaccagttgtcaggagtctgtgctgtgcaccctgggttataaggaggcttaggagagaggttatgggtattggtgtctctatccccaggaatagaacttaaggggtgggaagaacaggaaaagaagctggaacacagaagagaggaggttgtgtctcttgctcatagcaagcctgtgggtagaggaaagagtgatctggtgtcgaataggaggacccatgtagattcgcagatggcctggatgggaggaagggcagacggtacatgtcccagcccacatagatgccccttgctgagggtagcaggaccttctgttgaactttgtgtcctcactctgatgtctccttccttcagaatctaccacccctcccccaggctgggagaaggggctcctgggtgtctgtatacacgccaaaggcagatacaaataaaatacagattgtcctttca

SEQ ID NO: 296026 - DNA, 1763 bp, Homo sapiens
ggccacgaccagggacgcccagcacccagtgcagggcctgccctggaagaggtcagtagtgcaaagttagggctggaactgggaggaaattcgagcatgcgtcccagccggaggctgagcttgcgggcgaagaacacggcagcgctgggaaccgggctagggctttccgtgtgggccgcgcctgccggccctctctgttgtcccacttggcacggactgggctaccgccacggtttgacttccgccaccagcaaccaagggaaccagatcccaagggaaccagcacccctgggcgctcgcggcccgaagcctgaggttcccgccccgccccggcagggcggccccgccgacacccgtagcggtcccgccccccgcggccgcaccgcctcctgcctggtctcgggtgccagcgccgccggcggagaacaggagcatggagggcgggctggggcgtgctgtgtgcttgctgaccggggcctcccgcggcttcggccggacgctggccccgctcctggcctcgctgctgtcgcccggctccgtgcttgtccttagcgcccgcaacgacgaggcactgcgccagctggaggccgagctgggcgccgagcggtctggcctgcgcgtggtgcgggtgcccgccgacctgggcgccgaggccggcttgcagcagctgctcggcgccctgcgcgagctcccccggcccaaggggctgcagcgactgctgcttatcaacaacgcgggctctcttggggatgtgtccaaaggcttcgtggacctgagtgactccactcaagtgaacaactactgggcactgaacttgacctccatgctctgcctgacttccagcgtcctgaaggccttcccggacagtcctggcctcaacagaaccgtggttaacatctcgtccctctgtgccctgcaacctttcaaaggctgggcgctgtactgtgcaggaaaggctgctcgtgatatgctgttccaggtcctggcgctggaggaacctaatgtgagggtgctgaactatgccccaggtcctctggacacagacatgcagcagttggcccgggagacctccgtggacccagacatgcgaaaagggctgcaggagctgaaggcaaaggggaagctggtggattgcaaggtgtcagcccagaaactgctgagcttactggaaaaggacgagttcaagtctggagcccacgtggacttctatgacaaataagcccatgtttttggcttcctgaacctttttgcccccacttttagacataccccagagccctgtggctccccacaccctgccataggggcagtcctgccttacacatagaagcattcatgcctgctgccctgccctcaggcacagccagctgtgagctcccaggtcattggccttaccagttgtcaggagtctgtgctgtgcaccctgggttataaggaggcttaggagagaggttatgggtattggtgtctcttgctcatagcaagcctgtgggtagaggaaagagtgatctggtgtcgaataggaggacccatgtagattcgcagatggcctggatgggaggaagggcagacggtacatgtcccagcccacatagatgccccttgctgagggtagcaggaccttctgttgaactttgtgtcctcactctgatgtctccttccttcagaatctaccacccctcccccaggctgggagaaggggctcctgggtgtctgtatacacgccaaaggcagatacaaataaaatacagattgtcctttca

SEQ ID NO: 296027 - DNA, 2418 bp, Homo sapiens
ggccacgaccagggacgcccagcacccagtgcagggcctgccctggaagaggtcagtagtgcaaagttagggctggaactgggaggaaattcgagcatgcgtcccagccggaggctgagcttgcgggcgaagaacacggcagcgctgggaaccgggctagggctttccgtgtgggccgcgcctgccggccctctctgttgtcccacttggcacggactgggctaccgccacggtttgacttccgccaccagcaaccaagggaaccagatcccaagggaaccagcacccctgggcgctcgcggcccgaagcctgaggttcccgccccgccccggcagggcggccccgccgacacccgtagcggtcccgccccccgcggccgcaccgcctcctgcctggtctcgggtgccagcgccgccggcggagaacaggagcatggagggcgggctggggcgtgctgtgtgcttgctgaccggggcctcccgcggcttcggccggacgctggccccgctcctggcctcgctgctgtcgcccggctccgtgcttgtccttagcgcccgcaacgacgaggcactgcgccagctggaggccgagctgggcgccgagcggtctggcctgcgcgtggtgcgggtgcccgccgacctgggcgccgaggccggcttgcagcagctgctcggcgccctgcgcgagctcccccggcccaaggggctgcagcgactgctgcttatcaacaacgcgggtaagaccccggggctggagcggactccccatgtgagcgcccacttcctccaccgctggggaatttaagggctactcctaggggtcagataggacgcctagaaatctaaagccctagttgttccagcttgagtagcaagtggaggcgaggtgtacaggaagactcggtgccgtcgggacaacagtctgcccccacttcctggaaaattggccagccgggttttccaaagcgcctgtagaactttcccgagccccttgctctgcgccctctggcggaggcctgagtcagggcttggagtctccaaacaagtaaactctctgcttctccaaaggaccgctagagctttccttcagccccacggcaaggcaggtgccttctcattctgcagcttgggatggctaggttccccagctgtgtctttccgcagagctggggaagagagaagcctcttcagaagcgctaggcagcttcctcctctaggtctgcatgggaagaggatatctggaggaacttgggagggctggggaagaagaaagccccgcctgcactgagttactcctaagggttggtttttcaggctctcttggggatgtgtccaaaggcttcgtggacctgagtgactccactcaagtgaacaactactgggcactgaacttgacctccatgctctgcctgacttccagcgtcctgaaggccttcccggacagtcctggcctcaacagaaccgtggttaacatctcgtccctctgtgccctgcaacctttcaaaggctgggcgctgtactgtgcaggaaaggctgctcgtgatatgctgttccaggtcctggcgctggaggaacctaatgtgagggtgctgaactatgccccaggtcctctggacacagacatgcagcagttggcccgggagacctccgtggacccagacatgcgaaaagggctgcaggagctgaaggcaaaggggaagctggtggattgcaaggtgtcagcccagaaactgctgagcttactggaaaaggacgagttcaagtctggagcccacgtggacttctatgacaaataagcccatgtttttggcttcctgaacctttttgcccccacttttagacataccccagagccctgtggctccccacaccctgccataggggcagtcctgccttacacatagaagcattcatgcctgctgccctgccctcaggcacagccagctgtgagctcccaggtcattggccttaccagttgtcaggagtctgtgctgtgcaccctgggttataaggaggcttaggagagaggttatgggtattggtgtctctatccccaggaatagaacttaaggggtgggaagaacaggaaaagaagctggaacacagaagagaggaggttgtgtctcttgctcatagcaagcctgtgggtagaggaaagagtgatctggtgtcgaataggaggacccatgtagattcgcagatggcctggatgggaggaagggcagacggtacatgtcccagcccacatagatgccccttgctgagggtagcaggaccttctgttgaactttgtgtcctcactctgatgtctccttccttcagaatctaccacccctcccccaggctgggagaaggggctcctgggtgtctgtatacacgccaaaggcagatacaaataaaatacagattgtcctttca

SEQ ID NO: 296028 - DNA, 2206 bp, Homo sapiens
ggccacgaccagggacgcccagcacccagtgcagggcctgccctggaagaggtcagtagtgcaaagttagggctggaactgggaggaaattcgagcatgcgtcccagccggaggctgagcttgcgggcgaagaacacggcagcgctgggaaccgggctagggctttccgtgtgggccgcgcctgccggccctctctgttgtcccacttggcacggactgggctaccgccacggtttgacttccgccaccagcaaccaagggaaccagatcccaagggaaccagcacccctgggcgctcgcggcccgaagcctgaggttcccgccccgccccggcagggcggccccgccgacacccgtagcggtcccgccccccgcggccgcaccgcctcctgcctggtctcgggtgccagcgccgccggcggagaacaggagcatggagggcgggctggggcgtgctgtgtgcttgctgaccggggcctcccgcggcttcggccggacgctggccccgctcctggcctcgctgctgtcgcccggctccgtgcttgtccttagcgcccgcaacgacgaggcactgcgccagctggaggccgagctgggcgccgagcggtctggcctgcgcgtggtgcgggtgcccgccgacctgggcgccgaggccggcttgcagcagctgctcggcgccctgcgcgagctcccccggcccaaggggctgcagcgactgctgcttatcaacaacgcgggtaagaccccggggctggagcggactccccatgtgagcgcccacttcctccaccgctggggaatttaagggctactcctaggggtcagataggacgcctagaaatctaaagccctagttgttccagcttgagtagcaagtggaggcgaggtgtacaggaagactcggtgccgtcgggacaacagtctgcccccacttcctggaaaattggccagccgggttttccaaagcgcctgtagaactttcccgagccccttgctctgcgccctctggcggaggcctgagtcagggcttggagtctccaaacaagtaaactctctgcttctccaaaggaccgctagagctttccttcagccccacggcaaggctctcttggggatgtgtccaaaggcttcgtggacctgagtgactccactcaagtgaacaactactgggcactgaacttgacctccatgctctgcctgacttccagcgtcctgaaggccttcccggacagtcctggcctcaacagaaccgtggttaacatctcgtccctctgtgccctgcaacctttcaaaggctgggcgctgtactgtgcaggaaaggctgctcgtgatatgctgttccaggtcctggcgctggaggaacctaatgtgagggtgctgaactatgccccaggtcctctggacacagacatgcagcagttggcccgggagacctccgtggacccagacatgcgaaaagggctgcaggagctgaaggcaaaggggaagctggtggattgcaaggtgtcagcccagaaactgctgagcttactggaaaaggacgagttcaagtctggagcccacgtggacttctatgacaaataagcccatgtttttggcttcctgaacctttttgcccccacttttagacataccccagagccctgtggctccccacaccctgccataggggcagtcctgccttacacatagaagcattcatgcctgctgccctgccctcaggcacagccagctgtgagctcccaggtcattggccttaccagttgtcaggagtctgtgctgtgcaccctgggttataaggaggcttaggagagaggttatgggtattggtgtctctatccccaggaatagaacttaaggggtgggaagaacaggaaaagaagctggaacacagaagagaggaggttgtgtctcttgctcatagcaagcctgtgggtagaggaaagagtgatctggtgtcgaataggaggacccatgtagattcgcagatggcctggatgggaggaagggcagacggtacatgtcccagcccacatagatgccccttgctgagggtagcaggaccttctgttgaactttgtgtcctcactctgatgtctccttccttcagaatctaccacccctcccccaggctgggagaaggggctcctgggtgtctgtatacacgccaaaggcagatacaaataaaatacagattgtcctttca

SEQ ID NO: 296029 - DNA, 1816 bp, Homo sapiens
ggccacgaccagggacgcccagcacccagtgcagggcctgccctggaagaggtcagtagtgcaaagttagggctggaactgggaggaaattcgagcatgcgtcccagccggaggctgagcttgcgggcgaagaacacggcagcgctgggaaccgggctagggctttccgtgtgggccgcgcctgccggccctctctgttgtcccacttggcacggactgggctaccgccacggtttgacttccgccaccagcaaccaagggaaccagatcccaagggaaccagcacccctgggcgctcgcggcccgaagcctgaggttcccgccccgccccggcagggcggccccgccgacacccgtagcggtcccgccccccgcggccgcaccgcctcctgcctggtctcgggtgccagcgccgccggcggagaacaggagcatggagggcgggctggggcgtgctgtgtgcttgctgaccggggcctcccgcggcttcggccggacgctggccccgctcctggcctcgctgctgtcgcccggctccgtgcttgtccttagcgcccgcaacgacgaggcactgcgccagctggaggccgagctgggcgccgagcggtctggcctgcgcgtggtgcgggtgcccgccgacctgggcgccgaggccggcttgcagcagctgctcggcgccctgcgcgagctcccccggcccaaggggctgcagcgactgctgcttatcaacaacgcgggctctcttggggatgtgtccaaaggcttcgtggacctgagtgactccactcaagtgaacaactactgggcactgaacttgacctccatgctctgcctgacttccagcgtcctgaaggccttcccggacagtcctggcctcaacagaaccgtggttaacatctcgtccctctgtgccctgcaacctttcaaaggctgggcgctgtactgtgcaggaaaggctgctcgtgatatgctgttccaggtcctggcgctggaggaacctaatgtcctctggacacagacatgcagcagttggcccgggagacctccgtggacccagacatgcgaaaagggctgcaggagctgaaggcaaaggggaagctggtggattgcaaggtgtcagcccagaaactgctgagcttactggaaaaggacgagttcaagtctggagcccacgtggacttctatgacaaataagcccatgtttttggcttcctgaacctttttgcccccacttttagacataccccagagccctgtggctccccacaccctgccataggggcagtcctgccttacacatagaagcattcatgcctgctgccctgccctcaggcacagccagctgtgagctcccaggtcattggccttaccagttgtcaggagtctgtgctgtgcaccctgggttataaggaggcttaggagagaggttatgggtattggtgtctctatccccaggaatagaacttaaggggtgggaagaacaggaaaagaagctggaacacagaagagaggaggttgtgtctcttgctcatagcaagcctgtgggtagaggaaagagtgatctggtgtcgaataggaggacccatgtagattcgcagatggcctggatgggaggaagggcagacggtacatgtcccagcccacatagatgccccttgctgagggtagcaggaccttctgttgaactttgtgtcctcactctgatgtctccttccttcagaatctaccacccctcccccaggctgggagaaggggctcctgggtgtctgtatacacgccaaaggcagatacaaataaaatacagattgtcctttca

SEQ ID NO: 296030 - DNA, 902 bp, Homo sapiens
cgacaggaagactcctcaggagagctggagtgctgccgtcattaacgccaggccagaacacggcgggctaacagggcgctggcctgcgtgcccacctctaggtccgctaatatgtgcccagctctaggtccgctaatgtgctacgcgataactgaaagacagcacaagccagagcggacggccgcgggatcccgttggggcgcatgcgcgagagcgaacgcggcgccgtgcgcatgcgcgcaagagagcgggaagccgagctgggcgagaagtaggggagggcggtgctccgccgcggtggcggttgctatcgcttcgcagaacctactcaggcagccagctgagaagagttgagggaaagtgctgctgctgggtctgcagacgcgatggataacgtgcagccgaaaataaaacatcgccccttctgcttcagtgtgaaaggccacgtgaagatgctgcggctggcactaactgtgacatctatgaccttttttatcatcgcacaagcccctgaaccatatattgttatcactggatttgaagtcaccgttatcttatttttcatacttttatatgtactcagacttgatcgattaatgaagtggttattttggcctttgcttgatattatcaactcactggtaacaacagtattcatgctcatcgtatctgtgttggcactgataccagaaaccacaacattgacagttggtggaggggtgtttgcacttgtgacagcagtatgctgtcttgccgacggggcccttatttaccggaagcttctgttcaatcccagcggtccttaccagaaaaagcctgtgcatgaaaaaaaagaagttttgtaattttatattactttttagtttgatactaagtattaaacatatttctgtattcttcca

SEQ ID NO: 296031 - DNA, 743 bp, Homo sapiens
cgacaggaagactcctcaggagagctggagtgctgccgtcattaacgccaggccagaacacggcgggctaacagggcgctggcctgcgtgcccacctctaggtccgctaatatgtgcccagctctaggtccgctaatgtgctacgcgataactgaaagacagcacaagccagagcggacggccgcgggatcccgttggggcgcatgcgcgagagcgaacgcggcgccgtgcgcatgcgcgcaagagagcgggaagccgagctgggcgagaagtaggggagggcggtgctccgccgcggtggcggttgctatcgcttcgcagaacctactcaggcagccagctgagaagagttgagggaaagtgctgctgctgggtctgcagacgcgatggataacgtgcagccgaaaataaaacatcgccccttctgcttcagtgtgaaaggccacgtgaagatgctgcggctggatattatcaactcactggtaacaacagtattcatgctcatcgtatctgtgttggcactgataccagaaaccacaacattgacagttggtggaggggtgtttgcacttgtgacagcagtatgctgtcttgccgacggggcccttatttaccggaagcttctgttcaatcccagcggtccttaccagaaaaagcctgtgcatgaaaaaaaagaagttttgtaattttatattactttttagtttgatactaagtattaaacatatttctgtattcttcca

SEQ ID NO: 296032 - DNA, 964 bp, Homo sapiens
cgacaggaagactcctcaggagagctggagtgctgccgtcattaacgccaggccagaacacggcgggctaacagggcgctggcctgcgtgcccacctctaggtccgctaatatgtgcccagctctaggtccgctaatgtgctacgcgataactgaaagacagcacaagccagagcggacggccgcgggatcccgttggggcgcatgcgcgagagcgaacgcggcgccgtgcgcatgcgcgcaagagagcgggaagccgagctgggcgagaagtaggggagggcggtgctccgccgcggtggcggttgctatcgcttcgcagaacctactcaggcagccagctgagaagagttgagggaaagtgctgctgctgggtctgcagacgcgatggataacgtgcagccgaaaataaaacatcgccccttctgcttcagtgtgaaaggccacgtgaagatgctgcggctggcactaactgtgacatctatgaccttttttatcatcgcacaagcccctgaaccatatattgttatcactggatttgaagtcaccgttatcttatttttcatacttttatatgtactcagacttgatcgattaatgaagtggttattttggcctttgcttgatattatcaactcactggtaacaacagtattcatgctcatcgtatctgtgttggcactgataccagaaaccacaacattgacagttggtggaggggtgtttgcacttgtgacagcagtatgctgtcttgccgacggggcccttatttaccggaagcttctgttcaatcccagcggtccttaccagaaaaagcctgtgcatgaaaaaaaagaagttttgtaattttatattactttttagtttgatactaagtattaaacatatttctgtattcttccaaaaaaaaaaaaaaaaaaaaaaaaaaaaaaaacggggggttaaatggggggggggaaaagggg

SEQ ID NO: 296033 - DNA, 805 bp, Homo sapiens
cgacaggaagactcctcaggagagctggagtgctgccgtcattaacgccaggccagaacacggcgggctaacagggcgctggcctgcgtgcccacctctaggtccgctaatatgtgcccagctctaggtccgctaatgtgctacgcgataactgaaagacagcacaagccagagcggacggccgcgggatcccgttggggcgcatgcgcgagagcgaacgcggcgccgtgcgcatgcgcgcaagagagcgggaagccgagctgggcgagaagtaggggagggcggtgctccgccgcggtggcggttgctatcgcttcgcagaacctactcaggcagccagctgagaagagttgagggaaagtgctgctgctgggtctgcagacgcgatggataacgtgcagccgaaaataaaacatcgccccttctgcttcagtgtgaaaggccacgtgaagatgctgcggctggatattatcaactcactggtaacaacagtattcatgctcatcgtatctgtgttggcactgataccagaaaccacaacattgacagttggtggaggggtgtttgcacttgtgacagcagtatgctgtcttgccgacggggcccttatttaccggaagcttctgttcaatcccagcggtccttaccagaaaaagcctgtgcatgaaaaaaaagaagttttgtaattttatattactttttagtttgatactaagtattaaacatatttctgtattcttccaaaaaaaaaaaaaaaaaaaaaaaaaaaaaaaacggggggttaaatggggggggggaaaagggg

SEQ ID NO: 296034 - DNA, 806 bp, Homo sapiens
cgacaggaagactcctcaggagagctggagtgctgccgtcattaacgccaggccagaacacggcgggctaacagggcgctggcctgcgtgcccacctctaggtccgctaatatgtgcccagctctaggtccgctaatgtgctacgcgataactgaaagacagcacaagccagagcggacggccgcgggatcccgttggggcgcatgcgcgagagcgaacgcggcgccgtgcgcatgcgcgcaagagagcgggaagccgagctgggcgagaagtaggggagggcggtgctccgccgcggtggcggttgctatcgcttcgcagaacctactcaggcagccagctgagaagagttgagggaaagtgctgctgctgggtctgcagacgcgatggataacgtgcagccgaaaataaaacatcgccccttctgcttcagtgtgaaaggccacgtgaagatgctgcggctggcactaactgtgacatctatgaccttttttatcatcgcacaagcccctgaaccatatattgttatcactggatttgaagtcaccgttatcttatttttcatacttttatatgtactcagacttgatcgattaatgaagtggttattttggcctttgcttgtgtttgcacttgtgacagcagtatgctgtcttgccgacggggcccttatttaccggaagcttctgttcaatcccagcggtccttaccagaaaaagcctgtgcatgaaaaaaaagaagttttgtaattttatattactttttagtttgatactaagtattaaacatatttctgtattcttcca

SEQ ID NO: 296035 - DNA, 647 bp, Homo sapiens
cgacaggaagactcctcaggagagctggagtgctgccgtcattaacgccaggccagaacacggcgggctaacagggcgctggcctgcgtgcccacctctaggtccgctaatatgtgcccagctctaggtccgctaatgtgctacgcgataactgaaagacagcacaagccagagcggacggccgcgggatcccgttggggcgcatgcgcgagagcgaacgcggcgccgtgcgcatgcgcgcaagagagcgggaagccgagctgggcgagaagtaggggagggcggtgctccgccgcggtggcggttgctatcgcttcgcagaacctactcaggcagccagctgagaagagttgagggaaagtgctgctgctgggtctgcagacgcgatggataacgtgcagccgaaaataaaacatcgccccttctgcttcagtgtgaaaggccacgtgaagatgctgcggctggtgtttgcacttgtgacagcagtatgctgtcttgccgacggggcccttatttaccggaagcttctgttcaatcccagcggtccttaccagaaaaagcctgtgcatgaaaaaaaagaagttttgtaattttatattactttttagtttgatactaagtattaaacatatttctgtattcttcca

SEQ ID NO: 296036 - DNA, 297 bp, Homo sapiens
tttattgtgtgtttttaggatattatcaactcactggtaacaacagtattcatgctcatcgtatctgtgttggcactgataccagaaaccacaacattgacagttggtggaggggtgtttgcacttgtgacagcagtatgctgtcttgccgacggggcccttatttaccggaagcttctgttcaatcccagcggtccttaccagaaaaagcctgtgcatgaaaaaaaagaagttttgtaattttatattactttttagtttgatactaagtattaaacatatttctgtattcttcca

SEQ ID NO: 296037 - DNA, 136 bp, Homo sapiens
gcggccgcctactactactactgctcgaattcaagcttctaacgatgtacggggacatgaaaaaaaagaagttttgtaattttatattactttttagtttgatactaagtattaaacatatttctgtattcttcca

SEQ ID NO: 296038 - DNA, 1430 bp, Homo sapiens
cgacaggaagactcctcaggagagctggagtgctgccgtcattaacgccaggccagaacacggcgggctaacagggcgctggcctgcgtgcccacctctaggtccgctaatatgtgcccagctctaggtccgctaatgtgctacgcgataactgaaagacagcacaagccagagcggacggccgcgggatcccgttggggcgcatgcgcgagagcgaacgcggcgccgtgcgcatgcgcgcaagagagcgggaagccgagctgggcgagaagtaggggagggcggtgctccgccgcggtggcggttgctatcgcttcgcagaacctactcaggcagccagctgagaagagttgagggaaagtgctgctgctgggtctgcagacgcgatggataacgtgcagccgaaaataaaacatcgccccttctgcttcagtgtgaaaggccacgtgaagatgctgcggctggtgaggccgggccgcggagggcgggaggctgatgaagctgctggggggcgggagatgtgggtgtgaagtgcaaagctgaacgcctgtttgcttttcaacctcgctttgatcaagattgaaaggcaaggcatggcctccttggggaagaaggagagagatacggcactgtcctccccttaggagggtttagggacacactcattcatgaaaaccagagagggcggggcgccgtggcgcacacctgtggtcccagcactttgggaggccgggacgggaggatcgcttgatcccaggagttcgaggctgcagtgaacgttgatcgcaccactgcacacaagcctaggcgacagagaggtcctgcctctttaaaaacaaaaacaaaaaaaaaccctttttttaaattaaaaatcagatctacccaaatggtctacatttggacccacaaaccgggtacccaggttaccaggcgagacaactgcagttatacctctcagaagcccacaagatttgaaagaaaaaaaaaaaagcctcaggggtttcggtgaatgttgtgtggacttccgtgagacagacgtttgatgtgaactgagttcaaggctgatacagcccagaaccaggacaaggagagaactgctcgtttccgggagcagacttcctaccgggagcactgcagtcacttctgaacaggatattatcaactcactggtaacaacagtattcatgctcatcgtatctgtgttggcactgataccagaaaccacaacattgacagttggtggaggggtgtttgcacttgtgacagcagtatgctgtcttgccgacggggcccttatttaccggaagcttctgttcaatcccagcggtccttaccagaaaaagcctgtgcatgaaaaaaaagaagttttgtaattttatattactttttagtttgatactaagtattaaacatatttctgtattcttcca

SEQ ID NO: 296039 - DNA, 844 bp, Homo sapiens
cgacaggaagactcctcaggagagctggagtgctgccgtcattaacgccaggccagaacacggcgggctaacagggcgctggcctgcgtgcccacctctaggtccgctaatatgtgcccagctctaggtccgctaatgtgctacgcgataactgaaagacagcacaagccagagcggacggccgcgggatcccgttggggcgcatgcgcgagagcgaacgcggcgccgtgcgcatgcgcgcaagagagcgggaagccgagctgggcgagaagtaggggagggcggtgctccgccgcggtggcggttgctatcgcttcgcagaacctactcaggcagccagctgagaagagttgagggaaagtgctgctgctgggtctgcagacgcgatggataacgtgcagccgaagcactaactgtgacatctatgaccttttttatcatcgcacaagcccctgaaccatatattgttatcactggatttgaagtcaccgttatcttatttttcatacttttatatgtactcagacttgatcgattaatgaagtggttattttggcctttgcttgatattatcaactcactggtaacaacagtattcatgctcatcgtatctgtgttggcactgataccagaaaccacaacattgacagttggtggaggggtgtttgcacttgtgacagcagtatgctgtcttgccgacggggcccttatttaccggaagcttctgttcaatcccagcggtccttaccagaaaaagcctgtgcatgaaaaaaaagaagttttgtaattttatattactttttagtttgatactaagtattaaacatatttctgtattcttcca

SEQ ID NO: 296040 - DNA, 820 bp, Homo sapiens
catatatgtcagaagccatgattttcatctcccttaggccctgagcaacttcatgaggagtcagaattattctagaaatgagatagctctgtatcaatttcccccagcactttgggaggccgggacgggaggatcgcttgatcccaggagttcgaggctgcagtgaacgttgatcgcaccactgcacacaagcctaggcgacagagaggtcctgcctctttaaaaacaaaaacaaaaaaaaaccctttttttaaattaaaaatcagatctacccaaatggtctacatttggacccacaaaccgggtacccaggttaccaggcgagacaactgcagttatacctctcagaagcccacaagatttgaaagaaaaaaaaaaaagcctcaggggtttcggtgaatgttgtgtggacttccgtgagacagacgtttgatgtgaactgagttcaaggctgatacagcccagaaccaggacaaggagagaactgctcgtttccgggagcagacttcctaccgggagcactgcagtcacttctgaacaggatattatcaactcactggtaacaacagtattcatgctcatcgtatctgtgttggcactgataccagaaaccacaacattgacagttggtggaggggtgtttgcacttgtgacagcagtatgctgtcttgccgacggggcccttatttaccggaagcttctgttcaatcccagcggtccttaccagaaaaagcctgtgcatgaaaaaaaagaagttttgtaattttatattactttttagtttgatactaagtattaaacatatttctgtattcttcca

SEQ ID NO: 296041 - DNA, 371 bp, Homo sapiens
tatggatttcagagcccacactgctttattatttttctgctcacttaaattatcttttctctttctataggcaagtatttagaaaacttagcaatgaggagaataagatgatctctgaagtctctccatgttagtattagatgaagcacagggagcaatccgagtaccctagcaagagaggaatctggtgggcagaccacttaaaacttgtgtgaatgacaggagtggggaccatggttagggcagtgacacttgtctttctttccaggtgtttgcacttgtgacagcagtatgctgtcttgccgacggggcccttatttaccggaagcttctgttcaatcccagcggtccttaccagaaaaagcctgtgc

SEQ ID NO: 296042 - DNA, 2670 bp, Homo sapiens
  misc_feature (1934)..(1934): n is a, c, g, or t
  misc_feature (2547)..(2547): n is a, c, g, or t
cctacttcttgggctgtttcagtggcttcttcttgccaccttcgcggccggacatggcgcctgccgccgcttccccagaagttaagtttaaaagtagaaggcaaagaattgaacacactgacatattaattctttgaaaataaatttaaaactcctaacaaccgccatgtcctcatctttaggatggggataatgacagtccctccctccctcatggggctgcgatgatgaataaataggagattctaggtgaagtccaaatccagcacaagctgggaactctgttaagtggccattaccttttttccttggaggcaagggatctgtgctcccaaaattgatctgtgcagtaggaccaaatagtcctgctatagactatttgagtcagtccctcacgtccccatgatggatgactggttggctagggaagcaattctgcatgataaccaacagcatgcatgggctttggattcagacctgagtcgaatcctcaccgtgctgtttatctgcctcatgaacttgtgccagccccttaccctctctgggcctaatgtccctatatgtgaaatgggctcacagggctatagagaggaccagtgaaccaaggactgtcagatcgccagaacttaggacacatgggatggagattctaatcagggctcctgtgggtggaggattacccaggtgccgaggcaagagactgaaggcacaaactgtttcagtataataaagaaaatggttagaataagaatagtcataatacaaattagatatagagatgatcatggacaattatcaatcattattataaacattattaatcattagcttttaatattactctttgttgcattactaatataacctaggaataaccggtgggtatagggtcaggtgctgaagggacattgggagaagtgacctagaaggcaagaggtgagtcttctgtcacgcccgcataagggttgcttgagggctccttggtcaagtggtaacgccggtgtctgggaaggcacctgttacttagccgaccacgaaagggagtctcctttccttggaggagtcagggcacactctgctccaccagcttcttgtggaaggctggatattatccaggcctgcccgcagtcatccggaggcctaaacccctccctgtggtgctgtgcttcaatgggcacactcctcgtccactttcatgttcctcccatactcctggttcctctttgaagttcgtagtagatagtggtagaaggaatagggaaaatcttaaagtgtttgatctttcttataagtgcatagaagaaaacgctgacatatgctgccttctctgtctgcttcagctacctaagagggaagggccccctgtccagtgatcacgtgacttgcttcaccttgtcaatcacttagaagattcaccctccttaccctgcccccttgtcttgtatgcaataaatatcagtgcacccagcctttcggggccacttaccggtctccacgtcttggtggtagtggtcccccgggcccagctgttttctctttatctctttgtcttgtgtcttatttattacaatctctcgtctccgcacacagggagaacacccgctaagctccgtagggctggaccctacaggctccagagcatgccttccaagcacgtagccctttacctcttggggaagggagcagaagtccatgcgggcttcctgcaggcatcctcagtccacacttacctgctctcatgaggctttcaggcgtttgggggaagccctgcgtggtgagtgagggggagagagaagagaaggctgcatctccagagaaggacgagacacgcatcagagtcacttcctggggggcctcagagccgagtgtggctgggaagatgacattagctgacctaccttgtgtcaggcactgtgttgacctccttccctgcngggatgacttctgcactttgccgtcaggagccatagcatctttgtcatagccttgggagccaggctggtatgagttcaaacacccatgccacaattcctggtcatgggcagctcacccaatctctcagagccgccctcctccctgggagggggtctgttcacctcctccatcaccgtcagaggttcctgcaaggtcctatgggtggggggccattgtcccctgggaggtctgcctctcccatcaggccctacccccaattctttttcaggcctcagggacactcagccctggggctccgtccccctgctgtaatcagtcactttcttccttttgtagatgctttgcttattgttcgtccccaagttccgccaaactgtggcctctgaggagctcaaaacaagctgattgatgacatccaccaccacccctgcccgcccccccccccaaagcttccttcctgagaccaagccagggtattgctcaccctctgtgccagaaggtggattaagctacttatacgtagtctagcttttttcttgtaggtcaggatgtaagtgagagaccttgggaccagcaaacattttgcccagctgttggggtgtgaagaacatntcttcagtccaggagcaagaacagtgttgctccaggggaacttgggccagtgggtctattgtgccaaaaatgctgaccttcaggccccgcaggtgctctcctggggctgaagttgggagcagc

SEQ ID NO: 296043 - DNA, 491 bp, Homo sapiens
gatcgcacaagtggctgcaaccaggctctaggagggagaaagagcggatcccccaaccccctccgcccgcccgccccccgcgagacgcggcgccgcgcagggtcctagtgcccgctgtgcgaagggttcctgaatctggccacttcgctgggaggccctgggctccccagtgccacccgaagggcctgaggaggccatctgcaggatcattctggctgctgggcgaaggttcaactaaagaatggcaagagtagaagctggaaatctaattaggaggctcctgcagaccccaagctggggggtgatgacagccagactagagtggtggcagttgtctgattccagttaggttttgaaagtgaaaccatcaggacccactgatggatcggatgtgacacgtgaccataagagtgaagtcaaggagaaatcctggcaattcacacactgctggtgggagtgtagttaggcaaaaactactttgggaaactatt

SEQ ID NO: 296044 - DNA, 3344 bp, Homo sapiens
acatagagataaagggaatgaactataaagacactggcatctctgtttcccacaaatcaagacattcatgaaattaatgactaacttacaatgaattttttagaggtgtgtctcataaggaaaaacctggatgatatggaccccgcaggtgattgggggcgtagcctggagtgagggtttggctggtgtagcttggagtgaggccccctggcgtggagtcttgaggcctgctgagggcgtgagctggcatgaggcgaagagagggccatggcaccgactccgagatgggtcaaggacccgtacgggagtcgcaatcctcagaccctcccgcgctccagttccggataagcgagtataagccgctgaacatggcgggagtggagcagcccccgagccccgagctgcggcaggaaggcgtgaccgaatacgaagatggcggggccccggcgggagatggcgaggcgggcccccaacaggcggaggaccacccccagaatcctccagaagatcccaatcaggaccccccagaggatgatagcacctgtcagtgccaggcgtgcgggcctcaccaagccgcgggtccagatcttggttcctctaatgatggctgccctcagctgttccaggagcggtcagtcatagtggagaactcctcaggctctaccagcgcttctgagctcctcaaacccatgaagaagaggaagcgcagggaataccagagcccatcagaggaggagtcggagccagaggccatggagaagcaagaagaaggaaaggacccagagggacaacccactgctagcaccccagagagtgaggagtggagcagcagccagcctgcaacaggtgagaagaaggaatgctggtcgtgggagtcctacctagaggagcagaaggccattactgctccagtcagcctcttccaggactcccaggcagtcactcacaacaagaatggcttcaaactgggcatgaagttggaaggcattgaccctcaacacccgtccatgtacttcatcctcaccgtggctgaggtatgtggctatcgcctacgcctgcactttgatgggtattctgagtgccatgacttctgggtcaatgccaactcccctgacattcaccctgctggctggttcgagaagacgggccacaagctgcagcctcccaaaggttacaaggaggaggagttcagctggagccagtacctgcgcagcacaagagctcaggctgcccccaagcacctgtttgtgagccagagccacagtcccccacccctgggcttccaggtgggcatgaagctggaggctgttgaccgcatgaacccgtcccttgtctgcgtggccagtgtgaccgatgtggtggacagccgcttcctggtgcactttgacaactgggatgatacttatgactactggtgtgatcccagcagcccctacatccacccagtgggctggtgccagaagcaaggaaagcccctcacccctccacaagactacccagaccctgataacttctgttgggagaaatatctggaagaaactggggcctctgctgtccccacctgggccttcaaggtgcgaccccctcacagcttcctggtcaatatgaagctggaggctgtggaccgcaggaacccagccctgattcgcgtggccagcgtggaggatgtggaggaccatcggataaagatccactttgatggctggagtcatggctatgatttctggatcgacgctgaccacccagacatccaccctgccggctggtgctccaagacaggacatcccctgcagcctcctctcggacccagagagcccagctctgcctcccctgggggctgtccccctctcagctataggagcctgccccacactaggacctccaaatacagctttcaccaccggaagtgccccactcctggttgcgacggctctggccatgtcacaggcaagttcacagctcaccattgcctctcaggctgcccactggctgagaggaaccagagccggctgaaagcggagctgtctgactcggaggcctcagcccgcaagaagaacctctcaggcttctccccaaggaagaagcctcgccatcacggccgaattggacgccctccgaagtatcgaaagattccgcaggaagatttccagaccctcacgcccgatgtcgtgcaccagtccctcttcatgtcagccctgtcggcccaccctgaccgctcactctcagtgtgctgggagcagcactgcaagctcctgccaggagtagcgggcatctcagcctcgacagtcgccaagtggaccatcgatgaggtcttcggctttgttcagaccctgacaggttgtgaggaccaagcacgcctcttcaaagacgaggcaagaatagtcagagtgacccatgtatctgggaagactctagtctggactgtggcccagcttggggaccttgtgtgctcagatcatcttcaggaaggaaaaggcatcctggagacaggagtccattcactcctctgctctctacccactcatttgcttgccaaacttagctttgccagtgatagtcaatattaaagtgtacttttttcccctttaatccaatatagttgataattaaagtgtattttgaatgacacagatattgtgatttactgcaaggatcctaacacacacttaaaatcaagagccaaggagtagtgagttgtagataaaaaaagaatgtcagctttggagacagtctgggtttaaatcccagttctgtcaatttgagctgtttactgtctctgagcctacatcttcttgtctgtaaaatggagataaaatgggtttaatgaggtctaccttgcagagccattgtgagcattggaaatgatgaatgaatcataccagaacgtctagtataattacagtcatgcattgcttaacgatggggatacattcttagaaatgtgtcactaggcaattctgtcattgtgtaaacattatagaatgtacttacacaaacctagatgttatatgtatttttatttacatgtatattttcacatgaaataccaaatgtcacagcattattactgaatgtcagtcatttcccctacttgatctgcaatgccaatatcaagggccatgtatcaggtttctgtatatgttccactataatcttatgggaccatggttttaaatgtggaatcattgacagaaatgtctttatgtagcatatggctgtgtatcactagtatataatagagcaatattatggaggaatatgtagatccaatcactttacctatacaaaatgactgctatggtgggaacacaataaacaccagttttgacttttaaaaaaaaatt

SEQ ID NO: 296045 - DNA, 5207 bp, Homo sapiens
  misc_feature (2735)..(2735): n is a, c, g, or t
acatagagataaagggaatgaactataaagacactggcatctctgtttcccacaaatcaagacattcatgaaattaatgactaacttacaatgaattttttagaggtgtgtctcataaggaaaaacctggatgatatggaccccgcaggtgattgggggcgtagcctggagtgagggtttggctggtgtagcttggagtgaggccccctggcgtggagtcttgaggcctgctgagggcgtgagctggcatgaggcgaagagagggccatggcaccgactccgagatgggtcaaggacccgtacgggagtcgcaatcctcagaccctcccgcgctccagttccggataagcgagtataagccgctgaacatggcgggagtggagcagcccccgagccccgagctgcggcaggaaggcgtgaccgaatacgaagatggcggggccccggcgggagatggcgaggcgggcccccaacaggcggaggaccacccccagaatcctccagaagatcccaatcaggaccccccagaggatgatagcacctgtcagtgccaggcgtgcgggcctcaccaagccgcgggtccagatcttggttcctctaatgatggctgccctcagctgttccaggagcggtcagtcatagtggagaactcctcaggctctaccagcgcttctgagctcctcaaacccatgaagaagaggaagcgcagggaataccagagcccatcagaggaggagtcggagccagaggccatggagaagcaagaagaaggaaaggacccagagggacaacccactgctagcaccccagagagtgaggagtggagcagcagccagcctgcaacaggtgagaagaaggaatgctggtcgtgggagtcctacctagaggagcagaaggccattactgctccagtcagcctcttccaggactcccaggcagtcactcacaacaagaatggcttcaaactgggcatgaagttggaaggcattgaccctcaacacccgtccatgtacttcatcctcaccgtggctgaggtatgtggctatcgcctacgcctgcactttgatgggtattctgagtgccatgacttctgggtcaatgccaactcccctgacattcaccctgctggctggttcgagaagacgggccacaagctgcagcctcccaaaggttacaaggaggaggagttcagctggagccagtacctgcgcagcacaagagctcaggctgcccccaagcacctgtttgtgagccagagccacagtcccccacccctgggcttccaggtgggcatgaagctggaggctgttgaccgcatgaacccgtcccttgtctgcgtggccagtgtgaccgatgtggtggacagccgcttcctggtgcactttgacaactgggatgatacttatgactactggtgtgatcccagcagcccctacatccacccagtgggctggtgccagaagcaaggaaagcccctcacccctccacaagactacccagaccctgataacttctgttgggagaaatatctggaagaaactggggcctctgctgtccccacctgggccttcaaggtgcgaccccctcacagcttcctggtcaatatgaagctggaggctgtggaccgcaggaacccagccctgattcgcgtggccagcgtggaggatgtggaggaccatcggataaagatccactttgatggctggagtcatggctatgatttctggatcgacgctgaccacccagacatccaccctgccggctggtgctccaagacaggacatcccctgcagcctcctctcggacccagagagcccagctctgcctcccctgggggctgtccccctctcagctataggagcctgccccacactaggacctccaaatacagctttcaccaccggaagtgccccactcctggttgcgacggctctggccatgtcacaggcaagttcacagctcaccattgcctctcaggctgcccactggctgagaggaaccagagccggctgaaagcggagctgtctgactcggaggcctcagcccgcaagaagaacctctcaggcttctccccaaggaagaagcctcgccatcacggccgaattggacgccctccgaagtatcgaaagattccgcaggaagatttccagaccctcacgcccgatgtcgtgcaccagtccctcttcatgtcagccctgtcggcccaccctgaccgctcactctcagtgtgctgggagcagcactgcaagctcctgccaggagtagcgggcatctcagcctcgacagtcgccaagtggaccatcgatgaggtcttcggctttgttcagaccctgacaggttgtgaggaccaagcacgcctcttcaaagacgagatgattgacggcgaggccttccttttgctgacacaggcggacattgtgaagatcatgagcgtcaagctgggcccagccttgaagatctataacgccattctcatgttcaaaaacgctgatgacaccttaaagtgactggcccagggctgggccctcctgcagcccctgcttggcctccctctccagctgatgctttcttcctgacctgaattcctcataccccacacgtccccatgctccacctatatctgaccaggctggtccttcttagagggtgcatgggagctgaggagccctggggagggtaggcacccagccccaagtcctagagctcattcgtcaccaggcatgttggtgagggcntgactggcaggggcattactcatggagtcagttggactgtggcagccccacagccccagtggacttttattgtattaccaaagggtctttttcttggcagtggaggagagactagtagagcagcagtccttcaatctgaggcccctttcccttttttggtatctctgtgtacttttctctccttggctcctttcctcctgccaagaagtgaccccaccacaaatgtatttactcctggaggtacctcctctctttctgtctgctggttttgctgccctcattctgctgcttcgtttcctgggcagtgcccccagccagaccccactggctcttccccctgagatatgtgaacctcggaaacatgttttcctaagatcccttggaagtctctagctgcctttctctcttttgcccagaattgagagattttgagccaagatgccttcctgaacttacccagttctggaccagttggcattttagtgtcccacgccaagtccaagtttcagcagaatgagcaggtggtttgagcctgttttatagatggcagaggttgaggttccactgctgttttccatacacccttcatgtgttgagtctgggaaggagtaagcctagcctgccagtagcctaggttaggagaccagcataaggatttgttagacaatctcgggtctttggccagaggggcagctccagcaggcatagtggtgcctgaagttaggaatactgtactctctgtagctttggacctcagccaaggtattgcccatggggtgatggctccaggcctgccaggccttctgccatgagaatgtagcactctgtgtagcacacacccccatgacatcatttaacctgtcccttaaatgttgaccattagctcttgcagcgtcttacaaagacgacttgaagttgggagttaggaaggtgaacttttctatctgaattctccgggtccctgaagccctccttgccgctctccatctgtcttgcactgccagctgggtccctgctggggctctgggacttccacttctcagtccacataggaacccagcttccactgagtcactgccaaacctgcctcccagcctgggtgggaagggggagagccactggtaggagccagccccacatggaggtgaggagccactgccaacctcccgtgtccaggtgctgatgtgggcctgcggagtgtggggctggtgccttcacccagaccccttcaatcatgtgatgtgtgtgtgtgtgcatgtgtgtgtgtgtgtgtgtgtggcactctcagaagtgtttgacagggtgcagatgtgaggcttagtgttgggaaaatgccaagggctattatcattaaaatttgaagctttatttttcccttagaagtgggaaacccagagctctgttgatttcctaccacaacccagtaggggcctctctctgccatgggctggacagctttttgaggaagccattcagctcccacagttgagctcccacagggctttaggtgtccattccctctcaactgcttagaggcagctttgagcacagccttcctggaaggaagctaggcaagacctgccacacagcgaaggttgggtttacaagggtgacattggtacccccttggccaagagtaaagaagaacaagtctaagccttgcttttatcttagttgtctgggtggtagcagaactcatcagctccttatcctcagtctgttcctctataaaagatgagagatgttcactgactttgtgcagtgagaaggcagcaagtactcacggctggtgctgtgggacctcacagcttctaaggagaggggctgggagggcctttgccatcagatctgccaagcacctaatgcttgcctgtggtgaaggcaagatggaccaagggccttggagaaaagggctcccaggcttctgaactttgaggcctcagcactttctgcattatcgtcaaactctttggaaagaaaccaaatcattaaaaagtagaaagaaatctgcctcttgtctgccctactgcccctttacccccactctgtccccaaatgatattattgcaccttgacctgggagcgcagagaggggagggagttggcagagacttctggtgccctctgccctcctagcaacagatgccacttatattttggcccctggcagcctcgcccagcccctgatcagcccaggcctagggcagttaggacctttctgtttattttctgaagcagagagaatgatctcagagtttgcaaatgaagccttttttgcactttcattcacatgcactttggtggggttacatttttgtacttgcctcttgtgtgtgcacatgtgtgtatgtgttctttaagagaatcttctggcttaagctaaggtgactcttgaaggagaaaaagttacaaacaaaatgtggtgtgatctgtcagtgtatcaaaacaacataaataaacttgaacaactga

SEQ ID NO: 296046 - DNA, 5453 bp, Homo sapiens
  misc_feature (2981)..(2981): n is a, c, g, or t
gggggctatgtttggcttgtaggcctgccaggatggaggggcatgctgggatggaggggcatgctgaaatggagatgctgaggacactgaaggggccttccacaggggaggtcagcatgcacttggtggccggagacagccccggttctggtcctcacctgcccgcaactgccttcatcattccagccagttcggccaccctcggcctgcccagcagtgccctggatgtgtcttgctttccccgggagccaatccatgtgggtgccccggagcaagtggccggctgcgaaccagtttctgccaccgtcctgccgcagcttagcgccgggccggccagctccagcaccagcacagtgcggcttctggaatggacagaggccgcggccccgcccccagggggcggcctgcggttccggataagcgagtataagccgctgaacatggcgggagtggagcagcccccgagccccgagctgcggcaggaaggcgtgaccgaatacgaagatggcggggccccggcgggagatggcgaggcgggcccccaacaggcggaggaccacccccagaatcctccagaagatcccaatcaggaccccccagaggatgatagcacctgtcagtgccaggcgtgcgggcctcaccaagccgcgggtccagatcttggttcctctaatgatggctgccctcagctgttccaggagcggtcagtcatagtggagaactcctcaggctctaccagcgcttctgagctcctcaaacccatgaagaagaggaagcgcagggaataccagagcccatcagaggaggagtcggagccagaggccatgtgatagggggatgtctgctggagctgcactcctgctggcggcctagaagaaattctgcctgtttggggcagaacaccacatggccagagagccaggtaggggccaggatcagaccctagggcttcatcccaaaccatgaggagaagaagctgggatcaggcttgccttctacaggagaagcaagaagaaggaaaggacccagagggacaacccactgctagcaccccagagagtgaggagtggagcagcagccagcctgcaacaggtgagaagaaggaatgctggtcgtgggagtcctacctagaggagcagaaggccattactgctccagtcagcctcttccaggactcccaggcagtcactcacaacaagaatggcttcaaactgggcatgaagttggaaggcattgaccctcaacacccgtccatgtacttcatcctcaccgtggctgaggtatgtggctatcgcctacgcctgcactttgatgggtattctgagtgccatgacttctgggtcaatgccaactcccctgacattcaccctgctggctggttcgagaagacgggccacaagctgcagcctcccaaaggttacaaggaggaggagttcagctggagccagtacctgcgcagcacaagagctcaggctgcccccaagcacctgtttgtgagccagagccacagtcccccacccctgggcttccaggtgggcatgaagctggaggctgttgaccgcatgaacccgtcccttgtctgcgtggccagtgtgaccgatgtggtggacagccgcttcctggtgcactttgacaactgggatgatacttatgactactggtgtgatcccagcagcccctacatccacccagtgggctggtgccagaagcaaggaaagcccctcacccctccacaagactacccagaccctgataacttctgttgggagaaatatctggaagaaactggggcctctgctgtccccacctgggccttcaaggtgcgaccccctcacagcttcctggtcaatatgaagctggaggctgtggaccgcaggaacccagccctgattcgcgtggccagcgtggaggatgtggaggaccatcggataaagatccactttgatggctggagtcatggctatgatttctggatcgacgctgaccacccagacatccaccctgccggctggtgctccaagacaggacatcccctgcagcctcctctcggacccagagagcccagctctgcctcccctgggggctgtccccctctcagctataggagcctgccccacactaggacctccaaatacagctttcaccaccggaagtgccccactcctggttgcgacggctctggccatgtcacaggcaagttcacagctcaccattgcctctcaggctgcccactggctgagaggaaccagagccggctgaaagcggagctgtctgactcggaggcctcagcccgcaagaagaacctctcaggcttctccccaaggaagaagcctcgccatcacggccgaattggacgccctccgaagtatcgaaagattccgcaggaagatttccagaccctcacgcccgatgtcgtgcaccagtccctcttcatgtcagccctgtcggcccaccctgaccgctcactctcagtgtgctgggagcagcactgcaagctcctgccaggagtagcgggcatctcagcctcgacagtcgccaagtggaccatcgatgaggtcttcggctttgttcagaccctgacaggttgtgaggaccaagcacgcctcttcaaagacgagatgattgacggcgaggccttccttttgctgacacaggcggacattgtgaagatcatgagcgtcaagctgggcccagccttgaagatctataacgccattctcatgttcaaaaacgctgatgacaccttaaagtgactggcccagggctgggccctcctgcagcccctgcttggcctccctctccagctgatgctttcttcctgacctgaattcctcataccccacacgtccccatgctccacctatatctgaccaggctggtccttcttagagggtgcatgggagctgaggagccctggggagggtaggcacccagccccaagtcctagagctcattcgtcaccaggcatgttggtgagggcntgactggcaggggcattactcatggagtcagttggactgtggcagccccacagccccagtggacttttattgtattaccaaagggtctttttcttggcagtggaggagagactagtagagcagcagtccttcaatctgaggcccctttcccttttttggtatctctgtgtacttttctctccttggctcctttcctcctgccaagaagtgaccccaccacaaatgtatttactcctggaggtacctcctctctttctgtctgctggttttgctgccctcattctgctgcttcgtttcctgggcagtgcccccagccagaccccactggctcttccccctgagatatgtgaacctcggaaacatgttttcctaagatcccttggaagtctctagctgcctttctctcttttgcccagaattgagagattttgagccaagatgccttcctgaacttacccagttctggaccagttggcattttagtgtcccacgccaagtccaagtttcagcagaatgagcaggtggtttgagcctgttttatagatggcagaggttgaggttccactgctgttttccatacacccttcatgtgttgagtctgggaaggagtaagcctagcctgccagtagcctaggttaggagaccagcataaggatttgttagacaatctcgggtctttggccagaggggcagctccagcaggcatagtggtgcctgaagttaggaatactgtactctctgtagctttggacctcagccaaggtattgcccatggggtgatggctccaggcctgccaggccttctgccatgagaatgtagcactctgtgtagcacacacccccatgacatcatttaacctgtcccttaaatgttgaccattagctcttgcagcgtcttacaaagacgacttgaagttgggagttaggaaggtgaacttttctatctgaattctccgggtccctgaagccctccttgccgctctccatctgtcttgcactgccagctgggtccctgctggggctctgggacttccacttctcagtccacataggaacccagcttccactgagtcactgccaaacctgcctcccagcctgggtgggaagggggagagccactggtaggagccagccccacatggaggtgaggagccactgccaacctcccgtgtccaggtgctgatgtgggcctgcggagtgtggggctggtgccttcacccagaccccttcaatcatgtgatgtgtgtgtgtgtgcatgtgtgtgtgtgtgtgtgtgtggcactctcagaagtgtttgacagggtgcagatgtgaggcttagtgttgggaaaatgccaagggctattatcattaaaatttgaagctttatttttcccttagaagtgggaaacccagagctctgttgatttcctaccacaacccagtaggggcctctctctgccatgggctggacagctttttgaggaagccattcagctcccacagttgagctcccacagggctttaggtgtccattccctctcaactgcttagaggcagctttgagcacagccttcctggaaggaagctaggcaagacctgccacacagcgaaggttgggtttacaagggtgacattggtacccccttggccaagagtaaagaagaacaagtctaagccttgcttttatcttagttgtctgggtggtagcagaactcatcagctccttatcctcagtctgttcctctataaaagatgagagatgttcactgactttgtgcagtgagaaggcagcaagtactcacggctggtgctgtgggacctcacagcttctaaggagaggggctgggagggcctttgccatcagatctgccaagcacctaatgcttgcctgtggtgaaggcaagatggaccaagggccttggagaaaagggctcccaggcttctgaactttgaggcctcagcactttctgcattatcgtcaaactctttggaaagaaaccaaatcattaaaaagtagaaagaaatctgcctcttgtctgccctactgcccctttacccccactctgtccccaaatgatattattgcaccttgacctgggagcgcagagaggggagggagttggcagagacttctggtgccctctgccctcctagcaacagatgccacttatattttggcccctggcagcctcgcccagcccctgatcagcccaggcctagggcagttaggacctttctgtttattttctgaagcagagagaatgatctcagagtttgcaaatgaagccttttttgcactttcattcacatgcactttggtggggttacatttttgtacttgcctcttgtgtgtgcacatgtgtgtatgtgttctttaagagaatcttctggcttaagctaaggtgactcttgaaggagaaaaagttacaaacaaaatgtggtgtgatctgtcagtgtatcaaaacaacataaataaacttgaacaactga

SEQ ID NO: 296047 - DNA, 4629 bp, Homo sapiens
  misc_feature (1890)..(1890): n is a, c, g, or t
acatagagataaagggaatgaactataaagacactggcatctctgtttcccacaaatcaagacattcatgaaattaatgactaacttacaatgaattttttagaggtgtgtctcataaggaaaaacctggatgatatggaccccgcaggtgattgggggcgtagcctggagtgagggtttggctggtgtagcttggagtgaggccccctggcgtggagtcttgaggcctgctgagggcgtgagctggcatgaggcgaagagagggccatggcaccgactccgagatgggtcaaggacccgtacgggagtcgcaatcctcagaccctcccgcgctccagttccggataagcgagtataagccgctgaacatggcgggagtggagcagcccccgagccccgagctgcggcaggaaggcgtgaccgaatacgaagatggcggggccccggcgggagatggcgaggcgggcccccaacaggcggaggaccacccccagaatcctccagaagatcccaatcaggaccccccagaggatgatagcacctgtcagtgccaggcgtgcgggcctcaccaagccgcgggtccagatcttggttcctctaatgatggctgccctcagctgttccaggagcggtcagtcatagtggagaactcctcaggctctaccagcgcttctgagctcctcaaacccatgaagaagaggaagcgcagggaataccagagcccatcagaggaggagtcggagccagaggccatggagaagcaagaagaaggaaaggacccagagggacaacccactgctagcaccccagagagtgaggagtggagcagcagccagcctgcaacaggtgagaagaaggaatgctggtcgtgggagtcctacctagaggagcagaaggccattactgctccagtcagcctcttccaggactcccaggcagtcactcacaacaagaatggcttcaaactgggcatgaagttggaaggcattgaccctcaacacccgtccatgtacttcatcctcaccgtggctgaggtatgtggctatcgcctacgcctgcactttgatgggtattctgagtgccatgacttctgggtcaatgccaactcccctgacattcaccctgctggctggttcgagaagacgggccacaagctgcagcctcccaaaggttacaaggaggaggagttcagctggagccagtacctgcgcagcacaagagctcaggctgcccccaagcacctgtttgtgagccagagccacgtgagtgcccctgagtgagagtggatgtcactcccatgtgccagagttcactgcagctggcccagggtatctgactcatcagaagggagctcatgtgctggttctctcagctttgttctgatctctcatatcagatgggaggggtacagctgggcagggtccagggccagagatgggaagctggttataggtttttcccgacttccctccctcctttgctactgcagataccctgtcctcacatccccttggagcccctggcccactaccctagtctgagcactgagatgtcattgctcatatattcttgctttggcttgctctgcagttctttggtgtaaggtcaatgcctctattctgggagcttctttttctttccttttgcccaacattgagactcttccatttatttccaacaattcatcccttgtcctttcctctgttcagggcagctggcagcttatccagcagttaaagtatctcataatcccaaccaaaaggcctaagagatacagggagcctccattaaaaatatcatactggaccaggtgtggcggctcatgcctgtaatcccagcactttgggaggctgaggcgggtggatcacctgaggtcaggagttcaagacnagcctgggcaacatggtgaaacccccatctctactaaaaatataaaaaattagctgggcgtggtggtgggtgtctgtaatcccagttactcaggatgctgaggcaggagaatcgcttgaacctggggggcggaagttgcagtgagccaagatcacgccattgcactccggtctcagcaacaagaacgaaactccgtctcaaaaaaaagaagtatgtatcagtcttactggctgggtgcggtggctcacacctgtaattccagtactttgggaggctgaggcgggaggatcacttgagcccaggagtttgagaccagcgtaggcaacatagtgagaccccatctgtacaaaaaatgtcattaaattattagctgggcatggtgcatgtgcctgtagtcctagataccacagtagctagctgagctgggaggattgtttgagcccaggaattcaaggctacagcaagctatgattgtaccactgtaccccagcctgggcgacagagtgagaccctgtgtctaaagaaaaaaaaccatattgaatgtctagagtttccctgggcccaggactccaccatgctcttcaggcagagacagttactcccctaccccagtccagccccagagttcatacttgcaagttcccaggtgacaggtggggtcctgcctgctgttgtgacaacgaatgccgacttttaattcaaactatttaaatactggccccgccgttgactagcattgtgttctgggccaagtgatttaacttcttaaatgggaatagggttgttgtaaaggtccaaggaggtgatgtcttttgaagcttacatggcaggtactcagtttatactggttccctgtctgcctctatgccatagatgtccgctgtttcttcccagccaccccactgttgccacaactgcctcaggacaagctgggaagggcttgtctgggtagggaagatttatacttggttcaccaggttctttgggcgaacgcatagcctccttccaggcacttaccttctgacacaagccaggcctctgagtgcaccttggaggccagaggttcctgagtgcctcagggctcaggttatgattctgccctggagggccctctttcccagcttatttctccttcctttctcactgcccacaccccaggctttcctagagaacctattcctttgtttgccaatgggctctgggctggtcttagccagcttggccctggccgtggcagctcctttttttcccctagagtcccccacccctgggcttccaggtgggcatgaagctggaggctgttgaccgcatgaacccgtcccttgtctgcgtggccagtgtgaccgatgtggtggacagccgcttcctggtgcactttgacaactgggatgatacttatgactactggtgtgatcccagcagcccctacatccacccagtgggctggtgccagaagcaaggaaagcccctcacccctccacaagactacccagaccctgataacttctgttgggagaaatatctggaagaaactggggcctctgctgtccccacctgggccttcaaggtgcgaccccctcacagcttcctggtcaatatgaagctggaggctgtggaccgcaggaacccagccctgattcgcgtggccagcgtggaggatgtggaggaccatcggataaagatccactttgatggctggagtcatggctatgatttctggatcgacgctgaccacccagacatccaccctgccggctggtgctccaagacaggacatcccctgcagcctcctctcggacccagagagcccagctctgcctcccctgggggctgtccccctctcagctataggagcctgccccacactaggacctccaaatacagctttcaccaccggaagtgccccactcctggttgcgacggctctggccatgtcacaggcaagttcacagctcaccattgcctctcaggctgcccactggctgagaggaaccagagccggctgaaagcggagctgtctgactcggaggcctcagcccgcaagaagaacctctcaggcttctccccaaggaagaagcctcgccatcacggccgaattggacgccctccgaagtatcgaaagattccgcaggaagatttccagaccctcacgcccgatgtcgtgcaccagtccctcttcatgtcagccctgtcggcccaccctgaccgctcactctcagtgtgctgggagcagcactgcaagctcctgccaggagtagcgggcatctcagcctcgacagtcgccaagtggaccatcgatgaggtcttcggctttgttcagaccctgacaggttgtgaggaccaagcacgcctcttcaaagacgaggtaaggtgcaagtgcagagtgggagacagagccggggtcactgtccttaagacggcaggaagcaggtgccctccccagcgtcacttctgctaaggagggacccgtgttgccccaccaggcaagaatagtcagagtgacccatgtatctgggaagactctagtctggactgtggcccagcttggggaccttgtgtgctcagatcatcttcaggaaggaaaaggcatcctggagacaggagtccattcactcctctgctctctacccactcatttgcttgccaaacttagctttgccagtgatagtcaatattaaagtgtacttttttcccctttaatccaatatagttgataattaaagtgtattttgaatgaca

SEQ ID NO: 296048 - DNA, 7519 bp, Homo sapiens
  misc_feature (1890)..(1890): n is a, c, g, or t
  misc_feature (4618)..(4618): n is a, c, g, or t
acatagagataaagggaatgaactataaagacactggcatctctgtttcccacaaatcaagacattcatgaaattaatgactaacttacaatgaattttttagaggtgtgtctcataaggaaaaacctggatgatatggaccccgcaggtgattgggggcgtagcctggagtgagggtttggctggtgtagcttggagtgaggccccctggcgtggagtcttgaggcctgctgagggcgtgagctggcatgaggcgaagagagggccatggcaccgactccgagatgggtcaaggacccgtacgggagtcgcaatcctcagaccctcccgcgctccagttccggataagcgagtataagccgctgaacatggcgggagtggagcagcccccgagccccgagctgcggcaggaaggcgtgaccgaatacgaagatggcggggccccggcgggagatggcgaggcgggcccccaacaggcggaggaccacccccagaatcctccagaagatcccaatcaggaccccccagaggatgatagcacctgtcagtgccaggcgtgcgggcctcaccaagccgcgggtccagatcttggttcctctaatgatggctgccctcagctgttccaggagcggtcagtcatagtggagaactcctcaggctctaccagcgcttctgagctcctcaaacccatgaagaagaggaagcgcagggaataccagagcccatcagaggaggagtcggagccagaggccatggagaagcaagaagaaggaaaggacccagagggacaacccactgctagcaccccagagagtgaggagtggagcagcagccagcctgcaacaggtgagaagaaggaatgctggtcgtgggagtcctacctagaggagcagaaggccattactgctccagtcagcctcttccaggactcccaggcagtcactcacaacaagaatggcttcaaactgggcatgaagttggaaggcattgaccctcaacacccgtccatgtacttcatcctcaccgtggctgaggtatgtggctatcgcctacgcctgcactttgatgggtattctgagtgccatgacttctgggtcaatgccaactcccctgacattcaccctgctggctggttcgagaagacgggccacaagctgcagcctcccaaaggttacaaggaggaggagttcagctggagccagtacctgcgcagcacaagagctcaggctgcccccaagcacctgtttgtgagccagagccacgtgagtgcccctgagtgagagtggatgtcactcccatgtgccagagttcactgcagctggcccagggtatctgactcatcagaagggagctcatgtgctggttctctcagctttgttctgatctctcatatcagatgggaggggtacagctgggcagggtccagggccagagatgggaagctggttataggtttttcccgacttccctccctcctttgctactgcagataccctgtcctcacatccccttggagcccctggcccactaccctagtctgagcactgagatgtcattgctcatatattcttgctttggcttgctctgcagttctttggtgtaaggtcaatgcctctattctgggagcttctttttctttccttttgcccaacattgagactcttccatttatttccaacaattcatcccttgtcctttcctctgttcagggcagctggcagcttatccagcagttaaagtatctcataatcccaaccaaaaggcctaagagatacagggagcctccattaaaaatatcatactggaccaggtgtggcggctcatgcctgtaatcccagcactttgggaggctgaggcgggtggatcacctgaggtcaggagttcaagacnagcctgggcaacatggtgaaacccccatctctactaaaaatataaaaaattagctgggcgtggtggtgggtgtctgtaatcccagttactcaggatgctgaggcaggagaatcgcttgaacctggggggcggaagttgcagtgagccaagatcacgccattgcactccggtctcagcaacaagaacgaaactccgtctcaaaaaaaagaagtatgtatcagtcttactggctgggtgcggtggctcacacctgtaattccagtactttgggaggctgaggcgggaggatcacttgagcccaggagtttgagaccagcgtaggcaacatagtgagaccccatctgtacaaaaaatgtcattaaattattagctgggcatggtgcatgtgcctgtagtcctagataccacagtagctagctgagctgggaggattgtttgagcccaggaattcaaggctacagcaagctatgattgtaccactgtaccccagcctgggcgacagagtgagaccctgtgtctaaagaaaaaaaaccatattgaatgtctagagtttccctgggcccaggactccaccatgctcttcaggcagagacagttactcccctaccccagtccagccccagagttcatacttgcaagttcccaggtgacaggtggggtcctgcctgctgttgtgacaacgaatgccgacttttaattcaaactatttaaatactggccccgccgttgactagcattgtgttctgggccaagtgatttaacttcttaaatgggaatagggttgttgtaaaggtccaaggaggtgatgtcttttgaagcttacatggcaggtactcagtttatactggttccctgtctgcctctatgccatagatgtccgctgtttcttcccagccaccccactgttgccacaactgcctcaggacaagctgggaagggcttgtctgggtagggaagatttatacttggttcaccaggttctttgggcgaacgcatagcctccttccaggcacttaccttctgacacaagccaggcctctgagtgcaccttggaggccagaggttcctgagtgcctcagggctcaggttatgattctgccctggagggccctctttcccagcttatttctccttcctttctcactgcccacaccccaggctttcctagagaacctattcctttgtttgccaatgggctctgggctggtcttagccagcttggccctggccgtggcagctcctttttttcccctagagtcccccacccctgggcttccaggtgggcatgaagctggaggctgttgaccgcatgaacccgtcccttgtctgcgtggccagtgtgaccgatgtggtggacagccgcttcctggtgcactttgacaactgggatgatacttatgactactggtgtgatcccagcagcccctacatccacccagtgggctggtgccagaagcaaggaaagcccctcacccctccacaagactacccagaccctgataacttctgttgggagaaatatctggaagaaactggggcctctgctgtccccacctgggccttcaaggtgcgaccccctcacagcttcctggtcaatatgaagctggaggctgtggaccgcaggaacccagccctgattcgcgtggccagcgtggaggatgtggaggaccatcggataaagatccactttgatggctggagtcatggctatgatttctggatcgacgctgaccacccagacatccaccctgccggctggtgctccaagacaggacatcccctgcagcctcctctcggacccagagagcccagctctgcctcccctgggggctgtccccctctcagctataggagcctgccccacactaggacctccaaatacagctttcaccaccggaagtgccccactcctggttgcgacggctctggccatgtcacaggcaagttcacagctcaccattgcctctcaggctgcccactggctgagaggaaccagagccggctgaaagcggagctgtctgactcggaggcctcagcccgcaagaagaacctctcaggcttctccccaaggaagaagcctcgccatcacggccgaattggacgccctccgaagtatcgaaagattccgcaggaagatttccagaccctcacgcccgatgtcgtgcaccagtccctcttcatgtcagccctgtcggcccaccctgaccgctcactctcagtgtgctgggagcagcactgcaagctcctgccaggagtagcgggcatctcagcctcgacagtcgccaagtggaccatcgatgaggtcttcggctttgttcagaccctgacaggttgtgaggaccaagcacgcctcttcaaagacgagatgattgacggcgaggccttccttttgctgacacaggcggacattgtgaagatcatgagcgtcaagctgggcccagccttgaagatctataacgccattctcatgttcaaaaacgctgatgacaccttaaagtgactggcccagggctgggccctcctgcagcccctgcttggcctccctctccagctgatgctttcttcctgacctgaattcctcataccccacacgtccccatgctccacctatatctgaccaggctggtccttcttagagggtgcatgggagctgaggagccctggggagggtaggcacccagccccaagtcctagagctcattcgtcaccaggcatgttggtgagggcntgactggcaggggcattactcatggagtcagttggactgtggcagccccacagccccagtggacttttattgtattaccaaagggtctttttcttggcagtggaggagagactagtagagcagcagtccttcaatctgaggcccctttcccttttttggtatctctgtgtacttttctctccttggctcctttcctcctgccaagaagtgaccccaccacaaatgtatttactcctggaggtacctcctctctttctgtctgctggttttgctgccctcattctgctgcttcgtttcctgggcagtgcccccagccagaccccactggctcttccccctgagatatgtgaacctcggaaacatgttttcctaagatcccttggaagtctctagctgcctttctctcttttgcccagaattgagagattttgagccaagatgccttcctgaacttacccagttctggaccagttggcattttagtgtcccacgccaagtccaagtttcagcagaatgagcaggtggtttgagcctgttttatagatggcagaggttgaggttccactgctgttttccatacacccttcatgtgttgagtctgggaaggagtaagcctagcctgccagtagcctaggttaggagaccagcataaggatttgttagacaatctcgggtctttggccagaggggcagctccagcaggcatagtggtgcctgaagttaggaatactgtactctctgtagctttggacctcagccaaggtattgcccatggggtgatggctccaggcctgccaggccttctgccatgagaatgtagcactctgtgtagcacacacccccatgacatcatttaacctgtcccttaaatgttgaccattagctcttgcagcgtcttacaaagacgacttgaagttgggagttaggaaggtgaacttttctatctgaattctccgggtccctgaagccctccttgccgctctccatctgtcttgcactgccagctgggtccctgctggggctctgggacttccacttctcagtccacataggaacccagcttccactgagtcactgccaaacctgcctcccagcctgggtgggaagggggagagccactggtaggagccagccccacatggaggtgaggagccactgccaacctcccgtgtccaggtgctgatgtgggcctgcggagtgtggggctggtgccttcacccagaccccttcaatcatgtgatgtgtgtgtgtgtgcatgtgtgtgtgtgtgtgtgtgtggcactctcagaagtgtttgacagggtgcagatgtgaggcttagtgttgggaaaatgccaagggctattatcattaaaatttgaagctttatttttcccttagaagtgggaaacccagagctctgttgatttcctaccacaacccagtaggggcctctctctgccatgggctggacagctttttgaggaagccattcagctcccacagttgagctcccacagggctttaggtgtccattccctctcaactgcttagaggcagctttgagcacagccttcctggaaggaagctaggcaagacctgccacacagcgaaggttgggtttacaagggtgacattggtacccccttggccaagagtaaagaagaacaagtctaagccttgcttttatcttagttgtctgggtggtagcagaactcatcagctccttatcctcagtctgttcctctataaaagatgagagatgttcactgactttgtgcagtgagaaggcagcaagtactcacggctggtgctgtgggacctcacagcttctaaggagaggggctgggagggcctttgccatcagatctgccaagcacctaatgcttgcctgtggtgaaggcaagatggaccaagggccttggagaaaagggctcccaggcttctgaactttgaggcctcagcactttctgcattatcgtcaaactctttggaaagaaaccaaatcattaaaaagtagaaagaaatctgcctcttgtctgccctactgcccctttacccccactctgtccccaaatgatattattgcaccttgacctgggagcgcagagaggggagggagttggcagagacttctggtgccctctgccctcctagcaacagatgccacttatattttggcccctggcagcctcgcccagcccctgatcagcccaggcctagggcagttaggacctttctgtttattttctgaagcagagagaatgatctcagagtttgcaaatgaagccttttttgcactttcattcacatgcactttggtggggttacatttttgtacttgcctcttgtgtgtgcacatgtgtgtatgtgttctttaagagaatcttctggcttaagctaaggtgactcttgaaggagaaaaagttacaaacaaaatgtggtgtgatctgtcagtgtatcaaaacaacataaataaacttgaacaactgatacgcagccagagtctgtttctattttcatgataaaacatccagagaacacaaaatggttatcagtagtggcactactgaagagactaaagtgttctctttgttgttagttaggggtccttatagtttttaaggaaagaaacaaaggataaggataaatgggtatctgtctgcactgaaagtgtaaacagtgggaactcccagagatcggtgtgtaaaagggcctgatccttaacatttgataaatggtcaagggcagaaaattcaatgaaacctgtaatttttaaaataataatatcagctgggcacagtggctcacacctgtaatcctagccactttggagggccaaggagggaggatcacatgaggccaggagttcaagaccatcctgggtaacgtagctagatcctgtctctataaaaaaaaaaa

SEQ ID NO: 296049 - DNA, 3711 bp, Homo sapiens
  misc_feature (1239)..(1239): n is a, c, g, or t
gagatgccagtaacttaatgagtgatgcccttggaaaatgtggtggccaagacagattattgcagggttggccccttggttctttcaatccaggatcttgcttctgacaggtcccagggatggggagaggaccttctggctgagctgggctccatgagaaacgcctgacttccaagagcctttcctccccagatccactttgatggctggagtcatggctatgatttctggatcgacgctgaccacccagacatccaccctgccggctggtgctccaagacaggacatcccctgcagcctcctctcggacccagagagcccagctctgcctcccctgggggctgtccccctctcagctataggagcctgccccacactaggacctccaaatacagctttcaccaccggaagtgccccactcctggttgcgacggctctggccatgtcacaggcaagttcacagctcaccattgcctctcaggctgcccactggctgagaggaaccagagccggctgaaagcggagctgtctgactcggaggcctcagcccgcaagaagaacctctcaggcttctccccaaggaagaagcctcgccatcacggccgaattggacgccctccgaagtatcgaaagattccgcaggaagatttccagaccctcacgcccgatgtcgtgcaccagtccctcttcatgtcagccctgtcggcccaccctgaccgctcactctcagtgtgctgggagcagcactgcaagctcctgccaggagtagcgggcatctcagcctcgacagtcgccaagtggaccatcgatgaggtcttcggctttgttcagaccctgacaggttgtgaggaccaagcacgcctcttcaaagacgagatgattgacggcgaggccttccttttgctgacacaggcggacattgtgaagatcatgagcgtcaagctgggcccagccttgaagatctataacgccattctcatgttcaaaaacgctgatgacaccttaaagtgactggcccagggctgggccctcctgcagcccctgcttggcctccctctccagctgatgctttcttcctgacctgaattcctcataccccacacgtccccatgctccacctatatctgaccaggctggtccttcttagagggtgcatgggagctgaggagccctggggagggtaggcacccagccccaagtcctagagctcattcgtcaccaggcatgttggtgagggcntgactggcaggggcattactcatggagtcagttggactgtggcagccccacagccccagtggacttttattgtattaccaaagggtctttttcttggcagtggaggagagactagtagagcagcagtccttcaatctgaggcccctttcccttttttggtatctctgtgtacttttctctccttggctcctttcctcctgccaagaagtgaccccaccacaaatgtatttactcctggaggtacctcctctctttctgtctgctggttttgctgccctcattctgctgcttcgtttcctgggcagtgcccccagccagaccccactggctcttccccctgagatatgtgaacctcggaaacatgttttcctaagatcccttggaagtctctagctgcctttctctcttttgcccagaattgagagattttgagccaagatgccttcctgaacttacccagttctggaccagttggcattttagtgtcccacgccaagtccaagtttcagcagaatgagcaggtggtttgagcctgttttatagatggcagaggttgaggttccactgctgttttccatacacccttcatgtgttgagtctgggaaggagtaagcctagcctgccagtagcctaggttaggagaccagcataaggatttgttagacaatctcgggtctttggccagaggggcagctccagcaggcatagtggtgcctgaagttaggaatactgtactctctgtagctttggacctcagccaaggtattgcccatggggtgatggctccaggcctgccaggccttctgccatgagaatgtagcactctgtgtagcacacacccccatgacatcatttaacctgtcccttaaatgttgaccattagctcttgcagcgtcttacaaagacgacttgaagttgggagttaggaaggtgaacttttctatctgaattctccgggtccctgaagccctccttgccgctctccatctgtcttgcactgccagctgggtccctgctggggctctgggacttccacttctcagtccacataggaacccagcttccactgagtcactgccaaacctgcctcccagcctgggtgggaagggggagagccactggtaggagccagccccacatggaggtgaggagccactgccaacctcccgtgtccaggtgctgatgtgggcctgcggagtgtggggctggtgccttcacccagaccccttcaatcatgtgatgtgtgtgtgtgtgcatgtgtgtgtgtgtgtgtgtgtggcactctcagaagtgtttgacagggtgcagatgtgaggcttagtgttgggaaaatgccaagggctattatcattaaaatttgaagctttatttttcccttagaagtgggaaacccagagctctgttgatttcctaccacaacccagtaggggcctctctctgccatgggctggacagctttttgaggaagccattcagctcccacagttgagctcccacagggctttaggtgtccattccctctcaactgcttagaggcagctttgagcacagccttcctggaaggaagctaggcaagacctgccacacagcgaaggttgggtttacaagggtgacattggtacccccttggccaagagtaaagaagaacaagtctaagccttgcttttatcttagttgtctgggtggtagcagaactcatcagctccttatcctcagtctgttcctctataaaagatgagagatgttcactgactttgtgcagtgagaaggcagcaagtactcacggctggtgctgtgggacctcacagcttctaaggagaggggctgggagggcctttgccatcagatctgccaagcacctaatgcttgcctgtggtgaaggcaagatggaccaagggccttggagaaaagggctcccaggcttctgaactttgaggcctcagcactttctgcattatcgtcaaactctttggaaagaaaccaaatcattaaaaagtagaaagaaatctgcctcttgtctgccctactgcccctttacccccactctgtccccaaatgatattattgcaccttgacctgggagcgcagagaggggagggagttggcagagacttctggtgccctctgccctcctagcaacagatgccacttatattttggcccctggcagcctcgcccagcccctgatcagcccaggcctagggcagttaggacctttctgtttattttctgaagcagagagaatgatctcagagtttgcaaatgaagccttttttgcactttcattcacatgcactttggtggggttacatttttgtacttgcctcttgtgtgtgcacatgtgtgtatgtgttctttaagagaatcttctggcttaagctaaggtgactcttgaaggagaaaaagttacaaacaaaatgtggtgtgatctgtcagtgtatcaaaacaacataaataaacttgaacaactga

SEQ ID NO: 296050 - DNA, 4091 bp, Homo sapiens
  misc_feature (1619)..(1619): n is a, c, g, or t
tgctgtggcccagcctctgcacggcgctctgttcatgcccctcgaggggcctaggttacaaggaggaggagttcagctggagccagtacctgcgcagcacaagagctcaggctgcccccaagcacctgtttgtgagccagagccacagtcccccacccctgggcttccaggtgggcatgaagctggaggctgttgaccgcatgaacccgtcccttgtctgcgtggccagtgtgaccgatgtggtggacagccgcttcctggtgcactttgacaactgggatgatacttatgactactggtgtgatcccagcagcccctacatccacccagtgggctggtgccagaagcaaggaaagcccctcacccctccacaagactacccagaccctgataacttctgttgggagaaatatctggaagaaactggggcctctgctgtccccacctgggccttcaaggtgcgaccccctcacagcttcctggtcaatatgaagctggaggctgtggaccgcaggaacccagccctgattcgcgtggccagcgtggaggatgtggaggaccatcggataaagatccactttgatggctggagtcatggctatgatttctggatcgacgctgaccacccagacatccaccctgccggctggtgctccaagacaggacatcccctgcagcctcctctcggacccagagagcccagctctgcctcccctgggggctgtccccctctcagctataggagcctgccccacactaggacctccaaatacagctttcaccaccggaagtgccccactcctggttgcgacggctctggccatgtcacaggcaagttcacagctcaccattgcctctcaggctgcccactggctgagaggaaccagagccggctgaaagcggagctgtctgactcggaggcctcagcccgcaagaagaacctctcaggcttctccccaaggaagaagcctcgccatcacggccgaattggacgccctccgaagtatcgaaagattccgcaggaagatttccagaccctcacgcccgatgtcgtgcaccagtccctcttcatgtcagccctgtcggcccaccctgaccgctcactctcagtgtgctgggagcagcactgcaagctcctgccaggagtagcgggcatctcagcctcgacagtcgccaagtggaccatcgatgaggtcttcggctttgttcagaccctgacaggttgtgaggaccaagcacgcctcttcaaagacgagatgattgacggcgaggccttccttttgctgacacaggcggacattgtgaagatcatgagcgtcaagctgggcccagccttgaagatctataacgccattctcatgttcaaaaacgctgatgacaccttaaagtgactggcccagggctgggccctcctgcagcccctgcttggcctccctctccagctgatgctttcttcctgacctgaattcctcataccccacacgtccccatgctccacctatatctgaccaggctggtccttcttagagggtgcatgggagctgaggagccctggggagggtaggcacccagccccaagtcctagagctcattcgtcaccaggcatgttggtgagggcntgactggcaggggcattactcatggagtcagttggactgtggcagccccacagccccagtggacttttattgtattaccaaagggtctttttcttggcagtggaggagagactagtagagcagcagtccttcaatctgaggcccctttcccttttttggtatctctgtgtacttttctctccttggctcctttcctcctgccaagaagtgaccccaccacaaatgtatttactcctggaggtacctcctctctttctgtctgctggttttgctgccctcattctgctgcttcgtttcctgggcagtgcccccagccagaccccactggctcttccccctgagatatgtgaacctcggaaacatgttttcctaagatcccttggaagtctctagctgcctttctctcttttgcccagaattgagagattttgagccaagatgccttcctgaacttacccagttctggaccagttggcattttagtgtcccacgccaagtccaagtttcagcagaatgagcaggtggtttgagcctgttttatagatggcagaggttgaggttccactgctgttttccatacacccttcatgtgttgagtctgggaaggagtaagcctagcctgccagtagcctaggttaggagaccagcataaggatttgttagacaatctcgggtctttggccagaggggcagctccagcaggcatagtggtgcctgaagttaggaatactgtactctctgtagctttggacctcagccaaggtattgcccatggggtgatggctccaggcctgccaggccttctgccatgagaatgtagcactctgtgtagcacacacccccatgacatcatttaacctgtcccttaaatgttgaccattagctcttgcagcgtcttacaaagacgacttgaagttgggagttaggaaggtgaacttttctatctgaattctccgggtccctgaagccctccttgccgctctccatctgtcttgcactgccagctgggtccctgctggggctctgggacttccacttctcagtccacataggaacccagcttccactgagtcactgccaaacctgcctcccagcctgggtgggaagggggagagccactggtaggagccagccccacatggaggtgaggagccactgccaacctcccgtgtccaggtgctgatgtgggcctgcggagtgtggggctggtgccttcacccagaccccttcaatcatgtgatgtgtgtgtgtgtgcatgtgtgtgtgtgtgtgtgtgtggcactctcagaagtgtttgacagggtgcagatgtgaggcttagtgttgggaaaatgccaagggctattatcattaaaatttgaagctttatttttcccttagaagtgggaaacccagagctctgttgatttcctaccacaacccagtaggggcctctctctgccatgggctggacagctttttgaggaagccattcagctcccacagttgagctcccacagggctttaggtgtccattccctctcaactgcttagaggcagctttgagcacagccttcctggaaggaagctaggcaagacctgccacacagcgaaggttgggtttacaagggtgacattggtacccccttggccaagagtaaagaagaacaagtctaagccttgcttttatcttagttgtctgggtggtagcagaactcatcagctccttatcctcagtctgttcctctataaaagatgagagatgttcactgactttgtgcagtgagaaggcagcaagtactcacggctggtgctgtgggacctcacagcttctaaggagaggggctgggagggcctttgccatcagatctgccaagcacctaatgcttgcctgtggtgaaggcaagatggaccaagggccttggagaaaagggctcccaggcttctgaactttgaggcctcagcactttctgcattatcgtcaaactctttggaaagaaaccaaatcattaaaaagtagaaagaaatctgcctcttgtctgccctactgcccctttacccccactctgtccccaaatgatattattgcaccttgacctgggagcgcagagaggggagggagttggcagagacttctggtgccctctgccctcctagcaacagatgccacttatattttggcccctggcagcctcgcccagcccctgatcagcccaggcctagggcagttaggacctttctgtttattttctgaagcagagagaatgatctcagagtttgcaaatgaagccttttttgcactttcattcacatgcactttggtggggttacatttttgtacttgcctcttgtgtgtgcacatgtgtgtatgtgttctttaagagaatcttctggcttaagctaaggtgactcttgaaggagaaaaagttacaaacaaaatgtggtgtgatctgtcagtgtatcaaaacaacataaataaacttgaacaactga

SEQ ID NO: 296051 - DNA, 6854 bp, Homo sapiens
  misc_feature (1890)..(1890): n is a, c, g, or t
  misc_feature (4618)..(4618): n is a, c, g, or t
acatagagataaagggaatgaactataaagacactggcatctctgtttcccacaaatcaagacattcatgaaattaatgactaacttacaatgaattttttagaggtgtgtctcataaggaaaaacctggatgatatggaccccgcaggtgattgggggcgtagcctggagtgagggtttggctggtgtagcttggagtgaggccccctggcgtggagtcttgaggcctgctgagggcgtgagctggcatgaggcgaagagagggccatggcaccgactccgagatgggtcaaggacccgtacgggagtcgcaatcctcagaccctcccgcgctccagttccggataagcgagtataagccgctgaacatggcgggagtggagcagcccccgagccccgagctgcggcaggaaggcgtgaccgaatacgaagatggcggggccccggcgggagatggcgaggcgggcccccaacaggcggaggaccacccccagaatcctccagaagatcccaatcaggaccccccagaggatgatagcacctgtcagtgccaggcgtgcgggcctcaccaagccgcgggtccagatcttggttcctctaatgatggctgccctcagctgttccaggagcggtcagtcatagtggagaactcctcaggctctaccagcgcttctgagctcctcaaacccatgaagaagaggaagcgcagggaataccagagcccatcagaggaggagtcggagccagaggccatggagaagcaagaagaaggaaaggacccagagggacaacccactgctagcaccccagagagtgaggagtggagcagcagccagcctgcaacaggtgagaagaaggaatgctggtcgtgggagtcctacctagaggagcagaaggccattactgctccagtcagcctcttccaggactcccaggcagtcactcacaacaagaatggcttcaaactgggcatgaagttggaaggcattgaccctcaacacccgtccatgtacttcatcctcaccgtggctgaggtatgtggctatcgcctacgcctgcactttgatgggtattctgagtgccatgacttctgggtcaatgccaactcccctgacattcaccctgctggctggttcgagaagacgggccacaagctgcagcctcccaaaggttacaaggaggaggagttcagctggagccagtacctgcgcagcacaagagctcaggctgcccccaagcacctgtttgtgagccagagccacgtgagtgcccctgagtgagagtggatgtcactcccatgtgccagagttcactgcagctggcccagggtatctgactcatcagaagggagctcatgtgctggttctctcagctttgttctgatctctcatatcagatgggaggggtacagctgggcagggtccagggccagagatgggaagctggttataggtttttcccgacttccctccctcctttgctactgcagataccctgtcctcacatccccttggagcccctggcccactaccctagtctgagcactgagatgtcattgctcatatattcttgctttggcttgctctgcagttctttggtgtaaggtcaatgcctctattctgggagcttctttttctttccttttgcccaacattgagactcttccatttatttccaacaattcatcccttgtcctttcctctgttcagggcagctggcagcttatccagcagttaaagtatctcataatcccaaccaaaaggcctaagagatacagggagcctccattaaaaatatcatactggaccaggtgtggcggctcatgcctgtaatcccagcactttgggaggctgaggcgggtggatcacctgaggtcaggagttcaagacnagcctgggcaacatggtgaaacccccatctctactaaaaatataaaaaattagctgggcgtggtggtgggtgtctgtaatcccagttactcaggatgctgaggcaggagaatcgcttgaacctggggggcggaagttgcagtgagccaagatcacgccattgcactccggtctcagcaacaagaacgaaactccgtctcaaaaaaaagaagtatgtatcagtcttactggctgggtgcggtggctcacacctgtaattccagtactttgggaggctgaggcgggaggatcacttgagcccaggagtttgagaccagcgtaggcaacatagtgagaccccatctgtacaaaaaatgtcattaaattattagctgggcatggtgcatgtgcctgtagtcctagataccacagtagctagctgagctgggaggattgtttgagcccaggaattcaaggctacagcaagctatgattgtaccactgtaccccagcctgggcgacagagtgagaccctgtgtctaaagaaaaaaaaccatattgaatgtctagagtttccctgggcccaggactccaccatgctcttcaggcagagacagttactcccctaccccagtccagccccagagttcatacttgcaagttcccaggtgacaggtggggtcctgcctgctgttgtgacaacgaatgccgacttttaattcaaactatttaaatactggccccgccgttgactagcattgtgttctgggccaagtgatttaacttcttaaatgggaatagggttgttgtaaaggtccaaggaggtgatgtcttttgaagcttacatggcaggtactcagtttatactggttccctgtctgcctctatgccatagatgtccgctgtttcttcccagccaccccactgttgccacaactgcctcaggacaagctgggaagggcttgtctgggtagggaagatttatacttggttcaccaggttctttgggcgaacgcatagcctccttccaggcacttaccttctgacacaagccaggcctctgagtgcaccttggaggccagaggttcctgagtgcctcagggctcaggttatgattctgccctggagggccctctttcccagcttatttctccttcctttctcactgcccacaccccaggctttcctagagaacctattcctttgtttgccaatgggctctgggctggtcttagccagcttggccctggccgtggcagctcctttttttcccctagagtcccccacccctgggcttccaggtgggcatgaagctggaggctgttgaccgcatgaacccgtcccttgtctgcgtggccagtgtgaccgatgtggtggacagccgcttcctggtgcactttgacaactgggatgatacttatgactactggtgtgatcccagcagcccctacatccacccagtgggctggtgccagaagcaaggaaagcccctcacccctccacaagactacccagaccctgataacttctgttgggagaaatatctggaagaaactggggcctctgctgtccccacctgggccttcaaggtgcgaccccctcacagcttcctggtcaatatgaagctggaggctgtggaccgcaggaacccagccctgattcgcgtggccagcgtggaggatgtggaggaccatcggataaagatccactttgatggctggagtcatggctatgatttctggatcgacgctgaccacccagacatccaccctgccggctggtgctccaagacaggacatcccctgcagcctcctctcggacccagagagcccagctctgcctcccctgggggctgtccccctctcagctataggagcctgccccacactaggacctccaaatacagctttcaccaccggaagtgccccactcctggttgcgacggctctggccatgtcacaggcaagttcacagctcaccattgcctctcaggctgcccactggctgagaggaaccagagccggctgaaagcggagctgtctgactcggaggcctcagcccgcaagaagaacctctcaggcttctccccaaggaagaagcctcgccatcacggccgaattggacgccctccgaagtatcgaaagattccgcaggaagatttccagaccctcacgcccgatgtcgtgcaccagtccctcttcatgtcagccctgtcggcccaccctgaccgctcactctcagtgtgctgggagcagcactgcaagctcctgccaggagtagcgggcatctcagcctcgacagtcgccaagtggaccatcgatgaggtcttcggctttgttcagaccctgacaggttgtgaggaccaagcacgcctcttcaaagacgagatgattgacggcgaggccttccttttgctgacacaggcggacattgtgaagatcatgagcgtcaagctgggcccagccttgaagatctataacgccattctcatgttcaaaaacgctgatgacaccttaaagtgactggcccagggctgggccctcctgcagcccctgcttggcctccctctccagctgatgctttcttcctgacctgaattcctcataccccacacgtccccatgctccacctatatctgaccaggctggtccttcttagagggtgcatgggagctgaggagccctggggagggtaggcacccagccccaagtcctagagctcattcgtcaccaggcatgttggtgagggcntgactggcaggggcattactcatggagtcagttggactgtggcagccccacagccccagtggacttttattgtattaccaaagggtctttttcttggcagtggaggagagactagtagagcagcagtccttcaatctgaggcccctttcccttttttggtatctctgtgtacttttctctccttggctcctttcctcctgccaagaagtgaccccaccacaaatgtatttactcctggaggtacctcctctctttctgtctgctggttttgctgccctcattctgctgcttcgtttcctgggcagtgcccccagccagaccccactggctcttccccctgagatatgtgaacctcggaaacatgttttcctaagatcccttggaagtctctagctgcctttctctcttttgcccagaattgagagattttgagccaagatgccttcctgaacttacccagttctggaccagttggcattttagtgtcccacgccaagtccaagtttcagcagaatgagcaggtggtttgagcctgttttatagatggcagaggttgaggttccactgctgttttccatacacccttcatgtgttgagtctgggaaggagtaagcctagcctgccagtagcctaggttaggagaccagcataaggatttgttagacaatctcgggtctttggccagaggggcagctccagcaggcatagtggtgcctgaagttaggaatactgtactctctgtagctttggacctcagccaaggtattgcccatggggtgatggctccaggcctgccaggccttctgccatgagaatgtagcactctgtgtagcacacacccccatgacatcatttaacctgtcccttaaatgttgaccattagctcttgcagcgtcttacaaagacgacttgaagttgggagttaggaaggtgaacttttctatctgaattctccgggtccctgaagccctccttgccgctctccatctgtcttgcactgccagctgggtccctgctggggctctgggacttccacttctcagtccacataggaacccagcttccactgagtcactgccaaacctgcctcccagcctgggtgggaagggggagagccactggtaggagccagccccacatggaggtgaggagccactgccaacctcccgtgtccaggtgctgatgtgggcctgcggagtgtggggctggtgccttcacccagaccccttcaatcatgtgatgtgtgtgtgtgtgcatgtgtgtgtgtgtgtgtgtgtggcactctcagaagtgtttgacagggtgcagatgtgaggcttagtgttgggaaaatgccaagggctattatcattaaaatttgaagctttatttttcccttagaagtgggaaacccagagctctgttgatttcctaccacaacccagtaggggcctctctctgccatgggctggacagctttttgaggaagccattcagctcccacagttgagctcccacagggctttaggtgtccatcccctgatcagcccaggcctagggcagttaggacctttctgtttattttctgaagcagagagaatgatctcagagtttgcaaatgaagccttttttgcactttcattcacatgcactttggtggggttacatttttgtacttgcctcttgtgtgtgcacatgtgtgtatgtgttctttaagagaatcttctggcttaagctaaggtgactcttgaaggagaaaaagttacaaacaaaatgtggtgtgatctgtcagtgtatcaaaacaacataaataaacttgaacaactgatacgcagccagagtctgtttctattttcatgataaaacatccagagaacacaaaatggttatcagtagtggcactactgaagagactaaagtgttctctttgttgttagttaggggtccttatagtttttaaggaaagaaacaaaggataaggataaatgggtatctgtctgcactgaaagtgtaaacagtgggaactcccagagatcggtgtgtaaaagggcctgatccttaacatttgataaatggtcaagggcagaaaattcaatgaaacctgtaatttttaaaataataatatcagctgggcacagtggctcacacctgtaatcctagccactttggagggccaaggagggaggatcacatgaggccaggagttcaagaccatcctgggtaacgtagctagatcctgtctctataaaaaaaaaaa

SEQ ID NO: 296052 - DNA, 6049 bp, Homo sapiens
  misc_feature (1890)..(1890): n is a, c, g, or t
  misc_feature (4618)..(4618): n is a, c, g, or t
acatagagataaagggaatgaactataaagacactggcatctctgtttcccacaaatcaagacattcatgaaattaatgactaacttacaatgaattttttagaggtgtgtctcataaggaaaaacctggatgatatggaccccgcaggtgattgggggcgtagcctggagtgagggtttggctggtgtagcttggagtgaggccccctggcgtggagtcttgaggcctgctgagggcgtgagctggcatgaggcgaagagagggccatggcaccgactccgagatgggtcaaggacccgtacgggagtcgcaatcctcagaccctcccgcgctccagttccggataagcgagtataagccgctgaacatggcgggagtggagcagcccccgagccccgagctgcggcaggaaggcgtgaccgaatacgaagatggcggggccccggcgggagatggcgaggcgggcccccaacaggcggaggaccacccccagaatcctccagaagatcccaatcaggaccccccagaggatgatagcacctgtcagtgccaggcgtgcgggcctcaccaagccgcgggtccagatcttggttcctctaatgatggctgccctcagctgttccaggagcggtcagtcatagtggagaactcctcaggctctaccagcgcttctgagctcctcaaacccatgaagaagaggaagcgcagggaataccagagcccatcagaggaggagtcggagccagaggccatggagaagcaagaagaaggaaaggacccagagggacaacccactgctagcaccccagagagtgaggagtggagcagcagccagcctgcaacaggtgagaagaaggaatgctggtcgtgggagtcctacctagaggagcagaaggccattactgctccagtcagcctcttccaggactcccaggcagtcactcacaacaagaatggcttcaaactgggcatgaagttggaaggcattgaccctcaacacccgtccatgtacttcatcctcaccgtggctgaggtatgtggctatcgcctacgcctgcactttgatgggtattctgagtgccatgacttctgggtcaatgccaactcccctgacattcaccctgctggctggttcgagaagacgggccacaagctgcagcctcccaaaggttacaaggaggaggagttcagctggagccagtacctgcgcagcacaagagctcaggctgcccccaagcacctgtttgtgagccagagccacgtgagtgcccctgagtgagagtggatgtcactcccatgtgccagagttcactgcagctggcccagggtatctgactcatcagaagggagctcatgtgctggttctctcagctttgttctgatctctcatatcagatgggaggggtacagctgggcagggtccagggccagagatgggaagctggttataggtttttcccgacttccctccctcctttgctactgcagataccctgtcctcacatccccttggagcccctggcccactaccctagtctgagcactgagatgtcattgctcatatattcttgctttggcttgctctgcagttctttggtgtaaggtcaatgcctctattctgggagcttctttttctttccttttgcccaacattgagactcttccatttatttccaacaattcatcccttgtcctttcctctgttcagggcagctggcagcttatccagcagttaaagtatctcataatcccaaccaaaaggcctaagagatacagggagcctccattaaaaatatcatactggaccaggtgtggcggctcatgcctgtaatcccagcactttgggaggctgaggcgggtggatcacctgaggtcaggagttcaagacnagcctgggcaacatggtgaaacccccatctctactaaaaatataaaaaattagctgggcgtggtggtgggtgtctgtaatcccagttactcaggatgctgaggcaggagaatcgcttgaacctggggggcggaagttgcagtgagccaagatcacgccattgcactccggtctcagcaacaagaacgaaactccgtctcaaaaaaaagaagtatgtatcagtcttactggctgggtgcggtggctcacacctgtaattccagtactttgggaggctgaggcgggaggatcacttgagcccaggagtttgagaccagcgtaggcaacatagtgagaccccatctgtacaaaaaatgtcattaaattattagctgggcatggtgcatgtgcctgtagtcctagataccacagtagctagctgagctgggaggattgtttgagcccaggaattcaaggctacagcaagctatgattgtaccactgtaccccagcctgggcgacagagtgagaccctgtgtctaaagaaaaaaaaccatattgaatgtctagagtttccctgggcccaggactccaccatgctcttcaggcagagacagttactcccctaccccagtccagccccagagttcatacttgcaagttcccaggtgacaggtggggtcctgcctgctgttgtgacaacgaatgccgacttttaattcaaactatttaaatactggccccgccgttgactagcattgtgttctgggccaagtgatttaacttcttaaatgggaatagggttgttgtaaaggtccaaggaggtgatgtcttttgaagcttacatggcaggtactcagtttatactggttccctgtctgcctctatgccatagatgtccgctgtttcttcccagccaccccactgttgccacaactgcctcaggacaagctgggaagggcttgtctgggtagggaagatttatacttggttcaccaggttctttgggcgaacgcatagcctccttccaggcacttaccttctgacacaagccaggcctctgagtgcaccttggaggccagaggttcctgagtgcctcagggctcaggttatgattctgccctggagggccctctttcccagcttatttctccttcctttctcactgcccacaccccaggctttcctagagaacctattcctttgtttgccaatgggctctgggctggtcttagccagcttggccctggccgtggcagctcctttttttcccctagagtcccccacccctgggcttccaggtgggcatgaagctggaggctgttgaccgcatgaacccgtcccttgtctgcgtggccagtgtgaccgatgtggtggacagccgcttcctggtgcactttgacaactgggatgatacttatgactactggtgtgatcccagcagcccctacatccacccagtgggctggtgccagaagcaaggaaagcccctcacccctccacaagactacccagaccctgataacttctgttgggagaaatatctggaagaaactggggcctctgctgtccccacctgggccttcaaggtgcgaccccctcacagcttcctggtcaatatgaagctggaggctgtggaccgcaggaacccagccctgattcgcgtggccagcgtggaggatgtggaggaccatcggataaagatccactttgatggctggagtcatggctatgatttctggatcgacgctgaccacccagacatccaccctgccggctggtgctccaagacaggacatcccctgcagcctcctctcggacccagagagcccagctctgcctcccctgggggctgtccccctctcagctataggagcctgccccacactaggacctccaaatacagctttcaccaccggaagtgccccactcctggttgcgacggctctggccatgtcacaggcaagttcacagctcaccattgcctctcaggctgcccactggctgagaggaaccagagccggctgaaagcggagctgtctgactcggaggcctcagcccgcaagaagaacctctcaggcttctccccaaggaagaagcctcgccatcacggccgaattggacgccctccgaagtatcgaaagattccgcaggaagatttccagaccctcacgcccgatgtcgtgcaccagtccctcttcatgtcagccctgtcggcccaccctgaccgctcactctcagtgtgctgggagcagcactgcaagctcctgccaggagtagcgggcatctcagcctcgacagtcgccaagtggaccatcgatgaggtcttcggctttgttcagaccctgacaggttgtgaggaccaagcacgcctcttcaaagacgagatgattgacggcgaggccttccttttgctgacacaggcggacattgtgaagatcatgagcgtcaagctgggcccagccttgaagatctataacgccattctcatgttcaaaaacgctgatgacaccttaaagtgactggcccagggctgggccctcctgcagcccctgcttggcctccctctccagctgatgctttcttcctgacctgaattcctcataccccacacgtccccatgctccacctatatctgaccaggctggtccttcttagagggtgcatgggagctgaggagccctggggagggtaggcacccagccccaagtcctagagctcattcgtcaccaggcatgttggtgagggcntgactggcaggggcattactcatggagtcagttggactgtggcagccccacagccccagtggacttttattgtattaccaaagggtctttttcttggcagtggaggagagactagtagagcagcagtccttcaatctgaggcccctttcccttttttggtatctctgtgtacttttctctccttggctcctttcctcctgccaagaagtgaccccaccacaaatgtatttactcctggaggtacctcctctctttctgtctgctggttttgctgccctcattctgctgcttcgtttcctgggcagtgcccccagccagaccccactggctcttccccctgagatatgtgaacctcggaaacatgttttcctaagatcccttggaagtctctagctgcctttctctcttttgcccagaattgagagattttgagccaagatgccttcctgaacttacccagttctggaccagttggcattttagtgtcccacgccaagtccaagtttcagcagaatgagcaggtggtttgagcctgttttatagatggcagaggttgaggttccactgctgttttccatacacccttcatgtgttgagtctgggaaggagtaagcctagcctgccagtagcctaggttaggagaccagcataaggatttgttagacaatctcgggtctttggccagaggggcagctccagcaggcatagtggtgcctgaagttaggaatactgtactctctgtagctttggacctcagccaaggtattgcccatggggtgatggctccaggcctgccaggccttctgccatgagaatgtagcactctgtgtagcacacacccccatgacatcatttaacctgtcccttaaatgttgaccattagctcttgcagcgtcttacaaagacgacttgaagttgggagttaggaaggtgaacttttctatctgaattctccgggtccctgaagccctccttgccgctctccatctgtcttgcactgccagctgggtccctgctggggctctgggacttccacttctcagtccacataggaacccagcttccactgagtcactgccaaacctgccctcctagcaacagatgccacttatattttggcccctggcagcctcgcccagcccctgatcagcccaggcctagggcagttaggacctttctgtttattttctgaagcagagagaatgatctcagagtttgcaaatgaagccttttttgcactttcattcacatgcactttggtggggttacatttttgtacttgcctcttgtgtgtgcacatgtgtgtatgtgttctttaagagaatcttctggcttaagctaaggtgactcttgaaggagaaaaagttacaaacaaaatgtggtgtgatctgtcagtgtatcaaaacaacataaataaacttgaacaactga

SEQ ID NO: 296053 - DNA, 4511 bp, Homo sapiens
  misc_feature (1890)..(1890): n is a, c, g, or t
acatagagataaagggaatgaactataaagacactggcatctctgtttcccacaaatcaagacattcatgaaattaatgactaacttacaatgaattttttagaggtgtgtctcataaggaaaaacctggatgatatggaccccgcaggtgattgggggcgtagcctggagtgagggtttggctggtgtagcttggagtgaggccccctggcgtggagtcttgaggcctgctgagggcgtgagctggcatgaggcgaagagagggccatggcaccgactccgagatgggtcaaggacccgtacgggagtcgcaatcctcagaccctcccgcgctccagttccggataagcgagtataagccgctgaacatggcgggagtggagcagcccccgagccccgagctgcggcaggaaggcgtgaccgaatacgaagatggcggggccccggcgggagatggcgaggcgggcccccaacaggcggaggaccacccccagaatcctccagaagatcccaatcaggaccccccagaggatgatagcacctgtcagtgccaggcgtgcgggcctcaccaagccgcgggtccagatcttggttcctctaatgatggctgccctcagctgttccaggagcggtcagtcatagtggagaactcctcaggctctaccagcgcttctgagctcctcaaacccatgaagaagaggaagcgcagggaataccagagcccatcagaggaggagtcggagccagaggccatggagaagcaagaagaaggaaaggacccagagggacaacccactgctagcaccccagagagtgaggagtggagcagcagccagcctgcaacaggtgagaagaaggaatgctggtcgtgggagtcctacctagaggagcagaaggccattactgctccagtcagcctcttccaggactcccaggcagtcactcacaacaagaatggcttcaaactgggcatgaagttggaaggcattgaccctcaacacccgtccatgtacttcatcctcaccgtggctgaggtatgtggctatcgcctacgcctgcactttgatgggtattctgagtgccatgacttctgggtcaatgccaactcccctgacattcaccctgctggctggttcgagaagacgggccacaagctgcagcctcccaaaggttacaaggaggaggagttcagctggagccagtacctgcgcagcacaagagctcaggctgcccccaagcacctgtttgtgagccagagccacgtgagtgcccctgagtgagagtggatgtcactcccatgtgccagagttcactgcagctggcccagggtatctgactcatcagaagggagctcatgtgctggttctctcagctttgttctgatctctcatatcagatgggaggggtacagctgggcagggtccagggccagagatgggaagctggttataggtttttcccgacttccctccctcctttgctactgcagataccctgtcctcacatccccttggagcccctggcccactaccctagtctgagcactgagatgtcattgctcatatattcttgctttggcttgctctgcagttctttggtgtaaggtcaatgcctctattctgggagcttctttttctttccttttgcccaacattgagactcttccatttatttccaacaattcatcccttgtcctttcctctgttcagggcagctggcagcttatccagcagttaaagtatctcataatcccaaccaaaaggcctaagagatacagggagcctccattaaaaatatcatactggaccaggtgtggcggctcatgcctgtaatcccagcactttgggaggctgaggcgggtggatcacctgaggtcaggagttcaagacnagcctgggcaacatggtgaaacccccatctctactaaaaatataaaaaattagctgggcgtggtggtgggtgtctgtaatcccagttactcaggatgctgaggcaggagaatcgcttgaacctggggggcggaagttgcagtgagccaagatcacgccattgcactccggtctcagcaacaagaacgaaactccgtctcaaaaaaaagaagtatgtatcagtcttactggctgggtgcggtggctcacacctgtaattccagtactttgggaggctgaggcgggaggatcacttgagcccaggagtttgagaccagcgtaggcaacatagtgagaccccatctgtacaaaaaatgtcattaaattattagctgggcatggtgcatgtgcctgtagtcctagataccacagtagctagctgagctgggaggattgtttgagcccaggaattcaaggctacagcaagctatgattgtaccactgtaccccagcctgggcgacagagtgagaccctgtgtctaaagaaaaaaaaccatattgaatgtctagagtttccctgggcccaggactccaccatgctcttcaggcagagacagttactcccctaccccagtccagccccagagttcatacttgcaagttcccaggtgacaggtggggtcctgcctgctgttgtgacaacgaatgccgacttttaattcaaactatttaaatactggccccgccgttgactagcattgtgttctgggccaagtgatttaacttcttaaatgggaatagggttgttgtaaaggtccaaggaggtgatgtcttttgaagcttacatggcaggtactcagtttatactggttccctgtctgcctctatgccatagatgtccgctgtttcttcccagccaccccactgttgccacaactgcctcaggacaagctgggaagggcttgtctgggtagggaagatttatacttggttcaccaggttctttgggcgaacgcatagcctccttccaggcacttaccttctgacacaagccaggcctctgagtgcaccttggaggccagaggttcctgagtgcctcagggctcaggttatgattctgccctggagggccctctttcccagcttatttctccttcctttctcactgcccacaccccaggctttcctagagaacctattcctttgtttgccaatgggctctgggctggtcttagccagcttggccctggccgtggcagctcctttttttcccctagagtcccccacccctgggcttccaggtgggcatgaagctggaggctgttgaccgcatgaacccgtcccttgtctgcgtggccagtgtgaccgatgtggtggacagccgcttcctggtgcactttgacaactgggatgatacttatgactactggtgtgatcccagcagcccctacatccacccagtgggctggtgccagaagcaaggaaagcccctcacccctccacaagactacccagaccctgataacttctgttgggagaaatatctggaagaaactggggcctctgctgtccccacctgggccttcaaggtgcgaccccctcacagcttcctggtcaatatgaagctggaggctgtggaccgcaggaacccagccctgattcgcgtggccagcgtggaggatgtggaggaccatcggataaagatccactttgatggctggagtcatggctatgatttctggatcgacgctgaccacccagacatccaccctgccggctggtgctccaagacaggacatcccctgcagcctcctctcggacccagagagcccagctctgcctcccctgggggctgtccccctctcagctataggagcctgccccacactaggacctccaaatacagctttcaccaccggaagtgccccactcctggttgcgacggctctggccatgtcacaggcaagttcacagctcaccattgcctctcaggctgcccactggctgagaggaaccagagccggctgaaagcggagctgtctgactcggaggcctcagcccgcaagaagaacctctcaggcttctccccaaggaagaagcctcgccatcacggccgaattggacgccctccgaagtatcgaaagattccgcaggaagatttccagaccctcacgcccgatgtcgtgcaccagtccctcttcatgtcagccctgtcggcccaccctgaccgctcactctcagtgtgctgggagcagcactgcaagctcctgccaggagtagcgggcatctcagcctcgacagtcgccaagtggaccatcgatgaggtcttcggctttgttcagaccctgacaggttgtgaggaccaagcacgcctcttcaaagacgaggcaagaatagtcagagtgacccatgtatctgggaagactctagtctggactgtggcccagcttggggaccttgtgtgctcagatcatcttcaggaaggaaaaggcatcctggagacaggagtccattcactcctctgctctctacccactcatttgcttgccaaacttagctttgccagtgatagtcaatattaaagtgtacttttttcccctttaatccaatatagttgataattaaagtgtattttgaatgaca

SEQ ID NO: 296054 - DNA, 834 bp, Homo sapiens
acatagagataaagggaatgaactataaagacactggcatctctgtttcccacaaatcaagacattcatgaaattaatgactaacttacaatgaattttttagaggtgtgtctcataaggaaaaacctggatgatatggaccccgcaggtgattgggggcgtagcctggagtgagggtttggctggtgtagcttggagtgaggccccctggcgtggagtcttgaggcctgctgagggcgtgagctggcatgaggcgaagagagggccatggcaccgactccgagatgggtcaaggacccgtacgggagtcgcaatcctcagaccctcccgcgctccagttccggataagcgagtataagccgctgaacatggcgggagtggagcagcccccgagccccgagctgcggcaggaaggcgtgaccgaatacgaagatggcggggccccggcgggagatggcgaggcgggcccccaacaggcggaggaccacccccagaatcctccagaagatcccaatcaggaccccccagaggatgatagcacctgtcagtgccaggcgtgcgggcctcaccaagccgcgggtccagatcttggttcctctaatgatggctgccctcagctgttccaggagcggagaagcaagaagaaggaaaggacccagagggacaacccactgctagcaccccagagagtgaggagtggagcagcagccagcctgcaacaggtgagaagaaggaatgctggtcgtgggagtcctacctagaggagcagaaggccattactgctccagtcagcctcttccaggaccccactaggcaaggataaggctggatgga

SEQ ID NO: 296055 - DNA, 333 bp, Homo sapiens
gggtggtgcagcctcagagagacggggtgagggtcattccgaatagctgacctgagagtctttaagagagtcactttaccagcaggagtgaacactgtgtgaggagtcaggagatacggctcaccctcttgactctacaggctgtcagaaggggcccggagtcctgtctactctgccagccagtctcctgagtggtgtgggtatgcatgggcttcgggaacagtttagtcatcctcgttggcctgccagcctctgcctctgctttccagccctcacgcccgatgtcgtgcaccagtccctcttcatgtcagccctgtcggcccaccctgaccg

SEQ ID NO: 296056 - DNA, 138 bp, Homo sapiens
agagtggggcaccctgggactggaccccgcaggtgattgggggcgtagcctggagtgagggtttggctggtgtagcttggagtgaggccccctggcgtggagtcttgaggcctgctgagggcgtgagctggcatgagg

SEQ ID NO: 296057 - DNA, 2242 bp, Homo sapiens
gaattccgctccgcactgctcactcccgcgcagtgaggttggcacagccaccgctctgtggctcgcttggttcccttagtcccgagcgctcgcccactgcagattcctttcccgtgcagacatggcctctggcaccaccaccaccgccgtgaagattggaataattggtggaacaggcctggatgatccagaaattttagaaggaagaactgaaaaatatgtggatactccatttggcaagccatctgatgccttaattttggggaagataaaaaatgttgattgcatcctccttgcaaggcatggaaggcagcacaccatcatgccttcaaaggtcaactaccaggcgaacatctgggctttgaaggaagagggctgtacacatgtcatagtgaccacagcttgtggctccttgagggaggagattcagcccggcgatattgtcattattgatcagttcattgacaggaccactatgagacctcagtccttctatgatggaagtcattcttgtgccagaggagtgtgccatattccaatggctgagccgttttgccccaaaacgagagaggttcttatagagactgctaagaagctaggactccggtgccactcaaaggggacaatggtcacaatcgagggacctcgttttagctcccgggcagaaagcttcatgttccgcacctggggggcggatgttatcaacatgaccacagttccagaggtggttcttgctaaggaggctggaatttgttacgcaagtatcgccatggcgacagattatgactgctggaaggagcacgaggaagcagtttcggtggaccgggtcttaaagaccctgaaagaaaacgctaataaagccaaaagcttactgctcactaccatacctcagatagggtccacagaatggtcagaaaccctccataacctgaagaatatggcccagttttctgttttattaccaagacattaaagtagcatggctgcccaggagaaaagaagacattctaattccagtcattttgggaattcctgcttaacttgaaaaaaatatgggaaagacatgcagctttcatgcccttgcctatcaaagagtatgttgtaagaaagacaagacattgtgtgtattagagactcctgaatgatttagacaacttcaaaatacagaagaaaagcaaatgactagtaaacatgtgggaaaaaatattacattttaagggggaaaaaaaaacccaccattctcttctccccctattaaatttgcaacaataaagggtggagggtaatctctactttcctatactgccaaagaatgtgaggaagaaatgggactctttggttatttattgatgcgactgtaaattggtacagtatttctggagggcaatttggtaaaatgcatcaaaagacttaaaaatacggacgtactttgtgctgggaactctacatctagcaatttctctttaaaaccatatcagagatgcatacaaagaattatatataaagaagggtgtttaataatgatagttataataataaataattgaaacaatctgaatcccttgcaattggaggtaaattatgtcttagttataattagattgtgaatcagccaactgaaaatcctttttgcatatttcaatgtcctaaaaagacacggttgctctatatatgaagtgaaaaaaggatatggtagcattttatagtactagttttgctttaaaatgctatgtaaatatacaaaaaaactagaaagaaatatatataaccttgttattgtatttgggggagggatactgggataatttttattttctttgaatctttctgtgtcttcacatttttctacagtgaatataatcaaatagtaaagttgttgtaaaaataaaagtggatttagaaagatccagttcttgaaaacactgtttctggtaatgaagcagaatttaagttggtaatattaaggtgaatgtcatttaagggagttacatctttattctgctaaagaagaggatcattgatttctgtacagtcagaacagtacttgggtttgcaacagctttctgagaaaagctaggtgtttaatagtttaactgaaagtttaactatttaaaagactaaatgcacattttatggtatctgatattttaaaaagtaatgtttgattctcctttttatgagttaaattattttatacgagttggtaatttttgctttttaataaagtggaagcttgcttttt

SEQ ID NO: 296058 - DNA, 1401 bp, Homo sapiens
gaattccgctccgcactgctcactcccgcgcagtgaggttggcacagccaccgctctgtggctcgcttggttcccttagtcccgagcgctcgcccactgcagattcctttcccgtgcagacatggcctctggcaccaccaccaccgccgtgaagattggaataattggtggaacaggcctggatgatccagaaattttagaaggaagaactgaaaaatatgtggatactccatttggcaagccatctgatgccttaattttggggaagataaaaaatgttgattgcatcctccttgcaaggcatggaaggcagcacaccatcatgccttcaaaggtcaactaccaggcgaacatctgggctttgaaggaagagggctgtacacatgtcatagtgaccacagcttgtggctccttgagggaggagattcagcccggcgatattgtcattattgatcagttcattgacaggaccactatgagacctcagtccttctatgatggaagtcattcttgtgccagaggagtgtgccatattccaatggctgagccgttttgccccaaaacgagagaggttcttatagagactgctaagaagctaggactccggtgccactcaaaggggacaatggtcacaatcgagggacctcgttttagctcccgggcagaaagcttcatgttccgcacctggggggcggatgttatcaacatgaccacagttccagaggtggttcttgctaaggaggctggaatttgttacgcaagtatcgccatggcgacagattatgactgctggaaggagcacgaggaagcagtttcggtggaccgggtcttaaagaccctgaaagaaaacgctaataaagccaaaagcttactgctcactaccatacctcagatagggtccacagaatggtcagaaaccctccataacctgaagaaaaaatctgctggaatggcactgaatttttaggtcgatttgggaagaattgacaatattgaacctttcaatcgatggacatggtatgtttctgcatttatttgggccttttaaaatttatctcagcaatattttgtagttttagtgaagaagtcttgtatatatcttttgttaaatgtattcctaaatattttgtggaaatgttactgtaaatagtactttaatttcatttttaagtttattgctggtatacagaaatatgttttatttttgtatattgactttatattctgtaatcttattaaattcacttagttcagtagtagttcttatttttattttattgcaagtgccttagggataccttgtgtacacaatcatgtcatatatgaataacaacagtttaccttttgtttcttcttgctttgtcgtaatggctaggaccttcaacctaatgttgaatagaa

SEQ ID NO: 296059 - DNA, 2167 bp, Homo sapiens
gattgacttcaagataataagctgctaattgtaaacaaaacagttaccctccagtattaatatgactcattagtgtgagccatttgggtcaagtatgattatgacccttggacttcctgatgtagtattaaatttcaactctggttatccattagcaatctgtagagaacttaatgaacctgaacccaggcttctctagctctggtaacgtgtgattgttttcactacaatatgatacatagatggtaccttacttttcctcattcttaataggtgtctaagaatgtcagggcaaaagtatgggcatttttcttgctatgttcagaaagtacagttctctccaacttgcagaggtacttttcttgattaaatagccttctctagcaacatcattttcagactaactaaatgaatgcagtatactcttttctttgttctcaatcattcactccttatgcaaagccaatataattttcctcataccttatgcttgaggatattgttgaagaacacttcctggaacacttctcacttgtgatgctgtactaattttttttttttaatttaagctagtatactaagtgaacaccatggtcagttgtgagcattttggtttccgcaaaggatggatggtgagcatcatgggaaagctgtagtttagtgacttagcccttagtgattaatagatttgcatgtacatagaagtctttgttggccttataatctgctgttatatttggcatggattttcatggttttgagaatgacatcctggccctgtggtccccgagggtcatggtccttgtgacctggcccctgttcactgcccccttcgctagcacgagttgctgtgcagggctggaggtagctaccatggcttgtttcaaggaaggaaactctggtacggtggcaccctcaggagtggaggacagtgaacttccttgaagagggagtgactaaggtgacctccaacctgccctgagccagctgccctgcaggtgccacgtgagcctgctctggcatccacaggatgctcctggagcctcttctctggctgctacctcagggcatggttgtggccccaccaacacctattttccaaataattattcattcttgtgacagtggcctgaacatgtttttaattttctcaacaagcatttagccagcacttatccagtgaaacaatttgataaggtttcaaggagtatctgatgggttaggaagtcacgaaatgaggagttcttgccacatttgcagagtccctccttgataaggtttggcggtgtccccacccaaatctcatgttgaattgtagttcccataatccccacatgttgtgggagggacccagtgggaggtaattaaatcatgggggtggttacccccacactgctgttctcatgatactgagttctcacaagtcctgtttgttttataaggggcttttcccccttttgctcaacacttcttcctgccatcatgtgaagaaggacgtgtttgtttccccttctgccacgattgtaagtttcctgaggccttcccagctatgtggaactgtgagttaattaaacctctttcctttataaattacccagtcatgggcagtcctttacagcagcatgagaatggactaatacactcctcaaatgttttgaagattgttgcaccttggaactaccagtgtgcacacaatctggctcaatgtatatattggcccagcaaggcaaagaactgaagttccaggatggaagaacctgtgttctcctcataatagtatagaataattcaagataggcaagaaggacagcagtaaatgaagaccatggaagaaaagaaggaatgccaaagatcgaggaaatctaccaagactagtagggtagtccagaagaagctgtttcagggcctgttgccagctatgcctttgagaacctcgggatcccaaagaatgaggggaatttcttcagaaagacaatctcggcatgcattatttctttgttttgaagattcactcatgttgcatgcatctgtagcttgtgccttttttattgcctagtagtattctgtcatatgcctatcttacaatttgattatctattcacctgttgatgaatgtttgaattttttccatttgaggaattttatgaataaagctgctataagcatg

SEQ ID NO: 296060 - DNA, 943 bp, Homo sapiens
gaattccgctccgcactgctcactcccgcgcagtgaggttggcacagccaccgctctgtggctcgcttggttcccttagtcccgagcgctcgcccactgcagattcctttcccgtgcagacatggcctctggcaccaccaccaccgccgtgaagattggaataattggtggaacaggcctggatgatccagaaattttagaaggaagaactgaaaaatatgtggatactccatttggcaagccatctgatgccttaattttggggaagataaaaaatgttgattgcatcctccttgcaaggcatggaaggcagcacaccatcatgccttcaaaggtcaactaccaggcgaacatctgggctttgaaggaagagggctgtacacatgtcatagtgaccacagcttgtggctccttgagggaggagattcagcccggcgatattgtcattattgatcagttcattgacaggactatttgccacgacatttcaaaggattccaagagagaatattggtgtccatgctgtgatgattcctcagctcctctcatctgatctccgtcctggcccccatgactttctttgtggtagttagggtgtggtatgtgccactgaggcccacacctattgctgcaatttatagcactgatctgtcatcaataccacttgctgtcttggatgtgaagatgatttttcctgcagggattccctctacaaaattaaaaacactgggcatgtggaaataatattcatgctttaaattgtcttttctcttcactacaccaggggtccccaacccctaggccacagactgtggccctagtgtagtgaatagaaaagacaatttaaagcgtgaatattatttcctcatgcccagtgtttttaattttgtactggtctgtggcttgttagaaaccaggctgcacagcagaaggtgggcagcag

SEQ ID NO: 296061 - DNA, 658 bp, Homo sapiens
ctcgccccctagctacatccgtcacctgacacggccctaccaggaacagccgcgctcccgcggattctgatttggaaaacaagcgaaattaaactaaaccgctgcacgcctctgacgcgacatctggacacggcgcggcgctggcgctgccggagctgtcgacccggcctggcgccggactaggactatttgccacgacatttcaaaggattccaagagagaatattggtgtccatgctgtgatgattcctcagctcctctcatctgatctccgtcctggcccccatgactttctttgtggtagttagggtgtggtatgtgccactgaggcccacacctattgctgcaatttatagcactgatctgtcatcaataccacttgctgtcttggatgtgaagatgatttttcctgcagggattccctctacaaaattaaaaacactgggcatgtggaaataatattcatgctttaaattgtcttttctcttcactacaccaggggtccccaacccctaggccacagactgtggccctagtgtagtgaatagaaaagacaatttaaagcgtgaatattatttcctcatgcccagtgtttttaattttgtactggtctgtggcttgttagaaaccaggctgcacagcagaaggtgggcagcag

SEQ ID NO: 296062 - DNA, 2533 bp, Homo sapiens
gaattccgctccgcactgctcactcccgcgcagtgaggttggcacagccaccgctctgtggctcgcttggttcccttagtcccgagcgctcgcccactgcagattcctttcccgtgcagacatggcctctggcaccaccaccaccgccgtgaagattggaataattggtggaacaggcctggatgatccagaaattttagaaggaagaactgaaaaatatgtggatactccatttggcaagccatctgatgccttaattttggggaagataaaaaatgttgattgcatcctccttgcaaggcatggaaggcagcacaccatcatgccttcaaaggtcaactaccaggcgaacatctgggctttgaaggaagagggctgtacacatgtcatagtgaccacagcttgtggctccttgagggaggagattcagcccggcgatattgtcattattgatcagttcattgacaggaccactatgagacctcagtccttctatgatggaagtcattcttgtgccagaggagtgtgccatattccaatggctgagccgttttgccccaaaacgagagaggttcttatagagactgctaagaagctaggactccggtgccactcaaaggggacaatggtcacaatcgagggacctcgttttagctcccgggcagaaagcttcatgttccgcacctggggggcggatgttatcaacatgaccacagttccagaggtggttcttgctaaggaggctggaatttgttacgcaagtatcgccatggcgacagattatgactgctggaaggagcacgaggaagcagtttcggtggaccgggtcttaaagaccctgaaagaaaacgctaataaagccaaaagcttactgctcactaccatacctcagatagggtccacagaatggtcagaaaccctccataacctgaagaatatggcccagttttctgttttattaccaagacattaaagtagcatggctgcccaggagaaaagaagacattctaattccagtcattttgggaattcctgcttaacttgaaaaaaatatgggaaagacatgcagctttcatgcccttgcctatcaaagagtatgttgtaagaaagacaagacattgtgtgtattagagactcctgaatgatttagacaacttcaaaatacagaagaaaagcaaatgactagtaaacatgtgggaaaaaatattacattttaagggggaaaaaaaaacccaccattctcttctccccctattaaatttgcaacaataaagggtggagggtaatctctactttcctatactgccaaagaatgtgaggaagaaatgggactctttggttatttattgatgcgactgtaaattggtacagtatttctggagggcaatttggtaaaatgcatcaaaagacttaaaaatacggacgtactttgtgctgggaactctacatctagcaatttctctttaaaaccatatcagagatgcatacaaagaattatatataaagaagggtgtttaataatgatagttataataataaataattgaaacaatctgaatcccttgcaattggaggtaaattatgtcttagttataattagattgtgaatcagccaactgaaaatcctttttgcatatttcaatgtcctaaaaagacacggttgctctatatatgaagtgaaaaaaggatatggtagcattttatagtactagttttgctttaaaatgctatgtaaatatacaaaaaaactagaaagaaatatatataaccttgttattgtatttgggggagggatactgggataatttttattttctttgaatctttctgtgtcttcacatttttctacagtgaatataatcaaatagtaaagttgttgtaaaaataaaagtggatttagaaagatccagttcttgaaaacactgtttctggtaatgaagcagaatttaagttggtaatattaaggtgaatgtcatttaagggagttacatctttattctgctaaagaagaggatcattgatttctgtacagtcagaacagtacttgggtttgcaacagctttctgagaaaagctaggtgtttaatagtttaactgaaagtttaactatttaaaagactaaatgcacattttatggtatctgatattttaaaaagtaatgtttgattctcctttttatgagttaaattattttatacgagttggtaatttttgctttttaataaagtggaagcttgcttttttaactctttttttattgttattttatagaaatgctttttgttggccgggcacagttgctcatccatgtaatcccagcactgtgggaggccgagacgggtggatcacaaggtcaggagatcgagaccatcctggctaatgcgttgaaactccgtctctactaaaaatacaaaaaaaaaaaaaaaaaaaagagtgaaatgctttttgtttgcttcagttttttatcatggggagatctttttcctcagaattgttttcttttcactgtaggctattacaggatacttcaggat

SEQ ID NO: 296063 - DNA, 1588 bp, Homo sapiens
gaattccgctccgcactgctcactcccgcgcagtgaggttggcacagccaccgctctgtggctcgcttggttcccttagtcccgagcgctcgcccactgcagattcctttcccgtgcagacatggcctctggcaccaccaccaccgccgtgaagattggaataattggtggaacaggcctggatgatccagaaattttagaaggaagaactgaaaaatatgtggatactccatttggcaagccatctgatgccttaattttggggaagataaaaaatgttgattgcatcctccttgcaaggcatggaaggcagcacaccatcatgccttcaaaggtcaactaccaggcgaacatctgggctttgaaggaagagggctgtacacatgtcatagtgaccacagcttgtggctccttgagggaggagattcagcccggcgatattgtcattattgatcagttcattgacaggaccactatgagacctcagtccttctatgatggaagtcattcttgtgccagaggagtgtgccatattccaatggctgagccgttttgccccaaaacgagagaggttcttatagagactgctaagaagctaggactccggtgccactcaaaggggacaatggtcacaatcgagggacctcgttttagctcccgggcagaaagcttcatgttccgcacctggggggcggatgttatcaacatgaccacagttccagaggtggttcttgctaaggaggctggaatttgttacgcaagtatcgccatggcgacagattatgactgctggaaggagcacgaggaagcagtttcggtggaccgggtcttaaagaccctgaaagaaaacgctaataaagccaaaagcttactgctcactaccatacctcagatagggtccacagaatggtcagaaaccctccataacctgaagaatatggcccagttttctgttttattaccaagacattaaagtagcatggctgcccaggagaaaagaagacattctaattccagtcattttgggaattcctgcttaacttgaaaaaaatatgggaaagacatgcagctttcatgcccttgcctatcaaagagtatgttgtaagaaagacaagacattgtgtgtattagagactcctgaatgatttagacaacttcaaaatacagaagaaaagcaaatgactagtaaacatgtgggaaaaaatattacattttaagggggaaaaaaaaacccaccattctcttctccccctattaaatttgcaacaataaagggtggagggtaatctctactttcctatactgccaaagaatgtgaggaagaaatgggactctttggttatttattgatgcgactgtaaattggtacagtatttctggagggcaatttggtaaaatgcatcaaaagacttaaaaatacggacgtactttgtgctgggaactctacatctagcaatttctctttgccgccctctgaccgccgccgcccgaccgctctccgcccccaacggacgtgcgcgatactagacgtggggtgtgggcgggggggggcgtgccggcgcccgccgggctccccgggggcggccgc

SEQ ID NO: 296064 - DNA, 2584 bp, Homo sapiens
gaattccgctccgcactgctcactcccgcgcagtgaggttggcacagccaccgctctgtggctcgcttggttcccttagtcccgagcgctcgcccactgcagattcctttcccgtgcagacatggcctctggcaccaccaccaccgccgtgaagattggaataattggtggaacaggcctggatgatccagaaattttagaaggaagaactgaaaaatatgtggatactccatttggcaagccatctgatgccttaattttggggaagataaaaaatgttgattgcatcctccttgcaaggcatggaaggcagcacaccatcatgccttcaaaggtcaactaccaggcgaacatctgggctttgaaggaagagggctgtacacatgtcatagtgaccacagcttgtggctccttgagggaggagattcagcccggcgatattgtcattattgatcagttcattgacaggaccactatgagacctcagtccttctatgatggaagtcattcttgtgccagaggagtgtgccatattccaatggctgagccgttttgccccaaaacgagagaggttcttatagagactgctaagaagctaggactccggtgccactcaaaggggacaatggtcacaatcgagggacctcgttttagctcccgggcagaaagcttcatgttccgcacctggggggcggatgttatcaacatgaccacagttccagaggtggttcttgctaaggaggctggaatttgttacgcaagtatcgccatggcgacagattatgactgctggaaggagcacgaggaagcagtttcggtggaccgggtcttaaagaccctgaaagaaaacgctaataaagccaaaagcttactgctcactaccatacctcagatagggtccacagaatggtcagaaaccctccataacctgaaggaaagggaggtgaggaaccaagagtttagagtacccgaagttccacatctgaatatggcccagttttctgttttattaccaagacattaaagtagcatggctgcccaggagaaaagaagacattctaattccagtcattttgggaattcctgcttaacttgaaaaaaatatgggaaagacatgcagctttcatgcccttgcctatcaaagagtatgttgtaagaaagacaagacattgtgtgtattagagactcctgaatgatttagacaacttcaaaatacagaagaaaagcaaatgactagtaaacatgtgggaaaaaatattacattttaagggggaaaaaaaaacccaccattctcttctccccctattaaatttgcaacaataaagggtggagggtaatctctactttcctatactgccaaagaatgtgaggaagaaatgggactctttggttatttattgatgcgactgtaaattggtacagtatttctggagggcaatttggtaaaatgcatcaaaagacttaaaaatacggacgtactttgtgctgggaactctacatctagcaatttctctttaaaaccatatcagagatgcatacaaagaattatatataaagaagggtgtttaataatgatagttataataataaataattgaaacaatctgaatcccttgcaattggaggtaaattatgtcttagttataattagattgtgaatcagccaactgaaaatcctttttgcatatttcaatgtcctaaaaagacacggttgctctatatatgaagtgaaaaaaggatatggtagcattttatagtactagttttgctttaaaatgctatgtaaatatacaaaaaaactagaaagaaatatatataaccttgttattgtatttgggggagggatactgggataatttttattttctttgaatctttctgtgtcttcacatttttctacagtgaatataatcaaatagtaaagttgttgtaaaaataaaagtggatttagaaagatccagttcttgaaaacactgtttctggtaatgaagcagaatttaagttggtaatattaaggtgaatgtcatttaagggagttacatctttattctgctaaagaagaggatcattgatttctgtacagtcagaacagtacttgggtttgcaacagctttctgagaaaagctaggtgtttaatagtttaactgaaagtttaactatttaaaagactaaatgcacattttatggtatctgatattttaaaaagtaatgtttgattctcctttttatgagttaaattattttatacgagttggtaatttttgctttttaataaagtggaagcttgcttttttaactctttttttattgttattttatagaaatgctttttgttggccgggcacagttgctcatccatgtaatcccagcactgtgggaggccgagacgggtggatcacaaggtcaggagatcgagaccatcctggctaatgcgttgaaactccgtctctactaaaaatacaaaaaaaaaaaaaaaaaaaagagtgaaatgctttttgtttgcttcagttttttatcatggggagatctttttcctcagaattgttttcttttcactgtaggctattacaggatacttcaggat

SEQ ID NO: 296065 - DNA, 2702 bp, Homo sapiens
gaattccgctccgcactgctcactcccgcgcagtgaggttggcacagccaccgctctgtggctcgcttggttcccttagtcccgagcgctcgcccactgcagattcctttcccgtgcagacatggcctctggcaccaccaccaccgccgtgaaggtgagatgagccctcccagccgcagcggttcgccctgccggatgccttctcgcccccgcgccgggggaccgcgcctccgggggccatgcgcccggcccgtgcgtcccttgccgccgcggggagggactggggcgcggcactcgggactcacttgccgcgcgaggagaggattggaataattggtggaacaggcctggatgatccagaaattttagaaggaagaactgaaaaatatgtggatactccatttggcaagccatctgatgccttaattttggggaagataaaaaatgttgattgcatcctccttgcaaggcatggaaggcagcacaccatcatgccttcaaaggtcaactaccaggcgaacatctgggctttgaaggaagagggctgtacacatgtcatagtgaccacagcttgtggctccttgagggaggagattcagcccggcgatattgtcattattgatcagttcattgacaggaccactatgagacctcagtccttctatgatggaagtcattcttgtgccagaggagtgtgccatattccaatggctgagccgttttgccccaaaacgagagaggttcttatagagactgctaagaagctaggactccggtgccactcaaaggggacaatggtcacaatcgagggacctcgttttagctcccgggcagaaagcttcatgttccgcacctggggggcggatgttatcaacatgaccacagttccagaggtggttcttgctaaggaggctggaatttgttacgcaagtatcgccatggcgacagattatgactgctggaaggagcacgaggaagcagtttcggtggaccgggtcttaaagaccctgaaagaaaacgctaataaagccaaaagcttactgctcactaccatacctcagatagggtccacagaatggtcagaaaccctccataacctgaagaatatggcccagttttctgttttattaccaagacattaaagtagcatggctgcccaggagaaaagaagacattctaattccagtcattttgggaattcctgcttaacttgaaaaaaatatgggaaagacatgcagctttcatgcccttgcctatcaaagagtatgttgtaagaaagacaagacattgtgtgtattagagactcctgaatgatttagacaacttcaaaatacagaagaaaagcaaatgactagtaaacatgtgggaaaaaatattacattttaagggggaaaaaaaaacccaccattctcttctccccctattaaatttgcaacaataaagggtggagggtaatctctactttcctatactgccaaagaatgtgaggaagaaatgggactctttggttatttattgatgcgactgtaaattggtacagtatttctggagggcaatttggtaaaatgcatcaaaagacttaaaaatacggacgtactttgtgctgggaactctacatctagcaatttctctttaaaaccatatcagagatgcatacaaagaattatatataaagaagggtgtttaataatgatagttataataataaataattgaaacaatctgaatcccttgcaattggaggtaaattatgtcttagttataattagattgtgaatcagccaactgaaaatcctttttgcatatttcaatgtcctaaaaagacacggttgctctatatatgaagtgaaaaaaggatatggtagcattttatagtactagttttgctttaaaatgctatgtaaatatacaaaaaaactagaaagaaatatatataaccttgttattgtatttgggggagggatactgggataatttttattttctttgaatctttctgtgtcttcacatttttctacagtgaatataatcaaatagtaaagttgttgtaaaaataaaagtggatttagaaagatccagttcttgaaaacactgtttctggtaatgaagcagaatttaagttggtaatattaaggtgaatgtcatttaagggagttacatctttattctgctaaagaagaggatcattgatttctgtacagtcagaacagtacttgggtttgcaacagctttctgagaaaagctaggtgtttaatagtttaactgaaagtttaactatttaaaagactaaatgcacattttatggtatctgatattttaaaaagtaatgtttgattctcctttttatgagttaaattattttatacgagttggtaatttttgctttttaataaagtggaagcttgcttttttaactctttttttattgttattttatagaaatgctttttgttggccgggcacagttgctcatccatgtaatcccagcactgtgggaggccgagacgggtggatcacaaggtcaggagatcgagaccatcctggctaatgcgttgaaactccgtctctactaaaaatacaaaaaaaaaaaaaaaaaaaagagtgaaatgctttttgtttgcttcagttttttatcatggggagatctttttcctcagaattgttttcttttcactgtaggctattacaggatacttcaggat

SEQ ID NO: 296066 - DNA, 2570 bp, Homo sapiens
gtagtatcattcgtgttcagtccggcgcaggaggtaggtagaagatggcgatatgtggtcgtatgatatccttattctcaatagtgcgtgcgattgtacgaatacctatatcacacagtgccccgacagtggacctcgtgctgttcagaaccaaactgccagatagagaattcgtgatagtcttgtgacgtggagcatcgtacttaggatgagtcgctacgaagtttagctcaggtgatcgaactgacagcctatggtcgtgtactccatttggcaagccatctgatgccttaattttggggaagataaaaaatgttgattgcatcctccttgcaaggcatggaaggcagcacaccatcatgccttcaaaggtcaactaccaggcgaacatctgggctttgaaggaagagggctgtacacatgtcatagtgaccacagcttgtggctccttgagggaggagattcagcccggcgatattgtcattattgatcagttcattgacaggaccactatgagacctcagtccttctatgatggaagtcattcttgtgccagaggagtgtgccatattccaatggctgagccgttttgccccaaaacgagagaggttcttatagagactgctaagaagctaggactccggtgccactcaaaggggacaatggtcacaatcgagggacctcgttttagctcccgggcagaaagcttcatgttccgcacctggggggcggatgttatcaacatgaccacagttccagaggtggttcttgctaaggaggctggaatttgttacgcaagtatcgccatggcgacagattatgactgctggaaggagcacgaggaagcagtttcggtggaccgggtcttaaagaccctgaaagaaaacgctaataaagccaaaagcttactgctcactaccatacctcagatagggtccacagaatggtcagaaaccctccataacctgaagaatatggcccagttttctgttttattaccaagacattaaagtagcatggctgcccaggagaaaagaagacattctaattccagtcattttgggaattcctgcttaacttgaaaaaaatatgggaaagacatgcagctttcatgcccttgcctatcaaagagtatgttgtaagaaagacaagacattgtgtgtattagagactcctgaatgatttagacaacttcaaaatacagaagaaaagcaaatgactagtaaacatgtgggaaaaaatattacattttaagggggaaaaaaaaacccaccattctcttctccccctattaaatttgcaacaataaagggtggagggtaatctctactttcctatactgccaaagaatgtgaggaagaaatgggactctttggttatttattgatgcgactgtaaattggtacagtatttctggagggcaatttggtaaaatgcatcaaaagacttaaaaatacggacgtactttgtgctgggaactctacatctagcaatttctctttaaaaccatatcagagatgcatacaaagaattatatataaagaagggtgtttaataatgatagttataataataaataattgaaacaatctgaatcccttgcaattggaggtaaattatgtcttagttataattagattgtgaatcagccaactgaaaatcctttttgcatatttcaatgtcctaaaaagacacggttgctctatatatgaagtgaaaaaaggatatggtagcattttatagtactagttttgctttaaaatgctatgtaaatatacaaaaaaactagaaagaaatatatataaccttgttattgtatttgggggagggatactgggataatttttattttctttgaatctttctgtgtcttcacatttttctacagtgaatataatcaaatagtaaagttgttgtaaaaataaaagtggatttagaaagatccagttcttgaaaacactgtttctggtaatgaagcagaatttaagttggtaatattaaggtgaatgtcatttaagggagttacatctttattctgctaaagaagaggatcattgatttctgtacagtcagaacagtacttgggtttgcaacagctttctgagaaaagctaggtgtttaatagtttaactgaaagtttaactatttaaaagactaaatgcacattttatggtatctgatattttaaaaagtaatgtttgattctcctttttatgagttaaattattttatacgagttggtaatttttgctttttaataaagtggaagcttgcttttttaactctttttttattgttattttatagaaatgctttttgttggccgggcacagttgctcatccatgtaatcccagcactgtgggaggccgagacgggtggatcacaaggtcaggagatcgagaccatcctggctaatgcgttgaaactccgtctctactaaaaatacaaaaaaaaaaaaaaaaaaaagagtgaaatgctttttgtttgcttcagttttttatcatggggagatctttttcctcagaattgttttcttttcactgtaggctattacaggatacttcaggat

SEQ ID NO: 296067 - DNA, 1003 bp, Homo sapiens
gaattccgctccgcactgctcactcccgcgcagtgaggttggcacagccaccgctctgtggctcgcttggttcccttagtcccgagcgctcgcccactgcagattcctttcccgtgcagacatggcctctggcaccaccaccaccgccgtgaagattggaataattggtggaacaggcctggatgatccagaaattttagaaggaagaactgaaaaatatgtggatactccatttggcaagccatctgatgccttaattttggggaagataaaaaatgttgattgcatcctccttgcaaggcatggaaggcagcacaccatcatgccttcaaaggtcaactaccaggcgaacatctgggctttgaaggaagagggctgtacacatgtcatagtgaccacagcttgtggctccttgagggaggagattcagcccggcgatattgtcattattgatcagttcattgacaggaccactatgagacctcagtccttctatgatggaagtcattcttgtgccagaggagtgtgccatattccaatggctgagccgttttgccccaaaacgagagaggttcttatagagactgctaagaagctaggactccggtgccactcaaaggggacaatggtcacaatcgagggacctcgttttagctcccgggcagaaagcttcatgttccgcacctggggggcggatgttatcaacatgaccacagttccagaggtggttcttgctaaggaggctggaatttgttacgcaagtatcgccatggcgacagattatgactgctggaaggagcacgaggaagcaatgatcaagttccagatgatcctcagtgagggataccatcctttcaatattcaagagtcacccttctacagaggactcctagacttcccatcagtgggacatggcagaggtgaaatcctgcccctgtctcccttagacctggctggatactgcttccaacaacccatgcagccaccctgccctgacagctag

SEQ ID NO: 296068 - DNA, 2222 bp, Homo sapiens
gaattccgctccgcactgctcactcccgcgcagtgaggttggcacagccaccgctctgtggctcgcttggttcccttagtcccgagcgctcgcccactgcagattcctttcccgtgcagacatggcctctggcaccaccaccaccgccgtgaagattggaataattggtggaacaggcctggatgatccagaaattttagaaggaagaactgaaaaatatgtggatactccatttggcaagccatctgatgccttaattttggggaagataaaaaatgttgattgcatcctccttgcaaggcatggaaggcagcacaccatcatgccttcaaaggtcaactaccaggcgaacatctgggctttgaaggaagagggctgtacacatgtcatagtgaccacagcttgtggctccttgagggaggagattcagcccggcgatattgtcattattgatcagttcattgacagattatgactgctggaaggagcacgaggaagcagtttcggtggaccgggtcttaaagaccctgaaagaaaacgctaataaagccaaaagcttactgctcactaccatacctcagatagggtccacagaatggtcagaaaccctccataacctgaagaatatggcccagttttctgttttattaccaagacattaaagtagcatggctgcccaggagaaaagaagacattctaattccagtcattttgggaattcctgcttaacttgaaaaaaatatgggaaagacatgcagctttcatgcccttgcctatcaaagagtatgttgtaagaaagacaagacattgtgtgtattagagactcctgaatgatttagacaacttcaaaatacagaagaaaagcaaatgactagtaaacatgtgggaaaaaatattacattttaagggggaaaaaaaaacccaccattctcttctccccctattaaatttgcaacaataaagggtggagggtaatctctactttcctatactgccaaagaatgtgaggaagaaatgggactctttggttatttattgatgcgactgtaaattggtacagtatttctggagggcaatttggtaaaatgcatcaaaagacttaaaaatacggacgtactttgtgctgggaactctacatctagcaatttctctttaaaaccatatcagagatgcatacaaagaattatatataaagaagggtgtttaataatgatagttataataataaataattgaaacaatctgaatcccttgcaattggaggtaaattatgtcttagttataattagattgtgaatcagccaactgaaaatcctttttgcatatttcaatgtcctaaaaagacacggttgctctatatatgaagtgaaaaaaggatatggtagcattttatagtactagttttgctttaaaatgctatgtaaatatacaaaaaaactagaaagaaatatatataaccttgttattgtatttgggggagggatactgggataatttttattttctttgaatctttctgtgtcttcacatttttctacagtgaatataatcaaatagtaaagttgttgtaaaaataaaagtggatttagaaagatccagttcttgaaaacactgtttctggtaatgaagcagaatttaagttggtaatattaaggtgaatgtcatttaagggagttacatctttattctgctaaagaagaggatcattgatttctgtacagtcagaacagtacttgggtttgcaacagctttctgagaaaagctaggtgtttaatagtttaactgaaagtttaactatttaaaagactaaatgcacattttatggtatctgatattttaaaaagtaatgtttgattctcctttttatgagttaaattattttatacgagttggtaatttttgctttttaataaagtggaagcttgcttttttaactctttttttattgttattttatagaaatgctttttgttggccgggcacagttgctcatccatgtaatcccagcactgtgggaggccgagacgggtggatcacaaggtcaggagatcgagaccatcctggctaatgcgttgaaactccgtctctactaaaaatacaaaaaaaaaaaaaaaaaaaagagtgaaatgctttttgtttgcttcagttttttatcatggggagatctttttcctcagaattgttttcttttcactgtaggctattacaggatacttcaggat

SEQ ID NO: 296069 - DNA, 2269 bp, Homo sapiens
ggattttatatatatgtgtatatatatacacacatacatacatatacacacacacacatataaaacctaaagagagaaaatgaggaattcctgctctagacaaaactgagaatcttggtcttcatgctacagcattaaggaacaccatactaataatccctttttctggggtagtattgttagcactgaaatgtgtatcattcattccctcactaagtcatttcagaaacacttagcacctgctatacgtcaaggtctggtttgcaaagataaagagttgtgatgatgatcctatggtgtttggagatatagacacataaaaatttcaatgatttcttacagtggggtaaggataagggatagaggttgcataaacaataatccaggctgggggctggtatggcaataagtgattatcagaacaatgctctgagataagcattattaacctcactttacaggaaagggaggtgaggaaccaagagtttagagtacccgaagttccacatctggttagtgaacttgaaaattttctgtagaatttatttaaagtgtatgtttcctgcgtcctcactttgatctagaaaatcaaaatctgtttttttttttaacaaacatctcagtaattacgccaacatgtgaatatcactgcctcctttcttcctttcagaatatggcccagttttctgttttattaccaagacattaaagtagcatggctgcccaggagaaaagaagacattctaattccagtcattttgggaattcctgcttaacttgaaaaaaatatgggaaagacatgcagctttcatgcccttgcctatcaaagagtatgttgtaagaaagacaagacattgtgtgtattagagactcctgaatgatttagacaacttcaaaatacagaagaaaagcaaatgactagtaaacatgtgggaaaaaatattacattttaagggggaaaaaaaaacccaccattctcttctccccctattaaatttgcaacaataaagggtggagggtaatctctactttcctatactgccaaagaatgtgaggaagaaatgggactctttggttatttattgatgcgactgtaaattggtacagtatttctggagggcaatttggtaaaatgcatcaaaagacttaaaaatacggacgtactttgtgctgggaactctacatctagcaatttctctttaaaaccatatcagagatgcatacaaagaattatatataaagaagggtgtttaataatgatagttataataataaataattgaaacaatctgaatcccttgcaattggaggtaaattatgtcttagttataattagattgtgaatcagccaactgaaaatcctttttgcatatttcaatgtcctaaaaagacacggttgctctatatatgaagtgaaaaaaggatatggtagcattttatagtactagttttgctttaaaatgctatgtaaatatacaaaaaaactagaaagaaatatatataaccttgttattgtatttgggggagggatactgggataatttttattttctttgaatctttctgtgtcttcacatttttctacagtgaatataatcaaatagtaaagttgttgtaaaaataaaagtggatttagaaagatccagttcttgaaaacactgtttctggtaatgaagcagaatttaagttggtaatattaaggtgaatgtcatttaagggagttacatctttattctgctaaagaagaggatcattgatttctgtacagtcagaacagtacttgggtttgcaacagctttctgagaaaagctaggtgtttaatagtttaactgaaagtttaactatttaaaagactaaatgcacattttatggtatctgatattttaaaaagtaatgtttgattctcctttttatgagttaaattattttatacgagttggtaatttttgctttttaataaagtggaagcttgcttttttaactctttttttattgttattttatagaaatgctttttgttggccgggcacagttgctcatccatgtaatcccagcactgtgggaggccgagacgggtggatcacaaggtcaggagatcgagaccatcctggctaatgcgttgaaactccgtctctactaaaaatacaaaaaaaaaaaaaaaaaaaagagtgaaatgctttttgtttgcttcagttttttatcatggggagatctttttcctcagaattgttttcttttcactgtaggctattacaggatacttcaggat

SEQ ID NO: 296070 - DNA, 3422 bp, Homo sapiens
gattgacttcaagataataagctgctaattgtaaacaaaacagttaccctccagtattaatatgactcattagtgtgagccatttgggtcaagtatgattatgacccttggacttcctgatgtagtattaaatttcaactctggttatccattagcaatctgtagagaacttaatgaacctgaacccaggcttctctagctctggtaacgtgtgattgttttcactacaatatgatacatagatggtaccttacttttcctcattcttaataggtgtctaagaatgtcagggcaaaagtatgggcatttttcttgctatgttcagaaagtacagttctctccaacttgcagaggtacttttcttgattaaatagccttctctagcaacatcattttcagactaactaaatgaatgcagtatactcttttctttgttctcaatcattcactccttatgcaaagccaatataattttcctcataccttatgcttgaggatattgttgaagaacacttcctggaacacttctcacttgtgatgctgtactaattttttttttttaatttaagctagtatactaagtgaacaccatggtcagttgtgagcattttggtttccgcaaaggatggatggtgagcatcatgggaaagctgtagtttagtgacttagcccttagtgattaatagatttgcatgtacatagaagtctttgttggccttataatctgctgttatatttggcatggattttcatggttttgagaatgacatcctggccctgtggtccccgagggtcatggtccttgtgacctggcccctgttcactgcccccttcgctagcacgagttgctgtgcagggctggaggtagctaccatggcttgtttcaaggaaggaaactctggtacggtggcaccctcaggagtggaggacagtgaacttccttgaagagggagtgactaaggtgacctccaacctgccctgagccagctgccctgcaggtgccacgtgagcctgctctggcatccacaggatgctcctggagcctcttctctggctgctacctcagggcatggttgtggccccaccaacacctattttccaaataattattcattcttgtgacagtggcctgaacatgtttttaattttctcaacaagcatttagccagcacttatccagtgaaacaatttgataaggtttcaaggagtatctgatgggttaggaagtcacgaaatgaggagttcttgccacatttgcagagtccctccttgataaggtttggcggtgtccccacccaaatctcatgttgaattgtagttcccataatccccacatgttgtgggagggacccagtgggaggtaattaaatcatgggggtggttacccccacactgctgttctcatgatactgagttctcacaagtcctgtttgttttataaggggcttttcccccttttgctcaacacttcttcctgccatcatgtgaagaaggacgtgtttgtttccccttctgccacgattgtaagtttcctgaggccttcccagctatgtggaactgtgagttaattaaacctctttcctttataaattacccagtcatgggcagtcctttacagcagcatgagaatggactaatacactcctcaaatgttttgaagattgttgcaccttggaactaccagtgtgcacacaatctggctcaatgtatatattggcccagcaaggcaaagaactgaagttccaggatggaagaacctgtgttctcctcataatagtatagaataattcaagataggcaagaaggacagcagtaaatgaagaccatggaagaaaagaaggaatgccaaagatcgaggaaatctaccaagactagtagggtagtccagaagaagctgtttcagggcctgttgccagctatgcctttgagaacctcgggatcccaaagaatgaggggaatttcttcagaaagacaatctcggcatgcattatttctttgttttgaagattcactcatgttgcatgcatctgtagcttgtgccttttttattgcctagtagtattctgtcatatgcctatcttacaatttgattatctattcacctgttgatgaatgtttgaattttttccatttgaggaattttatgaataaagctgctataagcatgaaattacaagtctttttgtgaacatattttcacttgtgcaaatgcctatactcccaccagtaatttgtaagaattcttgacaaagcttggtattgtcagcgtttttaattttagccattctattgggtatattttgatatctcgtggttttgatttgcatttttctgattaaagatgttgaacttcttttcatgtgcttattggccattcacatatttcgtgaactatctgtacaaatattttgtttattaaaaaattagattgttttgttttattattgaatagtaagaatgtttatatattctggatacactctttttcagatatgtgtgttgtgactattcttagtctttagcttgccttttcattttcttaattatgtctttcaaagaacaagtttttcattttgacgaagcctagtttatcaattttttttatggttggtgcttttgtgtgttccaagaaatctttgcctactcatttaattacctgtgtgcccttgtcaaaatcatttaattttgactactcacttaattaccttgcctactcatttaattacctgtgtgcccttgtcaaaatttactgtttatctgtgaatctggatgatctatttatgtcatttatctatgtgtctcttcttatgccagtaccccactgtcttgattattgtggctttatggtgtcttgaaattaagtattgttaagctttgcaatcttttccaagattgttttggctataggtcctttctttataaagtttatattaagcttctccatttttctttaagaaaaaatctgctggaatggcactgaatttttaggtcgatttgggaagaattgacaatattgaacctttcaatcgatggacatggtatgtttctgcatttatttgggccttttaaaatttatctcagcaatattttgtagttttagtgaagaagtcttgtatatatcttttgttaaatgtattcctaaatattttgtggaaatgttactgtaaatagtactttaatttcatttttaagtttattgctggtatacagaaatatgttttatttttgtatattgactttatattctgtaatcttattaaattcacttagttcagtagtagttcttatttttattttattgcaagtgccttagggataccttgtgtacacaatcatgtcatatatgaataacaacagtttaccttttgtttcttcttgctttgtcgtaatggctaggaccttcaacctaatgttgaatagaa

SEQ ID NO: 296071 - DNA, 1918 bp, Homo sapiens
gtctggctgccgcggagggcctactatttgttgcggttggctacgccttccagctcaccaaaaacagtctcaaaaacaaccatttcctctctgctgagagccagggaaggcgagctctgcgcacacgggcgtccctgcagcagccactctgctttccaggaccggccaactgccctggaggcatccacacaggggcccaggcagcacagaggagctgtgaacccgctccacaccggccaccctgcccggagcctggcactcacagcaggccggtgctaaggagtgtggcgcgggctcgactcccactgctgccggcctcccgagtgactctgttttccactgctgcaggcgagaagaggcacgcgcggcacaggccggcctccgcttcccgggaagacggcgcactcctggccctgggttcttgctgctgcccaccctctgctccctgggatgggccccgaggcgagcagcttcagcacaggcctggccctgctccaggtgcaggaaggaggataaggccgggccgagaggcggcacacctggaccatcccatgggcctccgcccgcgccgccccgaggatgagtggtgatgtcctctagccacccctagcagcgtcggctctccctggacgtgcggccgcggactgggacttggctttctccggataagcggcggcaccggcgtcagcgatgaccgtgcagagactcgtggccgcggccgtgctggtggccctggtctcactcatcctcaacaacgtggcggccttcacctccaactgggtgtgccagacgctggaggatgggcgcaggcgcagcgtggggctgtggaggtcctgctggctggtggacaggacccggggagggccgagccctggggccagagccggccaggtggacgcacatgactgtgaggcgctgggctggggctccgaggcagccggcttccaggagtcccgaggcaccgtcaaactgcagttcgacatgatgcgcgcctgcaacctggtggccacggccgcgctcaccgcaggccagctcaccttcctcctggggctggtgggcctgcccctgctgtcacccgacgccccgtgctgggaggaggccatggccgctgcattccaactggcgagttttgtcctggtcatcgggctcgtgactttctacagaattggcccatacaccaacctgtcctggtcctgctacctgaacattggcgcctgccttctggccacgctggcggcagccatgctcatctggaacattctccacaagagggaggactgcatggccccccgggtgattgtcatcagccgctccctgacagcgcgctttcgccgtgggctggacaatgactacgtggagtcaccatgctgagtcgcccttctcagcgctccatcaacgcacacctgctatcgtggaacagcctagaaaccaagggactccaccaccaagtcacttcccctgctcgtgcagaggcacgggatgagtctgggtgacctctgcgccatgcgtgcgagacacgtgtgcgtttactgttatgtcggtcatatgtctgtacgtgtcgtgggccaacctcgttctgcctccagctttcctggttagcgcaacgcggctccacgaccacacgcacttcagggtggaagctggaagctgagacacaggttaggtggcgcgaggctgccctgcgctccgctttgctttgggattaatttattctgcatctgctgagaggggcaccccagccatatcttacactttggtaaagcagaaaaccaggaaaattttcttaaaatatccacaatattccttgagtgagtcagaatctatagccggttagtgatggtttcagacagaatcgtgttcgtgtctgttttgctcgattcctttcctaagttaaataaatgcaagcctctgaactctg

SEQ ID NO: 296072 - DNA, 1626 bp, Homo sapiens
ccgctctgaggactggagggaccagccgcccacagagccccgagcccgtggtcccggcgagaagaggcacgcgcggcacaggccggcctccgcttcccgggaagacggcgcactcctggccctgggttcttgctgctgcccaccctctgctccctgggatgggccccgaggcgagcagcttcagcacaggcctggccctgctccaggtgcaggaaggaggataaggccgggccgagaggcggcacacctggaccatcccatgggcctccgcccgcgccgccccgaggatgagtggtgatgtcctctagccacccctagcagcgtcggctctccctggacgtgcggccgcggactgggacttggctttctccggataagcggcggcaccggcgtcagcgatgaccgtgcagagactcgtggccgcggccgtgctggtggccctggtctcactcatcctcaacaacgtggcggccttcacctccaactgggtgtgccagacgctggaggatgggcgcaggcgcagcgtggggctgtggaggtcctgctggctggtggacaggacccggggagggccgagccctggggccagagccggccaggtggacgcacatgactgtgaggcgctgggctggggctccgaggcagccggcttccaggagtcccgaggcaccgtcaaactgcagttcgacatgatgcgcgcctgcaacctggtggccacggccgcgctcaccgcaggccagctcaccttcctcctggggctggtgggcctgcccctgctgtcacccgacgccccgtgctgggaggaggccatggccgctgcattccaactggcgagttttgtcctggtcatcgggctcgtgactttctacagaattggcccatacaccaacctgtcctggtcctgctacctgaacattggcgcctgccttctggccacgctggcggcagccatgctcatctggaacattctccacaagagggaggactgcatggccccccgggtgattgtcatcagccgctccctgacagcgcgctttcgccgtgggctggacaatgactacgtggagtcaccatgctgagtcgcccttctcagcgctccatcaacgcacacctgctatcgtggaacagcctagaaaccaagggactccaccaccaagtcacttcccctgctcgtgcagaggcacgggatgagtctgggtgacctctgcgccatgcgtgcgagacacgtgtgcgtttactgttatgtcggtcatatgtctgtacgtgtcgtgggccaacctcgttctgcctccagctttcctggttagcgcaacgcggctccacgaccacacgcacttcagggtggaagctggaagctgagacacaggttaggtggcgcgaggctgccctgcgctccgctttgctttgggattaatttattctgcatctgctgagaggggcaccccagccatatcttacactttggtaaagcagaaaaccaggaaaattttcttaaaatatccacaatattccttgagtgagtcagaatctatagccggttagtgatggtttcagacagaatcgtgttcgtgtctgttttgctcgattcctttcctaagttaaataaatgcaagcctctgaactctg

SEQ ID NO: 296073 - DNA, 2507 bp, Homo sapiens
gtctggctgccgcggagggcctactatttgttgcggttggctacgccttccagctcaccaaaaacagtctcaaaaacaaccatttcctctctgctgagagccagggaaggcgagctctgcgcacacgggcgtccctgcagcagccactctgctttccaggaccggccaactgccctggaggcatccacacaggggcccaggcagcacagaggagctgtgaacccgctccacaccggccaccctgcccggagcctggcactcacagcaggccggtgctaaggagtgtggcgcgggctcgactcccactgctgccggcctcccgagtgactctgttttccactgctgcaggcgagaagaggcacgcgcggcacaggccggcctccgcttcccgggaagacggcgcactcctggccctgggttcttgctgctgcccaccctctgctccctgggatgggccccgaggcgagcagcttcagcacaggcctggccctgctccaggtgcaggaaggaggataaggccgggccgagaggcggcacacctggaccatcccatgggcctccgcccgcgccgccccgaggatgagtggtgatgtcctctagccacccctagcagcgtcggctctccctggacgtgcggccgcggactgggacttggctttctccggataagcggcggcaccggcgtcagcgatgaccgtgcagagactcgtggccgcggccgtgctggtggccctggtctcactcatcctcaacaacgtggcggccttcacctccaactgggtgtgccagacgctggaggatgggcgcaggcgcagcgtggggctgtggaggtcctgctggctggtggacaggacccggggagggccgagccctggggccagagccggccaggtggacgcacatgactgtgaggcgctgggctggggctccgaggcagccggcttccaggagtcccgaggcaccgtcaaactgcagttcgacatgatgcgcgcctgcaacctggtggccacggccgcgctcaccgcaggccagctcaccttcctcctggggctggtgggcctgcccctgctgtcacccgacgccccgtgctgggaggaggccatggccgctgcattccaactggcgagttttgtcctggtcatcgggctcgtgactttctacagaattggcccatacaccaacctgtcctggtcctgctacctgaacattggcgcctgccttctggccacgctggcggcagccatgctcatctggaacattctccacaagagggaggactgcatggccccccgggtgattgtcatcagccgctccctgacagcgcgctttcgccgtgggctggacaatgactacgtggagtcaccatgctgagtcgcccttctcagcgctccatcaacgcacacctgctatcgtggaacagcctagaaaccaagggactccaccaccaagtcacttcccctgctcgtgcagaggcacgggatgagtctgggtgacctctgcgccatgcgtgcgagacacgtgtgcgtttactgttatgtcggtcatatgtctgtacgtgtcgtgggccaacctcgttctgcctccagctttcctggttagcgcaacgcggctccacgaccacacgcacttcagggtggaagctggaagctgagacacaggttaggtggcgcgaggctgccctgcgctccgctttgctttgggattaatttattctgcatctgctgagaggggcaccccagccatatcttacactttggtaaagcagaaaaccaggaaaattttcttaaaatatccacaatattccttgagtgagtcagaatctatagccggttagtgatggtttcagacagaatcgtgttcgtgtctgttttgctcgattcctttcctaagttaaataaatgcaagcctctgaactctgaataaaaaaaaaataaaaaaaaaaacaacaaccactcatcaaaacaaacacaaaaaacaaaagggggggccccccccccataaagtatttcccccggggggggcgcccccaatcttttgtcggcgcgctaacccccgtttttttgtgtacacaagggggggccctaatatgggatggcgctgtcattatataacaagccgagtagcggctaatcgcccccctatttattacaacaacacgtgctctgtgatacgggtggaacacaccttgcgtgcctactcgggggtcaccttttgtggttgggaggcagcccctcactactcttaggcgggggtgcgagccaaccacactattgggtggccacaacaataattgccttctatggcggacaactattatacgaaccgctctcatcgagcgggagccatgtactcatagcacccttctccagcagaggcgtatatccaacggtgcctacaaacaacctgtgggctgataaatatactcgatgcgcgtgataaaacaacctactgctgcgccagccgggagtagttgagtgcgtggctcaaactccactttatacccgggt

SEQ ID NO: 296074 - DNA, 1738 bp, Homo sapiens
gtctggctgccgcggagggcctactatttgttgcggttggctacgccttccagctcaccaaaaacagtctcaaaaacaaccatttcctctctgctgagagccagggaaggcgagctctgcgcacacgggcgtccctgcagcagccacttctgttttccactgctgcaggcgagaagaggcacgcgcggcacaggccggcctccgcttcccgggaagacggcgcactcctggccctgggttcttgctgctgcccaccctctgctccctgggatgggccccgaggcgagcagcttcagcacaggcctggccctgctccaggtgcaggaaggaggataaggccgggccgagaggcggcacacctggaccatcccatgggcctccgcccgcgccgccccgaggatgagtggtgatgtcctctagccacccctagcagcgtcggctctccctggacgtgcggccgcggactgggacttggctttctccggataagcggcggcaccggcgtcagcgatgaccgtgcagagactcgtggccgcggccgtgctggtggccctggtctcactcatcctcaacaacgtggcggccttcacctccaactgggtgtgccagacgctggaggatgggcgcaggcgcagcgtggggctgtggaggtcctgctggctggtggacaggacccggggagggccgagccctggggccagagccggccaggtggacgcacatgactgtgaggcgctgggctggggctccgaggcagccggcttccaggagtcccgaggcaccgtcaaactgcagttcgacatgatgcgcgcctgcaacctggtggccacggccgcgctcaccgcaggccagctcaccttcctcctggggctggtgggcctgcccctgctgtcacccgacgccccgtgctgggaggaggccatggccgctgcattccaactggcgagttttgtcctggtcatcgggctcgtgactttctacagaattggcccatacaccaacctgtcctggtcctgctacctgaacattggcgcctgccttctggccacgctggcggcagccatgctcatctggaacattctccacaagagggaggactgcatggccccccgggtgattgtcatcagccgctccctgacagcgcgctttcgccgtgggctggacaatgactacgtggagtcaccatgctgagtcgcccttctcagcgctccatcaacgcacacctgctatcgtggaacagcctagaaaccaagggactccaccaccaagtcacttcccctgctcgtgcagaggcacgggatgagtctgggtgacctctgcgccatgcgtgcgagacacgtgtgcgtttactgttatgtcggtcatatgtctgtacgtgtcgtgggccaacctcgttctgcctccagctttcctggttagcgcaacgcggctccacgaccacacgcacttcagggtggaagctggaagctgagacacaggttaggtggcgcgaggctgccctgcgctccgctttgctttgggattaatttattctgcatctgctgagaggggcaccccagccatatcttacactttggtaaagcagaaaaccaggaaaattttcttaaaatatccacaatattccttgagtgagtcagaatctatagccggttagtgatggtttcagacagaatcgtgttcgtgtctgttttgctcgattcctttcctaagttaaataaatgcaagcctctgaactctg

SEQ ID NO: 296075 - DNA, 644 bp, Homo sapiens
gcggccgcgagcggggcgggggctgccggtgccctccgcaggccgggcctcctgggcgcccctcggtgctgcaggctggggggccttgggtacctgcagagccttttctctgaattccttatgtccggtgggccagaagcccgtcctcctatgctggtggaaggcggaggaccggagtccctgcagaaggccccgtgcactcgggggcctccctcacatcccgtgccccctgcgctggccttcacagtaggtaatggctccggcccgggtgttcgctgtccacggaacatggcagaggggcaccccggcccggaaagacgccagagccagcaggggctgtttcgggccgcgtggctccccgggtctcggccgtctcccctcttctgcgtctgttccgtgacttcgcctgggtgggatgtaccgcaggtgcatcgcgtcgaggtggggcacggccgccggcaagaaacccaccctgtccggaggcgggcgtgagacaagcccagcccgcacgcgctcatctttcttcgttttttgatcagtttattcagaattgctctataatttaccaattgtatgtatttaacctattcttgtggaaaaaaaaggtctttcattatatctttatttctgaatttcaaactgct

SEQ ID NO: 296076 - DNA, 360 bp, Homo sapiens
gcggtactcggccgagggcgagccttttctctgaattccttatgtccaggggctgtttcgggccgcgtggctccccgggtctcggccgtctcccctcttctgcgtctgttccgtgacttcgcctgggtgggatgtaccgcaggtgcatcgcgtcgaggtggggcacggccgccggcaagaaacccaccctgtccggaggcgggcgtgagacaagcccagcccgcacgcgctcatctttcttcgttttttgatcagtttattcagaattgctctataatttaccaattgtatgtatttaacctattcttgtggaaaaaaaaggtctttcattatatctttatttctgaatttcaaactgct

SEQ ID NO: 296077 - DNA, 2414 bp, Homo sapiens
gtttctccatagcataaatgaaaaaaaaaaaaaaaaagtaaacagggcagtgtgtgctttttcttttctcccccctcaactatattaagaactcctagtttcaccctttctccatcccatcatcccacctatctgtggttgcttcccaagacctcctcccaagatagacatctcctacccagtgcccttgtgtgaccccaggactcaagtctcagactgtgaacagatgtggccatgcccagagacgccagcctggccagaagggcatgcctcagcttactacttcatctctcctggttccctccctgcagtgccccgggtgtcatcttctcccactctgggtaccagggattctaccacataggcttcccaaagccccattctaactcccctctctcagggaagccctagagagaggtccaaaaagcattcacagctgtatcacactctatgcaggtggggtaggagactgatcaggcctgctgtggggaagcagtatgtatgaacacagccagaaatgtcatagtccaaacaggatgctttcaggccatctcagctgcttgatggtgagatggttcccttattccttcaggaaaggcttagcattgggccacataggggaagcagctttgaacaaatcagtcatagcactgcctatagcattagccagtgaccaaattagggacaacgtcttggcacagaattgcttatcaaggaacatttccacaagaaagaaaatattaaggggttatttccacagaagcccaaaacgtcttggaaacacagaggtgaggaggaggaatagtaattgtcaatgagcttttaataccaagatacaccccctgcccccaaagaagagtcctcttttagggaatcagaaccttcattgtcctagaagctgaaagattcttggaacattttagcttttactctcaacttgctgttctctttacattccttaagttagactttcgggtgtggcttctctcccaggggtaacatttacttccattttctagaccgaaccaaaagtcttctgcagaatctcccaccgagtgtggtaagaaggaaggacaaaaggctttaggatataaatttcatgttacagagcatgtcattgtcaaaggaaatctgtggccctgagattttaagaacataaaatgtgacatttgatatttctccagcccagggaagtaagatggttagcaatggttgccttaatcaaatggtcccatttttaaccccaaaggaagtgcccacagcaagaggtttgtgtgatgcacttatgtcctccggtgaggaaagggggccacatatgaaaggccccttaggtcagatcctgagagtagcacatttgagtgcagattcctgggccccacctcaaacctactaattctgaatctctgggaatagggccaggaaatctgccctttctacaaactacccaagttgttctgttgcacatcaatgtttgggaaccactgctgtaagggaatcattctggtcaccttgagctttgagctaccactaagccatgaaagaaaatacatcatacagggaagagagaagggaggaggttccaagtagtaactggcagatcctcctgtctggaggtaccaccttctattctggtttctgacttttccttcttgatgaccatagatgtgttccagaggcaaaagagacacattatcccagatggcagaacatgctttcaaaacatataaaatgtcaaagttccagatccttctacatctttagtcctgtctgaggatggtagctggctctctgtagctgatagatggctagagttccatccaaatccttgaccacgacttcatggagatttgaataatctatttgatgagatttctatttcaataacccacctctctcaccccacattcatatccctaaatttgaccctctgggccgagtcacattaccttcaggagacttgatcccagtagactgaggtcttccctttcagcagaaagatttcatttccctggcttgccagtggcactgatttccgaacacccaatgagtttaatattctttcctccttggcattactgccccagcctctttttattttttttgtgtgtgtctaataaccaggaaaaaaataaagcttaggttttaaaaagttttaaaaataatctgtttcagaaactgtcaaatgtaccatatttgtattaagagttgttgggaatttttgtacaatgaatttacatttatttatggtgacatatttacgcttgtgatcaaataatgatgttaaattcttaaatcatatttgctatgcagctgaagatgatattttgatttgtattttgggggtacctgtgttgagttgataaacatttccatcttcattaaaactgcttccaaactagtaaaaccaaaaaatt

SEQ ID NO: 296078 - DNA, 2360 bp, Homo sapiens
gtttctccatagcataaatgaaaaaaaaaaaaaaaaagtaaacagggcagtgtgtgctttttcttttctcccccctcaactatattaagaactcctagtttcaccctttctccatcccatcatcccacctatctgtggttgcttcccaagacctcctcccaagatagacatctcctacccagtgcccttgtgtgaccccaggactcaagtctcagactgtgaacagatgtggccatgcccagagacgccagcctggccagaagggcatgcctcagcttactacttcatctctcctggttccctccctgcagtgccccgggtgtcatcttctcccactctgggtaccagggattctaccacataggcttcccaaagccccattctaactcccctctctcagggaagccctagagagaggtccaagcctgctgtggggaagcagtatgtatgaacacagccagaaatgtcatagtccaaacaggatgctttcaggccatctcagctgcttgatggtgagatggttcccttattccttcaggaaaggcttagcattgggccacataggggaagcagctttgaacaaatcagtcatagcactgcctatagcattagccagtgaccaaattagggacaacgtcttggcacagaattgcttatcaaggaacatttccacaagaaagaaaatattaaggggttatttccacagaagcccaaaacgtcttggaaacacagaggtgaggaggaggaatagtaattgtcaatgagcttttaataccaagatacaccccctgcccccaaagaagagtcctcttttagggaatcagaaccttcattgtcctagaagctgaaagattcttggaacattttagcttttactctcaacttgctgttctctttacattccttaagttagactttcgggtgtggcttctctcccaggggtaacatttacttccattttctagaccgaaccaaaagtcttctgcagaatctcccaccgagtgtggtaagaaggaaggacaaaaggctttaggatataaatttcatgttacagagcatgtcattgtcaaaggaaatctgtggccctgagattttaagaacataaaatgtgacatttgatatttctccagcccagggaagtaagatggttagcaatggttgccttaatcaaatggtcccatttttaaccccaaaggaagtgcccacagcaagaggtttgtgtgatgcacttatgtcctccggtgaggaaagggggccacatatgaaaggccccttaggtcagatcctgagagtagcacatttgagtgcagattcctgggccccacctcaaacctactaattctgaatctctgggaatagggccaggaaatctgccctttctacaaactacccaagttgttctgttgcacatcaatgtttgggaaccactgctgtaagggaatcattctggtcaccttgagctttgagctaccactaagccatgaaagaaaatacatcatacagggaagagagaagggaggaggttccaagtagtaactggcagatcctcctgtctggaggtaccaccttctattctggtttctgacttttccttcttgatgaccatagatgtgttccagaggcaaaagagacacattatcccagatggcagaacatgctttcaaaacatataaaatgtcaaagttccagatccttctacatctttagtcctgtctgaggatggtagctggctctctgtagctgatagatggctagagttccatccaaatccttgaccacgacttcatggagatttgaataatctatttgatgagatttctatttcaataacccacctctctcaccccacattcatatccctaaatttgaccctctgggccgagtcacattaccttcaggagacttgatcccagtagactgaggtcttccctttcagcagaaagatttcatttccctggcttgccagtggcactgatttccgaacacccaatgagtttaatattctttcctccttggcattactgccccagcctctttttattttttttgtgtgtgtctaataaccaggaaaaaaataaagcttaggttttaaaaagttttaaaaataatctgtttcagaaactgtcaaatgtaccatatttgtattaagagttgttgggaatttttgtacaatgaatttacatttatttatggtgacatatttacgcttgtgatcaaataatgatgttaaattcttaaatcatatttgctatgcagctgaagatgatattttgatttgtattttgggggtacctgtgttgagttgataaacatttccatcttcattaaaactgcttccaaactagtaaaaccaaaaaatt

SEQ ID NO: 296079 - DNA, 2490 bp, Homo sapiens
  misc_feature (2490)..(2490): n is a, c, g, or t
gtttctccatagcataaatgaaaaaaaaaaaaaaaaagtaaacagggcagtgtgtgctttttcttttctcccccctcaactatattaagaactcctagtttcaccctttctccatcccatcatcccacctatctgtggttgcttcccaagacctcctcccaagatagacatctcctacccagtgcccttgtgtgaccccaggactcaagtctcagactgtgaacagatgtggccatgcccagagacgccagcctggccagaagggcatgcctcagcttactacttcatctctcctggttccctccctgcagtgccccgggtgtcatcttctcccactctgggtaccagggattctaccacataggcttcccaaagccccattctaactcccctctctcagggaagccctagagagaggtccaaaaagcattcacagctgtatcacactctatgcaggtggggtaggagactgatcaggcctgctgtggggaagcagtatgtatgaacacagccagaaatgtcatagtccaaacaggatgctttcaggccatctcagctgcttgatggtgagatggttcccttattccttcaggaaaggcttagcattgggccacataggggaagcagctttgaacaaatcagtcatagcactgcctatagcattagccagtgaccaaattagggacaacgtcttggcacagaattgcttatcaaggaacatttccacaagaaagaaaatattaaggggttatttccacagaagcccaaaacgtcttggaaacacagaggtgaggaggaggaatagtaattgtcaatgagcttttaataccaagatacaccccctgcccccaaagaagagtcctcttttagggaatcagaaccttcattgtcctagaagctgaaagattcttggaacattttagcttttactctcaacttgctgttctctttacattccttaagttagactttcgggtgtggcttctctcccaggggtaacatttacttccattttctagaccgaaccaaaagtcttctgcagaatctcccaccgagtgtggtaagaaggaaggacaaaaggctttaggatataaatttcatgttacagagcatgtcattgtcaaaggaaatctgtggccctgagattttaagaacataaaatgtgacatttgatatttctccagcccagggaagtaagatggttagcaatggttgccttaatcaaatggtcccatttttaaccccaaaggaagtgcccacagcaagaggtttgtgtgatgcacttatgtcctccggtgaggaaagggggccacatatgaaaggccccttaggtcagatcctgagagtagcacatttgagtgcagattcctgggccccacctcaaacctactaattctgaatctctgggaatagggccaggaaatctgccctttctacaaactacccaagttgttctgttgcacatcaatgtttgggaaccactgctgtaagggaatcattctggtcaccttgagctttgagctaccactaagccatgaaagaaaatacatcatacagggaagagagaagggaggaggttccaagtagtaactggcagatcctcctgtctggaggtaccaccttctattctggtttctgacttttccttcttgatgaccatagatgtgttccagaggcaaaagagacacattatcccagatggcagaacatgctttcaaaacatataaaatgtcaaagttccagatccttctacatctttagtcctgtctgaggatggtagctggctctctgtagctgatagatggctagagttccatccaaatccttgaccacgacttcatggagatttgaataatctatttgatgagatttctatttcaataacccacctctctcaccccacattcatatccctaaatttgaccctctgggccgagtcacattaccttcaggagacttgatcccagtagactgaggtcttccctttcagcagaaagatttcatttccctggcttgccagtggcactgatttccgaacacccaatgagtttaatattctttcctccttggcattactgccccagcctctttttattttttttgtgtgtgtctaataaccaggaaaaaaataaagcttaggttttaaaaagttttaaaaataatctgtttcagaaactgtcaaatgtaccatatttgtattaagagttgttgggaatttttgtacaatgaatttacatttatttatggtgacatatttacgcttgtgatcaaataatgatgttaaattcttaaatcatatttgctatgcagctgaagatgatattttgatttgtattttgggggtacctgtgttgagttgataaacatttccatcttcattaaaactgcttccaaactagtaaaaccaaaaaattacaacaattaattggccgttgttttacaacggctgactgggaaacccttgccgtccccaactttattgcttgtccn

SEQ ID NO: 296080 - DNA, 1337 bp, Homo sapiens
attttaagaacataaaatctcagggccacagatttcctttgacaatgacatgctctgtggccctgagattttaagaacataaaatgtgacatttgatatttctccagcccagggaagtaagatggttagcaatggttgccttaatcaaatggtcccatttttaaccccaaaggaagtgcccacagcaagaggtttgtgtgatgcacttatgtcctccggtgaggaaagggggccacatatgaaaggccccttaggtcagatcctgagagtagcacatttgagtgcagattcctgggccccacctcaaacctactaattctgaatctctgggaatagggccaggaaatctgccctttctacaaactacccaagttgttctgttgcacatcaatgtttgggaaccactgctgtaagggaatcattctggtcaccttgagctttgagctaccactaagccatgaaagaaaatacatcatacagggaagagagaagggaggaggttccaagtagtaactggcagatcctcctgtctggaggtaccaccttctattctggtttctgacttttccttcttgatgaccatagatgtgttccagaggcaaaagagacacattatcccagatggcagaacatgctttcaaaacatataaaatgtcaaagttccagatccttctacatctttagtcctgtctgaggatggtagctggctctctgtagctgatagatggctagagttccatccaaatccttgaccacgacttcatggagatttgaataatctatttgatgagatttctatttcaataacccacctctctcaccccacattcatatccctaaatttgaccctctgggccgagtcacattaccttcaggagacttgatcccagtagactgaggtcttccctttcagcagaaagatttcatttccctggcttgccagtggcactgatttccgaacacccaatgagtttaatattctttcctccttggcattactgccccagcctctttttattttttttgtgtgtgtctaataaccaggaaaaaaataaagcttaggttttaaaaagttttaaaaataatctgtttcagaaactgtcaaatgtaccatatttgtattaagagttgttgggaatttttgtacaatgaatttacatttatttatggtgacatatttacgcttgtgatcaaataatgatgttaaattcttaaatcatatttgctatgcagctgaagatgatattttgatttgtattttgggggtacctgtgttgagttgataaacatttccatcttcattaaaactgcttccaaactagtaaaaccaaaaaatt

SEQ ID NO: 296081 - DNA, 624 bp, Homo sapiens
actactactactactgctcgaattcaagcttctaacgatgtacgggttcatggagatttgaataatctatttgatgagatttctatttcaataacccacctctctcaccccacattcatatccctaaatttgaccctctgggccgagtcacattaccttcaggagacttgatcccagtagactgaggtcttccctttcagcagaaagatttcatttccctggcttgccagtggcactgatttccgaacacccaatgagtttaatattctttcctccttggcattactgccccagcctctttttattttttttgtgtgtgtctaataaccaggaaaaaaataaagcttaggttttaaaaagttttaaaaataatctgtttcagaaactgtcaaatgtaccatatttgtattaagagttgttgggaatttttgtacaatgaatttacatttatttatggtgacatatttacgcttgtgatcaaataatgatgttaaattcttaaatcatatttgctatgcagctgaagatgatattttgatttgtattttgggggtacctgtgttgagttgataaacatttccatcttcattaaaactgcttccaaactagtaaaaccaaaaaatt

SEQ ID NO: 296082 - DNA, 4416 bp, Homo sapiens
gcgcggcggccgtggttgcggcgcgggaagtttggatcctggttccgtccgctaggagtctgcgtgcgaggattatggctgctgttcctcaaaataatctacaggagcaactagaacgtcactcagccagaacacttaataataaattaagtctttcaaaaccaaaattttcaggtttcacttttaaaaagaaaacatcttcagataacaatgtatctgtaactaatgtgtcagtagcaaaaacacctgtattaagaaataaagatgttaatgttaccgaagacttttccttcagtgaacctctacccaacaccacaaatcagcaaagggtcaaggacttctttaaaaatgctccagcaggacaggaaacacagagaggtggatcaaaatcattattgccagatttcttgcagactccgaaggaagttgtatgcactacccaaaacacaccaactgtaaagaaatcccgggatactgctctcaagaaattagaatttagttcttcaccagattctttaagtaccatcaatgattgggatgatatggatgactttgatacttctgagacttcaaaatcatttgttacaccaccccaaagtcactttgtaagagtaagcactgctcagaaatcaaaaaagggtaagagaaacttttttaaagcacagctttatacaacaaacacagtaaagactgatttgcctccaccctcctctgaaagcgagcaaatagatttgactgaggaacagaaggatgactcagaatggttaagcagcgatgtgatttgcatcgatgatggccccattgctgaagtgcatataaatgaagatgctcaggaaagtgactctctgaaaactcatttggaagatgaaagagataatagcgaaaagaagaagaatttggaagaagctgaattacattcaactgagaaagttccatgtattgaatttgatgatgatgattatgatacggattttgttccaccttctccagaagaaattatttctgcttcttcttcctcttcaaaatgccttagtacgttaaaggaccttgacacctctgacagaaaagaggatgttcttagcacatcaaaagatcttttgtcaaaacctgagaaaatgagtatgcaggagctgaatccagaaaccagcacagactgtgacgctagacagataagtttacagcagcagcttattcatgtgatggagcacatctgtaaattaattgatactattcctgatgataaactgaaacttttggattgtgggaacgaactgcttcagcagcggaacataagaaggaaacttctaacggaagtagattttaataaaagtgatgccagtcttcttggctcattgtggagatacaggcctgattcacttgatggccctatggagggtgattcctgccctacagggaattctatgaaggagttaaatttttcacaccttccctcaaattctgtttctcctggggactgtttactgactaccaccctaggaaagacaggattctctgccaccaggaagaatctttttgaaaggcctttattcaatacccatttacagaagtcctttgtaagtagcaactgggctgaaacaccaagactaggaaaaaaaaatgaaagctcttatttcccaggaaatgttctcacaagcactgctgtgaaagatcagaataaacatactgcttcaataaatgacttagaaagagaaacccaaccttcctatgatattgataattttgacatagatgactttgatgatgatgatgactgggaagacataatgcataatttagcagccagcaaatcttccacagctgcctatcaacccatcaaggaaggtcggccaattaaatcagtatcagaaagactttcctcagccaagacagactgtcttccagtgtcatctactgctcaaaatataaacttctcagagtcaattcagaattatactgacaagtcagcacaaaatttagcatccagaaatctgaaacatgagcgtttccaaagtcttagttttcctcatacaaaggaaatgatgaagatttttcataaaaaatttggcctgcataattttagaactaatcagctagaggcgatcaatgctgcactgcttggtgaagactgttttatcctgatgccgactggaggtggtaagagtttgtgttaccagctccctgcctgtgtttctcctggggtcactgttgtcatttctcccttgagatcacttatcgtagatcaagtccaaaagctgacttccttggatattccagctacatatctgacaggtgataagactgactcagaagctacaaatatttacctccagttatcaaaaaaagacccaatcataaaacttctatatgtcactccagaaaagatctgtgcaagtaacagactcatttctactctggagaatctctatgagaggaagctcttggcacgttttgttattgatgaagcacattgtgtcagtcagtggggacatgattttcgtcaagattacaaaagaatgaatatgcttcgccagaagtttccttctgttccggtgatggctcttacggccacagctaatcccagggtacagaaggacatcctgactcagctgaagattctcagacctcaggtgtttagcatgagctttaacagacataatctgaaatactatgtattaccgaaaaagcctaaaaaggtggcatttgattgcctagaatggatcagaaagcaccacccatatgattcagggataatttactgcctctccaggcgagaatgtgacaccatggctgacacgttacagagagatgggctcgctgctcttgcttaccatgctggcctcagtgattctgccagagatgaagtgcagcagaagtggattaatcaggatggctgtcaggttatctgtgctacaattgcatttggaatggggattgacaaaccggacgtgcgatttgtgattcatgcatctctccctaaatctgtggagggttactaccaagaatctggcagagctggaagagatggggaaatatctcactgcctgcttttctatacctatcatgatgtgaccagactgaaaagacttataatgatggaaaaagatggaaaccatcatacaagagaaactcacttcaataatttgtatagcatggtacattactgtgaaaatataacggaatgcaggagaatacagcttttggcctactttggtgaaaatggatttaatcctgatttttgtaagaaacacccagatgtttcttgtgataattgctgtaaaacaaaggattataaaacaagagatgtgactgacgatgtgaaaagtattgtaagatttgttcaagaacatagttcatcacaaggaatgagaaatataaaacatgtaggtccttctggaagatttactatgaatatgctggtcgacattttcttggggagtaagagtgcaaaaatccagtcaggtatatttggaaaaggatctgcttattcacgacacaatgccgaaagactttttaaaaagctgatacttgacaagattttggatgaagacttatatatcaatgccaatgaccaggcgatcgcttatgtgatgctcggaaataaagcccaaactgtactaaatggcaatttaaaggtagactttatggaaacagaaaattccagcagtgtgaaaaaacaaaaagcgttagtagcaaaagtgtctcagagggaagagatggttaaaaaatgtcttggagaacttacagaagtctgcaaatctctggggaaagtttttggtgtccattacttcaatatttttaataccgtcactctcaagaagcttgcagaatctttatcttctgatcctgaggttttgcttcaaattgatggtgttactgaagacaaactggaaaaatatggtgcggaagtgatttcagtattacagaaatactctgaatggacatcgccagctgaagacagttccccagggataagcctgtccagcagcagaggccccggaagaagtgccgctgaggagctcgacgaggaaatacccgtatcttcccactactttgcaagtaaaaccagaaatgaaaggaagaggaaaaagatgccagcctcccaaaggtctaagaggagaaaaactgcttccagtggttccaaggcaaagggggggtctgccacatgtagaaagatatcttccaaaacgaaatcctccagcatcattggatccagttcagcctcacatacttctcaagcgacatcaggagccaatagcaaattggggattatggctccaccgaagcctataaatagaccgtttcttaagccttcatatgcattctcataacaaccgaatctcaatgtacatagaccctctttcttgtttgtcagcatctgaccatctgtgactataaagctgttattcttgttatacc

SEQ ID NO: 296083 - DNA, 980 bp, Homo sapiens
gcagtaaagagagggcacaccagtctcagctagatgagtactggccatgggaacagtgggcaagagcagatctgctccactccacgcacatggcacaggtcccaccctcagcttcctcctgccctggctcttgcccttgctctgccctggcctatgccgctggaattggatgaatctttatcttctgatcctgaggttttgcttcaaattgatggtgttactgaagacaaactggaaaaatatggtgcggaagtgatttcagtattacagaaatactctgaatggacatcgccagctgaagacagttccccagggataagcctgtccagcagcagaggccccggaagaagtgccgctgaggagctcgacgaggaaatacccgtatcttcccactactttgcaagtaaaaccagaaatgaaaggaagaggaaaaagatgccagcctcccaaaggtctaagaggagaaaaactgcttccagtggttccaaggcaaagggggggtctgccacatgtagaaagatatcttccaaaacgaaatcctccagcatcattggatccagttcagcctcacatacttctcaagcgacatcaggagccaatagcaaattggggattatggctccaccgaagcctataaatagaccgtttcttaagccttcatatgcattctcataacaaccgaatctcaatgtacatagaccctctttcttgtttgtcagcatctgaccatctgtgactataaagctgttattcttgttataccatttgaagtttttactcgtctctattaatatttaaataaatgctggggggtgatagttcttctttttaaaataaacattttcttttgaatagctgttttggtgccgctgcaagtgttgtggccgttgttctcagaacgtctgaggcagcagctggatcatctcaggcagagctttgagcataaagaaaccagaagccaaaggaagagccacgcgtgg

SEQ ID NO: 296084 - DNA, 4633 bp, Homo sapiens
gcgcggcggccgtggttgcggcgcgggaagtttggatcctggttccgtccgctaggagtctgcgtgcgaggattatggctgctgttcctcaaaataatctacaggagcaactagaacgtcactcagccagaacacttaataataaattaagtctttcaaaaccaaaattttcaggtttcacttttaaaaagaaaacatcttcagataacaatgtatctgtaactaatgtgtcagtagcaaaaacacctgtattaagaaataaagatgttaatgttaccgaagacttttccttcagtgaacctctacccaacaccacaaatcagcaaagggtcaaggacttctttaaaaatgctccagcaggacaggaaacacagagaggtggatcaaaatcattattgccagatttcttgcagactccgaaggaagttgtatgcactacccaaaacacaccaactgtaaagaaatcccgggatactgctctcaagaaattagaatttagttcttcaccagattctttaagtaccatcaatgattgggatgatatggatgactttgatacttctgagacttcaaaatcatttgttacaccaccccaaagtcactttgtaagagtaagcactgctcagaaatcaaaaaagggtaagagaaacttttttaaagcacagctttatacaacaaacacagtaaagactgatttgcctccaccctcctctgaaagcgagcaaatagatttgactgaggaacagaaggatgactcagaatggttaagcagcgatgtgatttgcatcgatgatggccccattgctgaagtgcatataaatgaagatgctcaggaaagtgactctctgaaaactcatttggaagatgaaagagataatagcgaaaagaagaagaatttggaagaagctgaattacattcaactgagaaagttccatgtattgaatttgatgatgatgattatgatacggattttgttccaccttctccagaagaaattatttctgcttcttcttcctcttcaaaatgccttagtacgttaaaggaccttgacacctctgacagaaaagaggatgttcttagcacatcaaaagatcttttgtcaaaacctgagaaaatgagtatgcaggagctgaatccagaaaccagcacagactgtgacgctagacagataagtttacagcagcagcttattcatgtgatggagcacatctgtaaattaattgatactattcctgatgataaactgaaacttttggattgtgggaacgaactgcttcagcagcggaacataagaaggaaacttctaacggaagtagattttaataaaagtgatgccagtcttcttggctcattgtggagatacaggcctgattcacttgatggccctatggagggtgattcctgccctacagggaattctatgaaggagttaaatttttcacaccttccctcaaattctgtttctcctggggactgtttactgactaccaccctaggaaagacaggattctctgccaccaggaagaatctttttgaaaggcctttattcaatacccatttacagaagtcctttgtaagtagcaactgggctgaaacaccaagactaggaaaaaaaaatgaaagctcttatttcccaggaaatgttctcacaagcactgctgtgaaagatcagaataaacatactgcttcaataaatgacttagaaagagaaacccaaccttcctatgatattgataattttgacatagatgactttgatgatgatgatgactgggaagacataatgcataatttagcagccagcaaatcttccacagctgcctatcaacccatcaaggaaggtcggccaattaaatcagtatcagaaagactttcctcagccaagacagactgtcttccagtgtcatctactgctcaaaatataaacttctcagagtcaattcagaattatactgacaagtcagcacaaaatttagcatccagaaatctgaaacatgagcgtttccaaagtcttagttttcctcatacaaaggaaatgatgaagatttttcataaaaaatttggcctgcataattttagaactaatcagctagaggcgatcaatgctgcactgcttggtgaagactgttttatcctgatgccgactggaggtggtaagagtttgtgttaccagctccctgcctgtgtttctcctggggtcactgttgtcatttctcccttgagatcacttatcgtagatcaagtccaaaagctgacttccttggatattccagctacatatctgacaggtgataagactgactcagaagctacaaatatttacctccagttatcaaaaaaagacccaatcataaaacttctatatgtcactccagaaaagatctgtgcaagtaacagactcatttctactctggagaatctctatgagaggaagctcttggcacgttttgttattgatgaagcacattgtgtcagtcagtggggacatgattttcgtcaagattacaaaagaatgaatatgcttcgccagaagtttccttctgttccggtgatggctcttacggccacagctaatcccagggtacagaaggacatcctgactcagctgaagattctcagacctcaggtgtttagcatgagctttaacagacataatctgaaatactatgtattaccgaaaaagcctaaaaaggtggcatttgattgcctagaatggatcagaaagcaccacccatatgattcagggataatttactgcctctccaggcgagaatgtgacaccatggctgacacgttacagagagatgggctcgctgctcttgcttaccatgctggcctcagtgattctgccagagatgaagtgcagcagaagtggattaatcaggatggctgtcaggttatctgtgctacaattgcatttggaatggggattgacaaaccggacgtgcgatttgtgattcatgcatctctccctaaatctgtggagggttactaccaagaatctggcagagctggaagagatggggaaatatctcactgcctgcttttctatacctatcatgatgtgaccagactgaaaagacttataatgatggaaaaagatggaaaccatcatacaagagaaactcacttcaataatttgtatagcatggtacattactgtgaaaatataacggaatgcaggagaatacagcttttggcctactttggtgaaaatggatttaatcctgatttttgtaagaaacacccagatgtttcttgtgataattgctgtaaaacaaaggattataaaacaagagatgtgactgacgatgtgaaaagtattgtaagatttgttcaagaacatagttcatcacaaggaatgagaaatataaaacatgtaggtccttctggaagatttactatgaatatgctggtcgacattttcttggggagtaagagtgcaaaaatccagtcaggtatatttggaaaaggatctgcttattcacgacacaatgccgaaagactttttaaaaagctgatacttgacaagattttggatgaagacttatatatcaatgccaatgaccaggcgatcgcttatgtgatgctcggaaataaagcccaaactgtactaaatggcaatttaaaggtagactttatggaaacagaaaattccagcagtgtgaaaaaacaaaaagcgttagtagcaaaagtgtctcagagggaagagatggttaaaaaatgtcttggagaacttacagaagtctgcaaatctctggggaaagtttttggtgtccattacttcaatatttttaataccgtcactctcaagaagcttgcagaatctttatcttctgatcctgaggttttgcttcaaattgatggtgttactgaagacaaactggaaaaatatggtgcggaagtgatttcagtattacagaaatactctgaatggacatcgccagctgaagacagttccccagggataagcctgtccagcagcagaggccccggaagaagtgccgctgaggagctcgacgaggaaatacccgtatcttcccactactttgcaagtaaaaccagaaatgaaaggaagaggaaaaagatgccagcctcccaaaggtctaagaggagaaaaactgcttccagtggttccaaggcaaagggggggtctgccacatgtagaaagatatcttccaaaacgaaatcctccagcatcattggatccagttcagcctcacatacttctcaagcgacatcaggagccaatagcaaattggggattatggctccaccgaagcctataaatagaccgtttcttaagccttcatatgcattctcataacaaccgaatctcaatgtacatagaccctctttcttgtttgtcagcatctgaccatctgtgactataaagctgttattcttgttataccatttgaagtttttactcgtctctattaatatttaaataaatgctggggggtgatagttcttctttttaaaataaacattttcttttgaatagctgttttggtgccgctgcaagtgttgtggccgttgttctcagaacgtctgaggcagcagctggatcatctcaggcagagctttgagcataaagaaaccagaagccaaaggaagagccacgcgtgg

SEQ ID NO: 296085 - DNA, 4684 bp, Homo sapiens
agacagtatataacagagaagagagacctgtttttcaaactcctcttttccaaaacctctgtagctggccctcaagattctccatcttctggccacaatttacctttttcagctttatctccacttatgcccttgcaataacccagtggttttaatgagtcaaaccaacaatctagaaagcatatcattttctttaattataatgttattgtttaaaaaataatattaaaaagttacactgttttgatttagttagaaagttgcattccaaaattattctttaggaaaatacagttgattcccagatgtcaagcaaatagaaatgtcctttttaaaatctttctttcatagtctgacactttccccatacttgtcattcagtttgcttaaatcttatctccttggcaaagccttctaaagttccaaaaaatgttacctttctttggatttccacagtatcctctctttaacactcattcagtactaatttattttgttatttgtaaagtattttttctatgtaatcagactgaccaggtttatatgttaatatgtttttgtataatctgtgtggtgaggtaattatatatgcagacacacaaaaacacatgtacatatatttgcataataagagaagtccagaaaaagtgctttgaaatctcagaaaaaagagacattaataatcacttgctggagaagtaatgctttggctggggctagaagaacaggtgtgatttgggtacgaagagattggaatggcaggttttccaaattgagaggatcagtggcaaaatcccaaaataggcaatgcagggcttatatgaagaatgtaagtggtacagtatgactgaagatttgtgttactgaaaggacatgatcggagataatgttgaaaagggctctttctggacaactttgaggaccagctaaagaagttttataattgaggaaatttaaaaaactacttctcttttctgttatatattgtctgatcagtggtagaaaaatattaagggtttcaaaattatacatttattgagtctagcctatagtatgattggcttaacattttttttatttgcagtacgttaaaggaccttgacacctctgacagaaaagaggatgttcttagcacatcaaaagatcttttgtcaaaacctgagaaaatgagtatgcaggagctgaatccagaaaccagcacagactgtgacgctagacagataagtttacagcagcagcttattcatgtgatggagcacatctgtaaattaattgatactattcctgatgataaactgaaacttttggattgtgggaacgaactgcttcagcagcggaacataagaaggaaacttctaacggaagtagattttaataaaagtgatgccagtcttcttggctcattgtggagatacaggcctgattcacttgatggccctatggagggtgattcctgccctacagggaattctatgaaggagttaaatttttcacaccttccctcaaattctgtttctcctggggactgtttactgactaccaccctaggaaagacaggattctctgccaccaggaagaatctttttgaaaggcctttattcaatacccatttacagaagtcctttgtaagtagcaactgggctgaaacaccaagactaggaaaaaaaaatgaaagctcttatttcccaggaaatgttctcacaagcactgctgtgaaagatcagaataaacatactgcttcaataaatgacttagaaagagaaacccaaccttcctatgatattgataattttgacatagatgactttgatgatgatgatgactgggaagacataatgcataatttagcagccagcaaatcttccacagctgcctatcaacccatcaaggaaggtcggccaattaaatcagtatcagaaagactttcctcagccaagacagactgtcttccagtgtcatctactgctcaaaatataaacttctcagagtcaattcagaattatactgacaagtcagcacaaaatttagcatccagaaatctgaaacatgagcgtttccaaagtcttagttttcctcatacaaaggaaatgatgaagatttttcataaaaaatttggcctgcataattttagaactaatcagctagaggcgatcaatgctgcactgcttggtgaagactgttttatcctgatgccgactggaggtggtaagagtttgtgttaccagctccctgcctgtgtttctcctggggtcactgttgtcatttctcccttgagatcacttatcgtagatcaagtccaaaagctgacttccttggatattccagctacatatctgacaggtgataagactgactcagaagctacaaatatttacctccagttatcaaaaaaagacccaatcataaaacttctatatgtcactccagaaaagatctgtgcaagtaacagactcatttctactctggagaatctctatgagaggaagctcttggcacgttttgttattgatgaagcacattgtgtcagtcagtggggacatgattttcgtcaagattacaaaagaatgaatatgcttcgccagaagtttccttctgttccggtgatggctcttacggccacagctaatcccagggtacagaaggacatcctgactcagctgaagattctcagacctcaggtgtttagcatgagctttaacagacataatctgaaatactatgtattaccgaaaaagcctaaaaaggtggcatttgattgcctagaatggatcagaaagcaccacccatatgattcagggataatttactgcctctccaggcgagaatgtgacaccatggctgacacgttacagagagatgggctcgctgctcttgcttaccatgctggcctcagtgattctgccagagatgaagtgcagcagaagtggattaatcaggatggctgtcaggttatctgtgctacaattgcatttggaatggggattgacaaaccggacgtgcgatttgtgattcatgcatctctccctaaatctgtggagggttactaccaagaatctggcagagctggaagagatggggaaatatctcactgcctgcttttctatacctatcatgatgtgaccagactgaaaagacttataatgatggaaaaagatggaaaccatcatacaagagaaactcacttcaataatttgtatagcatggtacattactgtgaaaatataacggaatgcaggagaatacagcttttggcctactttggtgaaaatggatttaatcctgatttttgtaagaaacacccagatgtttcttgtgataattgctgtaaaacaaaggattataaaacaagagatgtgactgacgatgtgaaaagtattgtaagatttgttcaagaacatagttcatcacaaggaatgagaaatataaaacatgtaggtccttctggaagatttactatgaatatgctggtcgacattttcttggggagtaagagtgcaaaaatccagtcaggtatatttggaaaaggatctgcttattcacgacacaatgccgaaagactttttaaaaagctgatacttgacaagattttggatgaagacttatatatcaatgccaatgaccaggcgatcgcttatgtgatgctcggaaataaagcccaaactgtactaaatggcaatttaaaggtagactttatggaaacagaaaattccagcagtgtgaaaaaacaaaaagcgttagtagcaaaagtgtctcagagggaagagatggttaaaaaatgtcttggagaacttacagaagtctgcaaatctctggggaaagtttttggtgtccattacttcaatatttttaataccgtcactctcaagaagcttgcagaatctttatcttctgatcctgaggttttgcttcaaattgatggtgttactgaagacaaactggaaaaatatggtgcggaagtgatttcagtattacagaaatactctgaatggacatcgccagctgaagacagttccccagggataagcctgtccagcagcagaggccccggaagaagtgccgctgaggagctcgacgaggaaatacccgtatcttcccactactttgcaagtaaaaccagaaatgaaaggaagaggaaaaagatgccagcctcccaaaggtctaagaggagaaaaactgcttccagtggttccaaggcaaagggggggtctgccacatgtagaaagatatcttccaaaacgaaatcctccagcatcattggatccagttcagcctcacatacttctcaagcgacatcaggagccaatagcaaattggggattatggctccaccgaagcctataaatagaccgtttcttaagccttcatatgcattctcataacaaccgaatctcaatgtacatagaccctctttcttgtttgtcagcatctgaccatctgtgactataaagctgttattcttgttataccatttgaagtttttactcgtctctattaatatttaaataaatgctggggggtgatagttcttctttttaaaataaacattttcttttgaatagctgttttggtgccgctgcaagtgttgtggccgttgttctcagaacgtctgaggcagcagctggatcatctcaggcagagctttgagcataaagaaaccagaagccaaaggaagagccacgcgtgg

SEQ ID NO: 296086 - DNA, 3623 bp, Homo sapiens
gcgcggcggccgtggttgcggcgcgggaagtttggatcctggttccgtccgctaggagtctgcgtgcgaggattatggctgctgttcctcaaaataatctacaggagcaactagaacgtcactcagccagaacacttaataataaattaagtctttcaaaaccaaaattttcaggtttcacttttaaaaagaaaacatcttcagataacaatgtatctgtaactaatgtgtcagtagcaaaaacacctgtattaagaaataaagatgttaatgttaccgaagacttttccttcagtgaacctctacccaacaccacaaatcagcaaagggtcaaggacttctttaaaaatgctccagcaggacaggaaacacagagaggtggatcaaaatcattattgccagatttcttgcagactccgaaggaagttgtatgcactacccaaaacacaccaactgtaaagaaatcccgggatactgctctcaagaaattagaatttagttcttcaccagattctttaagtaccatcaatgattgggatgatatggatgactttgatacttctgagacttcaaaatcatttgttacaccaccccaaagtcactttgtaagagtaagcactgctcagaaatcaaaaaagggtaagagaaacttttttaaagcacagctttatacaacaaacacagtaaagactgatttgcctccaccctcctctgaaagcgagcaaatagatttgactgaggaacagaaggatgactcagaatggttaagcagcgatgtgatttgcatcgatgatggccccattgctgaagtgcatataaatgaagatgctcaggaaagtgactctctgaaaactcatttggaagatgaaagagataatagcgaaaagaagaagaatttggaagaagctgaattacattcaactgagaaagttccatgtattgaatttgatgatgatgattatgatacggattttgttccaccttctccagaagaaattatttctgcttcttcttcctcttcaaaatgccttagtacgttaaaggaccttgacacctctgacagaaaagaggatgttcttagcacatcaaaagatcttttgtcaaaacctgagaaaatgagtatgcaggagctgaatccagaaaccagcacagactgtgacgctagacagataagtttacagcagcagcttattcatgtgatggagcacatctgtaaattaattgatactattcctgatgataaactgaaacttttggattgtgggaacgaactgcttcagcagcggaacataagaaggaaacttctaacggaagtagattttaataaaagtgatgccagtcttcttggctcattgtggagatacaggcctgattcacttgatggccctatggagggtgattcctgccctacagggaattctatgaaggagttaaatttttcacaccttccctcaaattctgtttctcctggggactgtttactgactaccaccctaggaaagacaggattctctgccaccaggaagaatctttttgaaaggcctttattcaatacccatttacagaagtcctttgtaagtagcaactgggctgaaacaccaagactaggaaaaaaaaatgaaagctcttatttcccaggaaatgttctcacaagcactgctgtgaaagatcagaataaacatactgcttcaataaatgacttagaaagagaaacccaaccttcctatgatattgataattttgacatagatgactttgatgatgatgatgactgggaagacataatgcataatttagcagccagcaaatcttccacagctgcctatcaacccatcaaggaaggtcggccaattaaatcagtatcagaaagactttcctcagccaagacagactgtcttccagtgtcatctactgctcaaaatataaacttctcagagtcaattcagaattatactgacaagtcagcacaaaatttagcatccagaaatctgaaacatgagcgtttccaaagtcttagttttcctcatacaaaggaaatgatgaagatttttcataaaaaatttggcctgcataattttagaactaatcagctagaggcgatcaatgctgcactgcttggtgaagactgttttatcctgatgccgactggaggtggtaagagtttgtgttaccagctccctgcctgtgtttctcctggggtcactgttgtcatttctcccttgagatcacttatcgtagatcaagtccaaaagctgacttccttggatattccagctacatatctgacaggtgataagactgactcagaagctacaaatatttacctccagttatcaaaaaaagacccaatcataaaacttctatatgtcactccagaaaagatctgtgcaagtaacagactcatttctactctggagaatctctatgagaggaagctcttggcacgttttgttattgatgaagcacattgtgtcagtcagtggggacatgattttcgtcaagattacaaaagaatgaatatgcttcgccagaagtttccttctgttccggtgatggctcttacggccacagctaatcccagggtacagaaggacatcctgactcagctgaagattctcagacctcaggtgtttagcatgagctttaacagacataatctgaaatactatgtattaccgaaaaagcctaaaaaggtggcatttgattgcctagaatggatcagaaagcaccacccatatgattcagggataatttactgcctctccaggcgagaatgtgacaccatggctgacacgttacagagagatgggctcgctgctcttgcttaccatgctggcctcagtgattctgccagagatgaagtgcagcagaagtggattaatcaggatggctgtcaggttatctgtgctacaattgcatttggaatggggattgacaaaccggacgtgcgatttgtgattcatgcatctctccctaaatctgtggagggttactaccaagaatctggcagagctggaagagatggggaaatatctcactgcctgcttttctatacctatcatgatgtgaccagactgaaaagacttataatgatggaaaaagatggaaaccatcatacaagagaaactcacttcaataatttgtatagcatggtacattactgtgaaaatataacggaatgcaggagaatacagcttttggcctactttggtgaaaatggatttaatcctgatttttgtaagaaacacccagatgtttcttgtgataattgctgtaaaacaaaggattataaaacaagagatgtgactgacgatgtgaaaagtattgtaagatttgttcaagaacatagttcatcacaaggaatgagaaatataaaacatgtaggtccttctggaagatttactatgaatatgctggtcgacattttcttggggagtaagagtgcaaaaatccagtcaggtatatttggaaaaggatctgcttattcacgacacaatgccgaaagactttttaaaaagctgatacttgacaagattttggatgaagacttatatatcaatgccaatgaccaggcgatcgcttatgtgatgctcggaaataaatcactggcctcgttggcctca

SEQ ID NO: 296087 - DNA, 3540 bp, Homo sapiens
gatcatcatgccactatgtttttgatttgtttacttttcaaaccactcctttaacattcgtattcatgtttttaagattgggaaaaaagcgaatatattttgctacaatttctatttggtatgaaaactacagatttgcttttgtggcctaccagagtaaactacttatatttaatacgttgttctcttttctctcttcagaaggaaacttctaacggaagtagattttaataaaagtgatgccagtcttcttggctcattgtggagatacaggcctgattcacttgatggccctatggagggtgattcctgccctacagggaattctatgaaggagttaaatttttcacaccttccctcaaattctgtttctcctggggactgtttactgactaccaccctaggaaagacaggattctctgccaccaggaagaatctttttgaaaggcctttattcaatacccatttacagaagtcctttgtaagtagcaactgggctgaaacaccaagactaggaaaaaaaaatgaaagctcttatttcccaggaaatgttctcacaagcactgctgtgaaagatcagaataaacatactgcttcaataaatgacttagaaagagaaacccaaccttcctatgatattgataattttgacatagatgactttgatgatgatgatgactgggaagacataatgcataatttagcagccagcaaatcttccacagctgcctatcaacccatcaaggaaggtcggccaattaaatcagtatcagaaagactttcctcagccaagacagactgtcttccagtgtcatctactgctcaaaatataaacttctcagagtcaattcagaattatactgacaagtcagcacaaaatttagcatccagaaatctgaaacatgagcgtttccaaagtcttagttttcctcatacaaaggaaatgatgaagatttttcataaaaaatttggcctgcataattttagaactaatcagctagaggcgatcaatgctgcactgcttggtgaagactgttttatcctgatgccgactggaggtggtaagagtttgtgttaccagctccctgcctgtgtttctcctggggtcactgttgtcatttctcccttgagatcacttatcgtagatcaagtccaaaagctgacttccttggatattccagctacatatctgacaggtgataagactgactcagaagctacaaatatttacctccagttatcaaaaaaagacccaatcataaaacttctatatgtcactccagaaaagatctgtgcaagtaacagactcatttctactctggagaatctctatgagaggaagctcttggcacgttttgttattgatgaagcacattgtgtcagtcagtggggacatgattttcgtcaagattacaaaagaatgaatatgcttcgccagaagtttccttctgttccggtgatggctcttacggccacagctaatcccagggtacagaaggacatcctgactcagctgaagattctcagacctcaggtgtttagcatgagctttaacagacataatctgaaatactatgtattaccgaaaaagcctaaaaaggtggcatttgattgcctagaatggatcagaaagcaccacccatatgattcagggataatttactgcctctccaggcgagaatgtgacaccatggctgacacgttacagagagatgggctcgctgctcttgcttaccatgctggcctcagtgattctgccagagatgaagtgcagcagaagtggattaatcaggatggctgtcaggttatctgtgctacaattgcatttggaatggggattgacaaaccggacgtgcgatttgtgattcatgcatctctccctaaatctgtggagggttactaccaagaatctggcagagctggaagagatggggaaatatctcactgcctgcttttctatacctatcatgatgtgaccagactgaaaagacttataatgatggaaaaagatggaaaccatcatacaagagaaactcacttcaataatttgtatagcatggtacattactgtgaaaatataacggaatgcaggagaatacagcttttggcctactttggtgaaaatggatttaatcctgatttttgtaagaaacacccagatgtttcttgtgataattgctgtaaaacaaaggattataaaacaagagatgtgactgacgatgtgaaaagtattgtaagatttgttcaagaacatagttcatcacaaggaatgagaaatataaaacatgtaggtccttctggaagatttactatgaatatgctggtcgacattttcttggggagtaagagtgcaaaaatccagtcaggtatatttggaaaaggatctgcttattcacgacacaatgccgaaagactttttaaaaagctgatacttgacaagattttggatgaagacttatatatcaatgccaatgaccaggcgatcgcttatgtgatgctcggaaataaagcccaaactgtactaaatggcaatttaaaggtagactttatggaaacagaaaattccagcagtgtgaaaaaacaaaaagcgttagtagcaaaagtgtctcagagggaagagatggttaaaaaatgtcttggagaacttacagaagtctgcaaatctctggggaaagtttttggtgtccattacttcaatatttttaataccgtcactctcaagaagcttgcagaatctttatcttctgatcctgaggttttgcttcaaattgatggtgttactgaagacaaactggaaaaatatggtgcggaagtgatttcagtattacagaaatactctgaatggacatcgccagctgaagacagttccccagggataagcctgtccagcagcagaggccccggaagaagtgccgctgaggagctcgacgaggaaatacccgtatcttcccactactttgcaagtaaaaccagaaatgaaaggaagaggaaaaagatgccagcctcccaaaggtctaagaggagaaaaactgcttccagtggttccaaggcaaagggggggtctgccacatgtagaaagatatcttccaaaacgaaatcctccagcatcattggatccagttcagcctcacatacttctcaagcgacatcaggagccaatagcaaattggggattatggctccaccgaagcctataaatagaccgtttcttaagccttcatatgcattctcataacaaccgaatctcaatgtacatagaccctctttcttgtttgtcagcatctgaccatctgtgactataaagctgttattcttgttataccatttgaagtttttactcgtctctattaatatttaaataaatgctggggggtgatagttcttctttttaaaataaacattttcttttgaatagctgttttggtgccgctgcaagtgttgtggccgttgttctcagaacgtctgaggcagcagctggatcatctcaggcagagctttgagcataaagaaaccagaagccaaaggaagagccacgcgtgg

SEQ ID NO: 296088 - DNA, 2371 bp, Homo sapiens
tttttttttggtataagtagctctcagacttttacccacatgagtttccattaaaattgtacaagctttgactttaaatcagctgatgaatagaaggagttgatgtgtgatcagctggtgctattgggaaaactgatgataagcagtggagcaggtaagaacgtattgttcctgaaccattggaggaactagcagcagtgacctctgaggagccctgggaacaccctggagctcctgagcaacacgttgcttgtgatcactgacctggatatcatgactgtgtgagcaacaccccccacacctcagtagcaaaaacagagaacagtggcagcacatcgtggggctgactgcagttgattctggctctcttacatgagaatgccaagtcatacaagaaagtgcctgccatgctgagcttctctttaccttcttgggttttaatggcattgcaagttatcagtataaaaactcatattagttatactaaatagttggaccaagttaagatattaggttgttatgtagtgtgcattttaaagtaaaacaaatgatagagcttttagaagcatctattatgaaaatgttccttcaagtctgtgccttatgaatctaataagcttttgcttttatatcaggttatctgtgctacaattgcatttggaatggggattgacaaaccggacgtgcgatttgtgattcatgcatctctccctaaatctgtggagggttactaccaagaatctggcagagctggaagagatggggaaatatctcactgcctgcttttctatacctatcatgatgtgaccagactgaaaagacttataatgatggaaaaagatggaaaccatcatacaagagaaactcacttcaataatttgtatagcatggtacattactgtgaaaatataacggaatgcaggagaatacagcttttggcctactttggtgaaaatggatttaatcctgatttttgtaagaaacacccagatgtttcttgtgataattgctgtaaaacaaaggattataaaacaagagatgtgactgacgatgtgaaaagtattgtaagatttgttcaagaacatagttcatcacaaggaatgagaaatataaaacatgtaggtccttctggaagatttactatgaatatgctggtcgacattttcttggggagtaagagtgcaaaaatccagtcaggtatatttggaaaaggatctgcttattcacgacacaatgccgaaagactttttaaaaagctgatacttgacaagattttggatgaagacttatatatcaatgccaatgaccaggcgatcgcttatgtgatgctcggaaataaagcccaaactgtactaaatggcaatttaaaggtagactttatggaaacagaaaattccagcagtgtgaaaaaacaaaaagcgttagtagcaaaagtgtctcagagggaagagatggttaaaaaatgtcttggagaacttacagaagtctgcaaatctctggggaaagtttttggtgtccattacttcaatatttttaataccgtcactctcaagaagcttgcagaatctttatcttctgatcctgaggttttgcttcaaattgatggtgttactgaagacaaactggaaaaatatggtgcggaagtgatttcagtattacagaaatactctgaatggacatcgccagctgaagacagttccccagggataagcctgtccagcagcagaggccccggaagaagtgccgctgaggagctcgacgaggaaatacccgtatcttcccactactttgcaagtaaaaccagaaatgaaaggaagaggaaaaagatgccagcctcccaaaggtctaagaggagaaaaactgcttccagtggttccaaggcaaagggggggtctgccacatgtagaaagatatcttccaaaacgaaatcctccagcatcattggatccagttcagcctcacatacttctcaagcgacatcaggagccaatagcaaattggggattatggctccaccgaagcctataaatagaccgtttcttaagccttcatatgcattctcataacaaccgaatctcaatgtacatagaccctctttcttgtttgtcagcatctgaccatctgtgactataaagctgttattcttgttataccatttgaagtttttactcgtctctattaatatttaaataaatgctggggggtgatagttcttctttttaaaataaacattttcttttgaatagctgttttggtgccgctgcaagtgttgtggccgttgttctcagaacgtctgaggcagcagctggatcatctcaggcagagctttgagcataaagaaaccagaagccaaaggaagagccacgcgtgg

SEQ ID NO: 296089 - DNA, 536 bp, Homo sapiens
gggttggtcacaagtcagaaaattaagaaacagtcctgcacatttcagaaagacaaatccagaacaaatttatatgaagggccgcggtcctttattccataagtagtaaaggaaacttaccttacctagggggctcgtaggcagaaaatgcacaaggacacattaggcccagggaagtggtattgtagctctgtgcaggttgagaggaagaaggtcattcatttttggtttcatttaacattttgatttttttctttgtcacatttcagggggtctgccacatgtagaaagatatcttccaaaacgaaatcctccagcatcattggatccagttcagcctcacatacttctcaagcgacatcaggagccaatagcaaattggggattatggctccaccgaagcctataaatagaccgtttcttaagccttcatatgcattctcataacaaccgaatctcaatgtacatagaccctctttcttgtttgtcagcatctgaccatctgtgactataaagctgttattcttgttatacca

SEQ ID NO: 296090 - DNA, 458 bp, Homo sapiens
gtcatggttggaggaagggagaagaggaaggaaagaataaaagtagtggtaggtgctgtagaaaaagtcaaggaaatacttgatttgggactttggcaagtttttggtggctttgagacttgtagggaaggaaagccagtaaagagtttaagaactgtgctgcagggaaacgtgtgccagtgattctgcagggcaagggaaatgctaaagctgtactttcactgtattcatgtactgatttttcttaacgttgattattttcctagacaagtcagcacaaaatttagcatccagaaatctgaaacatgagcgtttccaaagtcttagttttcctcatacaaaggaaatgatgaagatttttcataaaaaatttggcctgcataattttagaactaatcagctagaggcgatcaatgctgcactgcttggtgaagactgttttatcctgatgccgactg

SEQ ID NO: 296091 - DNA, 454 bp, Homo sapiens
gatatgaagaaattaagatcttttcaaatttgcaaaagctgaaagactgtcacccacaggtctgcactgcaagaaaagttaaaggatgtcctttgggcagaaggaaaatgcctgccttctgaaggaaataagcactggaaatagtaacaacatgggtaaatgtagcatttattatttaaacctctttaaaagacagttatttaaataaaagtcatagtgtaggatttataatatatgtaagagtaaaatggatgaccacaatagcttgaagattaggagaggagaatcatgctattgtaaagttctcatacacaaggtgacgtgctaccatttgaagatagagtgtgataagttacagatatgtgctgtaaaccctaaagcagctgctaaaatgacataccaaaaaatcatacctattaaactatcaaaagataaaatggaattattttaaaaa

SEQ ID NO: 296092 - DNA, 1172 bp, Homo sapiens
cggggcgtgccccgccagcggaggccgggaggaccaggaacccaggagagcatggccacgctgcgccggcttcgggaggcgccgcggcacttactggtttgcgagaaatccaacttcggcaaccacaagtcgcgccaccggcatcttgtgcagacgcactactataactacagggtttcatttctcattcctgaatgtgggatactatcggaagaactgaaaaacctggtcatgaacactggaccctattactttgtgaagaatttacctcttcatgaattaattacacctgaattcatcagtacctttataaagaaaggttcttgctatgcactaacatacaatacacatattgatgaagataatactgttgccctgctaccaaatgggaaattaattttgtcactggataaagacacttatgaagaaactggacttcagggtcatccatctcagttttctggcagaaaaattatgaaatttattgtttccattgatttgatggaattatccttaaacttggattctaagaagtatgaaagaatatcttggtctttcaaagaaaagaagccattgaaatttgattttcttttggcttggcataaaacaggttcagaagaatcgacaatgatgtcatatttttccaagtaccaaattcaggagcatcagccaaaagtagcactgagcacgttgagagatctccagtgcccagtgctgcagagcagcgagctggagggaacgccagaggtgtcctgccgggctctggagctcttcgactggctcggcgccgtcttcagtaatgtcgacctaaataatgagcctaataatttcatatcaacctattgctgtcctgagccaagcacagtggtggcaaaagcttatttgtgtacaatcactggcttcatacttccagagaagatctgtctcctattggaacatctctgtcactactttgatgaaccgaagttagctccatgggttacactgtccgttcaaggctttgcagacagccctgtttcttgggaaaaaaatgaacatggttttcgaaaaggaggagaacatttatataactttgtgatttttaataatcaggactattggcttcagatggctgttggggcaaatgatcactgtccaccataaaaaataaaaattaaaaatcgtgtttactt

SEQ ID NO: 296093 - DNA, 1103 bp, Homo sapiens
cggggcgtgccccgccagcggaggccgggaggaccaggaacccaggagagcatggccacgctgcgccggcttcgggaggcgccgcggcacttactggtttgcgagaaatccaacttcggcaaccacaagtcgcgccaccggcatcttgtgcagacgcactactataactacagggtttcatttctcattcctgaatgtgggatactatcggaagaactgaaaaacctggtcatgaacactggaccctattactttgtgaagaatttacctcttcatgaattaattacacctgaattcatcagtacctttataaagaaagggaaattaattttgtcactggataaagacacttatgaagaaactggacttcagggtcatccatctcagttttctggcagaaaaattatgaaatttattgtttccattgatttgatggaattatccttaaacttggattctaagaagtatgaaagaatatcttggtctttcaaagaaaagaagccattgaaatttgattttcttttggcttggcataaaacaggttcagaagaatcgacaatgatgtcatatttttccaagtaccaaattcaggagcatcagccaaaagtagcactgagcacgttgagagatctccagtgcccagtgctgcagagcagcgagctggagggaacgccagaggtgtcctgccgggctctggagctcttcgactggctcggcgccgtcttcagtaatgtcgacctaaataatgagcctaataatttcatatcaacctattgctgtcctgagccaagcacagtggtggcaaaagcttatttgtgtacaatcactggcttcatacttccagagaagatctgtctcctattggaacatctctgtcactactttgatgaaccgaagttagctccatgggttacactgtccgttcaaggctttgcagacagccctgtttcttgggaaaaaaatgaacatggttttcgaaaaggaggagaacatttatataactttgtgatttttaataatcaggactattggcttcagatggctgttggggcaaatgatcactgtccaccataaaaaataaaaattaaaaatcgtgtttactt

SEQ ID NO: 296094 - DNA, 1397 bp, Homo sapiens
cggggcgtgccccgccagcggaggccgggaggaccaggaacccaggagagcatggccacgctgcgccggcttcgggaggcgccgcggcacttactggtttgcgagaaatccaacttcggcaaccacaagtcgcgccaccggcatcttgtgcagacgcactactataactacagggtttcatttctcattcctgaatgtgggatactatcggaagaactgaaaaacctggtcatgaacactggaccctattactttgtgaagaatttacctcttcatgaattaattacacctgaattcatcagtacctttataaagaaaggttcttgctatgcactaacatacaatacacatattgatgaagataatactgttgccctgctaccaaatgggaaattaattttgtcactggataaagacacttatgaagaaactggacttcagggtcatccatctcagttttctggcagaaaaattatgaaatttattgtttccattgatttgatggaattatccttaaacttggattctaagaagtatgaaagaatatcttggtctttcaaagaaaagaagccattgaaatttgattttcttttggcttggcataaaacaggttcagaagaatcgacaatgatgtcatatttttccaagtaccaaattcaggagcatcagccaaaagtagcactgagcacgttgagagatctccagtgcccagtgctgcagagcagcgagctggagggaacgccagaggtgtcctgccgggctctggagctcttcgactggctcggcgccgtcttcagtaatgtcgacctaaataatgagcctaataatttcatatcaacctattgctgtcctgagccaagcacagtggtggcaaaagcttatttgtgtacaatcactggcttcatacttccagagaagatctgtctcctattggaacatctctggtaactggcagaagcaaaacagattgtctttggaggaactcggagagtttcaaggaatgtctgcactgcaagaaaagttaaaggatgtcctttgggcagaaggaaaatgcctgccttctgaaggaaataagcactggaaatagtaacaacatgggtaaatgtagcatttattatttaaacctctttaaaagacagttatttaaataaaagtcatagtgtaggatttataatatatgtaagagtaaaatggatgaccacaatagcttgaagattaggagaggagaatcatgctattgtaaagttctcatacacaaggtgacgtgctaccatttgaagatagagtgtgataagttacagatatgtgctgtaaaccctaaagcagctgctaaaatgacataccaaaaaatcatacctattaaactatcaaaagataaaatggaattattttaaaaa

SEQ ID NO: 296095 - DNA, 829 bp, Homo sapiens
cggggcgtgccccgccagcggaggccgggaggaccaggaacccaggagagcatggccacgctgcgccggcttcgggaggcgccgcggcacttactggtttgcgagaaatccaacttcggcaaccacaagtcgcgccaccggcatcttgtgcagacgcactactataactacagggtttcatttctcattcctgaatgtgggatactatcggaagaactgaaaaacctggtcatgaacactggaccctattactttgtgaagaatttacctcttcatgaattaattacacctgaattcatcagtacctttataaagaaaggttcttgctatgcactaacatacaatacacatattgatgaagataatactgttgccctgctaccaaatgggaaattaattttgtcactggataaagacacttatgaagaaactggacttcagggtcatccatctcagttttctggcagaaaaattatgaaatttattgtttccattgatttgatggaattatccttaaacttggattctaagaagtatgaaagaatatcttggtctttcaaagaaaagaagccattgaaatttgattttcttttggcttggcataaaacaggttcagaagaatcgacaatgatgtcatatttttccaagtaccaaattcaggagcatcagccaaaagtagcactgagcacgttgagagatctccagtgcccagtgctgcagagcagcgagctggagggaacgccagaggtgtcctgccgggctctggagctcttcgactggctcggcgccgtcttcagtaatgtcgacctcagggtaccgagctgcgatg

SEQ ID NO: 296096 - DNA, 765 bp, Homo sapiens
agtatagattttttcattttgggaggtggtatataaataaaatgtacattgaaaggaactcaaatcgcctattgcaaagaccgtacattgagtataatcctatttagtaagcatatcttctcagtcttcccttttgaaatgtcagatttaagtcttgaaggttttcctttttaagcccaacatcctttttcacatttattggtttagtactttgactttcttcgataggaaggctggatatgaaaaatctggtgaattatcctgcaacgtttcagttaactgagactctgagaacagtactcttaataggagggaaaggatccttaaacgcctgtggggttttttgttttgggttctttttgtcttaaagacctcccagaatgagggtgggaacagctgaggtttgtttcatgtgttgtatattagttaatccttatggagttcacagtgtgacatcaggaacttatcacacacctcttgattttcaaaaattaaagctaagatctaagctttattagaatatcagaaatactacttatcctgaataaattttttaaaatgcagacattcctaactctcttttaaaactctgtttaacaactacctttttttcagtcactactttgatgaaccgaagttagctccatgggttacactgtccgttcaaggctttgcagacagccctgtttcttgggaaaaaaatgaacatggttttcgaaaaggaggagaacatttatataactttgtgatttttaataatcagga

SEQ ID NO: 296097 - DNA, 204 bp, Homo sapiens
tcttgtaaaaataatccactaacatcttgcaggtgtaatttcttgttttaaatttttcctctgtactttctcttccaggttcttgctatgcactaacatacaatacacatattgatgaagataatactgttgccctgctaccaaatggtaacactttattttttcatctttctttaattgttaaaaaaaaatgcatactgtaaa

SEQ ID NO: 296098 - DNA, 418 bp, Homo sapiens
  misc_feature (29)..(29): n is a, c, g, or t
  misc_feature (40)..(40): n is a, c, g, or t
tctgccattaaaattacctacttaatcangataagcacgnatttttgttgcccttggttttacctgtaagactgtggaactattttaccttaagacctgaaaaagttttctggaaaggataaccctcccaatatccctagcagcagcagcaaaccaaagtcaaagtatccctggcacgacacacttggctgacttatgttctgtgcgcattctggcaggaattctgtctcttcagagactcatcctcaaaacaagacttgacactgtgtccttgccccagtcctaggaactgtggcacacagagatgttcattttaaaaacggatttcatgaaacactcttgtacttatgtttataagagagcactgggtagccaagtgatcttcccattcacagagttagtaaacctctgtactaca

SEQ ID NO: 296099 - DNA, 773 bp, Homo sapiens
gcttgtaccatccgttgggcacgcgagctccgcttgatctgtgactgtggtcataccctcgctctaccttagaatgattctggacttgactggttgtttgtgacttcttagctctggagccctaggctcggtggggggcgcagtcgcttgctgatactataactcgcggcattgcgctcgtgcatgatgggtcacttacatggcaatctatcacatgggtgttccaactcgtatctcgactctcattctccctgtgactcaggtgagcaaaaacatttccttccttatttcatccagtacccatgaaatttcctctctgtgtttcatgtgtcccaggtcccccaaaaaacaggtggtggtggattatacatggctttcagtagtggggtgatgaaaatgttctctctggtaaagcatgctgacactgtttatcttgtgtaataggccccaatcttcatctccttcttcattgctttgagagagatggccaaccttcctgtgcccagcctgcagacaggtggcctctggtggttccaggatctcacggtatccgatcccatctacatattaccactggcagtcactgctacaatgtgggctgttcttgaggtaagcccagattggccaagtgccaggcctgcaaagtgaactgggattggagggtaaagtagttgtacagaatggtcatccttcacttgctggagaaagagttgatgggtaagagattagagacagattcactgaaactgacagctttcccgacttttccaccc

SEQ ID NO: 296100 - DNA, 1717 bp, Homo sapiens
  misc_feature (78)..(78): n is a, c, g, or t
atggtaacgtggctttacagatttttacccacttcaaatatggccgccaagctccgttctcttttaccgcctgatctncggctacaattctggcttcatgcccgcctccaaaagtgcttcctctcgaggggttgtggttcttactgcgcaggcgcaaaagcaagtcctcttccgccgggcaaaatggcgatgggactaatgtgcggacgccgggagcttctgcgcttgctacagtccgggcgtcgggtccacagcgtcgcagggccctcgcaatggcttgggaaaccgctgaccacacggctcctattcccagtagccccgtgctgctgtcgcccacactacctcttccttgcggcttccggcccccgcagcctcagtacctctgctatctcttttgcagaagtccaggttcaggcccctcctgttgttgctgcaactccctcacccacagcagtacctgaggtggcttctggagagactgcagatgtagtccaaactgctgcagagcagagcttcgctgaactggggctggggtcatacaccccagtgggactgatccagaatttactggaatttatgcatgttgatctgggcctaccttggtggggggccattgctgcatgtacagtctttgcccgctgcctgatttttcctctcatcgtgacgggccagcgagaggcagccaggatccacaatcacttgccagagatccagaagttttccagtcgaatcagagaggccaagttagcaggagaccatattgagtattacaaggcttcctcggagatggcactttaccagaaaaaacatggtattaaactctataaacctctcattctccctgtgactcaggccccaatcttcatctccttcttcattgctttgagagagatggccaaccttcctgtgcccagcctgcagacaggtggcctctggtggttccaggatctcacggtatccgatcccatctacatattaccactggcagtcactgctacaatgtgggctgttcttgagctaggtgctgagacaggtgtgcaaagttctgaccttcagtggatgagaaatgtcatcagaatgatgcccctgataaccttgcccataaccatgcatttccccacggcagtgtttatgtactggctctcctccaatttgttttccctggtccaagtatcctgtctccggattccagcagtacgcactgtacttaaaatcccccagcgtgttgtacatgacctggacaaattacctccacgggaaggcttcctagagagcttcaaaaaaggctggaaaaatgctgaaatgacgcgtcagctgcgagagcgtgaacaacgcatgcggaatcagttggagctagcagccaggggtcctttacgacagacctttacccacaaccctctcctacaacctggaaaggataaccctcccaatatccctagcagcagcagcaaaccaaagtcaaagtatccctggcacgacacacttggctgacttatgttctgtgcgcattctggcaggaattctgtctcttcagagactcatcctcaaaacaagacttgacactgtgtccttgccccagtcctaggaactgtggcacacagagatgttcattttaaaaacggatttcatgaaacactcttgtacttatgtttataagagagcactgggtagccaagtgatcttcccattcacagagttagtaaacctctgtactaca

SEQ ID NO: 296101 - DNA, 1595 bp, Homo sapiens
ccacaacttccccccttttccccccaaaaaaaaaggaaaattggaaaattaaccgggcaaaatggcgatgggactaatgtgcggacgccgggagcttctgcgcttgctacagtccgggcgtcgggtccacagcgtcgcagggccctcgcaatggcttgggaaaccgctgaccacacggctcctattcccagtagccccgtgctgctgtcgcccacactacctcttccttgcggcttccggcccccgcagcctcagtacctctgctatctcttttgcagaagtccaggttcaggcccctcctgttgttgctgcaactccctcacccacagcagtacctgaggtggcttctggagagactgcagatgtagtccaaactgctgcagagcagagcttcgctgaactggggctggggtcatacaccccagtgggactgatccagaatttactggaatttatgcatgttgatctgggcctaccttggtggggggccattgctgcatgtacagtctttgcccgctgcctgatttttcctctcatcgtgacgggccagcgagaggcagccaggatccacaatcacttgccagagatccagaagttttccagtcgaatcagagaggccaagttagcaggagaccatattgagtattacaaggcttcctcggagatggcactttaccagaaaaaacatggtattaaactctataaacctctcattctccctgtgactcaggccccaatcttcatctccttcttcattgctttgagagagatggccaaccttcctgtgcccagcctgcagacaggtggcctctggtggttccaggatctcacggtatccgatcccatctacatattaccactggcagtcactgctacaatgtgggctgttcttgagctaggtgctgagacaggtgtgcaaagttctgaccttcagtggatgagaaatgtcatcagaatgatgcccctgataaccttgcccataaccatgcatttccccacggcagtgtttatgtactggctctcctccaatttgttttccctggtccaagtatcctgtctccggattccagcagtacgcactgtacttaaaatcccccagcgtgttgtacatgacctggacaaattacctccacgggaaggcttcctagagagcttcaaaaaaggctggaaaaatgctgaaatgacgcgtcagctgcgagagcgtgaacaacgcatgcggaatcagttggagctagcagccaggggtcctttacgacagacctttacccacaaccctctcctacaacctggaaaggataaccctcccaatatccctagcagcagcagcaaaccaaagtcaaagtatccctggcacgacacacttggctgacttatgttctgtgcgcattctggcaggaattctgtctcttcagagactcatcctcaaaacaagacttgacactgtgtccttgccccagtcctaggaactgtggcacacagagatgttcattttaaaaacggatttcatgaaacactcttgtacttatgtttataagagagcactgggtagccaagtgatcttcccattcacagagttagtaaacctctgtactaca

SEQ ID NO: 296102 - DNA, 2652 bp, Homo sapiens
  misc_feature (78)..(78): n is a, c, g, or t
atggtaacgtggctttacagatttttacccacttcaaatatggccgccaagctccgttctcttttaccgcctgatctncggctacaattctggcttcatgcccgcctccaaaagtgcttcctctcgaggggttgtggttcttactgcgcaggcgcaaaagcaagtcctcttccgccgggcaaaatggcgatgggactaatgtgcggacgccgggagcttctgcgcttgctacagtccgggcgtcgggtccacagcgtcgcagggccctcgcaatggcttgggaaaccgctgaccacacggctcctattcccagtagccccgtgctgctgtcgcccacactacctcttccttgcggcttccggcccccgcagcctcagtacctctgctatctcttttgcagaagtccaggttcaggcccctcctgttgttgctgcaactccctcacccacagcagtacctgaggtggcttctggagagactgcagatgtagtccaaactgctgcagagcagagcttcgctgaactggggctggggtcatacaccccagtgggactgatccagaatttactggaatttatgcatgttgatctgggcctaccttggtggggggccattgctgcatgtacagtctttgcccgctgcctgatttttcctctcatcgtgacgggccagcgagaggcagccaggatccacaatcacttgccagagatccagaagttttccagtcgaatcagagaggccaagttagcaggagaccatattgagtattacaaggcttcctcggagatggcactttaccagaaaaaacatggtattaaactctataaacctctcattctccctgtgactcaggccccaatcttcatctccttcttcattgctttgagagagatggccaaccttcctgtgcccagcctgcagacaggtggcctctggtggttccaggatctcacggtatccgatcccatctacatattaccactggcagtcactgctacaatgtgggctgttcttgagctaggtgctgagacaggtgtgcaaagttctgaccttcagtggatgagaaatgtcatcagaatgatgcccctgataaccttgcccataaccatgcatttccccacggcagtgtttatgtactggctctcctccaatttgttttccctggtccaagtatcctgtctccggattccagcagtacgcactgtacttaaaatcccccagcgtgttgtacatgacctggacaaattacctccacgggaaggcttcctagagagcttcaaaaaaggctggaaaaatgctgaaatgacgcgtcagctgcgagagcgtgaacaacgcatgcggaatcagttggagctagcagccaggggtcctttacgacagacctttacccacaaccctctcctacaacctggaaaggataaccctcccaatatccctagcagcagcagcaaaccaaagtcaaagtatccctggcacgacacacttggctgacttatgttctgtgcgcattctggcaggaattctgtctcttcagagactcatcctcaaaacaagacttgacactgtgtccttgccccagtcctaggaactgtggcacacagagatgttcattttaaaaacggatttcatgaaacactcttgtacttatgtttataagagagcactgggtagccaagtgatcttcccattcacagagttagtaaacctctgtactacaaaaaaaaaaaaaaaaaaaaaaaaaaaaaaaaaaaaaaaaaaaaaaacaaaaaaaaaaaaaaacaaaaaagaagaggggggccgcgcgcgcgccaaaaaacctccccgccggggggcgcgccccacgcgcgcgcccccccccttgtagcgagacaaagagggacgcgcacacctaagaagaggatgcgacgataatatagaaaagaaacagaacgactacgccgccgccagtcactaatcaacaacaaacacaaaagaggaggaaacaaaacaacgagagagcagatggaagaaaaacatgagaggagacgagagaccacaccacacactcgcgtggagcaggagagaaacaacatacttgggcagcgaaccacacacacccacccccgccacacggcacgatattataaaaccccccccccatcgcgcgggacacaacaacacaaacaccacccatccacaaagcgcagcggacatcaacagcgggacgtacacaacaacacaacgcacgaagcgcaccagcaagcacagtcgacgggagacgaagaacagaaaatagtgagcgctccaccgaacacgaacgacaaaatacaacatcaccaaacaaccaaccaaccaattattcccaccgccggcggagccctgttcaagagaaccataaaaaaagcgccgcacagaccgcagacggcacacaccagcccacgcccagcacaccacccgtcggagcgcgccgcacgaacccacagaccacgaccagaacaacggcgcgccacgaacacaacgcctcgacaggcgaagcgccccaccgacgccgcactgcagacgcagcgcccgcgacaggcccacgcagcagacccagcgcgcgcagacgcagggataccgaccacgcacacacgcccacccacaccagcccgagcgagccacgataaagcccac

SEQ ID NO: 296103 - DNA, 2001 bp, Homo sapiens
  misc_feature (78)..(78): n is a, c, g, or t
atggtaacgtggctttacagatttttacccacttcaaatatggccgccaagctccgttctcttttaccgcctgatctncggctacaattctggcttcatgcccgcctccaaaagtgcttcctctcgaggggttgtggttcttactgcgcaggcgcaaaagcaagtcctcttccgccgggcaaaatggcgatgggactaatgtgcggacgccgggagcttctgcgcttgctacagtccgggcgtcgggtccacagcgtcgcagggccctcgcaatggcttgggaaaccgctgaccacacggctcctattcccagtagccccgtgctgctgtcgcccacactacctcttccttgcggcttccggcccccgcagcctcagtacctctgctatctcttttgcagaagtccaggttcaggcccctcctgttgttgctgcaactccctcacccacagcagtacctgaggtggcttctggagagactgcagatgtagtccaaactgctgcagagcagagcttcgctgaactggggctggggtcatacaccccagtgggactgatccagaatttactggaatttatgcatgttgatctgggcctaccttggtggggggccattgctgcatgtacagtctttgcccgctgcctgatttttcctctcatcgtgacgggccagcgagaggcagccaggatccacaatcacttgccagagatccagaagttttccagtcgaatcagagaggccaagttagcaggagaccatattgagtattacaaggcttcctcggagatggcactttaccagaaaaaacatggtattaaactctataaacctctcattctccctgtgactcaggccccaatcttcatctccttcttcattgctttgagagagatggccaaccttcctgtgcccagcctgcagacaggtggcctctggtggttccaggatctcacggtatccgatcccatctacatattaccactggcagtcactgctacaatgtgggctgttcttgagctaggtgctgagacaggtgtgcaaagttctgaccttcagtggatgagaaatgtcatcagaatgatgcccctgataaccttgcccataaccatgcatttccccacggcagtgtttatgtactggctctcctccaatttgttttccctggtccaagtatcctgtctccggattccagcagtacgcactgtacttaaaatcccccagcgtgttgtacatgacctggacaaattacctccacgggaaggcttcctagagagcttcaaaaaaggctggaaaaatgctgaaatgacgcgtcagctgcgagagcgtgaacaacgcatgcggaatcagttggagctagcagccaggggtcctttacgacagacctttacccacaaccctctcctacaacctggaaaggataaccctcccaatatccctagcagcagcagcaaaccaaagtcaaagtatccctggcacgacacacttggctgacttatgttctgtgcgcattctggcaggaattctgtctcttcagagactcatcctcaaaacaagacttgacactgtgtccttgccccagtcctaggaactgtggcacacagagatgttcattttaaaaacggatttcatgaaacactcttgtacttatgtttataagagagcactgggtagccaagtgatcttcccattcacagagttagtaaacctctgtactacaaaaaaaaaaaaaaaaaagatttcggccgcaaatctttttttttttttttttttctctgcaatgctcagccattttacttgagacataaaaaaagttttaagagtagttgttttgctttttcgatttaaacattcatgagaacggatgggacggtagtgctgtggtgtggacttgtgtctgagtggccatgccggtcgggtccttcagaccacatactggtacgggtctgccttcccttggtctggcgtggcaaagggctgcccagcctagagagaaggggtggc

SEQ ID NO: 296104 - DNA, 2258 bp, Homo sapiens
  misc_feature (78)..(78): n is a, c, g, or t
atggtaacgtggctttacagatttttacccacttcaaatatggccgccaagctccgttctcttttaccgcctgatctncggctacaattctggcttcatgcccgcctccaaaagtgcttcctctcgaggggttgtggttcttactgcgcaggcgcaaaagcaagtcctcttccgccgggcaaaatggcgatgggactaatgtgcggacgccgggagcttctgcgcttgctacagtccgggcgtcgggtccacagcgtcgcagggccctcgcaatggcttgggaaaccgctgaccacacggctcctattcccagtagccccgtgctgctgtcgcccacactacctcttccttgcggcttccggcccccgcagcctcagtacctctgctatctcttttgcagaagtccaggttcaggcccctcctgttgttgctgcaactccctcacccacagcagtacctgaggtggcttctggagagactgcagatgtagtccaaactgctgcagagcagagcttcgctgaactggggctggggtcatacaccccagtgggactgatccagaatttactggaatttatgcatgttgatctgggcctaccttggtggggggccattgctgcatgtacagtctttgcccgctgcctgatttttcctctcatcgtgacgggccagcgagaggcagccaggatccacaatcacttgccagagatccagaagttttccagtcgaatcagagaggccaagttagcaggagaccatattgagtattacaaggcttcctcggagatggcactttaccagaaaaaacatggtattaaactctataaacctctcattctccctgtgactcaggccccaatcttcatctccttcttcattgctttgagagagatggccaaccttcctgtgcccagcctgcagacaggtggcctctggtggttccaggatctcacggtatccgatcccatctacatattaccactggcagtcactgctacaatgtgggctgttcttgagctaggtgctgagacaggtgtgcaaagttctgaccttcagtggatgagaaatgtcatcagaatgatgcccctgataaccttgcccataaccatgcatttccccacggcagtgtttatgtactggctctcctccaatttgttttccctggtccaagtatcctgtctccggattccagcagtacgcactgtacttaaaatcccccagcgtgttgtacatgacctggacaaattacctccacgggaaggcttcctagagagcttcaaaaaaggctggaaaaatgctgaaatgacgcgtcagctgcgagagcgtgaacaacgcatgcggaatcagttggagctagcagccaggggtcctttacgacagacctttacccacaaccctctcctacaacctggaaaggataaccctcccaatatccctagcagcagcagcaaaccaaagtcaaagtatccctggcacgacacacttggctgacttatgttctgtgcgcattctggcaggaattctgtctcttcagagactcatcctcaaaacaagacttgacactgtgtccttgccccagtcctaggaactgtggcacacagagatgttcattttaaaaacggatttcatgaaacactcttgtacttatgtttataagagagcactgggtagccaagtgatcttcccattcacagagttagtaaacctctgtactacatacatgctgcttcctgatacttattgaacagggaaatgagtgtgcacttcagaaaactgaagaatacccagcattttgggaggccgaggtgggtggatcacctgagatcaggagtttgagaccagcctggccaacatggggaaacgccatctctgctgttttacaaaaatagccacacgtggtggtgcacacctgtagtcccagctactcgggaggctgaggcaggagaattgcttgaatccgagaggcggaggttgcagtgagccaagatcgcaccaccgcactccagcctgggcaatagagggagactgtctcaaaaaaaaaagaaaactgaagaatagagtgagtcatgattgcttttgctggcccatggccttggaaaatataatgttttaacctggcattaagggtttaaacttccacccaggcgcagtggctcacgccagtaatcccagcacttttgggaggccaaggcgggcggatcacgaagtcagcagatcgagaccatcctggccaacatggtgaaaccccgtctctacta

SEQ ID NO: 296105 - DNA, 1507 bp, Homo sapiens
  misc_feature (78)..(78): n is a, c, g, or t
atggtaacgtggctttacagatttttacccacttcaaatatggccgccaagctccgttctcttttaccgcctgatctncggctacaattctggcttcatgcccgcctccaaaagtgcttcctctcgaggggttgtggttcttactgcgcaggcgcaaaagcaagtcctcttccgccgggcaaaatggcgatgggactaatgtgcggacgccgggagcttctgcgcttgctacagtccgggcgtcgggtccacagcgtcgcagggccctcgcaatggcttgggaaaccgctgaccacacggctcctattcccagtagccccgtgctgctgtcgcccacactacctcttccttgcggcttccggcccccgcagcctcagtacctctgctatctcttttgcagaagtccaggttcaggcccctcctgttgttgctgcaactccctcacccacagcagtacctgaggtggcttctggagagactgcagatgtagtccaaactgctgcagagcagagcttcgctgaactggggctggggtcatacaccccagtgggactgatccagaatttactggaatttatgcatgttgatctgggcctaccttggtggggggccattgctgcatgtacagtctttgcccgctgcctgatttttcctctcatcgtgacgggccagcgagaggcagccaggatccacaatcacttgccagagatccagaagttttccagtcgaatcagagaggccaagttagcaggagaccatattgagtattacaaggcttcctcggagatggcactttaccagaaaaaacatggtattaaactctataaacctctcattctccctgtgactcaggccccaatcttcatctccttcttcattgctttgagagagatggccaaccttcctgtgcccagcctgcagacaggtggcctctggtggttccaggatctcacggtatccgatcccatctacatattaccactggcagtcactgctacaatgtgggctgttcttgagctaggtgctgagacaggtgtgcaaagttctgaccttcagtggatgagaaatgtcatcagaatgatgcccctgataaccttgcccataaccatgcatttccccacggcagtgtttatgtactggctctcctccaatttgttttccctggtccaagtatcctgtctccggattccagcagtacgcactgtacttaaaatcccccagcgtgttgtacatgacctggacaaattacctccacgggaaggcttcctagagagcttcaaaaaaggctggaaaaatgctgaaatgacgcgtcagctgcgagagcgtgaacaacgcatgcggaatcagttggagctagcagccaggggtcctttacgacagacctttacccacaaccctctcctacaacctggaaaggataaccctcccaatatccctagcagcagcagcaaaccaaagtcaaagtatccctggcactgtttggactctgggcactgtttggactctg

SEQ ID NO: 296106 - DNA, 2078 bp, Homo sapiens
ccacaacttccccccttttccccccaaaaaaaaaggaaaattggaaaattaaccgggcaaaatggcgatgggactaatgtgcggacgccgggagcttctgcgcttgctacagtccgggcgtcgggtaaggatgccccggggcagagcaccgggatgctgccctgacccagtgaaccaggccccaggacagctcgtgctaggggtatcagcagacgctgacctgctcaccgggacctgaatgtcatgacctcgggtcatgtgaggacgcgctagggttagtccccgacactatgggcccagcagcccggtgtcagcttctggaattggcttggctcctggcgagagcacctcggcctcgttctcagggccctccgatgtgggtctgcgataactgagatgcggggaacccaggttcgagcttcgctctgcaggcaccacccgctgcatgccttcgggctagcggtctgcgcgcggtgatagcaatgtcctcccctgtagtggccgagctgcctgcttcttggggagttagcataatgaatcccgtttgcacccacgcgaggacttctgctcccggtaaaggggctccatcatccttttacacgctcaggtccacagcgtcgcagggccctcgcaatggcttgggaaaccgctgaccacacggctcctattcccagtagccccgtgctgctgtcgcccacactacctcttccttgcggcttccggcccccgcagcctcagtacctctgctatctcttttgcagaagtccaggttcaggcccctcctgttgttgctgcaactccctcacccacagcagtacctgaggtggcttctggagagactgcagatgtagtccaaactgctgcagagcagagcttcgctgaactggggctggggtcatacaccccagtgggactgatccagaatttactggaatttatgcatgttgatctgggcctaccttggtggggggccattgctgcatgtacagtctttgcccgctgcctgatttttcctctcatcgtgacgggccagcgagaggcagccaggatccacaatcacttgccagagatccagaagttttccagtcgaatcagagaggccaagttagcaggagaccatattgagtattacaaggcttcctcggagatggcactttaccagaaaaaacatggtattaaactctataaacctctcattctccctgtgactcaggccccaatcttcatctccttcttcattgctttgagagagatggccaaccttcctgtgcccagcctgcagacaggtggcctctggtggttccaggatctcacggtatccgatcccatctacatattaccactggcagtcactgctacaatgtgggctgttcttgagctaggtgctgagacaggtgtgcaaagttctgaccttcagtggatgagaaatgtcatcagaatgatgcccctgataaccttgcccataaccatgcatttccccacggcagtgtttatgtactggctctcctccaatttgttttccctggtccaagtatcctgtctccggattccagcagtacgcactgtacttaaaatcccccagcgtgttgtacatgacctggacaaattacctccacgggaaggcttcctagagagcttcaaaaaaggctggaaaaatgctgaaatgacgcgtcagctgcgagagcgtgaacaacgcatgcggaatcagttggagctagcagccaggggtcctttacgacagacctttacccacaaccctctcctacaacctggaaaggataaccctcccaatatccctagcagcagcagcaaaccaaagtcaaagtatccctggcacgacacacttggctgacttatgttctgtgcgcattctggcaggaattctgtctcttcagagactcatcctcaaaacaagacttgacactgtgtccttgccccagtcctaggaactgtggcacacagagatgttcattttaaaaacggatttcatgaaacactcttgtacttatgtttataagagagcactgggtagccaagtgatcttcccattcacagagttagtaaacctctgtactaca

SEQ ID NO: 296107 - DNA, 1745 bp, Homo sapiens
ccacaacttccccccttttccccccaaaaaaaaaggaaaattggaaaattaaccgggcaaaatggcgatgggactaatgtgcggacgccgggagcttctgcgcttgctacagtccgggcgtcgggtaaggatgccccggggcagagcaccgggatgctgccctgacccagtgaaccaggccccaggacagctcgtgctaggggtatcagcagacgctgacctgctcaccgggacctgaatgtcatgacctcgggtcatgtgaggacgcgctagggtccacagcgtcgcagggccctcgcaatggcttgggaaaccgctgaccacacggctcctattcccagtagccccgtgctgctgtcgcccacactacctcttccttgcggcttccggcccccgcagcctcagtacctctgctatctcttttgcagaagtccaggttcaggcccctcctgttgttgctgcaactccctcacccacagcagtacctgaggtggcttctggagagactgcagatgtagtccaaactgctgcagagcagagcttcgctgaactggggctggggtcatacaccccagtgggactgatccagaatttactggaatttatgcatgttgatctgggcctaccttggtggggggccattgctgcatgtacagtctttgcccgctgcctgatttttcctctcatcgtgacgggccagcgagaggcagccaggatccacaatcacttgccagagatccagaagttttccagtcgaatcagagaggccaagttagcaggagaccatattgagtattacaaggcttcctcggagatggcactttaccagaaaaaacatggtattaaactctataaacctctcattctccctgtgactcaggccccaatcttcatctccttcttcattgctttgagagagatggccaaccttcctgtgcccagcctgcagacaggtggcctctggtggttccaggatctcacggtatccgatcccatctacatattaccactggcagtcactgctacaatgtgggctgttcttgagctaggtgctgagacaggtgtgcaaagttctgaccttcagtggatgagaaatgtcatcagaatgatgcccctgataaccttgcccataaccatgcatttccccacggcagtgtttatgtactggctctcctccaatttgttttccctggtccaagtatcctgtctccggattccagcagtacgcactgtacttaaaatcccccagcgtgttgtacatgacctggacaaattacctccacgggaaggcttcctagagagcttcaaaaaaggctggaaaaatgctgaaatgacgcgtcagctgcgagagcgtgaacaacgcatgcggaatcagttggagctagcagccaggggtcctttacgacagacctttacccacaaccctctcctacaacctggaaaggataaccctcccaatatccctagcagcagcagcaaaccaaagtcaaagtatccctggcacgacacacttggctgacttatgttctgtgcgcattctggcaggaattctgtctcttcagagactcatcctcaaaacaagacttgacactgtgtccttgccccagtcctaggaactgtggcacacagagatgttcattttaaaaacggatttcatgaaacactcttgtacttatgtttataagagagcactgggtagccaagtgatcttcccattcacagagttagtaaacctctgtactaca

SEQ ID NO: 296108 - DNA, 1423 bp, Homo sapiens
  misc_feature (78)..(78): n is a, c, g, or t
atggtaacgtggctttacagatttttacccacttcaaatatggccgccaagctccgttctcttttaccgcctgatctncggctacaattctggcttcatgcccgcctccaaaagtgcttcctctcgaggggttgtggttcttactgcgcaggcgcaaaagcaagtcctcttccgccgggcaaaatggcgatgggactaatgtgcggacgccgggagcttctgcgcttgctacagtccgggcgtcgggtccacagcgtcgcagggccctcgcaatggcttgggaaaccgctgaccacacggctcctattcccagtagccccgtgctgctgtcgcccacactacctcttccttgcggcttccggcccccgcagcctcagtacctctgctatctcttttgcagaagtccaggttcaggcccctcctgttgttgctgcaactccctcacccacagcagtacctgaggtggcttctggagagactgcagatgtagtccaaactgctgcagagcagagcttcgctgaactggggctggggtcatacaccccagtgggactgatccagaatttactggaatttatgcatgttgatctgggcctaccttggtggggggccattgctgcatgtacagtctttgcccgctgcctgatttttcctctcatcgtgacgggccagcgagaggcagccaggatccacaatcacttgccagagatccagaagttttccagtcgaatcagagaggccaagttagcaggagaccatattgagtattacaaggcttcctcggagatggcactttaccagaaaaaacatggtattaaactctataaacctctcattctccctgtgactcaggccccaatcttcatctccttcttcattgctttgagagagatggccaaccttcctgtgcccagcctgcagacaggtggcctctggtggttccaggatctcacggtatccgatcccatctacatattaccactggcagtcactgctacaatgtgggctgttcttgagctaggtgctgagacaggtgtgcaaagttctgaccttcagtggatgagaaatgtcatcagaatgatgcccctgataaccttgcccataaccatgcatttccccacggcagtgtttatgtactggctctcctccaatttgttttccctggtccaagtatcctgtctccggattccagcagtacgcactgtacttaaaatcccccagcgtgttgtacatgacctggacaaattacctccacgggaaggcttcctagagagcttcaaaaaaggctggaaaaatgctgaaatgacgcgtcagctgcgagagcgtgaacaacgcatgcggaatcagttggagctagcagccagggctcccctagcacagacctttacccgcgaccctataatacaaggggtttggaagcagg

SEQ ID NO: 296109 - DNA, 1899 bp, Homo sapiens
  misc_feature (78)..(78): n is a, c, g, or t
atggtaacgtggctttacagatttttacccacttcaaatatggccgccaagctccgttctcttttaccgcctgatctncggctacaattctggcttcatgcccgcctccaaaagtgcttcctctcgaggggttgtggttcttactgcgcaggcgcaaaagcaagtcctcttccgccgggcaaaatggcgatgggactaatgtgcggacgccgggagcttctgcgcttgctacagtccgggcgtcgggtccacagcgtcgcagggccctcgcaatggcttgggaaaccgctgaccacacggctcctattcccagtagccccgtgctgctgtcgcccacactacctcttccttgcggcttccggcccccgcagcctcagtacctctgctatctcttttgcagaagtccaggttcaggcccctcctgttgttgctgcaactccctcacccacagcagtacctgaggtggcttctggagagactgcagatgtagtccaaactgctgcagagcagagcttcgctgaactggggctggggtcatacaccccagtgggactgatccagaatttactggaatttatgcatgttgatctgggcctaccttggtggggggccattgctgcatgtacagtctttgcccgctgcctgatttttcctctcatcgtgacgggccagcgagaggcagccaggatccacaatcacttgccagagatccagaagttttccagtcgaatcagagaggccaagttagcaggagaccatattgagtattacaaggcttcctcggagatggcactttaccagaaaaaacatggtattaaactctataaacctctcattctccctgtgactcaggtgagcaaaaacatttccttccttatttcatccagtacccatgaaatttcctctctgtgtttcatgtgtcccaggtcccccaaaaaacaggtggtggtggattatacatggctttcagtagtggggtgatgaaaatgttctctctggtaaagcatgctgacactgtttatcttgtgtaataggccccaatcttcatctccttcttcattgctttgagagagatggccaaccttcctgtgcccagcctgcagacaggtggcctctggtggttccaggatctcacggtatccgatcccatctacatattaccactggcagtcactgctacaatgtgggctgttcttgagctaggtgctgagacaggtgtgcaaagttctgaccttcagtggatgagaaatgtcatcagaatgatgcccctgataaccttgcccataaccatgcatttccccacggcagtgtttatgtactggctctcctccaatttgttttccctggtccaagtatcctgtctccggattccagcagtacgcactgtacttaaaatcccccagcgtgttgtacatgacctggacaaattacctccacgggaaggcttcctagagagcttcaaaaaaggctggaaaaatgctgaaatgacgcgtcagctgcgagagcgtgaacaacgcatgcggaatcagttggagctagcagccaggggtcctttacgacagacctttacccacaaccctctcctacaacctggaaaggataaccctcccaatatccctagcagcagcagcaaaccaaagtcaaagtatccctggcacgacacacttggctgacttatgttctgtgcgcattctggcaggaattctgtctcttcagagactcatcctcaaaacaagacttgacactgtgtccttgccccagtcctaggaactgtggcacacagagatgttcattttaaaaacggatttcatgaaacactcttgtacttatgtttataagagagcactgggtagccaagtgatcttcccattcacagagttagtaaacctctgtactaca

SEQ ID NO: 296110 - DNA, 1725 bp, Homo sapiens
ccacaacttccccccttttccccccaaaaaaaaaggaaaattggaaaattaaccgggcaaaatggcgatgggactaatgtgcggacgccgggagcttctgcgcttgctacagtccgggcgtcggcacatcacgcgtcgacagaggccctctcaactggctttgggaaatcgttgtaccactacggcgtcctattcccagtagccaccgttcctgctgtcagcctcacacgtatcgctctttcctttgccgtgtcttcacaggtcaccccgtctagcacatcatgtacttctactgactatcatcgttcttgctggaatttccaggttctaggcgcaccttccttgattgttgggctgtcggacatcccatccacgcacgactagtcgacgttacctgagagttggcttctggagagacttgcgagaagtgtaggtcgcaaaactagcttgcagtagtcaccacgcttctgctgaaactggtggcctgggtggtcactacctatccccatgctgcggaccttggatccacgtaatgtttacgtgtgcatacttgtactgtctctgttctgcaactctcgggggctagcccttgggtgcgggcgcgtccacttggctgtctttgatgcaggagtacagtctttgcccgctgcctgatttttcctctcatcgtgacgggccagcgagaggcagccaggatccacaatcacttgccagagatccagaagttttccagtcgaatcagagaggccaagttagcaggagaccatattgagtattacaaggcttcctcggagatggcactttaccagaaaaaacatggtattaaactctataaacctctcattctccctgtgactcaggccccaatcttcatctccttcttcattgctttgagagagatggccaaccttcctgtgcccagcctgcagacaggtggcctctggtggttccaggatctcacggtatccgatcccatctacatattaccactggcagtcactgctacaatgtgggctgttcttgagctaggtgctgagacaggtgtgcaaagttctgaccttcagtggatgagaaatgtcatcagaatgatgcccctgataaccttgcccataaccatgcatttccccacggcagtgtttatgtactggctctcctccaatttgttttccctggtccaagtatcctgtctccggattccagcagtacgcactgtacttaaaatcccccagcgtgttgtacatgacctggacaaattacctccacgggaaggcttcctagagagcttcaaaaaaggctggaaaaatgctgaaatgacgcgtcagctgcgagagcgtgaacaacgcatgcggaatcagttggagctagcagccaggggtcctttacgacagacctttacccacaaccctctcctacaacctggaaaggataaccctcccaatatccctagcagcagcagcaaaccaaagtcaaagtatccctggcacgacacacttggctgacttatgttctgtgcgcattctggcaggaattctgtctcttcagagactcatcctcaaaacaagacttgacactgtgtccttgccccagtcctaggaactgtggcacacagagatgttcattttaaaaacggatttcatgaaacactcttgtacttatgtttataagagagcactgggtagccaagtgatcttcccattcacagagttagtaaacctctgtactaca

SEQ ID NO: 296111 - DNA, 1369 bp, Homo sapiens
ccacaacttccccccttttccccccaaaaaaaaaggaaaattggaaaattaaccgggcaaaatggcgatgggactaatgtgcggacgccgggagcttctgcgcttgctacagtccgggcgtcgggtaaggatgccccggggcagagcaccgggatgctgccctgacccagtgaaccaggccccaggacagctcgtgctaggggtatcagcagacgctgacctgctcaccgggacctgaatgtcatgacctcgggtcatgtgaggacgcgctagggtacagtctttgcccgctgcctgatttttcctctcatcgtgacgggccagcgagaggcagccaggatccacaatcacttgccagagatccagaagttttccagtcgaatcagagaggccaagttagcaggagaccatattgagtattacaaggcttcctcggagatggcactttaccagaaaaaacatggtattaaactctataaacctctcattctccctgtgactcaggccccaatcttcatctccttcttcattgctttgagagagatggccaaccttcctgtgcccagcctgcagacaggtggcctctggtggttccaggatctcacggtatccgatcccatctacatattaccactggcagtcactgctacaatgtgggctgttcttgagctaggtgctgagacaggtgtgcaaagttctgaccttcagtggatgagaaatgtcatcagaatgatgcccctgataaccttgcccataaccatgcatttccccacggcagtgtttatgtactggctctcctccaatttgttttccctggtccaagtatcctgtctccggattccagcagtacgcactgtacttaaaatcccccagcgtgttgtacatgacctggacaaattacctccacgggaaggcttcctagagagcttcaaaaaaggctggaaaaatgctgaaatgacgcgtcagctgcgagagcgtgaacaacgcatgcggaatcagttggagctagcagccaggggtcctttacgacagacctttacccacaaccctctcctacaacctggaaaggataaccctcccaatatccctagcagcagcagcaaaccaaagtcaaagtatccctggcacgacacacttggctgacttatgttctgtgcgcattctggcaggaattctgtctcttcagagactcatcctcaaaacaagacttgacactgtgtccttgccccagtcctaggaactgtggcacacagagatgttcattttaaaaacggatttcatgaaacactcttgtacttatgtttataagagagcactgggtagccaagtgatcttcccattcacagagttagtaaacctctgtactaca

SEQ ID NO: 296112 - DNA, 1853 bp, Homo sapiens
ccacaacttccccccttttccccccaaaaaaaaaggaaaattggaaaattaaccgggcaaaatggcgatgggactaatgtgcggacgccgggagcttctgcgcttgctacagtccgggcgtcgggtccacagcgtcgcagggccctcgcaatggcttgggaaaccgctgaccacacggctcctattcccagtagccccgtgctgctgtcgcccacactacctcttccttgcggcttccggcccccgcagcctcagtacctctgctatctcttttgcagaagtccaggttcaggcccctcctgttgttgctgcaactccctcacccacagcagtacctgaggtggcttctggagagactgcagatgtagtccaaactgctgcagagcagagcttcgctgaactggggctggggtcatacaccccagtgggactgatccagaatttactggaatttatgcatgttgatctgggcctaccttggtggggggccattgctgcatgtacagtctttgcccgctgcctgatttttcctctcatcgtgacgggccagcgagaggcagccaggatccacaatcacttgccagagatccagaagttttccagtcgaatcagagaggccaagttagcaggagaccatattgagtgtgagtcagttgcagaatgagcgtgggagaagtccacatttgcacttttccttacattctgctgggggaaaggaacaatgtaaatcagaagttgccacagtcgggaaagttctaaaggtttatctgtttcttagacctaatgctcccaaggagtggccagggttggttagaaatttcacaggccaggtagataatgaggatgttcacctccactgatgtaactgttaccccaaccattaatttcccctcacctcacagattacaaggcttcctcggagatggcactttaccagaaaaaacatggtattaaactctataaacctctcattctccctgtgactcaggccccaatcttcatctccttcttcattgctttgagagagatggccaaccttcctgtgcccagcctgcagacaggtggcctctggtggttccaggatctcacggtatccgatcccatctacatattaccactggcagtcactgctacaatgtgggctgttcttgagctaggtgctgagacaggtgtgcaaagttctgaccttcagtggatgagaaatgtcatcagaatgatgcccctgataaccttgcccataaccatgcatttccccacggcagtgtttatgtactggctctcctccaatttgttttccctggtccaagtatcctgtctccggattccagcagtacgcactgtacttaaaatcccccagcgtgttgtacatgacctggacaaattacctccacgggaaggcttcctagagagcttcaaaaaaggctggaaaaatgctgaaatgacgcgtcagctgcgagagcgtgaacaacgcatgcggaatcagttggagctagcagccaggggtcctttacgacagacctttacccacaaccctctcctacaacctggaaaggataaccctcccaatatccctagcagcagcagcaaaccaaagtcaaagtatccctggcacgacacacttggctgacttatgttctgtgcgcattctggcaggaattctgtctcttcagagactcatcctcaaaacaagacttgacactgtgtccttgccccagtcctaggaactgtggcacacagagatgttcattttaaaaacggatttcatgaaacactcttgtacttatgtttataagagagcactgggtagccaagtgatcttcccattcacagagttagtaaacctctgtactaca

SEQ ID NO: 296113 - DNA, 1449 bp, Homo sapiens
  misc_feature (78)..(78): n is a, c, g, or t
  misc_feature (1250)..(1250): n is a, c, g, or t
  misc_feature (1334)..(1334): n is a, c, g, or t
  misc_feature (1383)..(1383): n is a, c, g, or t
  misc_feature (1413)..(1413): n is a, c, g, or t
  misc_feature (1428)..(1428): n is a, c, g, or t
  misc_feature (1441)..(1441): n is a, c, g, or t
atggtaacgtggctttacagatttttacccacttcaaatatggccgccaagctccgttctcttttaccgcctgatctncggctacaattctggcttcatgcccgcctccaaaagtgcttcctctcgaggggttgtggttcttactgcgcaggcgcaaaagcaagtcctcttccgccgggcaaaatggcgatgggactaatgtgcggacgccgggagcttctgcgcttgctacagtccgggcgtcgggtccacagcgtcgcagggccctcgcaatggcttgggaaaccgctgaccacacggctcctattcccagtagccccgtgctgctgtcgcccacactacctcttccttgcggcttccggcccccgcagcctcagtacctctgctatctcttttgcagaagtccaggttcaggcccctcctgttgttgctgcaactccctcacccacagcagtacctgaggtggcttctggagagactgcagatgtagtccaaactgctgcagagcagagcttcgctgaactggggctggggtcatacaccccagtgggactgatccagaatttactggaatttatgcatgttgatctgggcctaccttggtggggggccattgctgcatgtacagtctttgcccgctgcctgatttttcctctcatcgtgacgggccagcgagaggcagccaggatccacaatcacttgccagagatccagaagttttccagtcgaatcagagaggccaagttagcaggagaccatattgagtattacaaggcttcctcggagatggcactttaccagaaaaaacatggtattaaactctataaacctctcattctccctgtgactcaggccccaatcttcatctccttcttcattgctttgagagagatggccaaccttcctgtgcccagcctgcagacaggtggcctctggtggttccaggatctcacggtatccgatcccatctacatattaccactggcagtcactgctacaatgtgggctgttcttgagctaggtgctgagacaggtgtgcaaagttctgaccttcagtggatgagaaatgtcatcagaatgatgcccctgataaccttgcccataaccatgcatttccccacgcatcagcagtgtcctggcttggcactcacagcaaggccactgctgatgctgatggggctgctgttttctttcttgtcttattcatttgcaaaacctttactgatgacttttaccacagtcacacatantatctcatttaaacctcacagcaactctgtgagggattgttatctccattttatgggatgaggaagctgactctgagagatgantttccaaattcatccaactggaagaaaaaggaagtctctgggggacttngaatccagaactgtttcaggttccaagttncagggggttcaattntatttaaggccantccatgga

SEQ ID NO: 296114 - DNA, 2035 bp, Homo sapiens
ccacaacttccccccttttccccccaaaaaaaaaggaaaattggaaaattaaccgggcaaaatggcgatgggactaatgtgcggacgccgggagcttctgcgcttgctacagtccgggcgtcgggtccacagcgtcgcagggccctcgcaatggcttgggaaaccgctgaccacacggctcctattcccagtagccccgtgctgctgtcgcccacactacctcttccttgcggcttccggcccccgcagcctcagtacctctgctatctcttttgcagaagtccaggttcaggcccctcctgttgttgctgcaactccctcacccacagcagtacctgaggtggcttctggagagactgcagatgtagtccaaactgctgcagagcagagcttcgctgaactggggctggggtcatacaccccagtgggactgatccagaatttactggaatttatgcatgttgatctgggcctaccttggtggggggccattgctgcatgtacagtctttgcccgctgcctgatttttcctctcatcgtgacgggccagcgagaggcagccaggatccacaatcacttgccagagatccagaagttttccagtcgaatcagagaggccaagttagcaggagaccatattgagtgtgagtcagttgcagaatgagcgtgggagaagtccacatttgcacttttccttacattctgctgggggaaaggaacaatgtaaatcagaagttgccacagtcgggaaagttctaaaggtttatctgtttcttagacctaatgctcccaaggagtggccagggttggttagaaatttcacaggccaggtagataatgaggatgttcacctccactgatgtaactgttaccccaaccattaatttcccctcacctcacagattacaaggcttcctcggagatggcactttaccagaaaaaacatggtattaaactctataaacctctcattctccctgtgactcaggtgagcaaaaacatttccttccttatttcatccagtacccatgaaatttcctctctgtgtttcatgtgtcccaggtcccccaaaaaacaggtggtggtggattatacatggctttcagtagtggggtgatgaaaatgttctctctggtaaagcatgctgacactgtttatcttgtgtaataggccccaatcttcatctccttcttcattgctttgagagagatggccaaccttcctgtgcccagcctgcagacaggtggcctctggtggttccaggatctcacggtatccgatcccatctacatattaccactggcagtcactgctacaatgtgggctgttcttgagctaggtgctgagacaggtgtgcaaagttctgaccttcagtggatgagaaatgtcatcagaatgatgcccctgataaccttgcccataaccatgcatttccccacggcagtgtttatgtactggctctcctccaatttgttttccctggtccaagtatcctgtctccggattccagcagtacgcactgtacttaaaatcccccagcgtgttgtacatgacctggacaaattacctccacgggaaggcttcctagagagcttcaaaaaaggctggaaaaatgctgaaatgacgcgtcagctgcgagagcgtgaacaacgcatgcggaatcagttggagctagcagccaggggtcctttacgacagacctttacccacaaccctctcctacaacctggaaaggataaccctcccaatatccctagcagcagcagcaaaccaaagtcaaagtatccctggcacgacacacttggctgacttatgttctgtgcgcattctggcaggaattctgtctcttcagagactcatcctcaaaacaagacttgacactgtgtccttgccccagtcctaggaactgtggcacacagagatgttcattttaaaaacggatttcatgaaacactcttgtacttatgtttataagagagcactgggtagccaagtgatcttcccattcacagagttagtaaacctctgtactaca

SEQ ID NO: 296115 - DNA, 1451 bp, Homo sapiens
ccacaacttccccccttttccccccaaaaaaaaaggaaaattggaaaattaaccgggcaaaatggcgatgggactaatgtgcggacgccgggagcttctgcgcttgctacagtccgggcgtcgggtccacagcgtcgcagggccctcgcaatggcttgggaaaccgctgaccacacggctcctattcccagtagccccgtgctgctgtcgcccacactacctcttccttgcggcttccggcccccgcagcctcagtacctctgctatctcttttgcagaagtccaggttcaggcccctcctgttgttgctgcaactccctcacccacagcagtacctgaggtggcttctggagagactgcagatgtagtccaaactgctgcagagcagagcttcgctgaactggggctggggtcatacaccccagtgggactgatccagaatttactggaatttatgcatgttgatctgggcctaccttggtggggggccattgctgcatattacaaggcttcctcggagatggcactttaccagaaaaaacatggtattaaactctataaacctctcattctccctgtgactcaggccccaatcttcatctccttcttcattgctttgagagagatggccaaccttcctgtgcccagcctgcagacaggtggcctctggtggttccaggatctcacggtatccgatcccatctacatattaccactggcagtcactgctacaatgtgggctgttcttgagctaggtgctgagacaggtgtgcaaagttctgaccttcagtggatgagaaatgtcatcagaatgatgcccctgataaccttgcccataaccatgcatttccccacggcagtgtttatgtactggctctcctccaatttgttttccctggtccaagtatcctgtctccggattccagcagtacgcactgtacttaaaatcccccagcgtgttgtacatgacctggacaaattacctccacgggaaggcttcctagagagcttcaaaaaaggctggaaaaatgctgaaatgacgcgtcagctgcgagagcgtgaacaacgcatgcggaatcagttggagctagcagccaggggtcctttacgacagacctttacccacaaccctctcctacaacctggaaaggataaccctcccaatatccctagcagcagcagcaaaccaaagtcaaagtatccctggcacgacacacttggctgacttatgttctgtgcgcattctggcaggaattctgtctcttcagagactcatcctcaaaacaagacttgacactgtgtccttgccccagtcctaggaactgtggcacacagagatgttcattttaaaaacggatttcatgaaacactcttgtacttatgtttataagagagcactgggtagccaagtgatcttcccattcacagagttagtaaacctctgtactaca

SEQ ID NO: 296116 - DNA, 1633 bp, Homo sapiens
ccacaacttccccccttttccccccaaaaaaaaaggaaaattggaaaattaaccgggcaaaatggcgatgggactaatgtgcggacgccgggagcttctgcgcttgctacagtccgggcgtcgggtccacagcgtcgcagggccctcgcaatggcttgggaaaccgctgaccacacggctcctattcccagtagccccgtgctgctgtcgcccacactacctcttccttgcggcttccggcccccgcagcctcagtacctctgctatctcttttgcagaagtccaggttcaggcccctcctgttgttgctgcaactccctcacccacagcagtacctgaggtggcttctggagagactgcagatgtagtccaaactgctgcagagcagagcttcgctgaactggggctggggtcatacaccccagtgggactgatccagaatttactggaatttatgcatgttgatctgggcctaccttggtggggggccattgctgcatattacaaggcttcctcggagatggcactttaccagaaaaaacatggtattaaactctataaacctctcattctccctgtgactcaggtgagcaaaaacatttccttccttatttcatccagtacccatgaaatttcctctctgtgtttcatgtgtcccaggtcccccaaaaaacaggtggtggtggattatacatggctttcagtagtggggtgatgaaaatgttctctctggtaaagcatgctgacactgtttatcttgtgtaataggccccaatcttcatctccttcttcattgctttgagagagatggccaaccttcctgtgcccagcctgcagacaggtggcctctggtggttccaggatctcacggtatccgatcccatctacatattaccactggcagtcactgctacaatgtgggctgttcttgagctaggtgctgagacaggtgtgcaaagttctgaccttcagtggatgagaaatgtcatcagaatgatgcccctgataaccttgcccataaccatgcatttccccacggcagtgtttatgtactggctctcctccaatttgttttccctggtccaagtatcctgtctccggattccagcagtacgcactgtacttaaaatcccccagcgtgttgtacatgacctggacaaattacctccacgggaaggcttcctagagagcttcaaaaaaggctggaaaaatgctgaaatgacgcgtcagctgcgagagcgtgaacaacgcatgcggaatcagttggagctagcagccaggggtcctttacgacagacctttacccacaaccctctcctacaacctggaaaggataaccctcccaatatccctagcagcagcagcaaaccaaagtcaaagtatccctggcacgacacacttggctgacttatgttctgtgcgcattctggcaggaattctgtctcttcagagactcatcctcaaaacaagacttgacactgtgtccttgccccagtcctaggaactgtggcacacagagatgttcattttaaaaacggatttcatgaaacactcttgtacttatgtttataagagagcactgggtagccaagtgatcttcccattcacagagttagtaaacctctgtactaca

SEQ ID NO: 296117 - DNA, 1013 bp, Homo sapiens
  misc_feature (4)..(4): n is a, c, g, or t
  misc_feature (18)..(18): n is a, c, g, or t
  misc_feature (23)..(23): n is a, c, g, or t
ctgnggaagagggatatngggancgggttatcctttcaagttagcaggagaccatattgagtattacaaggcttcctcggagatggcactttaccagaaaaaacatggtattaaactctataaacctctcattctccctgtgactcaggccccaatcttcatctccttcttcattgctttgagagagatggccaaccttcctgtgcccagcctgcagacaggtggcctctggtggttccaggatctcacggtatccgatcccatctacatattaccactggcagtcactgctacaatgtgggctgttcttgagctaggtgctgagacaggtgtgcaaagttctgaccttcagtggatgagaaatgtcatcagaatgatgcccctgataaccttgcccataaccatgcatttccccacggcagtgtttatgtactggctctcctccaatttgttttccctggtccaagtatcctgtctccggattccagcagtacgcactgtacttaaaatcccccagcgtgttgtacatgacctggacaaattacctccacgggaaggcttcctagagagcttcaaaaaaggctggaaaaatgctgaaatgacgcgtcagctgcgagagcgtgaacaacgcatgcggaatcagttggagctagcagccaggggtcctttacgacagacctttacccacaaccctctcctacaacctggaaaggataaccctcccaatatccctagcagcagcagcaaaccaaagtcaaagtatccctggcacgacacacttggctgacttatgttctgtgcgcattctggcaggaattctgtctcttcagagactcatcctcaaaacaagacttgacactgtgtccttgccccagtcctaggaactgtggcacacagagatgttcattttaaaaacggatttcatgaaacactcttgtacttatgtttataagagagcactgggtagccaagtgatcttcccattcacagagttagtaaacctctgtactaca

SEQ ID NO: 296118 - DNA, 889 bp, Homo sapiens
gcttcctcggagatggcactttaccagaaaaaacatggtattaaactctataaacctctcattctccctgtgttcaggcccctcctgttgttgctgcaactccctcacccacagcagtacctgaggtggcttctggagagactgcagatgtagtccaaactgctgcagagcagagcttcgctgaactggggctggggtcatacaccccagtgggactgatccagaatttactggaatttatgcatgttgatctgggcctaccttggtggggggccattgctgcatgtacagtctttgcccgctgcctgatttttcctctcatcgtgacgggccagcgagaggcagccaggatccacaatcacttgccagagatccagaagttttccagtcgaatcagagaggccaagttagcaggagaccatattgagtgaaggcttcctagagagcttcaaaaaaggctggaaaaatgctgaaatgacgcgtcagctgcgagagcgtgaacaacgcatgcggaatcagttggagctagcagccaggggtcctttacgacagacctttacccacaaccctctcctacaacctggaaaggataaccctcccaatatccctagcagcagcagcaaaccaaagtcaaagtatccctggcacgacacacttggctgacttatgttctgtgcgcattctggcaggaattctgtctcttcagagactcatcctcaaaacaagacttgacactgtgtccttgccccagtcctaggaactgtggcacacagagatgttcattttaaaaacggatttcatgaaacactcttgtacttatgtttataagagagcactgggtagccaagtgatcttcccattcacagagttagtaaacctctgtactaca

SEQ ID NO: 296119 - DNA, 1035 bp, Homo sapiens
  misc_feature (78)..(78): n is a, c, g, or t
atggtaacgtggctttacagatttttacccacttcaaatatggccgccaagctccgttctcttttaccgcctgatctncggctacaattctggcttcatgcccgcctccaaaagtgcttcctctcgaggggttgtggttcttactgcgcaggcgcaaaagcaagtcctcttccgccgggcaaaatggcgatgggactaatgtgcggacgccgggagcttctgcgcttgctacagtccgggcgtcgggtccacagcgtcgcagggccctcgcaatggcttgggaaaccgctgaccacacggctcctattcccagtagccccgtgctgctgtcgcccacactacctcttccttgcggcttccggcccccgcagcctcagtacctctgctatctcttttgcagaagtccaggttcaggcccctcctgttgttgctgcaactccctcacccacagcagtacctgaggtggcttctggagagactgcagatgtagtccaaactgctgcagagcagagcttcgctgaactggggctggggtcatacaccccagtgggactgatccagaatttactggaatttatgcatgttgatctgggcctaccttggtggggggccattgctgcatgtacagtctttgcccgctgcctgatttttcctctcatcgtgacgggccagcgagaggcagccaggatccacaatcacttgccagagatccagaagttttccagtcgaatcagagaggccaagttagcaggagaccatattgagtattacaaggcttcctcggagatggcactttaccagaaaaaacatggtattaaactctataaacctctcattctccctgtgactcagcccccaatcttcatctccttcttcattggtttgaggaacagtgggctccttgtgggtcccaggaatctcacggaatccgatcccatctaaatattaaccaatggctgatcacctgggaacattgtggctggctcttgggcaacgggccgaacagggtgtgaaaggttctgccttcaatggctg

SEQ ID NO: 296120 - DNA, 1363 bp, Homo sapiens
  misc_feature (78)..(78): n is a, c, g, or t
atggtaacgtggctttacagatttttacccacttcaaatatggccgccaagctccgttctcttttaccgcctgatctncggctacaattctggcttcatgcccgcctccaaaagtgcttcctctcgaggggttgtggttcttactgcgcaggcgcaaaagcaagtcctcttccgccgggcaaaatggcgatgggactaatgtgcggacgccgggagcttctgcgcttgctacagtccgggcgtcgggtccacagcgtcgcagggccctcgcaatggcttgggaaaccgctgaccacacggctcctattcccagtagccccgtgctgctgtcgcccacactacctcttccttgcggcttccggcccccgcagcctcagtacctctgctatctcttttgcagaagtccaggttcaggcccctcctgttgttgctgcaactccctcacccacagcagtacctgaggtggcttctggagagactgcagatgtagtccaaactgctgcagagcagagcttcgctgaactggggctggggtcatacaccccagtgggactgatccagaatttactggaatttatgcatgttgatctgggcctaccttggtggggggccattgctgcatgtacagtctttgcccgctgcctgatttttcctctcatcgtgacgggccagcgagaggcagccaggatccacaatcacttgccagagatccagaagttttccagtcgaatcagagaggccaagttagcaggagaccatattgagtattacaaggcttcctcggagatggcactttaccagaaaaaacatggtattaaactctataaacctctcattctccctgtgactcaggtgagcaaaaacatttccttccttatttcatccagtacccatgaaatttcctctctgtgtttcatgtgtcccaggtcccccaaaaaacaggtggtggtggattatacatggctttcagtagtggggtgatgaaaatgttctctctggtaaagcatgctgacactgtttatcttgtgtaataggccccaatcttcatctccttcttcattgctttgagagagatggccaaccttcctgtgcccagcctgcagacaggtggcctctggtggttccaggatctcacggtatccgatcccatctacatattaccactggcagtcactgctacaatgtgggctgttcttgaggtaagcccagattggccaagtgccaggcctgcaaagtgaactgggattggagggtaaagtagttgtacagaatggtcatccttcacttgctggagaaagagttgatgggtaagagattagagacagattcactgaaactgacagctttcccgacttttccaccc

SEQ ID NO: 296121 - DNA, 509 bp, Homo sapiens
ccacaacttccccccttttccccccaaaaaaaaaggaaaattggaaaattaaccgggcaaaatggcgatgggactaatgtgcggacgccgggagcttctgcgcttgctacagtccgggcgtcgggtccacagcgtcgcagggccctcgcaatggcttgggaaaccgctgaccacacggctcctattcccagtagccccgtgctgctgtcgcccacactacctcttccttgcggcttccggcccccgcagcctcagtacctctgctatctcttttgcagaagtccaggttcaggcccctcctgttgttgctgcaactccctcacccacagcagtacctgaggtggcttctggagagactgcagatgtagtccaaactgctgcagaaacaaaaaactttcgctgaaacttggggggctggggggtctataacccccccaaggtgggaactggtccccaaaaatttccttgggaattttattcgcccttgttggaaaccgcggggggggcgc

SEQ ID NO: 296122 - DNA, 438 bp, Homo sapiens
tttactcatatcacctcattcgaactgccagtaacataattgctaaatccactcctgtcagctttttgtttgaggaaacaaacaggattcctaatcatctgcttagagaagttaatgccatacttttgtgatgccaaattagagaactgagccttaaagcaactaattcattcccctgaccttatttctgggcctcttaggcatgagtcatagaatggacaaggcaagaataagaccctttcagtaaggacctaaaagccttcaaccttctagctgcagaactgctttaatttcactccaatcctagtttgtattttccaggtacagtctttgcccgctgcctgatttttcctctcatcgtgacgggccagcgagaggcagccaggatccacaatcacttgccagagatccagaagttttccagtcgaatcagagagg

SEQ ID NO: 296123 - DNA, 1067 bp, Homo sapiens
gcgcagctccgagggctggcggctcggggcgccgaggcttccgcgcccgctggttcctcgctccggggcggagctcgcgatagcgaccgggagcagggcgcggggcgggacccaggtccgaggcgaggaagccggaagccaggcgcggggagcctcccccttcgactgcagcctcgctccgtgccttctgcgcgcctgggatcccggagcctgcctaggttctgtgcgctcccgcccaggccggtgcccgccgcccgcctgcgccccaggcaggtcccaggcctccggctgctcccggccgaagccccgagtgcgagatcgagcgtcctgagcgcctgaccgcagccctggatcgcctgcggcagcgcggcctggaacagaggtgtctgcggttgtcagcccgcgaggcctcggaagaggagctgggcctggtgcacagagtacctttcactgcgcgcggctggccgcaggggctggactgcagctggtggacgctgtgctcactggagctgtgcaaaatgggcttgccctggtgaggcctcccgggcaccatggccagagggcggctgccaacgggttctgcgtgttcaacaacgtggccatagcagctgcacatgccaagcagaaacacgggctacacaggatcctcgtcgtggactgggatgtgcaccatggccaggggatccagtatctctttgaggatgaccccagcgtcctttacttctcctggcaccgctatgagcatgggcgcttctggcctttcctgcgagagtcagatgcagacgcagtggggcggggacagggcctcggcttcactgtcaacctgccctggaaccagtggatgggcaacgctgactacgtggtgcttctgactggtgtccagtggcttgagggcaatgaggcagcaagtgtttcgccactcaacagtgctggagtgtgccggggcggtctgtgcgtgctgaggcggtacacctggagtcgggggagcacggcttaaacaactgttgtggccgcccctgttggaatggcatgatctaaaccccaagcggtgccacctgaacccaatg

SEQ ID NO: 296124 - DNA, 2704 bp, Homo sapiens
gcgcagctccgagggctggcggctcggggcgccgaggcttccgcgcccgctggttcctcgctccggggcggagctcgcgatagcgaccgggagcagggcgcggggcgggacccaggtccgaggcgaggaagccggaagccaggcgcggggagcctcccccttcgactgcagcctcgctccgtgccttctgcgcgcctgggatcccggagcctgcctaggttctgtgcgctcccgcccaggccggtgcccgccgcccgcctgcgccccaggcaggtcccaggcctccggctgctcccggccgaaggtggggacaggcagtggcaggcaccactagcgagggcgtttgggaacccagggtgaccacggcgcagccatggggaccgcgcttgtgtaccatgaggacatgacggccacccggctgctctgggacgaccccgagtgcgagatcgagcgtcctgagcgcctgaccgcagccctggatcgcctgcggcagcgcggcctggaacagaggtgtctgcggttgtcagcccgcgaggcctcggaagaggagctgggcctggtgcacagcccagagtatgtatccctggtcagggagacccaggtcctaggcaaggaggagctgcaggcgctgtccggacagttcgacgccatctacttccacccgagtacctttcactgcgcgcggctggccgcaggggctggactgcagctggtggacgctgtgctcactggagctgtgcaaaatgggcttgccctggtgaggcctcccgggcaccatggccagagggcggctgccaacgggttctgcgtgttcaacaacgtggccatagcagctgcacatgccaagcagaaacacgggctacacaggatcctcgtcgtggactgggatgtgcaccatggccaggggatccagtatctctttgaggatgaccccagcgtcctttacttctcctggcaccgctatgagcatgggcgcttctggcctttcctgcgagagtcagatgcagacgcagtggggcggggacagggcctcggcttcactgtcaacctgccctggaaccaggttgggatgggaaacgctgactacgtggctgccttcctgcacctgctgctcccactggcctttgagtttgaccctgagctggtgctggtctcggcaggatttgactcagccatcggggaccctgaggggcaaatgcaggccacgccagagtgcttcgcccacctcacacagctgctgcaggtgctggccggcggccgggtctgtgccgtgctggagggcggctaccacctggagtcactggcggagtcagtgtgcatgacagtacagacgctgctgggtgacccggccccacccctgtcagggccaatggcgccatgtcagagtgccctagagtccatccagagtgcccgtgctgcccaggccccgcactggaagagcctccagcagcaagatgtgaccgctgtgccgatgagccccagcagccactccccagaggggaggcctccacctctgctgcctgggggtccagtgtgtaaggcagctgcatctgcaccgagctccctcctggaccagccgtgcctctgccccgcaccctctgtccgcaccgctgttgccctgacaacgccggatatcacattggttctgccccctgacgtcatccaacaggaagcgtcagccctgagggaggagacagaagcctgggccaggccacacgagtccctggcccgggaggaggccctcactgcacttgggaagctcctgtacctcttagatgggatgctggatgggcaggtgaacagtggtatagcagccactccagcctctgctgcagcagccaccctggatgtggctgttcggagaggcctgtcccacggagcccagaggctgctgtgcgtggccctgggacagctggaccggcctccagacctcgcccatgacgggaggagtctgtggctgaacatcaggggcaaggaggcggctgccctatccatgttccatgtctccacgccactgccagtgatgaccggtggtttcctgagctgcatcttgggcttggtgctgcccctggcctatggcttccagcctgacctggtgctggtggcgctggggcctggccatggcctgcagggcccccacgctgcactcctggctgcaatgcttcgggggctggcagggggccgagtcctggccctcctggaggagaactccacaccccagctagcagggatcctggcccgggtgctgaatggagaggcacctcctagcctaggcccttcctctgtggcctccccagaggacgtccaggccctgatgtacctgagagggcagctggagcctcagtggaagatgttgcagtgccatcctcacctggtggcttgaaatcggccaaggtgggagcatttacaccgcagaaatgacaccgcacgccagcgccccgcggccgcgatccggaccccaagcccacggctccctcgactctggggcacggaaccccgcccactcccaatccccgcgccccgccctctcccacccgtgcttcccccgctccacccctcacctcacctcgcccccgccccacccatcgcgccccggcccgtcccatcgaggcccatgcaacccacgctcggtcccgttccggcccctgcgccccgctgcgcttcgctccccgcccttgcgccgttagtaaacatcgctcaaacg

SEQ ID NO: 296125 - DNA, 2683 bp, Homo sapiens
  misc_feature (2648)..(2648): n is a, c, g, or t
gcgcagctccgagggctggcggctcggggcgccgaggcttccgcgcccgctggttcctcgctccggggcggagctcgcgatagcgaccgggagcagggcgcggggcgggacccaggtccgaggcgaggaagccggaagccaggcgcggggagcctcccccttcgactgcagcctcgctccgtgccttctgcgcgcctgggatcccggagcctgcctaggttctgtgcgctcccgcccaggccggtgcccgccgcccgcctgcgccccaggcaggtcccaggcctccggctgctcccggccgaaggtggggacaggcagtggcaggcaccactagcgagggcgtttgggaacccagggtgaccacggcgcagccatggggaccgcgcttgtgtaccatgaggacatgacggccacccggctgctctgggacgaccccgagtgcgagatcgagcgtcctgagcgcctgaccgcagccctggatcgcctgcggcagcgcggcctggaacagaggtgtctgcggttgtcagcccgcgaggcctcggaagaggagctgggcctggtgcacagcccagagtatgtatccctggtcagggagacccaggtcctaggcaaggaggagctgcaggcgctgtccggacagttcgacgccatctacttccacccgagtacctttcactgcgcgcggctggccgcaggggctggactgcagctggtggacgctgtgctcactggagctgtgcaaaatgggcttgccctggtgaggcctcccgggcaccatggccagagggcggctgccaacgggttctgcgtgttcaacaacgtggccatagcagctgcacatgccaagcagaaacacgggctacacaggatcctcgtcgtggactgggatgtgcaccatggccaggggatccagtatctctttgaggatgaccccagcgtcctttacttctcctggcaccgctatgagcatgggcgcttctggcctttcctgcgagagtcagatgcagacgcagtggggcggggacagggcctcggcttcactgtcaacctgccctggaaccaggttgggatgggaaacgctgactacgtggctgccttcctgcacctgctgctcccactggcctttgagtttgaccctgagctggtgctggtctcggcaggatttgactcagccatcggggaccctgaggggcaaatgcaggccacgccagagtgcttcgcccacctcacacagctgctgcaggtgctggccggcggccgggtctgtgccgtgctggagggcggctaccacctggagtcactggcggagtcagtgtgcatgacagtacagacgctgctgggtgacccggccccacccctgtcagggccaatggcgccatgtcagagtgccctagagtccatccagagtgcccgtgctgcccaggccccgcactggaagagcctccagcagcaagatgtgaccgctgtgccgatgagccccagcagccactccccagaggggaggcctccacctctgctgcctgggggtccagtgtgtaaggcagctgcatctgcaccgagctccctcctggaccagccgtgcctctgccccgcaccctctgtccgcaccgctgttgccctgacaacgccggatatcacattggttctgccccctgacgtcatccaacaggaagcgtcagccctgagggaggagacagaagcctgggccaggccacacgagtccctggcccgggaggaggccctcactgcacttgggaagctcctgtacctcttagatgggatgctggatgggcaggtgaacagtggtatagcagccactccagcctctgctgcagcagccaccctggatgtggctgttcggagaggcctgtcccacggagcccagaggctgctgtgcgtggccctgggacagctggaccggcctccagacctcgcccatgacgggaggagtctgtggctgaacatcaggggcaaggaggcggctgccctatccatgttccatgtctccacgccactgccagtgatgaccggtggtttcctgagctgcatcttgggcttggtgctgcccctggcctatggcttccagcctgacctggtgctggtggcgctggggcctggccatggcctgcagggcccccacgctgcactcctggctgcaatgcttcgggggctggcagggggccgagtcctggccctcctggaggagaactccacaccccagctagcagggatcctggcccgggtgctgaatggagaggcacctcctagcctaggcccttcctctgtggcctccccagaggacgtccaggccctgatgtacctgagagggcagctggagcctcagtggaagatgttgcagtgccatcctcacctggtggcttgaaatcggccaaggtgggagcatttacaccgcagaaatgacaccgcacgccagcgccccgcggccgcgatccggaccccaagcccacggctccctcgactctggggcacggaaccccgcccactcccaatccccgcgccccgccctctcccacccgtgcttcccccgctccaccctacctactgccccgccaccatggcccgccgtccatgagccagcaccagctcgtcaagtcgccggcccgctgcgcttatgactccccgcgccnttgcgcccgttaggaaaaccttgaaccgtcggtcc

SEQ ID NO: 296126 - DNA, 2644 bp, Homo sapiens
gcgcagctccgagggctggcggctcggggcgccgaggcttccgcgcccgctggttcctcgctccggggcggagctcgcgatagcgaccgggagcagggcgcggggcgggacccaggtccgaggcgaggaagccggaagccaggcgcggggagcctcccccttcgactgcagcctcgctccgtgccttctgcgcgcctgggatcccggagcctgcctaggttctgtgcgctcccgcccaggccggtgcccgccgcccgcctgcgccccaggcaggtcccaggcctccggctgctcccggccgaaggtggggacaggcagtggcaggcaccactagcgagggcgtttgggaacccagggtgaccacggcgcagccatggggaccgcgcttgtgtaccatgaggacatgacggccacccggctgctctgggacgaccccgagtgcgagatcgagcgtcctgagcgcctgaccgcagccctggatcgcctgcggcagcgcggcctggaacagaggtgtctgcggttgtcagcccgcgaggcctcggaagaggagctgggcctggtgcacagcccagagtatgtatccctggtcagggagacccaggtcctaggcaaggaggagctgcaggcgctgtccggacagttcgacgccatctacttccacccgagtacctttcactgcgcgcggctggccgcaggggctggactgcagctggtggacgctgtgctcactggagctgtgcaaaatgggcttgccctggtgaggcctcccgggcaccatggccagagggcggctgccaacgggttctgcgtgttcaacaacgtggccatagcagctgcacatgccaagcagaaacacgggctacacaggatcctcgtcgtggactgggatgtgcaccatggccaggggatccagtatctctttgaggatgaccccagcgtcctttacttctcctggcaccgctatgagcatgggcgcttctggcctttcctgcgagagtcagatgcagacgcagtggggcggggacagggcctcggcttcactgtcaacctgccctggaaccaggttgggatgggaaacgctgactacgtggctgccttcctgcacctgctgctcccactggcctttgaggggcaaatgcaggccacgccagagtgcttcgcccacctcacacagctgctgcaggtgctggccggcggccgggtctgtgccgtgctggagggcggctaccacctggagtcactggcggagtcagtgtgcatgacagtacagacgctgctgggtgacccggccccacccctgtcagggccaatggcgccatgtcagagtgccctagagtccatccagagtgcccgtgctgcccaggccccgcactggaagagcctccagcagcaagatgtgaccgctgtgccgatgagccccagcagccactccccagaggggaggcctccacctctgctgcctgggggtccagtgtgtaaggcagctgcatctgcaccgagctccctcctggaccagccgtgcctctgccccgcaccctctgtccgcaccgctgttgccctgacaacgccggatatcacattggttctgccccctgacgtcatccaacaggaagcgtcagccctgagggaggagacagaagcctgggccaggccacacgagtccctggcccgggaggaggccctcactgcacttgggaagctcctgtacctcttagatgggatgctggatgggcaggtgaacagtggtatagcagccactccagcctctgctgcagcagccaccctggatgtggctgttcggagaggcctgtcccacggagcccagaggctgctgtgcgtggccctgggacagctggaccggcctccagacctcgcccatgacgggaggagtctgtggctgaacatcaggggcaaggaggcggctgccctatccatgttccatgtctccacgccactgccagtgatgaccggtggtttcctgagctgcatcttgggcttggtgctgcccctggcctatggcttccagcctgacctggtgctggtggcgctggggcctggccatggcctgcagggcccccacgctgcactcctggctgcaatgcttcgggggctggcagggggccgagtcctggccctcctggaggagaactccacaccccagctagcagggatcctggcccgggtgctgaatggagaggcacctcctagcctaggcccttcctctgtggcctccccagaggacgtccaggccctgatgtacctgagagggcagctggagcctcagtggaagatgttgcagtgccatcctcacctggtggcttgaaatcggccaaggtgggagcatttacaccgcagaaatgacaccgcacgccagcgccccgcggccgcgatccggaccccaagcccacggctccctcgactctggggcacggaaccccgcccactcccaatccccgcgccccgccctctcccacccgtgcttcccccgctccacccctcacctcacctcgcccccgccccacccatcgcgccccggcccgtcccatcgaggcccatgcaacccacgctcggtcccgttccggcccctgcgccccgctgcgcttcgctccccgcccttgcgccgttagtaaacatcgctcaaacg

SEQ ID NO: 296127 - DNA, 2576 bp, Homo sapiens
gcgcagctccgagggctggcggctcggggcgccgaggcttccgcgcccgctggttcctcgctccggggcggagctcgcgatagcgaccgggagcagggcgcggggcgggacccaggtccgaggcgaggaagccggaagccaggcgcggggagcctcccccttcgactgcagcctcgctccgtgccttctgcgcgcctgggatcccggagcctgcctaggttctgtgcgctcccgcccaggccggtgcccgccgcccgcctgcgccccaggcaggtcccaggcctccggctgctcccggccgaagccccgagtgcgagatcgagcgtcctgagcgcctgaccgcagccctggatcgcctgcggcagcgcggcctggaacagaggtgtctgcggttgtcagcccgcgaggcctcggaagaggagctgggcctggtgcacagcccagagtatgtatccctggtcagggagacccaggtcctaggcaaggaggagctgcaggcgctgtccggacagttcgacgccatctacttccacccgagtacctttcactgcgcgcggctggccgcaggggctggactgcagctggtggacgctgtgctcactggagctgtgcaaaatgggcttgccctggtgaggcctcccgggcaccatggccagagggcggctgccaacgggttctgcgtgttcaacaacgtggccatagcagctgcacatgccaagcagaaacacgggctacacaggatcctcgtcgtggactgggatgtgcaccatggccaggggatccagtatctctttgaggatgaccccagcgtcctttacttctcctggcaccgctatgagcatgggcgcttctggcctttcctgcgagagtcagatgcagacgcagtggggcggggacagggcctcggcttcactgtcaacctgccctggaaccaggttgggatgggaaacgctgactacgtggctgccttcctgcacctgctgctcccactggcctttgagtttgaccctgagctggtgctggtctcggcaggatttgactcagccatcggggaccctgaggggcaaatgcaggccacgccagagtgcttcgcccacctcacacagctgctgcaggtgctggccggcggccgggtctgtgccgtgctggagggcggctaccacctggagtcactggcggagtcagtgtgcatgacagtacagacgctgctgggtgacccggccccacccctgtcagggccaatggcgccatgtcagagtgccctagagtccatccagagtgcccgtgctgcccaggccccgcactggaagagcctccagcagcaagatgtgaccgctgtgccgatgagccccagcagccactccccagaggggaggcctccacctctgctgcctgggggtccagtgtgtaaggcagctgcatctgcaccgagctccctcctggaccagccgtgcctctgccccgcaccctctgtccgcaccgctgttgccctgacaacgccggatatcacattggttctgccccctgacgtcatccaacaggaagcgtcagccctgagggaggagacagaagcctgggccaggccacacgagtccctggcccgggaggaggccctcactgcacttgggaagctcctgtacctcttagatgggatgctggatgggcaggtgaacagtggtatagcagccactccagcctctgctgcagcagccaccctggatgtggctgttcggagaggcctgtcccacggagcccagaggctgctgtgcgtggccctgggacagctggaccggcctccagacctcgcccatgacgggaggagtctgtggctgaacatcaggggcaaggaggcggctgccctatccatgttccatgtctccacgccactgccagtgatgaccggtggtttcctgagctgcatcttgggcttggtgctgcccctggcctatggcttccagcctgacctggtgctggtggcgctggggcctggccatggcctgcagggcccccacgctgcactcctggctgcaatgcttcgggggctggcagggggccgagtcctggccctcctggaggagaactccacaccccagctagcagggatcctggcccgggtgctgaatggagaggcacctcctagcctaggcccttcctctgtggcctccccagaggacgtccaggccctgatgtacctgagagggcagctggagcctcagtggaagatgttgcagtgccatcctcacctggtggcttgaaatcggccaaggtgggagcatttacaccgcagaaatgacaccgcacgccagcgccccgcggccgcgatccggaccccaagcccacggctccctcgactctggggcacggaaccccgcccactcccaatccccgcgccccgccctctcccacccgtgcttcccccgctccacccctcacctcacctcgcccccgccccacccatcgcgccccggcccgtcccatcgaggcccatgcaacccacgctcggtcccgttccggcccctgcgccccgctgcgcttcgctccccgcccttgcgccgttagtaaacatcgctcaaacg

SEQ ID NO: 296128 - DNA, 2607 bp, Homo sapiens
gcgcagctccgagggctggcggctcggggcgccgaggcttccgcgcccgctggttcctcgctccggggcggagctcgcgatagcgaccgggagcagggcgcggggcgggacccaggtccgaggcgaggaagccggaagccaggcgcggggagcctcccccttcgactgcagcctcgctccgtgccttctgcgcgcctgggatcccggagcctgcctaggttctgtgcgctcccgcccaggccggtgcccgccgcccgcctgcgccccaggcaggtcccaggcctccggctgctcccggccgaaggtggggacaggcagtggcaggcaccactagcgagggcgtttgggaacccagggtgaccacggcgcagccatggggaccgcgcttgtgtaccatgaggacatgacggccacccggctgctctgggacgaccccgagtgcgagatcgagcgtcctgagcgcctgaccgcagccctggatcgcctgcggcagcgcggcctggaacagaggtgtctgcggttgtcagcccgcgaggcctcggaagaggagctgggcctggtgcacagagtacctttcactgcgcgcggctggccgcaggggctggactgcagctggtggacgctgtgctcactggagctgtgcaaaatgggcttgccctggtgaggcctcccgggcaccatggccagagggcggctgccaacgggttctgcgtgttcaacaacgtggccatagcagctgcacatgccaagcagaaacacgggctacacaggatcctcgtcgtggactgggatgtgcaccatggccaggggatccagtatctctttgaggatgaccccagcgtcctttacttctcctggcaccgctatgagcatgggcgcttctggcctttcctgcgagagtcagatgcagacgcagtggggcggggacagggcctcggcttcactgtcaacctgccctggaaccaggttgggatgggaaacgctgactacgtggctgccttcctgcacctgctgctcccactggcctttgagtttgaccctgagctggtgctggtctcggcaggatttgactcagccatcggggaccctgaggggcaaatgcaggccacgccagagtgcttcgcccacctcacacagctgctgcaggtgctggccggcggccgggtctgtgccgtgctggagggcggctaccacctggagtcactggcggagtcagtgtgcatgacagtacagacgctgctgggtgacccggccccacccctgtcagggccaatggcgccatgtcagagtgccctagagtccatccagagtgcccgtgctgcccaggccccgcactggaagagcctccagcagcaagatgtgaccgctgtgccgatgagccccagcagccactccccagaggggaggcctccacctctgctgcctgggggtccagtgtgtaaggcagctgcatctgcaccgagctccctcctggaccagccgtgcctctgccccgcaccctctgtccgcaccgctgttgccctgacaacgccggatatcacattggttctgccccctgacgtcatccaacaggaagcgtcagccctgagggaggagacagaagcctgggccaggccacacgagtccctggcccgggaggaggccctcactgcacttgggaagctcctgtacctcttagatgggatgctggatgggcaggtgaacagtggtatagcagccactccagcctctgctgcagcagccaccctggatgtggctgttcggagaggcctgtcccacggagcccagaggctgctgtgcgtggccctgggacagctggaccggcctccagacctcgcccatgacgggaggagtctgtggctgaacatcaggggcaaggaggcggctgccctatccatgttccatgtctccacgccactgccagtgatgaccggtggtttcctgagctgcatcttgggcttggtgctgcccctggcctatggcttccagcctgacctggtgctggtggcgctggggcctggccatggcctgcagggcccccacgctgcactcctggctgcaatgcttcgggggctggcagggggccgagtcctggccctcctggaggagaactccacaccccagctagcagggatcctggcccgggtgctgaatggagaggcacctcctagcctaggcccttcctctgtggcctccccagaggacgtccaggccctgatgtacctgagagggcagctggagcctcagtggaagatgttgcagtgccatcctcacctggtggcttgaaatcggccaaggtgggagcatttacaccgcagaaatgacaccgcacgccagcgccccgcggccgcgatccggaccccaagcccacggctccctcgactctggggcacggaaccccgcccactcccaatccccgcgccccgccctctcccacccgtgcttcccccgctccacccctcacctcacctcgcccccgccccacccatcgcgccccggcccgtcccatcgaggcccatgcaacccacgctcggtcccgttccggcccctgcgccccgctgcgcttcgctccccgcccttgcgccgttagtaaacatcgctcaaacg

SEQ ID NO: 296129 - DNA, 2479 bp, Homo sapiens
gcgcagctccgagggctggcggctcggggcgccgaggcttccgcgcccgctggttcctcgctccggggcggagctcgcgatagcgaccgggagcagggcgcggggcgggacccaggtccgaggcgaggaagccggaagccaggcgcggggagcctcccccttcgactgcagcctcgctccgtgccttctgcgcgcctgggatcccggagcctgcctaggttctgtgcgctcccgcccaggccggtgcccgccgcccgcctgcgccccaggcaggtcccaggcctccggctgctcccggccgaagccccgagtgcgagatcgagcgtcctgagcgcctgaccgcagccctggatcgcctgcggcagcgcggcctggaacagaggtgtctgcggttgtcagcccgcgaggcctcggaagaggagctgggcctggtgcacagagtacctttcactgcgcgcggctggccgcaggggctggactgcagctggtggacgctgtgctcactggagctgtgcaaaatgggcttgccctggtgaggcctcccgggcaccatggccagagggcggctgccaacgggttctgcgtgttcaacaacgtggccatagcagctgcacatgccaagcagaaacacgggctacacaggatcctcgtcgtggactgggatgtgcaccatggccaggggatccagtatctctttgaggatgaccccagcgtcctttacttctcctggcaccgctatgagcatgggcgcttctggcctttcctgcgagagtcagatgcagacgcagtggggcggggacagggcctcggcttcactgtcaacctgccctggaaccaggttgggatgggaaacgctgactacgtggctgccttcctgcacctgctgctcccactggcctttgagtttgaccctgagctggtgctggtctcggcaggatttgactcagccatcggggaccctgaggggcaaatgcaggccacgccagagtgcttcgcccacctcacacagctgctgcaggtgctggccggcggccgggtctgtgccgtgctggagggcggctaccacctggagtcactggcggagtcagtgtgcatgacagtacagacgctgctgggtgacccggccccacccctgtcagggccaatggcgccatgtcagagtgccctagagtccatccagagtgcccgtgctgcccaggccccgcactggaagagcctccagcagcaagatgtgaccgctgtgccgatgagccccagcagccactccccagaggggaggcctccacctctgctgcctgggggtccagtgtgtaaggcagctgcatctgcaccgagctccctcctggaccagccgtgcctctgccccgcaccctctgtccgcaccgctgttgccctgacaacgccggatatcacattggttctgccccctgacgtcatccaacaggaagcgtcagccctgagggaggagacagaagcctgggccaggccacacgagtccctggcccgggaggaggccctcactgcacttgggaagctcctgtacctcttagatgggatgctggatgggcaggtgaacagtggtatagcagccactccagcctctgctgcagcagccaccctggatgtggctgttcggagaggcctgtcccacggagcccagaggctgctgtgcgtggccctgggacagctggaccggcctccagacctcgcccatgacgggaggagtctgtggctgaacatcaggggcaaggaggcggctgccctatccatgttccatgtctccacgccactgccagtgatgaccggtggtttcctgagctgcatcttgggcttggtgctgcccctggcctatggcttccagcctgacctggtgctggtggcgctggggcctggccatggcctgcagggcccccacgctgcactcctggctgcaatgcttcgggggctggcagggggccgagtcctggccctcctggaggagaactccacaccccagctagcagggatcctggcccgggtgctgaatggagaggcacctcctagcctaggcccttcctctgtggcctccccagaggacgtccaggccctgatgtacctgagagggcagctggagcctcagtggaagatgttgcagtgccatcctcacctggtggcttgaaatcggccaaggtgggagcatttacaccgcagaaatgacaccgcacgccagcgccccgcggccgcgatccggaccccaagcccacggctccctcgactctggggcacggaaccccgcccactcccaatccccgcgccccgccctctcccacccgtgcttcccccgctccacccctcacctcacctcgcccccgccccacccatcgcgccccggcccgtcccatcgaggcccatgcaacccacgctcggtcccgttccggcccctgcgccccgctgcgcttcgctccccgcccttgcgccgttagtaaacatcgctcaaacg

SEQ ID NO: 296130 - DNA, 2788 bp, Homo sapiens
gcgcagctccgagggctggcggctcggggcgccgaggcttccgcgcccgctggttcctcgctccggggcggagctcgcgatagcgaccgggagcagggcgcggggcgggacccaggtccgaggcgaggaagccggaagccaggcgcggggagcctcccccttcgactgcagcctcgctccgtgccttctgcgcgcctgggatcccggagcctgcctaggttctgtgcgctcccgcccaggccggtgcccgccgcccgcctgcgccccaggcaggtcccaggcctccggctgctcccggccgaagccccgagtgcgagatcgagcgtcctgagcgcctgaccgcagccctggatcgcctgcggcagcgcggcctggaacagaggtgtctgcggttgtcagcccgcgaggcctcggaagaggagctgggcctggtgcacagcccagagtatgtatccctggtcagggagacccaggtcctaggcaaggaggagctgcaggcgctgtccggacagttcgacgccatctacttccacccgagtacctttcactgcgcgcggctggccgcaggggctggactgcagctggtggacgctgtgctcactggagctgtgcaaaatgggcttgccctggtgaggcctcccgggcaccatggccagagggcggctgccaacgggttctgcgtgttcaacaacgtggccatagcagctgcacatgccaagcagaaacacgggctacacaggatcctcgtcgtggactgggatgtgcaccatggccaggggatccagtatctctttgaggatgaccccagcgtcctttacttctcctggcaccgctatgagcatgggcgcttctggcctttcctgcgagagtcagatgcagacgcagtggggcggggacagggcctcggcttcactgtcaacctgccctggaaccaggttgggatgggaaacgctgactacgtggctgccttcctgcacctgctgctcccactggcctttgaggtgactgcacggagggctcccccagggcagccgggtgggagggggaccttgtgcctggagtgcgccagtgaaggcaggaggagggttatgagctgtcccactcctgtgtggctggggaaggtgctcaggaggggatgggatgggcctggctcgccctcacctgggctccagcccctctctgtcgaccctccccactccggcctggcctgtagtttgaccctgagctggtgctggtctcggcaggatttgactcagccatcggggaccctgaggggcaaatgcaggccacgccagagtgcttcgcccacctcacacagctgctgcaggtgctggccggcggccgggtctgtgccgtgctggagggcggctaccacctggagtcactggcggagtcagtgtgcatgacagtacagacgctgctgggtgacccggccccacccctgtcagggccaatggcgccatgtcagagtgccctagagtccatccagagtgcccgtgctgcccaggccccgcactggaagagcctccagcagcaagatgtgaccgctgtgccgatgagccccagcagccactccccagaggggaggcctccacctctgctgcctgggggtccagtgtgtaaggcagctgcatctgcaccgagctccctcctggaccagccgtgcctctgccccgcaccctctgtccgcaccgctgttgccctgacaacgccggatatcacattggttctgccccctgacgtcatccaacaggaagcgtcagccctgagggaggagacagaagcctgggccaggccacacgagtccctggcccgggaggaggccctcactgcacttgggaagctcctgtacctcttagatgggatgctggatgggcaggtgaacagtggtatagcagccactccagcctctgctgcagcagccaccctggatgtggctgttcggagaggcctgtcccacggagcccagaggctgctgtgcgtggccctgggacagctggaccggcctccagacctcgcccatgacgggaggagtctgtggctgaacatcaggggcaaggaggcggctgccctatccatgttccatgtctccacgccactgccagtgatgaccggtggtttcctgagctgcatcttgggcttggtgctgcccctggcctatggcttccagcctgacctggtgctggtggcgctggggcctggccatggcctgcagggcccccacgctgcactcctggctgcaatgcttcgggggctggcagggggccgagtcctggccctcctggaggagaactccacaccccagctagcagggatcctggcccgggtgctgaatggagaggcacctcctagcctaggcccttcctctgtggcctccccagaggacgtccaggccctgatgtacctgagagggcagctggagcctcagtggaagatgttgcagtgccatcctcacctggtggcttgaaatcggccaaggtgggagcatttacaccgcagaaatgacaccgcacgccagcgccccgcggccgcgatccggaccccaagcccacggctccctcgactctggggcacggaaccccgcccactcccaatccccgcgccccgccctctcccacccgtgcttcccccgctccacccctcacctcacctcgcccccgccccacccatcgcgccccggcccgtcccatcgaggcccatgcaacccacgctcggtcccgttccggcccctgcgccccgctgcgcttcgctccccgcccttgcgccgttagtaaacatcgctcaaacg

SEQ ID NO: 296131 - DNA, 2637 bp, Homo sapiens
gcgcagctccgagggctggcggctcggggcgccgaggcttccgcgcccgctggttcctcgctccggggcggagctcgcgatagcgaccgggagcagggcgcggggcgggacccaggtccgaggcgaggaagccggaagccaggcgcggggagcctcccccttcgactgcagcctcgctccgtgccttctgcgcgcctgggatcccggagcctgcctaggttctgtgcgctcccgcccaggccggtgcccgccgcccgcctgcgccccaggcaggtcccaggcctccggctgctcccggccgaaggtggggacaggcagtggcaggcaccactagcgagggcgtttgggaacccagggtgaccacggcgcagccatggggaccgcgcttgtgtaccatgaggacatgacggccacccggctgctctgggacgaccccgagtgcgagatcgagcgtcctgagcgcctgaccgcagccctggatcgcctgcggcagcgcggcctggaacagaggtgtctgcggttgtcagcccgcgaggcctcggaagaggagctgggcctggtgcacagagtacctttcactgcgcgcggctggccgcaggggctggactgcagctggtggacgctgtgctcactggagctgtgcaaaatgggcttgccctggtgaggcctcccgggcaccatggccagagggcggctgccaacgggttctgcgtgttcaacaacgtggccatagcagctgcacatgccaagcagaaacacgggctacacaggatcctcgtcgtggactgggatgtgcaccatggccaggggatccagtatctctttgaggatgaccccagcgtcctttacttctcctggcaccgctatgagcatgggcgcttctggcctttcctgcgagagtcagatgcagacgcagtggggcggggacagggcctcggcttcactgtcaacctgccctggaaccagttcaggatgtagcctgggatgtcctgccaggttgggatgggaaacgctgactacgtggctgccttcctgcacctgctgctcccactggcctttgagtttgaccctgagctggtgctggtctcggcaggatttgactcagccatcggggaccctgaggggcaaatgcaggccacgccagagtgcttcgcccacctcacacagctgctgcaggtgctggccggcggccgggtctgtgccgtgctggagggcggctaccacctggagtcactggcggagtcagtgtgcatgacagtacagacgctgctgggtgacccggccccacccctgtcagggccaatggcgccatgtcagagtgccctagagtccatccagagtgcccgtgctgcccaggccccgcactggaagagcctccagcagcaagatgtgaccgctgtgccgatgagccccagcagccactccccagaggggaggcctccacctctgctgcctgggggtccagtgtgtaaggcagctgcatctgcaccgagctccctcctggaccagccgtgcctctgccccgcaccctctgtccgcaccgctgttgccctgacaacgccggatatcacattggttctgccccctgacgtcatccaacaggaagcgtcagccctgagggaggagacagaagcctgggccaggccacacgagtccctggcccgggaggaggccctcactgcacttgggaagctcctgtacctcttagatgggatgctggatgggcaggtgaacagtggtatagcagccactccagcctctgctgcagcagccaccctggatgtggctgttcggagaggcctgtcccacggagcccagaggctgctgtgcgtggccctgggacagctggaccggcctccagacctcgcccatgacgggaggagtctgtggctgaacatcaggggcaaggaggcggctgccctatccatgttccatgtctccacgccactgccagtgatgaccggtggtttcctgagctgcatcttgggcttggtgctgcccctggcctatggcttccagcctgacctggtgctggtggcgctggggcctggccatggcctgcagggcccccacgctgcactcctggctgcaatgcttcgggggctggcagggggccgagtcctggccctcctggaggagaactccacaccccagctagcagggatcctggcccgggtgctgaatggagaggcacctcctagcctaggcccttcctctgtggcctccccagaggacgtccaggccctgatgtacctgagagggcagctggagcctcagtggaagatgttgcagtgccatcctcacctggtggcttgaaatcggccaaggtgggagcatttacaccgcagaaatgacaccgcacgccagcgccccgcggccgcgatccggaccccaagcccacggctccctcgactctggggcacggaaccccgcccactcccaatccccgcgccccgccctctcccacccgtgcttcccccgctccacccctcacctcacctcgcccccgccccacccatcgcgccccggcccgtcccatcgaggcccatgcaacccacgctcggtcccgttccggcccctgcgccccgctgcgcttcgctccccgcccttgcgccgttagtaaacatcgctcaaacg

SEQ ID NO: 296132 - DNA, 2606 bp, Homo sapiens
gcgcagctccgagggctggcggctcggggcgccgaggcttccgcgcccgctggttcctcgctccggggcggagctcgcgatagcgaccgggagcagggcgcggggcgggacccaggtccgaggcgaggaagccggaagccaggcgcggggagcctcccccttcgactgcagcctcgctccgtgccttctgcgcgcctgggatcccggagcctgcctaggttctgtgcgctcccgcccaggccggtgcccgccgcccgcctgcgccccaggcaggtcccaggcctccggctgctcccggccgaaggtggggacaggcagtggcaggcaccactagcgagggcgtttgggaacccagggtgaccacggcgcagccatggggaccgcgcttgtgtaccatgaggacatgacggccacccggctgctctgggacgaccccgagtgcgagatcgagcgtcctgagcgcctgaccgcagccctggatcgcctgcggcagcgcggcctggaacagaggtgtctgcggttgtcagcccgcgaggcctcggaagaggagctgggcctggtgcacagcccagagtatgtatccctggtcagggagacccaggtcctaggcaaggaggagctgcaggcgctgtccggacagttcgacgccatctacttccacccggcctcccgggcaccatggccagagggcggctgccaacgggttctgcgtgttcaacaacgtggccatagcagctgcacatgccaagcagaaacacgggctacacaggatcctcgtcgtggactgggatgtgcaccatggccaggggatccagtatctctttgaggatgaccccagcgtcctttacttctcctggcaccgctatgagcatgggcgcttctggcctttcctgcgagagtcagatgcagacgcagtggggcggggacagggcctcggcttcactgtcaacctgccctggaaccaggttgggatgggaaacgctgactacgtggctgccttcctgcacctgctgctcccactggcctttgagtttgaccctgagctggtgctggtctcggcaggatttgactcagccatcggggaccctgaggggcaaatgcaggccacgccagagtgcttcgcccacctcacacagctgctgcaggtgctggccggcggccgggtctgtgccgtgctggagggcggctaccacctggagtcactggcggagtcagtgtgcatgacagtacagacgctgctgggtgacccggccccacccctgtcagggccaatggcgccatgtcagagtgccctagagtccatccagagtgcccgtgctgcccaggccccgcactggaagagcctccagcagcaagatgtgaccgctgtgccgatgagccccagcagccactccccagaggggaggcctccacctctgctgcctgggggtccagtgtgtaaggcagctgcatctgcaccgagctccctcctggaccagccgtgcctctgccccgcaccctctgtccgcaccgctgttgccctgacaacgccggatatcacattggttctgccccctgacgtcatccaacaggaagcgtcagccctgagggaggagacagaagcctgggccaggccacacgagtccctggcccgggaggaggccctcactgcacttgggaagctcctgtacctcttagatgggatgctggatgggcaggtgaacagtggtatagcagccactccagcctctgctgcagcagccaccctggatgtggctgttcggagaggcctgtcccacggagcccagaggctgctgtgcgtggccctgggacagctggaccggcctccagacctcgcccatgacgggaggagtctgtggctgaacatcaggggcaaggaggcggctgccctatccatgttccatgtctccacgccactgccagtgatgaccggtggtttcctgagctgcatcttgggcttggtgctgcccctggcctatggcttccagcctgacctggtgctggtggcgctggggcctggccatggcctgcagggcccccacgctgcactcctggctgcaatgcttcgggggctggcagggggccgagtcctggccctcctggaggagaactccacaccccagctagcagggatcctggcccgggtgctgaatggagaggcacctcctagcctaggcccttcctctgtggcctccccagaggacgtccaggccctgatgtacctgagagggcagctggagcctcagtggaagatgttgcagtgccatcctcacctggtggcttgaaatcggccaaggtgggagcatttacaccgcagaaatgacaccgcacgccagcgccccgcggccgcgatccggaccccaagcccacggctccctcgactctggggcacggaaccccgcccactcccaatccccgcgccccgccctctcccacccgtgcttcccccgctccacccctcacctcacctcgcccccgccccacccatcgcgccccggcccgtcccatcgaggcccatgcaacccacgctcggtcccgttccggcccctgcgccccgctgcgcttcgctccccgcccttgcgccgttagtaaacatcgctcaaacg

SEQ ID NO: 296133 - DNA, 2728 bp, Homo sapiens
gcgcagctccgagggctggcggctcggggcgccgaggcttccgcgcccgctggttcctcgctccggggcggagctcgcgatagcgaccgggagcagggcgcggggcgggacccaggtccgaggcgaggaagccggaagccaggcgcggggagcctcccccttcgactgcagcctcgctccgtgccttctgcgcgcctgggatcccggagcctgcctaggttctgtgcgctcccgcccaggccggtgcccgccgcccgcctgcgccccaggcaggtcccaggcctccggctgctcccggccgaagccccgagtgcgagatcgagcgtcctgagcgcctgaccgcagccctggatcgcctgcggcagcgcggcctggaacagaggtgtctgcggttgtcagcccgcgaggcctcggaagaggagctgggcctggtgcacagcccagagtatgtatccctggtcagggagacccaggtcctaggcaaggaggagctgcaggcgctgtccggacagttcgacgccatctacttccacccgagtacctttcactgcgcgcggctggccgcaggggctggactgcagctggtggacgctgtgctcactggagctgtgcaaaatgggcttgccctggtgaggcctcccgggcaccatggccagagggcggctgccaacgggttctgcgtgttcaacaacgtggccatagcagctgcacatgccaagcagaaacacgggctacacaggatcctcgtcgtggactgggatgtgcaccatggccaggggatccagtatctctttgaggatgaccccagcgtcctttacttctcctggcaccgctatgagcatgggcgcttctggcctttcctgcgagagtcagatgcagacgcagtggggcggggacagggcctcggcttcactgtcaacctgccctggaaccaggttgggatgggaaacgctgactacgtggctgccttcctgcacctgctgctcccactggcctttgagtttgaccctgagctggtgctggtctcggcaggatttgactcagccatcggggaccctgaggggcaaatgcaggccacgccagagtgcttcgcccacctcacacagctgctgcaggtgctggccggcggccgggtctgtgccgtgctggagggcggctaccacctggagtcactggcggagtcagtgtgcatgacagtacagacgctgctgggtgacccggccccacccctgtcagggccaatggcgccatgtcagaggtgcgaggggaggtagggcgggcagggccggggtgtgagaccaggtgtcacgactgttgtgtctccctcacagtgccctagagtccatccagagtgcccgtgctgcccaggccccgcactggaagagcctccagcagcaaggtcagtgtggccgggtgctaggctgcaggatcccacctcgggctcctgtgcagtggctatgactccgaactgtccctagatgtgaccgctgtgccgatgagccccagcagccactccccagaggggaggcctccacctctgctgcctgggggtccagtgtgtaaggcagctgcatctgcaccgagctccctcctggaccagccgtgcctctgccccgcaccctctgtccgcaccgctgttgccctgacaacgccggatatcacattggttctgccccctgacgtcatccaacaggaagcgtcagccctgagggaggagacagaagcctgggccaggccacacgagtccctggcccgggaggaggccctcactgcacttgggaagctcctgtacctcttagatgggatgctggatgggcaggtgaacagtggtatagcagccactccagcctctgctgcagcagccaccctggatgtggctgttcggagaggcctgtcccacggagcccagaggctgctgtgcgtggccctgggacagctggaccggcctccagacctcgcccatgacgggaggagtctgtggctgaacatcaggggcaaggaggcggctgccctatccatgttccatgtctccacgccactgccagtgatgaccggtggtttcctgagctgcatcttgggcttggtgctgcccctggcctatggcttccagcctgacctggtgctggtggcgctggggcctggccatggcctgcagggcccccacgctgcactcctggctgcaatgcttcgggggctggcagggggccgagtcctggccctcctggaggagaactccacaccccagctagcagggatcctggcccgggtgctgaatggagaggcacctcctagcctaggcccttcctctgtggcctccccagaggacgtccaggccctgatgtacctgagagggcagctggagcctcagtggaagatgttgcagtgccatcctcacctggtggcttgaaatcggccaaggtgggagcatttacaccgcagaaatgacaccgcacgccagcgccccgcggccgcgatccggaccccaagcccacggctccctcgactctggggcacggaaccccgcccactcccaatccccgcgccccgccctctcccacccgtgcttcccccgctccacccctcacctcacctcgcccccgccccacccatcgcgccccggcccgtcccatcgaggcccatgcaacccacgctcggtcccgttccggcccctgcgccccgctgcgcttcgctccccgcccttgcgccgttagtaaacatcgctcaaacg

SEQ ID NO: 296134 - DNA, 2353 bp, Homo sapiens
gcgcagctccgagggctggcggctcggggcgccgaggcttccgcgcccgctggttcctcgctccggggcggagctcgcgatagcgaccgggagcagggcgcggggcgggacccaggtccgaggcgaggaagccggaagccaggcgcggggagcctcccccttcgactgcagcctcgctccgtgccttctgcgcgcctgggatcccggagcctgcctaggttctgtgcgctcccgcccaggccggtgcccgccgcccgcctgcgccccaggcaggtcccaggcctccggctgctcccggccgaagccccgagtgcgagatcgagcgtcctgagcgcctgaccgcagccctggatcgcctgcggcagcgcggcctggaacagaggtgtctgcggttgtcagcccgcgaggcctcggaagaggagctgggcctggtgcacagagtacctttcactgcgcgcggctggccgcaggggctggactgcagctggtggacgctgtgctcactggagctgtgcaaaatgggcttgccctggtgaggcctcccgggcaccatggccagagggcggctgccaacgggttctgcgtgttcaacaacgtggccatagcagctgcacatgccaagcagaaacacgggctacacaggatcctcgtcgtggactgggatgtgcaccatggccaggggatccagtatctctttgaggatgaccccagcgtcctttacttctcctggcaccgctatgagcatgggcgcttctggcctttcctgcgagagtcagatgcagacgcagtggggcggggacagggcctcggcttcactgtcaacctgccctggaaccaggggcaaatgcaggccacgccagagtgcttcgcccacctcacacagctgctgcaggtgctggccggcggccgggtctgtgccgtgctggagggcggctaccacctggagtcactggcggagtcagtgtgcatgacagtacagacgctgctgggtgacccggccccacccctgtcagggccaatggcgccatgtcagagtgccctagagtccatccagagtgcccgtgctgcccaggccccgcactggaagagcctccagcagcaagatgtgaccgctgtgccgatgagccccagcagccactccccagaggggaggcctccacctctgctgcctgggggtccagtgtgtaaggcagctgcatctgcaccgagctccctcctggaccagccgtgcctctgccccgcaccctctgtccgcaccgctgttgccctgacaacgccggatatcacattggttctgccccctgacgtcatccaacaggaagcgtcagccctgagggaggagacagaagcctgggccaggccacacgagtccctggcccgggaggaggccctcactgcacttgggaagctcctgtacctcttagatgggatgctggatgggcaggtgaacagtggtatagcagccactccagcctctgctgcagcagccaccctggatgtggctgttcggagaggcctgtcccacggagcccagaggctgctgtgcgtggccctgggacagctggaccggcctccagacctcgcccatgacgggaggagtctgtggctgaacatcaggggcaaggaggcggctgccctatccatgttccatgtctccacgccactgccagtgatgaccggtggtttcctgagctgcatcttgggcttggtgctgcccctggcctatggcttccagcctgacctggtgctggtggcgctggggcctggccatggcctgcagggcccccacgctgcactcctggctgcaatgcttcgggggctggcagggggccgagtcctggccctcctggaggagaactccacaccccagctagcagggatcctggcccgggtgctgaatggagaggcacctcctagcctaggcccttcctctgtggcctccccagaggacgtccaggccctgatgtacctgagagggcagctggagcctcagtggaagatgttgcagtgccatcctcacctggtggcttgaaatcggccaaggtgggagcatttacaccgcagaaatgacaccgcacgccagcgccccgcggccgcgatccggaccccaagcccacggctccctcgactctggggcacggaaccccgcccactcccaatccccgcgccccgccctctcccacccgtgcttcccccgctccacccctcacctcacctcgcccccgccccacccatcgcgccccggcccgtcccatcgaggcccatgcaacccacgctcggtcccgttccggcccctgcgccccgctgcgcttcgctccccgcccttgcgccgttagtaaacatcgctcaaacg

SEQ ID NO: 296135 - DNA, 2382 bp, Homo sapiens
gcgcagctccgagggctggcggctcggggcgccgaggcttccgcgcccgctggttcctcgctccggggcggagctcgcgatagcgaccgggagcagggcgcggggcgggacccaggtccgaggcgaggaagccggaagccaggcgcggggagcctcccccttcgactgcagcctcgctccgtgccttctgcgcgcctgggatcccggagcctgcctaggttctgtgcgctcccgcccaggccggtgcccgccgcccgcctgcgccccaggcaggtcccaggcctccggctgctcccggccgaagccccgagtgcgagatcgagcgtcctgagcgcctgaccgcagccctggatcgcctgcggcagcgcggcctggaacagaggtgtctgcggttgtcagcccgcgaggcctcggaagaggagctgggcctggtgcacagagtacctttcactgcgcgcggctggccgcaggggctggactgcagctggtggacgctgtgctcactggagctgtgcaaaatgggcttgccctggtgaggcctcccgggcaccatggccagagggcggctgccaacgggttctgcgtgttcaacaacgtggccatagcagctgcacatgccaagcagaaacacgggctacacaggatcctcgtcgtggactgggatgtgcaccatggccaggggatccagtatctctttgaggatgaccccagcgtcctttacttctcctggcaccgctatgagcatgggcgcttctggcctttcctgcgagagtcagatgcagacgcagtggggcggggacagggcctcggcttcactgtcaacctgccctggaaccaggatttgactcagccatcggggaccctgaggggcaaatgcaggccacgccagagtgcttcgcccacctcacacagctgctgcaggtgctggccggcggccgggtctgtgccgtgctggagggcggctaccacctggagtcactggcggagtcagtgtgcatgacagtacagacgctgctgggtgacccggccccacccctgtcagggccaatggcgccatgtcagagtgccctagagtccatccagagtgcccgtgctgcccaggccccgcactggaagagcctccagcagcaagatgtgaccgctgtgccgatgagccccagcagccactccccagaggggaggcctccacctctgctgcctgggggtccagtgtgtaaggcagctgcatctgcaccgagctccctcctggaccagccgtgcctctgccccgcaccctctgtccgcaccgctgttgccctgacaacgccggatatcacattggttctgccccctgacgtcatccaacaggaagcgtcagccctgagggaggagacagaagcctgggccaggccacacgagtccctggcccgggaggaggccctcactgcacttgggaagctcctgtacctcttagatgggatgctggatgggcaggtgaacagtggtatagcagccactccagcctctgctgcagcagccaccctggatgtggctgttcggagaggcctgtcccacggagcccagaggctgctgtgcgtggccctgggacagctggaccggcctccagacctcgcccatgacgggaggagtctgtggctgaacatcaggggcaaggaggcggctgccctatccatgttccatgtctccacgccactgccagtgatgaccggtggtttcctgagctgcatcttgggcttggtgctgcccctggcctatggcttccagcctgacctggtgctggtggcgctggggcctggccatggcctgcagggcccccacgctgcactcctggctgcaatgcttcgggggctggcagggggccgagtcctggccctcctggaggagaactccacaccccagctagcagggatcctggcccgggtgctgaatggagaggcacctcctagcctaggcccttcctctgtggcctccccagaggacgtccaggccctgatgtacctgagagggcagctggagcctcagtggaagatgttgcagtgccatcctcacctggtggcttgaaatcggccaaggtgggagcatttacaccgcagaaatgacaccgcacgccagcgccccgcggccgcgatccggaccccaagcccacggctccctcgactctggggcacggaaccccgcccactcccaatccccgcgccccgccctctcccacccgtgcttcccccgctccacccctcacctcacctcgcccccgccccacccatcgcgccccggcccgtcccatcgaggcccatgcaacccacgctcggtcccgttccggcccctgcgccccgctgcgcttcgctccccgcccttgcgccgttagtaaacatcgctcaaacg

SEQ ID NO: 296136 - DNA, 2594 bp, Homo sapiens
gcgcagctccgagggctggcggctcggggcgccgaggcttccgcgcccgctggttcctcgctccggggcggagctcgcgatagcgaccgggagcagggcgcggggcgggacccaggtccgaggcgaggaagccggaagccaggcgcggggagcctcccccttcgactgcagcctcgctccgtgccttctgcgcgcctgggatcccggagcctgcctaggttctgtgcgctcccgcccaggccggtgcccgccgcccgcctgcgccccaggcaggtcccaggcctccggctgctcccggccgaagccccgagtgcgagatcgagcgtcctgagcgcctgaccgcagccctggatcgcctgcggcagcgcggcctggaacagaggtgtctgcggttgtcagcccgcgaggcctcggaagaggagctgggcctggtgcacagagtacctttcactgcgcgcggctggccgcaggggctggactgcagctggtggacgctgtgctcactggagctgtgcaaaatgggcttgccctggtgaggcctcccgggcaccatggccagagggcggctgccaacgggttctgcgtgttcaacaacgtggccatagcagctgcacatgccaagcagaaacacgggctacacaggatcctcgtcgtggactgggatgtgcaccatggccaggggatccagtatctctttgaggatgaccccagttcaggatgtagcctgggatgtcctgccaggttgggatgggaaacgctgactacgtggctgccttcctgcacctgctgctcccactggcctttgaggtgactgcacggagggctcccccagggcagccgggtgggagggggaccttgtgcctggagtgcgccagtgaaggcaggaggagggttatgagctgtcccactcctgtgtggctggggaaggtgctcaggaggggatgggatgggcctggctcgccctcacctgggctccagcccctctctgtcgaccctccccactccggcctggcctgtagtttgaccctgagctggtgctggtctcggcaggatttgactcagccatcggggaccctgaggggcaaatgcaggccacgccagagtgcttcgcccacctcacacagctgctgcaggtgctggccggcggccgggtctgtgccgtgctggagggcggctaccacctggagtcactggcggagtcagtgtgcatgacagtacagacgctgctgggtgacccggccccacccctgtcagggccaatggcgccatgtcagagtgccctagagtccatccagagtgcccgtgctgcccaggccccgcactggaagagcctccagcagcaagatgtgaccgctgtgccgatgagccccagcagccactccccagaggggaggcctccacctctgctgcctgggggtccagtgtgtaaggcagctgcatctgcaccgagctccctcctggaccagccgtgcctctgccccgcaccctctgtccgcaccgctgttgccctgacaacgccggatatcacattggttctgccccctgacgtcatccaacaggaagcgtcagccctgagggaggagacagaagcctgggccaggccacacgagtccctggcccgggaggaggccctcactgcacttgggaagctcctgtacctcttagatgggatgctggatgggcaggtgaacagtggtatagcagccactccagcctctgctgcagcagccaccctggatgtggctgttcggagaggcctgtcccacggagcccagaggctgctgtgcgtggccctgggacagctggaccggcctccagacctcgcccatgacgggaggagtctgtggctgaacatcaggggcaaggaggcggctgccctatccatgttccatgtctccacgccactgccagtgatgaccggtggtttcctgagctgcatcttgggcttggtgctgcccctggcctatggcttccagcctgacctggtgctggtggcgctggggcctggccatggcctgcagggcccccacgctgcactcctggctgcaatgcttcgggggctggcagggggccgagtcctggccctcctggaggagaactccacaccccagctagcagggatcctggcccgggtgctgaatggagaggcacctcctagcctaggcccttcctctgtggcctccccagaggacgtccaggccctgatgtacctgagagggcagctggagcctcagtggaagatgttgcagtgccatcctcacctggtggcttgaaatcggccaaggtgggagcatttacaccgcagaaatgacaccgcacgccagcgccccgcggccgcgatccggaccccaagcccacggctccctcgactctggggcacggaaccccgcccactcccaatccccgcgccccgccctctcccacccgtgcttcccccgctccacccctcacctcacctcgcccccgccccacccatcgcgccccggcccgtcccatcgaggcccatgcaacccacgctcggtcccgttccggcccctgcgccccgctgcgcttcgctccccgcccttgcgccgttagtaaacatcgctcaaacg

SEQ ID NO: 296137 - DNA, 2922 bp, Homo sapiens
gcgcagctccgagggctggcggctcggggcgccgaggcttccgcgcccgctggttcctcgctccggggcggagctcgcgatagcgaccgggagcagggcgcggggcgggacccaggtccgaggcgaggaagccggaagccaggcgcggggagcctcccccttcgactgcagcctcgctccgtgccttctgcgcgcctgggatcccggagcctgcctaggttctgtgcgctcccgcccaggccggtgcccgccgcccgcctgcgccccaggcaggtcccaggcctccggctgctcccggccgaaggtggggacaggcagtggcaggcaccactagcgagggcgtttgggaacccagggtgaccacggcgcagccatggggaccgcgcttgtgtaccatgaggacatgacggccacccggctgctctgggacgaccccgagtgcgagatcgagcgtcctgagcgcctgaccgcagccctggatcgcctgcggcagcgcggcctggaacagaggtgtctgcggttgtcagcccgcgaggcctcggaagaggagctgggcctggtgcacagagtacctttcactgcgcgcggctggccgcaggggctggactgcagctggtggacgctgtgctcactggagctgtgcaaaatgggcttgccctggtgaggcctcccgggcaccatggccagagggcggctgccaacgggttctgcgtgttcaacaacgtggccatagcagctgcacatgccaagcagaaacacgggctacacaggatcctcgtcgtggactgggatgtgcaccatggccaggggatccagtatctctttgaggatgaccccagcgtcctttacttctcctggcaccgctatgagcatgggcgcttctggcctttcctgcgagagtcagatgcagacgcagtggggcggggacagggcctcggcttcactgtcaacctgccctggaaccagttcaggatgtagcctgggatgtcctgccaggttgggatgggaaacgctgactacgtggctgccttcctgcacctgctgctcccactggcctttgaggtgactgcacggagggctcccccagggcagccgggtgggagggggaccttgtgcctggagtgcgccagtgaaggcaggaggagggttatgagctgtcccactcctgtgtggctggggaaggtgctcaggaggggatgggatgggcctggctcgccctcacctgggctccagcccctctctgtcgaccctccccactccggcctggcctgtagtttgaccctgagctggtgctggtctcggcaggatttgactcagccatcggggaccctgaggggcaaatgcaggccacgccagagtgcttcgcccacctcacacagctgctgcaggtgctggccggcggccgggtctgtgccgtgctggagggcggctaccacctggagtcactggcggagtcagtgtgcatgacagtacagacgctgctgggtgacccggccccacccctgtcagggccaatggcgccatgtcagaggtgcgaggggaggtagggcgggcagggccggggtgtgagaccaggtgtcacgactgttgtgtctccctcacagtgccctagagtccatccagagtgcccgtgctgcccaggccccgcactggaagagcctccagcagcaagatgtgaccgctgtgccgatgagccccagcagccactccccagaggggaggcctccacctctgctgcctgggggtccagtgtgtaaggcagctgcatctgcaccgagctccctcctggaccagccgtgcctctgccccgcaccctctgtccgcaccgctgttgccctgacaacgccggatatcacattggttctgccccctgacgtcatccaacaggaagcgtcagccctgagggaggagacagaagcctgggccaggccacacgagtccctggcccgggaggaggccctcactgcacttgggaagctcctgtacctcttagatgggatgctggatgggcaggtgaacagtggtatagcagccactccagcctctgctgcagcagccaccctggatgtggctgttcggagaggcctgtcccacggagcccagaggctgctgtgcgtggccctgggacagctggaccggcctccagacctcgcccatgacgggaggagtctgtggctgaacatcaggggcaaggaggcggctgccctatccatgttccatgtctccacgccactgccagtgatgaccggtggtttcctgagctgcatcttgggcttggtgctgcccctggcctatggcttccagcctgacctggtgctggtggcgctggggcctggccatggcctgcagggcccccacgctgcactcctggctgcaatgcttcgggggctggcagggggccgagtcctggccctcctggaggagaactccacaccccagctagcagggatcctggcccgggtgctgaatggagaggcacctcctagcctaggcccttcctctgtggcctccccagaggacgtccaggccctgatgtacctgagagggcagctggagcctcagtggaagatgttgcagtgccatcctcacctggtggcttgaaatcggccaaggtgggagcatttacaccgcagaaatgacaccgcacgccagcgccccgcggccgcgatccggaccccaagcccacggctccctcgactctggggcacggaaccccgcccactcccaatccccgcgccccgccctctcccacccgtgcttcccccgctccacccctcacctcacctcgcccccgccccacccatcgcgccccggcccgtcccatcgaggcccatgcaacccacgctcggtcccgttccggcccctgcgccccgctgcgcttcgctccccgcccttgcgccgttagtaaacatcgctcaaacg

SEQ ID NO: 296138 - DNA, 1636 bp, Homo sapiens
gcgcagctccgagggctggcggctcggggcgccgaggcttccgcgcccgctggttcctcgctccggggcggagctcgcgatagcgaccgggagcagggcgcggggcgggacccaggtccgaggcgaggaagccggaagccaggcgcggggagcctcccccttcgactgcagcctcgctccgtgccttctgcgcgcctgggatcccggagcctgcctaggttctgtgcgctcccgcccaggccggtgcccgccgcccgcctgcgccccaggcaggtcccaggcctccggctgctcccggccgaaggtggggacaggcagtggcaggcaccactagcgagggcgtttgggaacccagggtgaccacggcgcagccatggggaccgcgcttgtgtaccatgaggacatgacggccacccggctgctctgggacgaccccgagtgcgagatcgagcgtcctgagcgcctgaccgcagccctggatcgcctgcggcagcgcggcctggaacagaggtgtctgcggttgtcagcccgcgaggcctcggaagaggagctgggcctggtgcacagcacattggttctgccccctgacgtcatccaacaggaagcgtcagccctgagggaggagacagaagcctgggccaggccacacgagtccctggcccgggaggaggccctcactgcacttgggaagctcctgtacctcttagatgggatgctggatgggcaggtgaacagtggtatagcagccactccagcctctgctgcagcagccaccctggatgtggctgttcggagaggcctgtcccacggagcccagaggctgctgtgcgtggccctgggacagctggaccggcctccagacctcgcccatgacgggaggagtctgtggctgaacatcaggggcaaggaggcggctgccctatccatgttccatgtctccacgccactgccagtgatgaccggtggtttcctgagctgcatcttgggcttggtgctgcccctggcctatggcttccagcctgacctggtgctggtggcgctggggcctggccatggcctgcagggcccccacgctgcactcctggctgcaatgcttcgggggctggcagggggccgagtcctggccctcctggaggagaactccacaccccagctagcagggatcctggcccgggtgctgaatggagaggcacctcctagcctaggcccttcctctgtggcctccccagaggacgtccaggccctgatgtacctgagagggcagctggagcctcagtggaagatgttgcagtgccatcctcacctggtggcttgaaatcggccaaggtgggagcatttacaccgcagaaatgacaccgcacgccagcgccccgcggccgcgatccggaccccaagcccacggctccctcgactctggggcacggaaccccgcccactcccaatccccgcgccccgccctctcccacccgtgcttcccccgctccacccctcacctcacctcgcccccgccccacccatcgcgccccggcccgtcccatcgaggcccatgcaacccacgctcggtcccgttccggcccctgcgccccgctgcgcttcgctccccgcccttgcgccgttagtaaacatcgctcaaacg

SEQ ID NO: 296139 - DNA, 2703 bp, Homo sapiens
gcgcagctccgagggctggcggctcggggcgccgaggcttccgcgcccgctggttcctcgctccggggcggagctcgcgatagcgaccgggagcagggcgcggggcgggacccaggtccgaggcgaggaagccggaagccaggcgcggggagcctcccccttcgactgcagcctcgctccgtgccttctgcgcgcctgggatcccggagcctgcctaggttctgtgcgctcccgcccaggccggtgcccgccgcccgcctgcgccccaggcaggtcccaggcctccggctgctcccggccgaagccccgagtgcgagatcgagcgtcctgagcgcctgaccgcagccctggatcgcctgcggcagcgcggcctggaacagaggtgtctgcggttgtcagcccgcgaggcctcggaagaggagctgggcctggtgcacagcccagagtatgtatccctggtcagggagacccaggtcctaggcaaggaggagctgcaggcgctgtccggacagttcgacgccatctacttccacccgagtacctttcactgcgcgcggctggccgcaggggctggactgcagctggtggacgctgtgctcactggagctgtgcaaaatgggcttgccctggtgaggcctcccgggcaccatggccagagggcggctgccaacgggttctgcgtgttcaacaacgtggccatagcagctgcacatgccaagcagaaacacgggctacacaggatcctcgtcgtggactgggatgtgcaccatggccaggggatccagtatctctttgaggatgaccccagcgtcctttacttctcctggcaccgctatgagcatgggcgcttctggcctttcctgcgagagtcagatgcagacgcagtggggcggggacagggcctcggcttcactgtcaacctgccctggaaccaggttgggatgggaaacgctgactacgtggctgccttcctgcacctgctgctcccactggcctttgaggtgactgcacggagggctcccccagggcagccgggtgggagggggaccttgtgcctggagtgcgccagtgaaggcaggaggagggttatgagctgtcccactcctgtgtggctggggaaggtgctcaggaggggatgggatgggcctggctcgccctcacctgggctccagcccctctctgtcgaccctccccactccggcctggcctgtagtttgaccctgagctggtgctggtctcggcaggatttgactcagccatcggggaccctgaggggcaaatgcaggccacgccagagtgcttcgcccacctcacacagctgctgcaggtgctggccggcggccgggtctgtgccgtgctggagggcggctaccacctggagtcactggcggagtcagtgtgcatgacagtacagacgctgctgggtgacccggccccacccctgtcagggccaatggcgccatgtcagagtgccctagagtccatccagagtgcccgtgctgcccaggccccgcactggaagagcctccagcagcaagatgtgaccgctgtgccgatgagccccagcagccactccccagaggggaggcctccacctctgctgcctgggggtccagtgtgtaaggcagctgcatctgcaccgagctccctcctggaccagccgtgcctctgccccgcaccctctgtccgcaccgctgttgccctgacaacgccggatatcacattggttctgccccctgacgtcatccaacaggaagcgtcagccctgagggaggagacagaagcctgggccaggtgaacagtggtatagcagccactccagcctctgctgcagcagccaccctggatgtggctgttcggagaggcctgtcccacggagcccagaggctgctgtgcgtggccctgggacagctggaccggcctccagacctcgcccatgacgggaggagtctgtggctgaacatcaggggcaaggaggcggctgccctatccatgttccatgtctccacgccactgccagtgatgaccggtggtttcctgagctgcatcttgggcttggtgctgcccctggcctatggcttccagcctgacctggtgctggtggcgctggggcctggccatggcctgcagggcccccacgctgcactcctggctgcaatgcttcgggggctggcagggggccgagtcctggccctcctggaggagaactccacaccccagctagcagggatcctggcccgggtgctgaatggagaggcacctcctagcctaggcccttcctctgtggcctccccagaggacgtccaggccctgatgtacctgagagggcagctggagcctcagtggaagatgttgcagtgccatcctcacctggtggcttgaaatcggccaaggtgggagcatttacaccgcagaaatgacaccgcacgccagcgccccgcggccgcgatccggaccccaagcccacggctccctcgactctggggcacggaaccccgcccactcccaatccccgcgccccgccctctcccacccgtgcttcccccgctccacccctcacctcacctcgcccccgccccacccatcgcgccccggcccgtcccatcgaggcccatgcaacccacgctcggtcccgttccggcccctgcgccccgctgcgcttcgctccccgcccttgcgccgttagtaaacatcgctcaaacg

SEQ ID NO: 296140 - DNA, 2703 bp, Homo sapiens
gcgcagctccgagggctggcggctcggggcgccgaggcttccgcgcccgctggttcctcgctccggggcggagctcgcgatagcgaccgggagcagggcgcggggcgggacccaggtccgaggcgaggaagccggaagccaggcgcggggagcctcccccttcgactgcagcctcgctccgtgccttctgcgcgcctgggatcccggagcctgcctaggttctgtgcgctcccgcccaggccggtgcccgccgcccgcctgcgccccaggcaggtcccaggcctccggctgctcccggccgaagccccgagtgcgagatcgagcgtcctgagcgcctgaccgcagccctggatcgcctgcggcagcgcggcctggaacagaggtgtctgcggttgtcagcccgcgaggcctcggaagaggagctgggcctggtgcacagcccagagtatgtatccctggtcagggagacccaggtcctaggcaaggaggagctgcaggcgctgtccggacagttcgacgccatctacttccacccgagtacctttcactgcgcgcggctggccgcaggggctggactgcagctggtggacgctgtgctcactggagctgtgcaaaatgggcttgccctggtgaggcctcccgggcaccatggccagagggcggctgccaacgggttctgcgtgttcaacaacgtggccatagcagctgcacatgccaagcagaaacacgggctacacaggatcctcgtcgtggactgggatgtgcaccatggccaggggatccagtatctctttgaggatgaccccagcgtcctttacttctcctggcaccgctatgagcatgggcgcttctggcctttcctgcgagagtcagatgcagacgcagtggggcggggacagggcctcggcttcactgtcaacctgccctggaaccaggttgggatgggaaacgctgactacgtggctgccttcctgcacctgctgctcccactggcctttgagtttgaccctgagctggtgctggtctcggcaggatttgactcagccatcggggaccctgaggggcaaatgcaggccacgccagagtgcttcgcccacctcacacagctgctgcaggtgctggccggcggccgggtctgtgccgtgctggagggcggctaccacctggagtcactggcggagtcagtgtgcatgacagtacagacgctgctgggtgacccggccccacccctgtcagggccaatggcgccatgtcagaggtgcgaggggaggtagggcgggcagggccggggtgtgagaccaggtgtcacgactgttgtgtctccctcacagtgccctagagtccatccagagtgcccgtgctgcccaggccccgcactggaagagcctccagcagcaagatgtgaccgctgtgccgatgagccccagcagccactccccagaggggaggcctccacctctgctgcctgggggtccagtgtgtaaggcagctgcatctgcaccgagctccctcctggaccagccgtgcctctgccccgcaccctctgtccgcaccgctgttgccctgacaacgccggatatcacattggttctgccccctgacgtcatccaacaggaagcgtcagccctgagggaggagacagaagcctgggccaggtgaacagtggtatagcagccactccagcctctgctgcagcagccaccctggatgtggctgttcggagaggcctgtcccacggagcccagaggtaagcctcacttggccatcctgagcctctgacggcaggacctgtgggcacccctatcctggctggccaagcacagagagttctgggaatggactctggacaacatgaacacctgtcctgaggccagctcttcttccaggctgctgtgcgtggccctgggacagctggaccggcctccagacctcgcccatgacgggaggagtctgtggctgaacatcaggggcaaggaggcggctgccctatccatgttccatgtctccacgccactgccagtgatgaccggtggtttcctgagctgcatcttgggcttggtgctgcccctggcctatggcttccagcctgacctggtgctggtggcgctggggcctggccatggcctgcagggcccccacgctgcactcctggctgcaatgcttcgggggctggcagggggccgagtcctggccctcctggaggagaactccacaccccagctagcagggatcctggcccgggtgctgaatggagaggcacctcctagcctaggcccttcctctgtggcctccccagaggacgtccaggccctgatgtacctgagagggcagctggagcctcagtggaagatgttgcagtgccatcctcacctggtggcttgaaatcggccaaggtgggagcatttacaccgcagaaatgacaccgcacgccagcgccccgcggccgcgatccggaccccaagcccacggctccctcgactctggggcacggaaccccgcccactcccaatccccgcgccccgccctctcccacccgtgcttcccccgctccacccctcacctcacctcgcccccgccccacccatcgcgccccggcccgtcccatcgaggcccatgcaacccacgctcggtcccgttccggcccctgcgccccgctgcgcttcgctccccgcccttgcgccgttagtaaacatcgctcaaacg

SEQ ID NO: 296141 - DNA, 1073 bp, Homo sapiens
tcgaagaaggtggtgttgattgcggtctgttagtagtatagtgatgccagcagctaggactgggagagataggagaagtaggactgctgtaattaggacggatcagacgaagaggggcgtttggtattgggttatggcagggggttttatattgataattgtgggtgaacagtggtatagcagccactccagcctctgctgcagcagccaccctggatgtggctgttcggagaggcctgtcccacggagcccagaggctgctgtgcgtggccctgggacagctggaccggcctccagacctcgcccatgacgggaggagtctgtggctgaacatcaggggcaaggaggcggctgccctatccatgttccatgtctccacgccactgccagtgatgaccggtggtttcctgagctgcatcttgggcttggtgctgcccctggcctatggcttccagcctgacctggtgctggtggcgctggggcctggccatggcctgcagggcccccacgctgcactcctggctgcaatgcttcgggggctggcagggggccgagtcctggccctcctggaggagaactccacaccccagctagcagggatcctggcccgggtgctgaatggagaggcacctcctagcctaggcccttcctctgtggcctccccagaggacgtccaggccctgatgtacctgagagggcagctggagcctcagtggaagatgttgcagtgccatcctcacctggtggcttgaaatcggccaaggtgggagcatttacaccgcagaaatgacaccgcacgccagcgccccgcggccgcgatccggaccccaagcccacggctccctcgactctggggcacggaaccccgcccactcccaatccccgcgccccgccctctcccacccgtgcttcccccgctccacccctcacctcacctcgcccccgccccacccatcgcgccccggcccgtcccatcgaggcccatgcaacccacgctcggtcccgttccggcccctgcgccccgctgcgcttcgctccccgcccttgcgccgttagtaaacatcgctcaaacg

SEQ ID NO: 296142 - DNA, 2390 bp, Homo sapiens
gcgcagctccgagggctggcggctcggggcgccgaggcttccgcgcccgctggttcctcgctccggggcggagctcgcgatagcgaccgggagcagggcgcggggcgggacccaggtccgaggcgaggaagccggaagccaggcgcggggagcctcccccttcgactgcagcctcgctccgtgccttctgcgcgcctgggatcccggagcctgcctaggttctgtgcgctcccgcccaggccggtgcccgccgcccgcctgcgccccaggcaggtcccaggcctccggctgctcccggccgaagccccgagtgcgagatcgagcgtcctgagcgcctgaccgcagccctggatcgcctgcggcagcgcggcctggaacagaggtgtctgcggttgtcagcccgcgaggcctcggaagaggagctgggcctggtgcacagcccagagtatgtatccctggtcagggagacccaggtcctaggcaaggaggagctgcaggcgctgtccggacagttcgacgccatctacttccacccgagtacctttcactgcgcgcggctggccgcaggggctggactgcagctggtggacgctgtgctcactggagctgtgcaaaatgggcttgccctggtgaggcctcccgggcaccatggccagagggcggctgccaacgggttctgcgtgttcaacaacgtggccatagcagctgcacatgccaagcagaaacacgggctacacaggatcctcgtcgtggactgggatgtgcaccatggccaggggatccagtatctctttgaggatgaccccagcgtcctttacttctcctggcaccgctatgagcatgggcgcttctggcctttcctgcgagagtcagatgcagacgcagtggggcggggacagggcctcggcttcactgtcaacctgccctggaaccaggttgggatgggaaacgctgactacgtggctgccttcctgcacctgctgctcccactggcctttgagtttgaccctgagctggtgctggtctcggcaggatttgactcagccatcggggaccctgaggggcaaatgcaggccacgccagagtgcttcgcccacctcacacagctgctgcaggtgctggccggcggccgggtctgtgccgtgctggagggcggctaccacctggagtcactggcggagtcagtgtgcatgacagtacagacgctgctgggtgacccggccccacccctgtcagggccaatggcgccatgtcagaggtgcgaggggaggtagggcgggcagggccggggtgtgagaccaggtgtcacgactgttgtgtctccctcacagtgccctagagtccatccagagtgcccgtgctgcccaggccccgcactggaagagcctccagcagcaagatgtgaccgctgtgccgatgagccccagcagccactccccagaggggaggcctccacctctgctgcctgggggtccagtgtgtaaggcagctgcatctgcaccgagctccctcctggaccagccgtgcctctgccccgcaccctctgtccgcaccgctgttgccctgacaacgccggatatcacattggttctgccccctgacgtcatccaacaggaagcgtcagccctgagggaggagacagaagcctgggccaggtgggcagggctggcctggggagaaggatggggccgcatctacacctgtgcctgtgtgtgcctgacctgcggtcactccgtgtctgtgtgtccctctggtctgtccaccacaggccacacgagtccctggcccgggaggaggccctcactgcacttgggaagctcctgtacctcttagatgggatgctggatgggcaggtgggagcacctgggaggggttggggatgctgtggacctaggggcagggaccaggacctgccaacgagatgtggcctgtccagaggagggctgggtggtgcagaaccacatggatgtgaacattgccttgtgccaggaactgttcccagaacagccccaggggtggggatcactagtgtgtctgacctctgacctcagcttcttcagttaaatgctctttggcagagaggtgaagggggtgatttaaagtatacatttaggcagggtgcagtggctcatgcctgtaataacggcagtttggggggccaaggtgggagaaacgcttgagcccaggagttcaagaccagcctagagaacatatggagaccctgtcttcacaaaaaataaaaaagtcagccaagcgtggtggtgtgtgcctgtagttacttaggaggctgaggcaggacgatcgcttaagcccaggagtttgaggctgtggtgagctacaattgcgccactgcacgccagcctggctacagaacgagaccctgcctctcc

SEQ ID NO: 296143 - DNA, 2661 bp, Homo sapiens
gcgcagctccgagggctggcggctcggggcgccgaggcttccgcgcccgctggttcctcgctccggggcggagctcgcgatagcgaccgggagcagggcgcggggcgggacccaggtccgaggcgaggaagccggaagccaggcgcggggagcctcccccttcgactgcagcctcgctccgtgccttctgcgcgcctgggatcccggagcctgcctaggttctgtgcgctcccgcccaggccggtgcccgccgcccgcctgcgccccaggcaggtcccaggcctccggctgctcccggccgaagccccgagtgcgagatcgagcgtcctgagcgcctgaccgcagccctggatcgcctgcggcagcgcggcctggaacagaggtgtctgcggttgtcagcccgcgaggcctcggaagaggagctgggcctggtgcacagcccagagtatgtatccctggtcagggagacccaggtcctaggcaaggaggagctgcaggcgctgtccggacagttcgacgccatctacttccacccgagtacctttcactgcgcgcggctggccgcaggggctggactgcagctggtggacgctgtgctcactggagctgtgcaaaatgggcttgccctggtgaggcctcccgggcaccatggccagagggcggctgccaacgggttctgcgtgttcaacaacgtggccatagcagctgcacatgccaagcagaaacacgggctacacaggatcctcgtcgtggactgggatgtgcaccatggccaggggatccagtatctctttgaggatgaccccagcgtcctttacttctcctggcaccgctatgagcatgggcgcttctggcctttcctgcgagagtcagatgcagacgcagtggggcggggacagggcctcggcttcactgtcaacctgccctggaaccaggttgggatgggaaacgctgactacgtggctgccttcctgcacctgctgctcccactggcctttgagtttgaccctgagctggtgctggtctcggcaggatttgactcagccatcggggaccctgaggggcaaatgcaggccacgccagagtgcttcgcccacctcacacagctgctgcaggtgctggccggcggccgggtctgtgccgtgctggagggcggctaccacctggagtcactggcggagtcagtgtgcatgacagtacagacgctgctgggtgacccggccccacccctgtcagggccaatggcgccatgtcagagtgccctagagtccatccagagtgcccgtgctgcccaggccccgcactggaagagcctccagcagcaagatgtgaccgctgtgccgatgagccccagcagccactccccagaggggaggcctccacctctgctgcctgggggtccagtgtgtaaggcagctgcatctgcaccgagctccctcctggaccagccgtgcctctgccccgcaccctctgtccgcaccgctgttgccctgacaacgccggatatcacattggttctgccccctgacgtcatccaacaggaagcgtcagccctgagggaggagacagaagcctgggccaggccacacgagtccctggcccgggaggaggccctcactgcacttgggaagctcctgtacctcttagatgggatgctggatgggcaggtgaacagtggtatagcagccactccagcctctgctgcagcagccaccctggatgtggctgttcggagaggcctgtcccacggagcccagaggctgctgtgcgtggccctgggacagctggaccggcctccagacctcgcccatgacgggaggagtctgtggctgaacatcaggggcaaggaggcggctgccctatccatgttccatgtctccacgccactgccagtgatgaccggtggtttcctgagctgcatcttgggcttggtgctgcccctggcctatggcttccagcctgacctggtgctggtggcgctggggcctggccatggcctgcagggcccccacgctgcactcctggctgcaatgcttcgggggctggcagggggccgagtcctggccctcctggaggaggaggtaagctgggcagggtggaggtgctgcggggtgggacgaggggaaggaccagtgactgcttccgtcttcgcccctggtccagaactccacaccccagctagcagggatcctggcccgggtgctgaatggagaggcacctcctagcctaggcccttcctctgtggcctccccagaggacgtccaggccctgatgtacctgagagggcagctggagcctcagtggaagatgttgcagtgccatcctcacctggtggcttgaaatcggccaaggtgggagcatttacaccgcagaaatgacaccgcacgccagcgccccgcggccgcgatccggaccccaagcccacggctccctcgactctggggcacggaaccccgcccactcccaatccccgcgccccgccctctcccacccgtgcttcccccgctccacccctcacctcacctcgcccccgccccacccatcgcgccccggcccgtcccatcgaggcccatgcaacccacgctcggtcccgttccggcccctgcgccccgctgcgcttcgctccccgcccttgcgccgttagtaaacatcgctcaaacg

SEQ ID NO: 296144 - DNA, 2288 bp, Homo sapiens
gcgcagctccgagggctggcggctcggggcgccgaggcttccgcgcccgctggttcctcgctccggggcggagctcgcgatagcgaccgggagcagggcgcggggcgggacccaggtccgaggcgaggaagccggaagccaggcgcggggagcctcccccttcgactgcagcctcgctccgtgccttctgcgcgcctgggatcccggagcctgcctaggttctgtgcgctcccgcccaggccggtgcccgccgcccgcctgcgccccaggcaggtcccaggcctccggctgctcccggccgaagccccgagtgcgagatcgagcgtcctgagcgcctgaccgcagccctggatcgcctgcggcagcgcggcctggaacagaggtgtctgcggttgtcagcccgcgaggcctcggaagaggagctgggcctggtgcacagcccagagtatgtatccctggtcagggagacccaggtcctaggcaaggaggagctgcaggcgctgtccggacagttcgacgccatctacttccacccgagtacctttcactgcgcgcggctggccgcaggggctggactgcagctggtggacgctgtgctcactggagctgtgcaaaatgggcttgccctggtgaggcctcccgggcaccatggccagagggcggctgccaacgggttctgcgtgttcaacaacgtggccatagcagctgcacatgccaagcagaaacacgggctacacaggatcctcgtcgtggactgggatgtgcaccatggccaggggatccagtatctctttgaggatgaccccagcgtcctttacttctcctggcaccgctatgagcatgggcgcttctggcctttcctgcgagagtcagatgcagacgcagtggggcggggacagggcctcggcttcactgtcaacctgccctggaaccaggttgggatgggaaacgctgactacgtggctgccttcctgcacctgctgctcccactggcctttgagtttgaccctgagctggtgctggtctcggcaggatttgactcagccatcggggaccctgaggggcaaatgcaggccacgccagagtgcttcgcccacctcacacagctgctgcaggtgctggccggcggccgggtctgtgccgtgctggagggcggctaccacctggagtcactggcggagtcagtgtgcatgacagtacagacgctgctgggtgacccggccccacccctgtcagggccaatggcgccatgtcagaggtgcgaggggaggtagggcgggcagggccggggtgtgagaccaggtgtcacgactgttgtgtctccctcacagtgccctagagtccatccagagtgcccgtgctgcccaggccccgcactggaagagcctccagcagcaaggtcagtgtggccgggtgctaggctgcaggatcccacctcgggctcctgtgcagtggctatgactccgaactgtccctagatgtgaccgctgtgccgatgagccccagcagccactccccagaggggaggcctccacctctgctgcctgggggtccagtgtgtaaggcagctgcatctgcaccgagctccctcctggaccagccgtgcctctgccccgcaccctctgtccgcaccgctgttgccctgacaacgccggatatcacattggttctgccccctgacgtcatccaacaggaagcgtcagccgaggtaagctgggcagggtggaggtgctgcggggtgggacgaggggaaggaccagtgactgcttccgtcttcgcccctggtccagaactccacaccccagctagcagggatcctggcccgggtgctgaatggagaggcacctcctagcctaggcccttcctctgtggcctccccagaggacgtccaggccctgatgtacctgagagggcagctggagcctcagtggaagatgttgcagtgccatcctcacctggtggcttgaaatcggccaaggtgggagcatttacaccgcagaaatgacaccgcacgccagcgccccgcggccgcgatccggaccccaagcccacggctccctcgactctggggcacggaaccccgcccactcccaatccccgcgccccgccctctcccacccgtgcttcccccgctccacccctcacctcacctcgcccccgccccacccatcgcgccccggcccgtcccatcgaggcccatgcaacccacgctcggtcccgttccggcccctgcgccccgctgcgcttcgctccccgcccttgcgccgttagtaaacatcgctcaaacg

SEQ ID NO: 296145 - DNA, 140 bp, Homo sapiens
aggcgctgtccggacagttcgacgccatctacttccacccggtgcgtgtccccggacacactcacctgtgcagacacacatgcacgtgcctttgagcgttcacagccacggccgccaaccccagccagtgtcccctggtc

SEQ ID NO: 296146 - DNA, 1110 bp, Homo sapiens
agctcgtggcctccccgtggtcttgcgacgtttagcgactattgcgcctgcgccagcgccggctgcgagactggggccgtggctgctggtcccgggtgatgctaggcggctccctgggctccaggctgttgcggggtgtaggtgggagtcacggacggttcggggcccgaggtgtccgcgaaggtggcgcagccatggcggcaggggagagcatggctcagcggatggtctgggtggacctggagatgacaggattggacattgagaaggaccagattattgagatggcctgtctgataactgactctgatctcaacattttggctgaaggtcctaacctgattataaaacaaccagatgagttgctggacagcatgtcagattggtgtaaggagcatcacgggaagtctggccttaccaaggcagtgaaggagagtacaattacattgcagcaggcagagtatgaatttctgtcctttgtacgacagcagactcctccagggctctgtccacttgcaggaaattcagttcatgaagataagaagtttcttgacaaatacatgccccagttcatgaaacatcttcattatagaataattgatgtgagcactgttaaagaactgtgcagacgctggtatccagaagaatatgaatttgcaccaaagaaggctgcttctcatagggcacttgatgacattagtgaaagcatcaaagagcttcagttttaccgaaataacatcttcaagaaaaaaatagatgaaaagaagaggaaaattatagaaaatggggaaaatgagaagaccgtgagttgatgccagttatcatgctgccactacatcgttatctggaggcaacttctggtggtttttttttctcacgctgatggcttggcagagcaccttcggttaacttgcatctccagattgattactcaagcagacagcacacgaaatactatttttctcctaatatgctgtttccattatgacacagcagctcctttgtaagtaccaggtcatgtccatcccttggtacatatatgcatttgcttttaaaccatttcttttgtttaaataaataaataagtaaataaagctagttctattgaaa

SEQ ID NO: 296147 - DNA, 616 bp, Homo sapiens
aactctctaatttccaccgctacaggaaattcagttcatgaagataagaagtttcttgacaaatacatgccccagttcatgaaacatcttcattatagaataattgatgtgagcactgttaaagaactgtgcagacgctggtatccagaagaatatgaatttgcaccaaagaaggctgcttctcatagggcacttgatgacattagtgaaagcatcaaagagcttcagttttaccgaaataacatcttcaagaaaaaaatagatgaaaagaagaggaaaattatagaaaatggggaaaatgagaagaccgtgagttgatgccagttatcatgctgccactacatcgttatctggaggcaacttctggtggtttttttttctcacgctgatggcttggcagagcaccttcggttaacttgcatctccagattgattactcaagcagacagcacacgaaatactatttttctcctaatatgctgtttccattatgacacagcagctcctttgtaagtaccaggtcatgtccatcccttggtacatatatgcatttgcttttaaaccatttcttttgtttaaataaataaataagtaaataaagctagttctattgaaa

SEQ ID NO: 296148 - DNA, 671 bp, Homo sapiens
aactctctaatttccaccgctacaggaaattcagttcatgaagataagaagtttcttgacaaatacatgccccagttcatgaaacatcttcattatagaataattgatgtgagcactgttaaagaactgtgcagacgctggtatccagaagaatatgaatttgcaccaaagaaggctgcttctcatagggcacttgatgacattagtgaaagcatcaaagagcttcagttttaccgaaataacatcttcaagaaaaaaatagatgaaaagaagaggaaaattatagaaaatggggaaaatgagaagaccgtgagttgatgccagttatcatgctgccactacatcgttatctggaggcaacttctggtggtttttttttctcacgctgatggcttggcagagcaccttcggttaacttgcatctccagattgattactcaagcagacagcacacgaaatactatttttctcctaatatgctgtttccattatgacacagcagctcctttgtaagtaccaggtcatgtccatcccttggtacatatatgcatttgcttttaaaccatttcttttgtttaaataaataaataagtaaataaagctagttctattgaaaacacaaaaacaaaaaaaattggggggggccgggcccgaaaaattcttaaaaaccg

SEQ ID NO: 296149 - DNA, 883 bp, Homo sapiens
gctagcgggacgactctcttaatcttccaccgctacactctggccttaccaaggcagtgaaggagagtacaattacattgcagcaggcagagtatgaatttctgtcctttgtacgacagcagactcctccagggctctgtccacttgcaggaaattcagttcatgaagataagaagtttcttgacaaatacatgccccagttcatgaaacatcttcattatagaataattgatgtgagcactgttaaagaactgtgcagacgctggtatccagaagaatatgaatttgcaccaaagaaggctgcttctcatagggcacttgatgacattagtgaaagcatcaaagagcttcagttttaccgaaataacatcttcaagaaaaaaatagatgaaaagaagaggaaaattatagaaaatggggaaaatgagaagaccgtgagttgatgccagttatcatgctgccactacatcgttatctggaggcaacttctggtggtttttttttctcacgctgatggcttggcagagcaccttcggttaacttgcatctccagattgattactcaagcagacagcacacgaaatactatttttctcctaatatgctgtttccattatgacacagcagctcctttgtaagtaccaggtcatgtccatcccttggtacatatatgcatttgcttttaaaccatttcttttgtttaaataaataaataagtaaataaagctagttctattgaaaggggcggccgcttcctttagggaggggaattgaatgacccggctcatggatccgtagggtcaggggttcgggtgggcgagcgggtcaactttctctaacgcgggagtccgggttcccacagacaggggaaacgccggagagg

SEQ ID NO: 296150 - DNA, 612 bp, Homo sapiens
agctcgtggcctccccgtggtcttgcgacgtttagcgactattgcgcctgcgccagcgccggctgcgagactggggccgtggctgctggtcccgggtgatgctaggcggctccctgggctccaggctgttgcggggtgtaggtgggagtcacggacggttcggggcccgaggtgtccgcgaaggtggcgcagccatggcggcaggggagagcatggctcagcggatggtctgggtggacctggagatgacaggattggacattgagaaggaccagattattgagatggcctgtctgataactgactctgatctcaacattttggctgaaggcacttgatgacattagtgaaagcatcaaagagcttcagttttaccgaaataacatcttcaagaaaaaaaaaaaaaaaaaaaaaaaaaaaaaaaaaacttggggggcctttttgttgtcgggggggggaaaagggggttatggggaaggggcccggtggtaatatggtgtgttttctgggccccggttttttgtgtgcaaagggggggaaatcgggggggcccccaatttgggggggggatatataaatttggaaaaggccgggttaaccggggttataggg

SEQ ID NO: 296151 - DNA, 1247 bp, Homo sapiens
taattaaccatgccagaaatttacagaaacataaattctgtcgtttactgagcgcttactgtatgccagctacagtttctgtgtgctttatatgtctttgttcttagttctcacagcaactataagttagttattgttataatgctcatttgatggatgaggacacttgagcatagagatgttgggtaatttgtctgaggtcccagtggctgtttactgggggagccaagagtttaactcaggctgtctcagtaaggtgctcctaacaagtaggacagccagctgtcctcccatcagatttggtgactcgtgccaatgtttgcgtctttatatcataaccttgactttaacttgactccatatttacaattctgccttttcaactaggacatgtgattcttctagatcagtattaagattttagaatttctgttagtgcacacccgtaaagtgttctgttgttgacagattgggcatgattaaggtttttgcatgctacttccaactgaaacatttagcaaaacaaaacacacctgctgcatttcagccactcatgaaacatttaataaggatgtgacaccatctggtagggggtgaaatccctgaccctgaataattctgttttatactgtcagcagtattcagagccagaaactccagaataggaacaaagtagggatgtttgtggaaaagagagtcttgttaaaataagttcctagagggtagcattgatatgttactggcactggatacatttcgtaaatctgcagttaacacttttgtttgttttgctgtgtaggtaaaagaggtgaggacgtatttctagattaatgactgcgtttgtggagtaccaggcttatcctccccacatatcaactgtaggagaatcatgagactttgtacttctcatcataacaacttttttaactttgtataaataaagccctgagttttagatttggttgtttttttctgttacttgggatttattggagatcaatagtgaagagaagtgtctttattttaccagtctaacttacccttggccgaagaagagtgtttcctttagactgttgatataatgtgaaatactgacagtttaatggacccgtaggttgatatgtaccctggaggaaatttgggtatgtattcacacagctgcagatgaatgcagcatttgtaaatggactaagtcagatgaggataaagatgttaaaaaaaaaaaaaaagcttaggggctatcagtt

SEQ ID NO: 296152 - DNA, 777 bp, Homo sapiens
agctcgtggcctccccgtggtcttgcgacgtttagcgactattgcgcctgcgccagcgccggctgcgagactggggccgtggctgctggtcccgggtgatgctaggcggctccctgggctccaggctgttgcggggtgtaggtgggagtcacggacggttcggggcccgaggtgtccgcgaaggtggcgcagccatggcggcaggggagagcatggctcagcggatggtctgggtggacctggagatgacaggattggacattgagaaggaccagattattgagatggcctgtctgataactgactctgatctcaacattttggctgaagtaaaagaggtgaggacgtatttctagattaatgactgcgtttgtggagtaccaggcttatcctccccacatatcaactgtaggagaatcatgagactttgtacttctcatcataacaacttttttaactttgtataaataaagccctgagttttagatttggttgtttttttctgttacttgggatttattggagatcaatagtgaagagaagtgtctttattttaccagtctaacttacccttggccgaagaagagtgtttcctttagactgttgatataatgtgaaatactgacagtttaatggacccgtaggttgatatgtaccctggaggaaatttgggtatgtattcacacagctgcagatgaatgcagcatttgtaaatggactaagtcagatgaggataaagatgttaaaaaaaaaaaaaaagcttaggggctatcagtt

SEQ ID NO: 296153 - DNA, 740 bp, Homo sapiens
agctcgtggcctccccgtggtcttgcgacgtttagcgactattgcgcctgcgccagcgccggctgcgagactggggccgtggctgctggtcccgggtgatgctaggcggctccctgggctccaggctgttgcggggtgtaggtgggagtcacggacggttcggggcccgaggtgtccgcgaaggtggcgcagccatggcggcaggggagagcatggctcagcggatggtctgggtggacctggagatgacaggattggacattgagaaggaccagattattgagatggcctgtctgataactgactctgatctcaacattttggctgaagaaattcagttcatgaagataagaagtttcttgacaaatacatgccccagttcatgaaacatcttcattatagaataattgatgtgagcactgttaaagaactgtgcaggtaagggctatatttaggatccattaaattacctcatttagcatgttttaattgagaatttgtggaaagtaattggatagagctgtagaactaaggctaccaagtgggttcatatcttcctcatcccattcttgcttgtataggaccttaacttaccctggactggtgagaattgggagaaacaacgtcagacatgttcccagtaaataagccaatgcctggcacaaaataagtgctcaagtacattttctggattaactaatattatgtggaagtcttgtgactgggaacatatagatgaa

SEQ ID NO: 296154 - DNA, 385 bp, Homo sapiens
ggctatggattacaagctgaccatgtttgagggaatcccctgttaaataaacttgggtaaaagaggcccagaatgatggctttgtgtgtgttatatatttatttttaattgcagatgacaggattggacattgagaaggaccagattattgagatggcctgtctgataactgactctgatctcaacattttggctgaagtacgtgatgcccatgtaatacagtcatactttttaaagggcactggaaatataaccatcattttttccagcttctttatttaaaaaataagaaagttgaggtctatatgggttaaggtaatgtgctaggtcatggtaggggtggtactagaaccaaagtaatccatctcacagcctagtgaaaatt

SEQ ID NO: 296155 - DNA, 1232 bp, Homo sapiens
  misc_feature (1162)..(1162): n is a, c, g, or t
  misc_feature (1232)..(1232): n is a, c, g, or t
agctcgtggcctccccgtggtcttgcgacgtttagcgactattgcgcctgcgccagcgccggctgcgagactggggccgtggctgctggtcccgggtgatgctaggcggctccctgggctccaggctgttgcggggtgtaggtgggagtcacggacggttcggggcccgaggtgtccgcgaaggtggcgcagccatggcggcaggggagagcatggctcagcggatggtctgggtggacctggagatgacaggattggacattgagaaggaccagattattgagatggcctgtctgataactgactctgatctcaacattttggctgaaggtcctaacctgattataaaacaaccagatgagttgctggacagcatgtcagattggtgtaaggagcatcacgggaagtctggccttaccaaggcagtgaaggagagtacaattacattgcagcaggcagagtatgaatttctgtcctttgtacgacagcagactcctccagggctctgtccacttgcaggaaattcagttcatgaagataagaagtttcttgacaaatacatgccccagttcatgaaacatcttcattatagaataattgatgtgagcactgttaaagaactgtgcagacgctggtatccagaagaatatgaatttgcaccaaagaaggctgcttctcatagggcacttgatgacattagtgaaagcatcaaagagcttcagttttaccgaaataacatcttcaagaaaaaaatagatgaaaagaagaggaaaattatagaaaatggggaaaatgagaagaccgtgagttgatgccagttatcatgctgccactacatcgttatctggaggcaacttctggtggtttttttttctcacgctgatggcttggcagagcaccttcggttaacttgcatctccagattgattactcaagcagacagcacacgaaatactatttttctcctaatatgctgtttccattatgacacagcagctcctttgtaagtaccaggtcatgtccatcccttggtacatatatgcatttgcttttaaaccatttcttttgtttaaataaataaataagtaaataaagctagttctattgaaaaaaaaaaacaaataacccatctagcctgaatccgcccgcataagattgtgtntgttttccggtggccccgttccttttaagaggttaatccccaaccccgctcaagcccagagctcgcgtgn

SEQ ID NO: 296156 - DNA, 1223 bp, Homo sapiens
  misc_feature (1223)..(1223): n is a, c, g, or t
agctcgtggcctccccgtggtcttgcgacgtttagcgactattgcgcctgcgccagcgccggctgcgagactggggccgtggctgctggtcccgggtgatgctaggcggctccctgggctccaggctgttgcggggtgtaggtgggagtcacggacggttcggggcccgaggtgtccgcgaaggtggcgcagccatggcggcaggggagagcatggctcagcggatggtctgggtggacctggagatgacaggattggacattgagaaggaccagattattgagatggcctgtctgataactgactctgatctcaacattttggctgaaggtcctaacctgattataaaacaaccagatgagttgctggacagcatgtcagattggtgtaaggagcatcacgggaagtctggccttaccaaggcagtgaaggagagtacaattacattgcagcaggcagagtatgaatttctgtcctttgtacgacagcagactcctccagggctctgtccacttgcaggaaattcagttcatgaagataagaagtttcttgacaaatacatgccccagttcatgaaacatcttcattatagaataattgatgtgagcactgttaaagaactgtgcagacgctggtatccagaagaatatgaatttgcaccaaagaaggctgcttctcatagggcacttgatgacattagtgaaagcatcaaagagcttcagttttaccgaaataacatcttcaagaaaaaaatagatgaaaagaagaggaaaattatagaaaatggggaaaatgagaagaccgtgagttgatgccagttatcatgctgccactacatcgttatctggaggcaacttctggtggtttttttttctcacgctgatggcttggcagagcaccttcggttaacttgcatctccagattgattactcaagcagacagcacacgaaatactatttttctcctaatatgctgtttccattatgacacagcagctcctttgtaagtaccaggtcatgtccatcccttggtacatatatgcatttgcttttaaaccatttcttttgtttaaataaataaataagtaaataaagctagttctattgaaaacgcggccgtccctttggggggggaataatgatccccgctactgactccgtgcgctgggcgttccgtgggggaacggtttcccttcttaaggcggaatccggtattccaaatn

SEQ ID NO: 296157 - DNA, 1298 bp, Homo sapiens
agctcgtggcctccccgtggtcttgcgacgtttagcgactattgcgcctgcgccagcgccggctgcgagactggggccgtggctgctggtcccgggtgatgctaggcggctccctgggctccaggctgttgcggggtgtaggtgggagtcacggacggttcggggcccgaggtgtccgcgaaggtggcgcagccatggcggcaggggagagcatggctcagcggatggtctgggtggacctggagatgacaggattggacattgagaaggaccagattattgagatggcctgtctgataactgactctgatctcaacattttggctgaaggtcctaacctgattataaaacaaccagatgagttgctggacagcatgtcagattggtgtaaggagcatcacgggaagtctggccttaccaaggcagtgaaggagagtacaattacattgcagcaggcagagtatgaatttctgtcctttgtacgacagcagactcctccagggctctgtccacttgcaggaaattcagttcatgaagataagaagtttcttgacaaatacatgccccagttcatgaaacatcttcattatagaataattgatgtgagcactgttaaagaactgtgcagacgctggtatccagaagaatatgaatttgcaccaaagaaggctgcttctcatagggcacttgatgacattagtgaaagcatcaaagagcttcagttttaccgaaataacatcttcaagaaaaaaatagatgaaaagaagaggaaaattatagaaaatggggaaaatgagaagaccgtgagttgatgccagttatcatgctgccactacatcgttatctggaggcaacttctggtggtttttttttctcacgctgatggcttggcagagcaccttcggttaacttgcatctccagattgattactcaagcagacagcacacgaaatactatttttctcctaatatgctgtttccattatgacacagcagctcctttgtaagtaccaggtcatgtccatcccttggtacatatatgcatttgcttttaaaccatttcttttgtttaaataaataaataagtaaataaagctagttctattgaaaaacaacccaccaaggcaaaaaaaatctttgttggggcgctctggccctagaaaaagtttctttaaccccatttggtgtggggcgccgggcccagttagggttagcggaacactgtggccatagggcggtttccccagggaaacccccgggccgaacacaggtggcgtgggtttcccccccaatataag

SEQ ID NO: 296158 - DNA, 1252 bp, Homo sapiens
agctcgtggcctccccgtggtcttgcgacgtttagcgactattgcgcctgcgccagcgccggctgcgagactggggccgtggctgctggtcccgggtgatgctaggcggctccctgggctccaggctgttgcggggtgtaggtgggagtcacggacggttcggggcccgaggtgtccgcgaaggtggcgcagccatggcggcaggggagagcatggctcagcggatggtctgggtggacctggagatgacaggattggacattgagaaggaccagattattgagatggcctgtctgataactgactctgatctcaacattttggctgaaggtcctaacctgattataaaacaaccagatgagttgctggacagcatgtcagattggtgtaaggagcatcacgggaagtctggccttaccaaggcagtgaaggagagtacaattacattgcagcaggcagagtatgaatttctgtcctttgtacgacagcagactcctccagggctctgtccacttgcaggaaattcagttcatgaagataagaagtttcttgacaaatacatgccccagttcatgaaacatcttcattatagaataattgatgtgagcactgttaaagaactgtgcagacgctggtatccagaagaatatgaatttgcaccaaagaaggctgcttctcatagggcacttgatgacattagtgaaagcatcaaagagcttcagttttaccgaaataacatcttcaagaaaaaaatagatgaaaagaagaggaaaattatagaaaatggggaaaatgagaagaccgtgagttgatgccagttatcatgctgccactacatcgttatctggaggcaacttctggtggtttttttttctcacgctgatggcttggcagagcaccttcggttaacttgcatctccagattgattactcaagcagacagcacacgaaatactatttttctcctaatatgctgtttccattatgacacagcagctcctttgtaagtaccaggtcatgtccatcccttggtacatatatgcatttgcttttaaaccatttcttttgtttaaataaataaataagtaaataaagctagttctattgaaaggggcggccgcttcctttagggaggggaattgaatgacccggctcatggatccgtagggtcaggggttcgggtgggcgagcgggtcaactttctctaacgcgggagtccgggttcccacagacaggggaaacgccggagagg

SEQ ID NO: 296159 - DNA, 1154 bp, Homo sapiens
agctcgtggcctccccgtggtcttgcgacgtttagcgactattgcgcctgcgccagcgccggctgcgagactggggccgtggctgctggtcccgggtgatgctaggcggctccctgggctccaggctgttgcggggtgtaggtgggagtcacggacggttcggggcccgaggtgtccgcgaaggtggcgcagccatggcggcaggggagagcatggctcagcggatggtctgggtggacctggagatgacaggattggacattgagaaggaccagattattgagatggcctgtctgataactgactctgatctcaacattttggctgaaggtcctaacctgattataaaacaaccagatgagttgctggacagcatgtcagattggtgtaaggagcatcacgggaagtctggccttaccaaggcagtgaaggagagtacaattacattgcagcaggcagagtatgaatttctgtcctttgtacgacagcagactcctccagggctctgtccacttgcaggaaattcagttcatgaagataagaagtttcttgacaaatacatgccccagttcatgaaacatcttcattatagaataattgatgtgagcactgttaaagaactgtgcagacgctggtatccagaagaatatgaatttgcaccaaagaaggctgcttctcatagggcacttgatgacattagtgaaagcatcaaagagcttcagttttaccgaaataacatcttcaagaaaaaaatagatgaaaagaagaggaaaattatagaaaatggggaaaatgagaagaccgtgagttgatgccagttatcatgctgccactacatcgttatctggaggcaacttctggtggtttttttttctcacgctgatggcttggcagagcaccttcggttaacttgcatctccagattgattactcaagcagacagcacacgaaatactatttttctcctaatatgctgtttccattatgacacagcagctcctttgtaagtaccaggtcatgtccatcccttggtacatatatgcatttgcttttaaaccatttcttttgtttaaataaataaataagtaaataaagctagttctattgaaaaggctgcccgttcctttaaggagggtaaatcctgatcctcgccc

SEQ ID NO: 296160 - DNA, 1163 bp, Homo sapiens
agctcgtggcctccccgtggtcttgcgacgtttagcgactattgcgcctgcgccagcgccggctgcgagactggggccgtggctgctggtcccgggtgatgctaggcggctccctgggctccaggctgttgcggggtgtaggtgggagtcacggacggttcggggcccgaggtgtccgcgaaggtggcgcagccatggcggcaggggagagcatggctcagcggatggtctgggtggacctggagatgacaggattggacattgagaaggaccagattattgagatggcctgtctgataactgactctgatctcaacattttggctgaaggtcctaacctgattataaaacaaccagatgagttgctggacagcatgtcagattggtgtaaggagcatcacgggaagtctggccttaccaaggcagtgaaggagagtacaattacattgcagcaggcagagtatgaatttctgtcctttgtacgacagcagactcctccagggctctgtccacttgcaggaaattcagttcatgaagataagaagtttcttgacaaatacatgccccagttcatgaaacatcttcattatagaataattgatgtgagcactgttaaagaactgtgcagacgctggtatccagaagaatatgaatttgcaccaaagaaggctgcttctcatagggcacttgatgacattagtgaaagcatcaaagagcttcagttttaccgaaataacatcttcaagaaaaaaatagatgaaaagaagaggaaaattatagaaaatggggaaaatgagaagaccgtgagttgatgccagttatcatgctgccactacatcgttatctggaggcaacttctggtggtttttttttctcacgctgatggcttggcagagcaccttcggttaacttgcatctccagattgattactcaagcagacagcacacgaaatactatttttctcctaatatgctgtttccattatgacacagcagctcctttgtaagtaccaggtcatgtccatcccttggtacatatatgcatttgcttttaaaccatttcttttgtttaaataaataaataagtaaataaagctagttctattgaaacatgatcggctcgcctctttcacgtaccgacaatacacgaccgccacgtcaat

SEQ ID NO: 296161 - DNA, 1165 bp, Homo sapiens
agctcgtggcctccccgtggtcttgcgacgtttagcgactattgcgcctgcgccagcgccggctgcgagactggggccgtggctgctggtcccgggtgatgctaggcggctccctgggctccaggctgttgcggggtgtaggtgggagtcacggacggttcggggcccgaggtgtccgcgaaggtggcgcagccatggcggcaggggagagcatggctcagcggatggtctgggtggacctggagatgacaggattggacattgagaaggaccagattattgagatggcctgtctgataactgactctgatctcaacattttggctgaaggtcctaacctgattataaaacaaccagatgagttgctggacagcatgtcagattggtgtaaggagcatcacgggaagtctggccttaccaaggcagtgaaggagagtacaattacattgcagcaggcagagtatgaatttctgtcctttgtacgacagcagactcctccagggctctgtccacttgcaggaaattcagttcatgaagataagaagtttcttgacaaatacatgccccagttcatgaaacatcttcattatagaataattgatgtgagcactgttaaagaactgtgcagacgctggtatccagaagaatatgaatttgcaccaaagaaggctgcttctcatagggcacttgatgacattagtgaaagcatcaaagagcttcagttttaccgaaataacatcttcaagaaaaaaatagatgaaaagaagaggaaaattatagaaaatggggaaaatgagaagaccgtgagttgatgccagttatcatgctgccactacatcgttatctggaggcaacttctggtggtttttttttctcacgctgatggcttggcagagcaccttcggttaacttgcatctccagattgattactcaagcagacagcacacgaaatactatttttctcctaatatgctgtttccattatgacacagcagctcctttgtaagtaccaggtcatgtccatcccttggtacatatatgcatttgcttttaaaccatttcttttgtttaaataaataaataagtaaataaagctagttctattgaaaacacaaaaacaaaaaaaattggggggggccgggcccgaaaaattcttaaaaaccg

SEQ ID NO: 296162 - DNA, 1956 bp, Homo sapiens
tttaattttgtagaaatgaggtcttgctatgttgcctggactggtcttgaactactggcctcaagtgatcctcccacctcggcctcccagagtgctgggattaccatgcttggcctagacacttttcaaaatgaactcataatcaagggttgacagacttttctggaaagagcaagttattaaattgtttaggctttgagtgcagtcatatgttcttgtcatatgttcttttttttttttaaacaatcttttacaaatgtaaaaatcattcttagctttctagctattaataaatagctgaagtgtggggccatagtttgctgacccttgatagatatctgtgtcatctatttgtaggattagagttttcagtggtgtgtgtatgttcgtatgttctattttgccttaatgaacagtgctggaatgaagggggaacacttaaagtatccttatctcttactttctctgatatgtatatttagtccttaaaacagcttaagctttccctctgaaagtaaggttattcctgttgtttcttggtgactgatggcgtttcccatccacagggtcctaacctgattataaaacaaccagatgagttgctggacagcatgtcagattggtgtaaggagcatcacgggaaggtaacattaccaaataacaggattgctgctttggggatcagtagcaagctttttgctcccacacctgaatccgataccattgttggatggtattttaaaaaggcttagagaagattgcatggcaagcctgggaaactgcttgcttgtttacttttcatctttgggacctctcgagatcatcttctcctgaatgtcctcttttttttctctcctacattcagtctgtcgcgaacgcattgtggattgtcaagtattactcaagtcagtcttttggataaggttagacatcaactttcagagaagggggattgctgctctcctgttaatagttgtttcttcccagaggttaatatccttggactttgaacaccgtcttttttgactgtggacatgctattaacagtcaggatcataactaagttggcttggattccattgaagaaaaaaaaatggtgcaaagatggcagttgcaatttgaacttgagctctaaaaatggtctatttgtggttatatttgcccattttaaaagtgaaatttcatttctggatgcctttgaaaactgactttacatgtgtttttggtggggggctggggattctctcttgcagtctggccttaccaaggcagtgaaggagagtacaattacattgcagcaggcagagtatgaatttctgtcctttgtacgacagcagactcctccagggctctgtccacttgcaggaaattcagttcatgaagataagaagtttcttgacaaatacatgccccagttcatgaaacatcttcattatagaataattgatgtgagcactgttaaagaactgtgcagacgctggtatccagaagaatatgaatttgcaccaaagaaggctgcttctcatagggcacttgatgacattagtgaaagcatcaaagagcttcagttttaccgaaataacatcttcaagaaaaaaatagatgaaaagaagaggaaaattatagaaaatggggaaaatgagaagaccgtgagttgatgccagttatcatgctgccactacatcgttatctggaggcaacttctggtggtttttttttctcacgctgatggcttggcagagcaccttcggttaacttgcatctccagattgattactcaagcagacagcacacgaaatactatttttctcctaatatgctgtttccattatgacacagcagctcctttgtaagtaccaggtcatgtccatcccttggtacatatatgcatttgcttttaaaccatttcttttgtttaaataaataaataagtaaataaagctagttctattgaaa

SEQ ID NO: 296163 - DNA, 1719 bp, Homo sapiens
agctcgtggcctccccgtggtcttgcgacgtttagcgactattgcgcctgcgccagcgccggctgcgagactggggccgtggctgctggtcccgggtgatgctaggcggctccctgggctccaggctgttgcggggtgtaggtgggagtcacggacggttcggggcccgaggtgtccgcgaaggtggcgcagccatggcggcaggggagagcatggctcagcggatggtctgggtggacctggagatgacaggattggacattgagaaggaccagattattgagatggcctgtctgataactgactctgatctcaacattttggctgaaggtcctaacctgattataaaacaaccagatgagttgctggacagcatgtcagattggtgtaaggagcatcacgggaaggtaacattaccaaataacaggattgctgctttggggatcagtagcaagctttttgctcccacacctgaatccgataccattgttggatggtattttaaaaaggcttagagaagattgcatggcaagcctgggaaactgcttgcttgtttacttttcatctttgggacctctcgagatcatcttctcctgaatgtcctcttttttttctctcctacattcagtctgtcgcgaacgcattgtggattgtcaagtattactcaagtcagtcttttggataaggttagacatcaactttcagagaagggggattgctgctctcctgttaatagttgtttcttcccagaggttaatatccttggactttgaacaccgtcttttttgactgtggacatgctattaacagtcaggatcataactaagttggcttggattccattgaagaaaaaaaaatggtgcaaagatggcagttgcaatttgaacttgagctctaaaaatggtctatttgtggttatatttgcccattttaaaagtgaaatttcatttctggatgcctttgaaaactgactttacatgtgtttttggtggggggctggggattctctcttgcagtctggccttaccaaggcagtgaaggagagtacaattacattgcagcaggcagagtatgaatttctgtcctttgtacgacagcagactcctccagggctctgtccacttgcaggaaattcagttcatgaagataagaagtttcttgacaaatacatgccccagttcatgaaacatcttcattatagaataattgatgtgagcactgttaaagaactgtgcagacgctggtatccagaagaatatgaatttgcaccaaagaaggctgcttctcatagggcacttgatgacattagtgaaagcatcaaagagcttcagttttaccgaaataacatcttcaagaaaaaaatagatgaaaagaagaggaaaattatagaaaatggggaaaatgagaagaccgtgagttgatgccagttatcatgctgccactacatcgttatctggaggcaacttctggtggtttttttttctcacgctgatggcttggcagagcaccttcggttaacttgcatctccagattgattactcaagcagacagcacacgaaatactatttttctcctaatatgctgtttccattatgacacagcagctcctttgtaagtaccaggtcatgtccatcccttggtacatatatgcatttgcttttaaaccatttcttttgtttaaataaataaataagtaaataaagctagttctattgaaa

SEQ ID NO: 296164 - DNA, 1626 bp, Homo sapiens
tttaattttgtagaaatgaggtcttgctatgttgcctggactggtcttgaactactggcctcaagtgatcctcccacctcggcctcccagagtgctgggattaccatgcttggcctagacacttttcaaaatgaactcataatcaagggttgacagacttttctggaaagagcaagttattaaattgtttaggctttgagtgcagtcatatgttcttgtcatatgttcttttttttttttaaacaatcttttacaaatgtaaaaatcattcttagctttctagctattaataaatagctgaagtgtggggccatagtttgctgacccttgatagatatctgtgtcatctatttgtaggattagagttttcagtggtgtgtgtatgttcgtatgttctattttgccttaatgaacagtgctggaatgaagggggaacacttaaagtatccttatctcttactttctctgatatgtatatttagtccttaaaacagcttaagctttccctctgaaagtaaggttattcctgttgtttcttggtgactgatggcgtttcccatccacagggtcctaacctgattataaaacaaccagatgagttgctggacagcatgtcagattggtgtaaggagcatcacgggaaggtaacattaccaaataacaggattgctgctttggggatcagtagcaagctttttgctcccacacctgaatccgataccattgttggatggtattttaaaaaggcttagagaagattgcatggcaagcctgggaaactgcttgcttgtttacttttcatctttgggacctctcgagatcatcttctcctgaatgtcctcttttttttctctcctacattcagtctgtcgcgaacgcattgtggattgtcaagtattactcaagtcagtcttttggataagtctggccttaccaaggcagtgaaggagagtacaattacattgcagcaggcagagtatgaatttctgtcctttgtacgacagcagactcctccagggctctgtccacttgcaggaaattcagttcatgaagataagaagtttcttgacaaatacatgccccagttcatgaaacatcttcattatagaataattgatgtgagcactgttaaagaactgtgcagacgctggtatccagaagaatatgaatttgcaccaaagaaggctgcttctcatagggcacttgatgacattagtgaaagcatcaaagagcttcagttttaccgaaataacatcttcaagaaaaaaatagatgaaaagaagaggaaaattatagaaaatggggaaaatgagaagaccgtgagttgatgccagttatcatgctgccactacatcgttatctggaggcaacttctggtggtttttttttctcacgctgatggcttggcagagcaccttcggttaacttgcatctccagattgattactcaagcagacagcacacgaaatactatttttctcctaatatgctgtttccattatgacacagcagctcctttgtaagtaccaggtcatgtccatcccttggtacatatatgcatttgcttttaaaccatttcttttgtttaaataaataaataagtaaataaagctagttctattgaaa

SEQ ID NO: 296165 - DNA, 3282 bp, Homo sapiens
tttaattttgtagaaatgaggtcttgctatgttgcctggactggtcttgaactactggcctcaagtgatcctcccacctcggcctcccagagtgctgggattaccatgcttggcctagacacttttcaaaatgaactcataatcaagggttgacagacttttctggaaagagcaagttattaaattgtttaggctttgagtgcagtcatatgttcttgtcatatgttcttttttttttttaaacaatcttttacaaatgtaaaaatcattcttagctttctagctattaataaatagctgaagtgtggggccatagtttgctgacccttgatagatatctgtgtcatctatttgtaggattagagttttcagtggtgtgtgtatgttcgtatgttctattttgccttaatgaacagtgctggaatgaagggggaacacttaaagtatccttatctcttactttctctgatatgtatatttagtccttaaaacagcttaagctttccctctgaaagtaaggttattcctgttgtttcttggtgactgatggcgtttcccatccacagggtcctaacctgattataaaacaaccagatgagttgctggacagcatgtcagattggtgtaaggagcatcacgggaaggtaacattaccaaataacaggattgctgctttggggatcagtagcaagctttttgctcccacacctgaatccgataccattgttggatggtattttaaaaaggcttagagaagattgcatggcaagcctgggaaactgcttgcttgtttacttttcatctttgggacctctcgagatcatcttctcctgaatgtcctcttttttttctctcctacattcagtctgtcgcgaacgcattgtggattgtcaagtattactcaagtcagtcttttggataaggttagacatcaactttcagagaagggggattgctgctctcctgttaatagttgtttcttcccagaggttaatatccttggactttgaacaccgtcttttttgactgtggacatgctattaacagtcaggatcataactaagttggcttggattccattgaagaaaaaaaaatggtgcaaagatggcagttgcaatttgaacttgagctctaaaaatggtctatttgtggttatatttgcccattttaaaagtgaaatttcatttctggatgcctttgaaaactgactttacatgtgtttttggtggggggctggggattctctcttgcagtctggccttaccaaggcagtgaaggagagtacaattacattgcagcaggcagagtatgaatttctgtcctttgtacgacagcagactcctccagggctctgtccacttgcaggtaaaatccaatcctgtgtatatcttatagtcttccatatgtagtggttcaagagactgcagttccagaaagactagccgagcccatccatgtcttccacttaaccctgctttgggttacacatcttaacttttctgttcaagtttctctgtgtagtttatagcatgagtattgggaaaatgccctgaaacctgacatgagatctgggaaacacaaacttactcaataagaatttctcccatatttttatgatggaaaaatttcacatgcacagaggagtggatttagtaattgttaaccttgtgtcgtatttgttttacctattttttgttggacattttaaaggaaattgcaggcatcaggacacttcattcctaaatacttcatcaaacatctcctaagataaagacattttcttatgtaatacaatgtcattgcattgaagataattaaacattattcagtatcatatgatatctagtccacattagatgttccccaaaatatttgtttttgaaccaggattcagtcaaggctcgtgcatttcatttagttatatttctttagtctcttaatgtaaaactttccacctattatttttcccctgtgtcattgactttctaaagagaccaggcctgttctaccaggatttttaaaagggtgacattgccagagggaagttaatgtttctctgaaggtatatgtgcgtttgtatatgtaagtcgatgtggtagctaatactgttcttaaacatttataaaaataagttttggcattaagtactagagcatatattgtgtaaatgtttccgccagccaatgtggctgatatctgttttaaaggtctcatttaaaatttagtgtttttagtataagttactttttggggacataaatatgcatatgatttgtttaaaaatttggattgtaaataaaggtttatctacctatgtgattcagttaaatttttagtgttagtggtgtgaattttgtgacactgggagaaagtttgcatatcaggtatgaccttagaaagtaacaaatagatttgtgcattacatcaagcatgtggaatgatagatttgtccttctgttcatgagaggtcatttacaaatttataaggagctaaactgactaagtacttggaaatctgtacttgtaagctaatcacatttacccaaacctgatttagaaatatagaggtgcttttaggaattgtttgaattttaaaaaatcatctccatttcaaatacaacttatgaattttgatatcctgttgtataatactagaaatatagagatgcagtatgcttcgtgtctttctaggaaattcagttcatgaagataagaagtttcttgacaaatacatgccccagttcatgaaacatcttcattatagaataattgatgtgagcactgttaaagaactgtgcagacgctggtatccagaagaatatgaatttgcaccaaagaaggctgcttctcatagggcacttgatgacattagtgaaagcatcaaagagcttcagttttaccgaaataacatcttcaagaaaaaaatagatgaaaagaagaggaaaattatagaaaatggggaaaatgagaagaccgtgagttgatgccagttatcatgctgccactacatcgttatctggaggcaacttctggtggtttttttttctcacgctgatggcttggcagagcaccttcggttaacttgcatctccagattgattactcaagcagacagcacacgaaatactatttttctcctaatatgctgtttccattatgacacagcagctcctttgtaagtaccaggtcatgtccatcccttggtacatatatgcatttgcttttaaaccatttcttttgtttaaataaataaataagtaaataaagctagttctattgaaa

SEQ ID NO: 296166 - DNA, 748 bp, Homo sapiens
  misc_feature (18)..(18): n is a, c, g, or t
cccccgggctcgcagganttcggcacgagggagcatcacgggaagtctggccttaccaaggcagtgaaggagagtacaattacattgcagcaggcagagtatgaatttctgtcctttgtacgacagcagactcctccagggctctgtccacttgcaggaaattcagttcatgaagataagaagtttcttgacaaatacatgccccagttcatgaaacatcttcattatagaataattgatgtgagcactgttaaagaactgtgcagacgctggtatccagaagaatatgaatttgcaccaaagaaggctgcttctcatagggcacttgatgacattagtgaaagcatcaaagagcttcagttttaccgaaataacatcttcaagaaaaaaatagatgaaaagaagaggaaaattatagaaaatggggaaaatgagaagaccgtgagttgatgccagttatcatgctgccactacatcgttatctggaggcaacttctggtggtttttttttctcacgctgatggcttggcagagcaccttcggttaacttgcatctccagattgattactcaagcagacagcacacgaaatactatttttctcctaatatgctgtttccattatgacacagcagctcctttgtaagtaccaggtcatgtccatcccttggtacatatatgcatttgcttttaaaccatttcttttgtttaaataaataaataagtaaataaagctagttctattgaaa

SEQ ID NO: 296167 - DNA, 1496 bp, Homo sapiens
tttaattttgtagaaatgaggtcttgctatgttgcctggactggtcttgaactactggcctcaagtgatcctcccacctcggcctcccagagtgctgggattaccatgcttggcctagacacttttcaaaatgaactcataatcaagggttgacagacttttctggaaagagcaagttattaaattgtttaggctttgagtgcagtcatatgttcttgtcatatgttcttttttttttttaaacaatcttttacaaatgtaaaaatcattcttagctttctagctattaataaatagctgaagtgtggggccatagtttgctgacccttgatagatatctgtgtcatctatttgtaggattagagttttcagtggtgtgtgtatgttcgtatgttctattttgccttaatgaacagtgctggaatgaagggggaacacttaaagtatccttatctcttactttctctgatatgtatatttagtccttaaaacagcttaagctttccctctgaaagtaaggttattcctgttgtttcttggtgactgatggcgtttcccatccacagggtcctaacctgattataaaacaaccagatgagttgctggacagcatgtcagattggtgtaaggagcatcacgggaaggtaacattaccaaataacaggattgctgctttggggatcagtagcaagctttttgctcccacacctgaatccgataccattgttggatggtattttaaaaaggcttagagaagattgcatggcaagcctgggaaactgcttgcttgtttacttttcatctttgggacctctcgagatcatcttctcctgaatgtcctcttttttttctctcctacattcagtctgtcgcgaacgcattgtggattgtcaagtattactcaagaaattcagttcatgaagataagaagtttcttgacaaatacatgccccagttcatgaaacatcttcattatagaataattgatgtgagcactgttaaagaactgtgcagacgctggtatccagaagaatatgaatttgcaccaaagaaggctgcttctcatagggcacttgatgacattagtgaaagcatcaaagagcttcagttttaccgaaataacatcttcaagaaaaaaatagatgaaaagaagaggaaaattatagaaaatggggaaaatgagaagaccgtgagttgatgccagttatcatgctgccactacatcgttatctggaggcaacttctggtggtttttttttctcacgctgatggcttggcagagcaccttcggttaacttgcatctccagattgattactcaagcagacagcacacgaaatactatttttctcctaatatgctgtttccattatgacacagcagctcctttgtaagtaccaggtcatgtccatcccttggtacatatatgcatttgcttttaaaccatttcttttgtttaaataaataaataagtaaataaagctagttctattgaaa

SEQ ID NO: 296168 - DNA, 998 bp, Homo sapiens
agctcgtggcctccccgtggtcttgcgacgtttagcgactattgcgcctgcgccagcgccggctgcgagactggggccgtggctgctggtcccgggtgatgctaggcggctccctgggctccaggctgttgcggggtgtaggtgggagtcacggacggttcggggcccgaggtgtccgcgaaggtggcgcagccatggcggcaggggagagcatggctcagcggatggtctgggtggacctggagatgacaggattggacattgagaaggaccagattattgagatggcctgtctgataactgactctgatctcaacattttggctgaaggtcctaacctgattataaaacaaccagatgagttgctggacagcatgtcagattggtgtaaggagcatcacgggaaggaaattcagttcatgaagataagaagtttcttgacaaatacatgccccagttcatgaaacatcttcattatagaataattgatgtgagcactgttaaagaactgtgcagacgctggtatccagaagaatatgaatttgcaccaaagaaggctgcttctcatagggcacttgatgacattagtgaaagcatcaaagagcttcagttttaccgaaataacatcttcaagaaaaaaatagatgaaaagaagaggaaaattatagaaaatggggaaaatgagaagaccgtgagttgatgccagttatcatgctgccactacatcgttatctggaggcaacttctggtggtttttttttctcacgctgatggcttggcagagcaccttcggttaacttgcatctccagattgattactcaagcagacagcacacgaaatactatttttctcctaatatgctgtttccattatgacacagcagctcctttgtaagtaccaggtcatgtccatcccttggtacatatatgcatttgcttttaaaccatttcttttgtttaaataaataaataagtaaataaagctagttctattgaaa

SEQ ID NO: 296169 - DNA, 920 bp, Homo sapiens
agctcgtggcctccccgtggtcttgcgacgtttagcgactattgcgcctgcgccagcgccggctgcgagactggggccgtggctgctggtcccgggtgatgctaggcggctccctgggctccaggctgttgcggggtgtaggtgggagtcacggacggttcggggcccgaggtgtccgcgaaggtggcgcagccatggcggcaggggagagcatggctcagcggatggtctgggtggacctggagatgacaggattggacattgagaaggaccagattattgagatggcctgtctgataactgactctgatctcaacattttggctgaagaaattcagttcatgaagataagaagtttcttgacaaatacatgccccagttcatgaaacatcttcattatagaataattgatgtgagcactgttaaagaactgtgcagacgctggtatccagaagaatatgaatttgcaccaaagaaggctgcttctcatagggcacttgatgacattagtgaaagcatcaaagagcttcagttttaccgaaataacatcttcaagaaaaaaatagatgaaaagaagaggaaaattatagaaaatggggaaaatgagaagaccgtgagttgatgccagttatcatgctgccactacatcgttatctggaggcaacttctggtggtttttttttctcacgctgatggcttggcagagcaccttcggttaacttgcatctccagattgattactcaagcagacagcacacgaaatactatttttctcctaatatgctgtttccattatgacacagcagctcctttgtaagtaccaggtcatgtccatcccttggtacatatatgcatttgcttttaaaccatttcttttgtttaaataaataaataagtaaataaagctagttctattgaaa

SEQ ID NO: 296170 - DNA, 2069 bp, Homo sapiens
  misc_feature (2069)..(2069): n is a, c, g, or t
tttaattttgtagaaatgaggtcttgctatgttgcctggactggtcttgaactactggcctcaagtgatcctcccacctcggcctcccagagtgctgggattaccatgcttggcctagacacttttcaaaatgaactcataatcaagggttgacagacttttctggaaagagcaagttattaaattgtttaggctttgagtgcagtcatatgttcttgtcatatgttcttttttttttttaaacaatcttttacaaatgtaaaaatcattcttagctttctagctattaataaatagctgaagtgtggggccatagtttgctgacccttgatagatatctgtgtcatctatttgtaggattagagttttcagtggtgtgtgtatgttcgtatgttctattttgccttaatgaacagtgctggaatgaagggggaacacttaaagtatccttatctcttactttctctgatatgtatatttagtccttaaaacagcttaagctttccctctgaaagtaaggttattcctgttgtttcttggtgactgatggcgtttcccatccacagggtcctaacctgattataaaacaaccagatgagttgctggacagcatgtcagattggtgtaaggagcatcacgggaaggtaacattaccaaataacaggattgctgctttggggatcagtagcaagctttttgctcccacacctgaatccgataccattgttggatggtattttaaaaaggcttagagaagattgcatggcaagcctgggaaactgcttgcttgtttacttttcatctttgggacctctcgagatcatcttctcctgaatgtcctcttttttttctctcctacattcagtctgtcgcgaacgcattgtggattgtcaagtattactcaagtcagtcttttggataaggttagacatcaactttcagagaagggggattgctgctctcctgttaatagttgtttcttcccagaggttaatatccttggactttgaacaccgtcttttttgactgtggacatgctattaacagtcaggatcataactaagttggcttggattccattgaagaaaaaaaaatggtgcaaagatggcagttgcaatttgaacttgagctctaaaaatggtctatttgtggttatatttgcccattttaaaagtgaaatttcatttctggatgcctttgaaaactgactttacatgtgtttttggtggggggctggggattctctcttgcagtctggccttaccaaggcagtgaaggagagtacaattacattgcagcaggcagagtatgaatttctgtcctttgtacgacagcagactcctccagggctctgtccacttgcaggaaattcagttcatgaagataagaagtttcttgacaaatacatgccccagttcatgaaacatcttcattatagaataattgatgtgagcactgttaaagaactgtgcagacgctggtatccagaagaatatgaatttgcaccaaagaaggctgcttctcatagggcacttgatgacattagtgaaagcatcaaagagcttcagttttaccgaaataacatcttcaagaaaaaaatagatgaaaagaagaggaaaattatagaaaatggggaaaatgagaagaccgtgagttgatgccagttatcatgctgccactacatcgttatctggaggcaacttctggtggtttttttttctcacgctgatggcttggcagagcaccttcggttaacttgcatctccagattgattactcaagcagacagcacacgaaatactatttttctcctaatatgctgtttccattatgacacagcagctcctttgtaagtaccaggtcatgtccatcccttggtacatatatgcatttgcttttaaaccatttcttttgtttaaataaataaataagtaaataaagctagttctattgaaaacgcggccgtccctttggggggggaataatgatccccgctactgactccgtgcgctgggcgttccgtgggggaacggtttcccttcttaaggcggaatccggtattccaaatn

SEQ ID NO: 296171 - DNA, 1670 bp, Homo sapiens
tttaattttgtagaaatgaggtcttgctatgttgcctggactggtcttgaactactggcctcaagtgatcctcccacctcggcctcccagagtgctgggattaccatgcttggcctagacacttttcaaaatgaactcataatcaagggttgacagacttttctggaaagagcaagttattaaattgtttaggctttgagtgcagtcatatgttcttgtcatatgttcttttttttttttaaacaatcttttacaaatgtaaaaatcattcttagctttctagctattaataaatagctgaagtgtggggccatagtttgctgacccttgatagatatctgtgtcatctatttgtaggattagagttttcagtggtgtgtgtatgttcgtatgttctattttgccttaatgaacagtgctggaatgaagggggaacacttaaagtatccttatctcttactttctctgatatgtatatttagtccttaaaacagcttaagctttccctctgaaagtaaggttattcctgttgtttcttggtgactgatggcgtttcccatccacagggtcctaacctgattataaaacaaccagatgagttgctggacagcatgtcagattggtgtaaggagcatcacgggaaggtaacattaccaaataacaggattgctgctttggggatcagtagcaagctttttgctcccacacctgaatccgataccattgttggatggtattttaaaaaggcttagagaagattgcatggcaagcctgggaaactgcttgcttgtttacttttcatctttgggacctctcgagatcatcttctcctgaatgtcctcttttttttctctcctacattcagtctgtcgcgaacgcattgtggattgtcaagtattactcaagtcagtcttttggataagtctggccttaccaaggcagtgaaggagagtacaattacattgcagcaggcagagtatgaatttctgtcctttgtacgacagcagactcctccagggctctgtccacttgcaggaaattcagttcatgaagataagaagtttcttgacaaatacatgccccagttcatgaaacatcttcattatagaataattgatgtgagcactgttaaagaactgtgcagacgctggtatccagaagaatatgaatttgcaccaaagaaggctgcttctcatagggcacttgatgacattagtgaaagcatcaaagagcttcagttttaccgaaataacatcttcaagaaaaaaatagatgaaaagaagaggaaaattatagaaaatggggaaaatgagaagaccgtgagttgatgccagttatcatgctgccactacatcgttatctggaggcaacttctggtggtttttttttctcacgctgatggcttggcagagcaccttcggttaacttgcatctccagattgattactcaagcagacagcacacgaaatactatttttctcctaatatgctgtttccattatgacacagcagctcctttgtaagtaccaggtcatgtccatcccttggtacatatatgcatttgcttttaaaccatttcttttgtttaaataaataaataagtaaataaagctagttctattgaaaaggctgcccgttcctttaaggagggtaaatcctgatcctcgccc

SEQ ID NO: 296172 - DNA, 1990 bp, Homo sapiens
tttaattttgtagaaatgaggtcttgctatgttgcctggactggtcttgaactactggcctcaagtgatcctcccacctcggcctcccagagtgctgggattaccatgcttggcctagacacttttcaaaatgaactcataatcaagggttgacagacttttctggaaagagcaagttattaaattgtttaggctttgagtgcagtcatatgttcttgtcatatgttcttttttttttttaaacaatcttttacaaatgtaaaaatcattcttagctttctagctattaataaatagctgaagtgtggggccatagtttgctgacccttgatagatatctgtgtcatctatttgtaggattagagttttcagtggtgtgtgtatgttcgtatgttctattttgccttaatgaacagtgctggaatgaagggggaacacttaaagtatccttatctcttactttctctgatatgtatatttagtccttaaaacagcttaagctttccctctgaaagtaaggttattcctgttgtttcttggtgactgatggcgtttcccatccacagggtcctaacctgattataaaacaaccagatgagttgctggacagcatgtcagattggtgtaaggagcatcacgggaaggtaacattaccaaataacaggattgctgctttggggatcagtagcaagctttttgctcccacacctgaatccgataccattgttggatggtattttaaaaaggcttagagaagattgcatggcaagcctgggaaactgcttgcttgtttacttttcatctttgggacctctcgagatcatcttctcctgaatgtcctcttttttttctctcctacattcagtctgtcgcgaacgcattgtggattgtcaagtattactcaagtcagtcttttggataaggttagacatcaactttcagagaagggggattgctgctctcctgttaatagttgtttcttcccagaggttaatatccttggactttgaacaccgtcttttttgactgtggacatgctattaacagtcaggatcataactaagttggcttggattccattgaagaaaaaaaaatggtgcaaagatggcagttgcaatttgaacttgagctctaaaaatggtctatttgtggttatatttgcccattttaaaagtgaaatttcatttctggatgcctttgaaaactgactttacatgtgtttttggtggggggctggggattctctcttgcagtctggccttaccaaggcagtgaaggagagtacaattacattgcagcaggcagagtatgaatttctgtcctttgtacgacagcagactcctccagggctctgtccacttgcaggaaattcagttcatgaagataagaagtttcttgacaaatacatgccccagttcatgaaacatcttcattatagaataattgatgtgagcactgttaaagaactgtgcagcttcctttgagagttccatttctgctgtgtatagacgctggtatccagaagaatatgaatttgcaccaaagaaggctgcttctcatagggcacttgatgacattagtgaaagcatcaaagagcttcagttttaccgaaataacatcttcaagaaaaaaatagatgaaaagaagaggaaaattatagaaaatggggaaaatgagaagaccgtgagttgatgccagttatcatgctgccactacatcgttatctggaggcaacttctggtggtttttttttctcacgctgatggcttggcagagcaccttcggttaacttgcatctccagattgattactcaagcagacagcacacgaaatactatttttctcctaatatgctgtttccattatgacacagcagctcctttgtaagtaccaggtcatgtccatcccttggtacatatatgcatttgcttttaaaccatttcttttgtttaaataaataaataagtaaataaagctagttctattgaaa

SEQ ID NO: 296173 - DNA, 1674 bp, Homo sapiens
tttaattttgtagaaatgaggtcttgctatgttgcctggactggtcttgaactactggcctcaagtgatcctcccacctcggcctcccagagtgctgggattaccatgcttggcctagacacttttcaaaatgaactcataatcaagggttgacagacttttctggaaagagcaagttattaaattgtttaggctttgagtgcagtcatatgttcttgtcatatgttcttttttttttttaaacaatcttttacaaatgtaaaaatcattcttagctttctagctattaataaatagctgaagtgtggggccatagtttgctgacccttgatagatatctgtgtcatctatttgtaggattagagttttcagtggtgtgtgtatgttcgtatgttctattttgccttaatgaacagtgctggaatgaagggggaacacttaaagtatccttatctcttactttctctgatatgtatatttagtccttaaaacagcttaagctttccctctgaaagtaaggttattcctgttgtttcttggtgactgatggcgtttcccatccacagggtcctaacctgattataaaacaaccagatgagttgctggacagcatgtcagattggtgtaaggagcatcacgggaaggtaacattaccaaataacaggattgctgctttggggatcagtagcaagctttttgctcccacacctgaatccgataccattgttggatggtattttaaaaaggcttagagaagattgcatggcaagcctgggaaactgcttgcttgtttacttttcatctttgggacctctcgagatcatcttctcctgaatgtcctcttttttttctctcctacattcagtctgtcgcgaacgcattgtggattgtcaagtattactcaagtcagtcttttggataaggttagacatcaactttcagagaagggggattgctgctctcctgttaatagttgtttcttcccagaggttaatatccttggactttgaacaccgtcttttttgactgtggacatgctattaacagtcaggatcataactaagttggcttggattccattgaagaaaaaaaaatggtgcaaagatggcagttgcaatttgaacttgagctctaaaaatggtctatttgtggttatatttgcccattttaaaagtgaaatttcatttctggatgcctttgaaaactgactttacatgtgtttttggtggggggctggggattctctcttgcagtctggccttaccaaggcagtgaaggagagtacaattacattgcagcaggcagagtatgaatttctgtcctttgtacgacagcagactcctccagggctctgtccacttgcaggaaattcagttcatgaagataagaagtttcttgacaaatacatgccccagttcatgaaacatcttcattatagaataattgatgtgagcactgttaaagaactgtgcagttgcatctccagattgattactcaagcagacagcacacgaaatactatttttctcctaatatgctgtttccattatgacacagcagctcctttgtaagtaccaggtcatgtccatcccttggtacatatatgcatttgcttttaaaccatttcttttgtttaaataaataaataagtaaataaagctagttctattgaaa

SEQ ID NO: 296174 - DNA, 1583 bp, Homo sapiens
tgccaataggtttccttttaaaaggactctgagtggaagattatgttagaatttgggaaagaaaccatgtgatcttatttggcatacaaatttataatggtagacgtaaaaacacatataatcttcccttatgaaattcatttgtatttggtaaagcttaataaaatgcaaagaagaataaattagtaatcctaattgctatccttaggcaaatttgtgataatttccccttgtatctagagaaggaaaatgtatattaaggctatgagaatgcaaataatggtactaaccacctgcttaatgagaaagacaagtgcaacctgtttctgttatatatttctttttctatttattaagaaatttgaatacttcatatctgctacaaaaccacagagcaggtgttttctccttaaagccctggttttttaaaagcccgccagcatttagatgcttgagaaagctaacacttatatttagccagacctacttgtataccaaacattctgaagttttaaccatgctgaccaacgaaactggctttgaaatcagttcttctgatgctacagtgaagattctcattacaacagtgccacccaatcttcgaaaactggatccagaactccatttggatatcaaagtattgcagagtgccttagcagccatccgacatgcccgctggttcgaggaaaatgcttctcagtccacagttaaagttctcatcagactactgaaggacttgaggattcgttttcctggctttgagcccctcacaccctggatccttgacctactaggccattatgctgtgatgaacaaccccaccagacagcctttggccctaaacgttgcatacaggcgctgcttgcagattctggctgcaggactgttcctgccaggttcagtgggtatcactgacccctgtgagagtggcaactttagagtacacacagtcatgaccctagaacagcaggacatggtctgctatacagctcagactctcgtccgaatcctctcacatggtggctttaggaagatccttggccaggagggtgatgccagctatcttgcttctgaaatatctacctgggatggagtgatagtaacaccttcagaaaaggcttatgagaagccaccagagaagaaggaaggagaggaagaagaggagaatacagaagaaccacctcaaggagaggaagaagaaagcatggaaactcaggagtgacattcccttcactccttttcctacccaagggggaagactggagcctaagctgcctgctactgggctttacatggtgacagacatttccgtgggatagggaagatagcaggaagaaaagtaaactccatagaagtgtcattccactgggttttgatattggcttagctgccagtctcccatttgtgacctatgccatccatctataatggaggataccaacatttcttcctaatattctataatctccaactcctgaaaacccctctctcaactaatactttgctgttgaaatgttgtgaaatgttaagtgtctggaaatttttttttctaagaaaaactattaaagtacttcctagtaggg

SEQ ID NO: 296175 - DNA, 2414 bp, Homo sapiens
tgccaataggtttccttttaaaaggactctgagtggaagattatgttagaatttgggaaagaaaccatgtgatcttatttggcatacaaatttataatggtagacgtaaaaacacatataatcttcccttatgaaattcatttgtatttggtaaagcttaataaaatgcaaagaagaataaattagtaatcctaattgctatccttaggcaaatttgtgataatttccccttgtatctagagaaggaaaatgtatattaaggctatgagaatgcaaataatggtactaaccacctgcttaatgagaaagacaagtgcaacctgtttctgttatatatttctttttctatttattaagaaatttgaatacttcatatctgctacaaaaccacagagcaggtgttttctccttaaagccctggttttttaaaagcccgccagcatttagatgcttgagaaagctaacacttatatttagccagacctacttgtataccaaacattctgaagttttaaccatgctgaccaacgaaactggctttgaaatcagttcttctgatgctacagtgaagattctcattacaacagtgccacccaatcttcgaaaactggatccagaactccatttggatatcaaagtattgcagagtgccttagcagccatccgacatgcccgctggttcgaggaaaatgcttctcagtccacagttaaagttctcatcagactactgaaggacttgaggattcgttttcctggctttgagcccctcacaccctggatccttgacctactaggccattatgctgtgatgaacaaccccaccagacagcctttggccctaaacgttgcatacaggcgctgcttgcagattctggctgcaggactgttcctgccaggttcagtgggtatcactgacccctgtgagagtggcaactttagagtacacacagtcatgaccctagaacagcaggacatggtctgctatacagctcagactctcgtccgaatcctctcacatggtggctttaggaagatccttggccaggagggtgatgccagctatcttgcttctgaaatatctacctgggatggagtgatagtaacaccttcagaaaaggcttatgagaagccaccagagaagaaggaaggagaggaagaagaggagaatacagaagaaccacctcaaggagaggaagaagaaagcatggaaactcaggagtgacattcccttcactccttttcctacccaagggggaagactggagcctaagctgcctgctactgggctttacatggtgacagacatttccgtgggatagggaagatagcaggaagaaaagtaaactccatagaagtgtcattccactgggttttgatattggcttagctgccagtctcccatttgtgacctatgccatccatctataatggaggataccaacatttcttcctaatattctataatctccaactcctgaaaacccctctctcaactaatactttgctgttgaaatgttgtgaaatgttaagtgtctggaaatttttttttctaagaaaaactattaaagtacttcctagtagggctcttggtctttctggttggtgttttttgtttgtttgtttttttgcatgtggcaaccttttttgcttttggctttgtgtactcttttgttgaaaatgataattgagtcatttaattataaatactcagatcacaatttgaagctgtctttgaattaaaggacaaactcctggaacctttccatataccagagtaaactagaatatcattttaagtatttattgaataaaatgattctatcaacactgctactgtattcaagccagtgcaataaaaaagtgggtggacagaggtcattcactttgactttgcctgccccctccaaatccccagtgtaaacaggaaaatgagaagtcacaggtagaggacatgctgtccaggcccatgtaaccaggcatgtaacatacaaaggaagcccctctggttaactagtcctgaagaaggtaagcctcaagtatgcagcttaaaaaaaaaagtagaggcctcagctcatttgtgaaaggaagcaagagccataattaatgtaagtcctttgggaacctcattctggctgtgtgtaggtttcctggggcccctacataaatgggtaagacgaagtgcttcaaacaaactgtacggctccctttttaatgtctgaaggtctatggggactgtctcctaggatctttgcatgtctgttgaaacaaggcagctggggaacagtacttgtgctactgagtccataggctcatctgttatttgcctggggagccaggggggtaaattcccgaatccagcattgctctcctgcgggctgtttccttggcaacactgtggtttagccgtctcagtc

SEQ ID NO: 296176 - DNA, 349 bp, Homo sapiens
  misc_feature (13)..(13): n is a, c, g, or t
  misc_feature (35)..(35): n is a, c, g, or t
aattcgcggccgngtcgactcggctgcgagaagangacagaaggctactgggctttacatggtgacagacatttccgtgggatagggaagatagcaggaagaaaagtaaactccatagaagtgtcattccactgggttttgatattggcttagctgccagtctcccatttgtgacctatgccatccatctataatggaggataccaacatttcttcctaatattctataatctccaactcctgaaaacccctctctcaactaatactttgctgttgaaatgttgtgaaatgttaagtgtctggaaatttttttttctaagaaaaactattaaagtacttcctagtaggg

SEQ ID NO: 296177 - DNA, 576 bp, Homo sapiens
gtaatgacttttatgctgggctactcgtctaaatcacctttttctctttcctagatcttgcttctgaaatatctacctgggatggagtgatagtaacaccttcagaaaaggcttatgagaagccaccagagaagaaggaaggagaggaagaagaggagaatacagaagaaccacctcaaggagaggaagaagaaagcatggaaactcaggagtgacattcccttcactccttttcctacccaagggggaagactggagcctaagctgcctgctactgggctttacatggtgacagacatttccgtgggatagggaagatagcaggaagaaaagtaaactccatagaagtgtcattccactgggttttgatattggcttagctgccagtctcccatttgtgacctatgccatccatctataatggaggataccaacatttcttcctaatattctataatctccaactcctgaaaacccctctctcaactaatactttgctgttgaaatgttgtgaaatgttaagtgtctggaaatttttttttctaagaaaaactattaaagtacttcctagtaggg

SEQ ID NO: 296178 - DNA, 1609 bp, Homo sapiens
agcggtcttcagttgtctgctactcagaggaaggggcggttggtgcggcctccattgttcgtgttttaaggcgccatgaggggtgacagaggccgtggtcgtggtgggcgctttggttccagaggaggcccaggaggagggttcaggccctttgtaccacatatcccatttgacttctatttgtgtgaaatggcctttccccgggtcaagccagcacctgatgaaacttccttcagtgaggccttgctgaagaggaatcaggacctggctcccaattctgctgaacaggcatctatcctttctctggtgacaaaaataaacaatgtgattgataatctgattgtggctccagggacatttgaagtgcaaattgaagaagttcgacaggtgggatcctataaaaaggggacaatgactacaggacacaatgtggctgacctggtggtgatactcaagattctgccaacgttggaagctgttgctgccctggggaacaaagtcgtggaaagcctaagagcacaggatccttctgaagttttaaccatgctgaccaacgaaactggctttgaaatcagttcttctgatgctacagtgaagattctcattacaacagtgccacccaatcttcgaaaactggatccagaactccatttggatatcaaagtattgcagagtgccttagcagccatccgacatgcccgctggttcgaggaaaatgcttctcagtccacagttaaagttctcatcagactactgaaggacttgaggattcgttttcctggctttgagcccctcacaccctggatccttgacctactaggccattatgctgtgatgaacaaccccaccagacagcctttggccctaaacgttgcatacaggcgctgcttgcagattctggctgcaggactgttcctgccaggttcagtgggtatcactgacccctgtgagagtggcaactttagagtacacacagtcatgaccctagaacagcaggacatggtctgctatacagctcagactctcgtccgaatcctctcacatggtggctttaggaagatccttggccaggagggtgatgccagctatcttgcttctgaaatatctacctgggatggagtgatagtaacaccttcagaaaaggcttatgagaagccaccagagaagaaggaaggagaggaagaagaggagaatacagaagaaccacctcaaggagaggaagaagaaagcatggaaactcaggagtgacattcccttcactccttttcctacccaagggggaagactggagcctaagctgcctgctactgggctttacatggtgacagacatttccgtgggatagggaagatagcaggaagaaaagtaaactccatagaagtgtcattccactgggttttgatattggcttagctgccagtctcccatttgtgacctatgccatccatctataatggaggataccaacatttcttcctaatattctataatctccaactcctgaaaacccctctctcaactaatactttgctgttgaaatgttgtgaaatgttaagtgtctggaaatttttttttctaagaaaaactattaaagtacttcctagtaggg

SEQ ID NO: 296179 - DNA, 1600 bp, Homo sapiens
agcgggtctgctactcagaggaaggggcggttggtgcggcctccattgttcgtgttttaaggcgccatgaggggtgacagaggccgtggtcgtggtgggcgctttggttccagaggaggcccaggaggagggttcaggccctttgtaccacatatcccatttgacttctatttgtgtgaaatggcctttccccgggtcaagccagcacctgatgaaacttccttcagtgaggccttgctgaagaggaatcaggacctggctcccaattctgctgaacaggcatctatcctttctctggtgacaaaaataaacaatgtgattgataatctgattgtggctccagggacatttgaagtgcaaattgaagaagttcgacaggtgggatcctataaaaaggggacaatgactacaggacacaatgtggctgacctggtggtgatactcaagattctgccaacgttggaagctgttgctgccctggggaacaaagtcgtggaaagcctaagagcacaggatccttctgaagttttaaccatgctgaccaacgaaactggctttgaaatcagttcttctgatgctacagtgaagattctcattacaacagtgccacccaatcttcgaaaactggatccagaactccatttggatatcaaagtattgcagagtgccttagcagccatccgacatgcccgctggttcgaggaaaatgcttctcagtccacagttaaagttctcatcagactactgaaggacttgaggattcgttttcctggctttgagcccctcacaccctggatccttgacctactaggccattatgctgtgatgaacaaccccaccagacagcctttggccctaaacgttgcatacaggcgctgcttgcagattctggctgcaggactgttcctgccaggttcagtgggtatcactgacccctgtgagagtggcaactttagagtacacacagtcatgaccctagaacagcaggacatggtctgctatacagctcagactctcgtccgaatcctctcacatggtggctttaggaagatccttggccaggagggtgatgccagctatcttgcttctgaaatatctacctgggatggagtgatagtaacaccttcagaaaaggcttatgagaagccaccagagaagaaggaaggagaggaagaagaggagaatacagaagaaccacctcaaggagaggaagaagaaagcatggaaactcaggagtgacattcccttcactccttttcctacccaagggggaagactggagcctaagctgcctgctactgggctttacatggtgacagacatttccgtgggatagggaagatagcaggaagaaaagtaaactccatagaagtgtcattccactgggttttgatattggcttagctgccagtctcccatttgtgacctatgccatccatctataatggaggataccaacatttcttcctaatattctataatctccaactcctgaaaacccctctctcaactaatactttgctgttgaaatgttgtgaaatgttaagtgtctggaaatttttttttctaagaaaaactattaaagtacttcctagtaggg

SEQ ID NO: 296180 - DNA, 1603 bp, Homo sapiens
gggctggtcccggccggaattttgggatggcggttggtgcggcctccattgttcgtgttttaaggcgccatgaggggtgacagaggccgtggtcgtggtgggcgctttggttccagaggaggcccaggaggagggttcaggccctttgtaccacatatcccatttgacttctatttgtgtgaaatggcctttccccgggtcaagccagcacctgatgaaacttccttcagtgaggccttgctgaagaggaatcaggacctggctcccaattctgctgaacaggcatctatcctttctctggtgacaaaaataaacaatgtgattgataatctgattgtggctccagggacatttgaagtgcaaattgaagaagttcgacaggtgggatcctataaaaaggggacaatgactacaggacacaatgtggctgacctggtggtgatactcaagattctgccaacgttggaagctgttgctgccctggggaacaaagtcgtggaaagcctaagagcacaggatccttctgaagttttaaccatgctgaccaacgaaactggctttgaaatcagttcttctgatgctacagtgaagattctcattacaacagtgccacccaatcttcgaaaactggatccagaactccatttggatatcaaagtattgcagagtgccttagcagccatccgacatgcccgctggttcgaggaaaatgcttctcagtccacagttaaagttctcatcagactactgaaggacttgaggattcgttttcctggctttgagcccctcacaccctggatccttgacctactaggccattatgctgtgatgaacaaccccaccagacagcctttggccctaaacgttgcatacaggcgctgcttgcagattctggctgcaggactgttcctgccaggttcagtgggtatcactgacccctgtgagagtggcaactttagagtacacacagtcatgaccctagaacagcaggacatggtctgctatacagctcagactctcgtccgaatcctctcacatggtggctttaggaagatccttggccaggagggtgatgccagctatcttgcttctgaaatatctacctgggatggagtgatagtaacaccttcagaaaaggcttatgagaagccaccagagaagaaggaaggagaggaagaagaggagaatacagaagaaccacctcaaggagaggaagaagaaagcatggaaactcaggagtgacattcccttcactccttttcctacccaagggggaagactggagcctaagctgcctgctactgggctttacatggtgacagacatttccgtgggatagggaagatagcaggaagaaaagtaaactccatagaagtgtcattccactgggttttgatattggcttagctgccagtctcccatttgtgacctatgccatccatctataatggaggataccaacatttcttcctaatattctataatctccaactcctgaaaacccctctctcaactaatactttgctgttgaaatgttgtgaaatgttaagtgtctggaaatttttttttctaagaaaaactattaaagtacttcctagtaggg

SEQ ID NO: 296181 - DNA, 2440 bp, Homo sapiens
agcggtcttcagttgtctgctactcagaggaaggggcggttggtgcggcctccattgttcgtgttttaaggcgccatgaggggtgacagaggccgtggtcgtggtgggcgctttggttccagaggaggcccaggaggagggttcaggccctttgtaccacatatcccatttgacttctatttgtgtgaaatggcctttccccgggtcaagccagcacctgatgaaacttccttcagtgaggccttgctgaagaggaatcaggacctggctcccaattctgctgaacaggcatctatcctttctctggtgacaaaaataaacaatgtgattgataatctgattgtggctccagggacatttgaagtgcaaattgaagaagttcgacaggtgggatcctataaaaaggggacaatgactacaggacacaatgtggctgacctggtggtgatactcaagattctgccaacgttggaagctgttgctgccctggggaacaaagtcgtggaaagcctaagagcacaggatccttctgaagttttaaccatgctgaccaacgaaactggctttgaaatcagttcttctgatgctacagtgaagattctcattacaacagtgccacccaatcttcgaaaactggatccagaactccatttggatatcaaagtattgcagagtgccttagcagccatccgacatgcccgctggttcgaggaaaatgcttctcagtccacagttaaagttctcatcagactactgaaggacttgaggattcgttttcctggctttgagcccctcacaccctggatccttgacctactaggccattatgctgtgatgaacaaccccaccagacagcctttggccctaaacgttgcatacaggcgctgcttgcagattctggctgcaggactgttcctgccaggttcagtgggtatcactgacccctgtgagagtggcaactttagagtacacacagtcatgaccctagaacagcaggacatggtctgctatacagctcagactctcgtccgaatcctctcacatggtggctttaggaagatccttggccaggagggtgatgccagctatcttgcttctgaaatatctacctgggatggagtgatagtaacaccttcagaaaaggcttatgagaagccaccagagaagaaggaaggagaggaagaagaggagaatacagaagaaccacctcaaggagaggaagaagaaagcatggaaactcaggagtgacattcccttcactccttttcctacccaagggggaagactggagcctaagctgcctgctactgggctttacatggtgacagacatttccgtgggatagggaagatagcaggaagaaaagtaaactccatagaagtgtcattccactgggttttgatattggcttagctgccagtctcccatttgtgacctatgccatccatctataatggaggataccaacatttcttcctaatattctataatctccaactcctgaaaacccctctctcaactaatactttgctgttgaaatgttgtgaaatgttaagtgtctggaaatttttttttctaagaaaaactattaaagtacttcctagtagggctcttggtctttctggttggtgttttttgtttgtttgtttttttgcatgtggcaaccttttttgcttttggctttgtgtactcttttgttgaaaatgataattgagtcatttaattataaatactcagatcacaatttgaagctgtctttgaattaaaggacaaactcctggaacctttccatataccagagtaaactagaatatcattttaagtatttattgaataaaatgattctatcaacactgctactgtattcaagccagtgcaataaaaaagtgggtggacagaggtcattcactttgactttgcctgccccctccaaatccccagtgtaaacaggaaaatgagaagtcacaggtagaggacatgctgtccaggcccatgtaaccaggcatgtaacatacaaaggaagcccctctggttaactagtcctgaagaaggtaagcctcaagtatgcagcttaaaaaaaaaagtagaggcctcagctcatttgtgaaaggaagcaagagccataattaatgtaagtcctttgggaacctcattctggctgtgtgtaggtttcctggggcccctacataaatgggtaagacgaagtgcttcaaacaaactgtacggctccctttttaatgtctgaaggtctatggggactgtctcctaggatctttgcatgtctgttgaaacaaggcagctggggaacagtacttgtgctactgagtccataggctcatctgttatttgcctggggagccaggggggtaaattcccgaatccagcattgctctcctgcgggctgtttccttggcaacactgtggtttagccgtctcagtc

SEQ ID NO: 296182 - DNA, 2069 bp, Homo sapiens
  misc_feature (1703)..(1704): n is a, c, g, or t
  misc_feature (1706)..(1706): n is a, c, g, or t
  misc_feature (1712)..(1712): n is a, c, g, or t
  misc_feature (1714)..(1714): n is a, c, g, or t
  misc_feature (1722)..(1722): n is a, c, g, or t
agcggtcttcagttgtctgctactcagaggaaggggcggttggtgcggcctccattgttcgtgttttaaggcgccatgaggggtgacagaggccgtggtcgtggtgggcgctttggttccagaggaggcccaggaggagggttcaggccctttgtaccacatatcccatttgacttctatttgtgtgaaatggcctttccccgggtcaagccagcacctgatgaaacttccttcagtgaggccttgctgaagaggaatcaggacctggctcccaattctgctgaacaggcatctatcctttctctggtgacaaaaataaacaatgtgattgataatctgattgtggctccagggacatttgaagtgcaaattgaagaagttcgacaggtgggatcctataaaaaggggacaatgactacaggacacaatgtggctgacctggtggtgatactcaagattctgccaacgttggaagctgttgctgccctggggaacaaagtcgtggaaagcctaagagcacaggatccttctgaagttttaaccatgctgaccaacgaaactggctttgaaatcagttcttctgatgctacagtgaagattctcattacaacagtgccacccaatcttcgaaaactggatccagaactccatttggatatcaaagtattgcagagtgccttagcagccatccgacatgcccgctggttcgaggaaaatgcttctcagtccacagttaaagttctcatcagactactgaaggacttgaggattcgttttcctggctttgagcccctcacaccctggatccttgacctactaggccattatgctgtgatgaacaaccccaccagacagcctttggccctaaacgttgcatacaggcgctgcttgcagattctggctgcaggactgttcctgccaggttcagtgggtatcactgacccctgtgagagtggcaactttagagtacacacagtcatgaccctagaacagcaggacatggtctgctatacagctcagactctcgtccgaatcctctcacatggtggctttaggaagatccttggccaggagggtgatgccagctatcttgcttctgaaatatctacctgggatggagtgatagtaacaccttcagaaaaggcttatgagaagccaccagagaagaaggaaggagaggaagaagaggagaatacagaagaaccacctcaaggagaggaagaagaaagcatggaaactcaggagtgacattcccttcactccttttcctacccaagggggaagactggagcctaagctgcctgctactgggctttacatggtgacagacatttccgtgggatagggaagatagcaggaagaaaagtaaactccatagaagtgtcattccactgggttttgatattggcttagctgccagtctcccatttgtgacctatgccatccatctataatggaggataccaacatttcttcctaatattctataatctccaactcctgaaaacccctctctcaactaatactttgctgttgaaatgttgtgaaatgttaagtgtctggaaatttttttttctaagaaaaactattaaagtacttcctagtagggcaaaaaaaaaaaaaaaaaaaaaaaaaaaaaaaaaaaaaaaaaaaaaaaaaaaaaacgaaaaaaaaaaacaaaaaaaaggggggggggggcgccnnanaaaaananaccacggnggggggggcccacgaagggaggccagcccacaagtttggggacaaagggagggggcgccccaaccaaaaggggagggaccgcgataataaatacaacaaagcggaagagcgcgagcgggggcagcggcgttgaataaacaaaaacgaacgggcgaggggacggaggagaaaaaaaagctcgtgatcgcagcggggaggaccactcttgttggggagaagagcgaccaccacctacactgagcgggggggagggacagaaacaacaagaggggggagaaacacaacaacccaccccagacagaagaagtattaaggagaagccgcgccggggggggcgaacagacaaa

SEQ ID NO: 296183 - DNA, 1658 bp, Homo sapiens
agcggtcttcagttgtctgctactcagaggaaggggcggttggtgcggcctccattgttcgtgttttaaggcgccatgaggggtgacagaggccgtggtcgtggtgggcgctttggttccagaggaggcccaggaggagggttcaggccctttgtaccacatatcccatttgacttctatttgtgtgaaatggcctttccccgggtcaagccagcacctgatgaaacttccttcagtgaggccttgctgaagaggaatcaggacctggctcccaattctgctgaacaggcatctatcctttctctggtgacaaaaataaacaatgtgattgataatctgattgtggctccagggacatttgaagtgcaaattgaagaagttcgacaggtgggatcctataaaaaggggacaatgactacaggacacaatgtggctgacctggtggtgatactcaagattctgccaacgttggaagctgttgctgccctggggaacaaagtcgtggaaagcctaagagcacaggatccttctgaagttttaaccatgctgaccaacgaaactggctttgaaatcagttcttctgatgctacagtgaagattctcattacaacagtgccacccaatcttcgaaaactggatccagaactccatttggatatcaaagtattgcagagtgccttagcagccatccgacatgcccgctggttcgaggaaaatgcttctcagtccacagttaaagttctcatcagactactgaaggacttgaggattcgttttcctggctttgagcccctcacaccctggatccttgacctactaggccattatgctgtgatgaacaaccccaccagacagcctttggccctaaacgttgcatacaggcgctgcttgcagattctggctgcaggactgttcctgccaggttcagtgggtatcactgacccctgtgagagtggcaactttagagtacacacagtcatgaccctagaacagcaggacatggtctgctatacagctcagactctcgtccgaatcctctcacatggtggctttaggaagatccttggccaggagggtgatgccagctatcttgcttctgaaatatctacctgggatggagtgatagtaacaccttcagaaaaggcttatgagaagccaccagagaagaaggaaggagaggaagaagaggagaatacagaagaaccacctcaaggagaggaagaagaaagcatggaaactcaggagtgacattcccttcactccttttcctacccaagggggaagactggagcctaagctgcctgctactgggctttacatggtgacagacatttccgtgggatagggaagatagcaggaagaaaagtaaactccatagaagtgtcattccactgggttttgatattggcttagctgccagtctcccatttgtgacctatgccatccatctataatggaggataccaacatttcttcctaatattctataatctccaactcctgaaaacccctctctcaactaatactttgctgttgaaatgttgtgaaatgttaagtgtctggaaatttttttttctaagaaaaactattaaagtacttcctagtagggctcttggtctgtcagggtgttctattgtggagcctctagatcgaccgca

SEQ ID NO: 296184 - DNA, 1649 bp, Homo sapiens
agcggtcttcagttgtctgctactcagaggaaggggcggttggtgcggcctccattgttcgtgttttaaggcgccatgaggggtgacagaggccgtggtcgtggtgggcgctttggttccagaggaggcccaggaggagggttcaggccctttgtaccacatatcccatttgacttctatttgtgtgaaatggcctttccccgggtcaagccagcacctgatgaaacttccttcagtgaggccttgctgaagaggaatcaggacctggctcccaattctgctgaacaggcatctatcctttctctggtgacaaaaataaacaatgtgattgataatctgattgtggctccagggacatttgaagtgcaaattgaagaagttcgacaggtgggatcctataaaaaggggacaatgactacaggacacaatgtggctgacctggtggtgatactcaagattctgccaacgttggaagctgttgctgccctggggaacaaagtcgtggaaagcctaagagcacaggatccttctgaagttttaaccatgctgaccaacgaaactggctttgaaatcagttcttctgatgctacagtgaagattctcattacaacagtgccacccaatcttcgaaaactggatccagaactccatttggatatcaaagtattgcagagtgccttagcagccatccgacatgcccgctggttcgaggaaaatgcttctcagtccacagttaaagttctcatcagactactgaaggacttgaggattcgttttcctggctttgagcccctcacaccctggatccttgacctactaggccattatgctgtgatgaacaaccccaccagacagcctttggccctaaacgttgcatacaggcgctgcttgcagattctggctgcaggactgttcctgccaggttcagtgggtatcactgacccctgtgagagtggcaactttagagtacacacagtcatgaccctagaacagcaggacatggtctgctatacagctcagactctcgtccgaatcctctcacatggtggctttaggaagatccttggccaggagggtgatgccagctatcttgcttctgaaatatctacctgggatggagtgatagtaacaccttcagaaaaggcttatgagaagccaccagagaagaaggaaggagaggaagaagaggagaatacagaagaaccacctcaaggagaggaagaagaaagcatggaaactcaggagtgacattcccttcactccttttcctacccaagggggaagactggagcctaagctgcctgctactgggctttacatggtgacagacatttccgtgggatagggaagatagcaggaagaaaagtaaactccatagaagtgtcattccactgggttttgatattggcttagctgccagtctcccatttgtgacctatgccatccatctataatggaggataccaacatttcttcctaatattctataatctccaactcctgaaaacccctctctcaactaatactttgctgttgaaatgttgtgaaatgttaagtgtctggaaatttttttttctaagaaaaactattaaagtacttcctagtagggaaaaaaaaaaaagtgagcatagaaataaaaacgcccgctc

SEQ ID NO: 296185 - DNA, 1657 bp, Homo sapiens
  misc_feature (1627)..(1628): n is a, c, g, or t
agcggtcttcagttgtctgctactcagaggaaggggcggttggtgcggcctccattgttcgtgttttaaggcgccatgaggggtgacagaggccgtggtcgtggtgggcgctttggttccagaggaggcccaggaggagggttcaggccctttgtaccacatatcccatttgacttctatttgtgtgaaatggcctttccccgggtcaagccagcacctgatgaaacttccttcagtgaggccttgctgaagaggaatcaggacctggctcccaattctgctgaacaggcatctatcctttctctggtgacaaaaataaacaatgtgattgataatctgattgtggctccagggacatttgaagtgcaaattgaagaagttcgacaggtgggatcctataaaaaggggacaatgactacaggacacaatgtggctgacctggtggtgatactcaagattctgccaacgttggaagctgttgctgccctggggaacaaagtcgtggaaagcctaagagcacaggatccttctgaagttttaaccatgctgaccaacgaaactggctttgaaatcagttcttctgatgctacagtgaagattctcattacaacagtgccacccaatcttcgaaaactggatccagaactccatttggatatcaaagtattgcagagtgccttagcagccatccgacatgcccgctggttcgaggaaaatgcttctcagtccacagttaaagttctcatcagactactgaaggacttgaggattcgttttcctggctttgagcccctcacaccctggatccttgacctactaggccattatgctgtgatgaacaaccccaccagacagcctttggccctaaacgttgcatacaggcgctgcttgcagattctggctgcaggactgttcctgccaggttcagtgggtatcactgacccctgtgagagtggcaactttagagtacacacagtcatgaccctagaacagcaggacatggtctgctatacagctcagactctcgtccgaatcctctcacatggtggctttaggaagatccttggccaggagggtgatgccagctatcttgcttctgaaatatctacctgggatggagtgatagtaacaccttcagaaaaggcttatgagaagccaccagagaagaaggaaggagaggaagaagaggagaatacagaagaaccacctcaaggagaggaagaagaaagcatggaaactcaggagtgacattcccttcactccttttcctacccaagggggaagactggagcctaagctgcctgctactgggctttacatggtgacagacatttccgtgggatagggaagatagcaggaagaaaagtaaactccatagaagtgtcattccactgggttttgatattggcttagctgccagtctcccatttgtgacctatgccatccatctataatggaggataccaacatttcttcctaatattctataatctccaactcctgaaaacccctctctcaactaatactttgctgttgaaatgttgtgaaatgttaagtgtctggaaatttttttttctaagaaaaactattaaagtacttcctagtagggaaaacaaccccaaaaccnnaaaaaaaatgcatgccggcggcaatttcg

SEQ ID NO: 296186 - DNA, 2048 bp, Homo sapiens
  misc_feature (1682)..(1683): n is a, c, g, or t
  misc_feature (1685)..(1685): n is a, c, g, or t
  misc_feature (1691)..(1691): n is a, c, g, or t
  misc_feature (1693)..(1693): n is a, c, g, or t
  misc_feature (1701)..(1701): n is a, c, g, or t
agcggtcttcagttgtctgctactcagaggaaggggcggttggtgcggcctccattgttcgtgttttaaggcgccatgaggggtgacagaggccgtggtcgtggtgggcgctttggttccagaggaggcccaggaggagggttcaggccctttgtaccacatatcccatttgacttctatttgtgtgaaatggcctttccccgggtcaagccagcacctgatgaaacttccttcagtgaggccttgctgaagaggaatcaggacctggctcccaattctgctgaacaggcatctatcctttctctggtgacaaaaataaacaatgtgattgataatctgattgtggctccagggacatttgaagtgcaaattgaagaagttcgacaggtgggatcctataaaaaggggacaatgactacaggacacaatgtggctgacctggtggtgatactcaagattctgccaacgttggaagctgttgctgccctggggaacaaagtcgtggaaagcctaagagcacaggatccttctgaagttttaaccatgctgaccaacgaaactggctttgaaatcagttcttctgatgctacagtgaagattctcattacaacagtgccacccaatcttcgaaaactggatccagaactccatttggatatcaaagtattgcagagtgccttagcagccatccgacatgcccgctggttcgaggaaaatgcttctcagtccacagttaaagttctcatcagactactgaaggacttgaggattcgttttcctggctttgagcccctcacaccctggatccttgacctactaggccattatgctgtgatgaacaaccccaccagacagcctttggccctaaacgttgcatacaggcgctgcttgcagattctggctgcaggactgttcctgccaggttcagtgggtatcactgacccctgtgagagtggcaactttagagtacacacagtcatgaccctagaacagcaggacatggtctgctatacagctcagactctcgtccgaatcctctcacatggtggctttaggaagatccttggccaggagggtgatgccagctatcttgcttctgaaatatctacctgggatggagtgatagtaacaccttcagaaaaggcttatgagaagccaccagagaagaaggaaggagaggaagaagaggagaatacagaagaaccacctcaaggagaggaagaagaaagcatggaaactcaggagtgacattcccttcactccttttcctacccaagggggaagactggagcctaagctgcctgctactgggctttacatggtgacagacatttccgtgggatagggaagatagcaggaagaaaagtaaactccatagaagtgtcattccactgggttttgatattggcttagctgccagtctcccatttgtgacctatgccatccatctataatggaggataccaacatttcttcctaatattctataatctccaactcctgaaaacccctctctcaactaatactttgctgttgaaatgttgtgaaatgttaagtgtctggaaatttttttttctaagaaaaactattaaagtacttcctagtagggaaaaaaaaaaaaaaaaaaaaaaaaaaaaaaaaaacgaaaaaaaaaaacaaaaaaaaggggggggggggcgccnnanaaaaananaccacggnggggggggcccacgaagggaggccagcccacaagtttggggacaaagggagggggcgccccaaccaaaaggggagggaccgcgataataaatacaacaaagcggaagagcgcgagcgggggcagcggcgttgaataaacaaaaacgaacgggcgaggggacggaggagaaaaaaaagctcgtgatcgcagcggggaggaccactcttgttggggagaagagcgaccaccacctacactgagcgggggggagggacagaaacaacaagaggggggagaaacacaacaacccaccccagacagaagaagtattaaggagaagccgcgccggggggggcgaacagacaaa

SEQ ID NO: 296187 - DNA, 1690 bp, Homo sapiens
agcggtcttcagttgtctgctactcagaggaaggggcggttggtgcggcctccattgttcgtgttttaaggcgccatgaggggtgacagaggccgtggtcgtggtgggcgctttggttccagaggaggcccaggaggagggttcaggccctttgtaccacatatcccatttgacttctatttgtgtgaaatggcctttccccgggtcaagccagcacctgatgaaacttccttcagtgaggccttgctgaagaggaatcaggacctggctcccaattctgctgaacaggcatctatcctttctctggtgacaaaaataaacaatgtgattgataatctgattgtggctccagggacatttgaagtgcaaattgaagaagttcgacaggtgggatcctataaaaaggggacaatgactacaggacacaatgtggctgacctggtggtgatactcaagattctgccaacgttggaagctgttgctgccctggggaacaaagtcgtggaaagcctaagagcacaggatccttctgaagttttaaccatgctgaccaacgaaactggctttgaaatcagttcttctgatgctacagtgaagattctcattacaacagtgccacccaatcttcgaaaactggatccagaactccatttggatatcaaagtattgcagagtgccttagcagccatccgacatgcccgctggttcgaggaaaatgcttctcagtccacagttaaagttctcatcagactactgaaggacttgaggattcgttttcctggctttgagcccctcacaccctggatccttgacctactaggccattatgctgtgatgaacaaccccaccagacagcctttggccctaaacgttgcatacaggtacagcatgctttgggtttagggttggttgtaaactattttgtgcattcctttaatacctcatacctccctgtgttctaggcgctgcttgcagattctggctgcaggactgttcctgccaggttcagtgggtatcactgacccctgtgagagtggcaactttagagtacacacagtcatgaccctagaacagcaggacatggtctgctatacagctcagactctcgtccgaatcctctcacatggtggctttaggaagatccttggccaggagggtgatgccagctatcttgcttctgaaatatctacctgggatggagtgatagtaacaccttcagaaaaggcttatgagaagccaccagagaagaaggaaggagaggaagaagaggagaatacagaagaaccacctcaaggagaggaagaagaaagcatggaaactcaggagtgacattcccttcactccttttcctacccaagggggaagactggagcctaagctgcctgctactgggctttacatggtgacagacatttccgtgggatagggaagatagcaggaagaaaagtaaactccatagaagtgtcattccactgggttttgatattggcttagctgccagtctcccatttgtgacctatgccatccatctataatggaggataccaacatttcttcctaatattctataatctccaactcctgaaaacccctctctcaactaatactttgctgttgaaatgttgtgaaatgttaagtgtctggaaatttttttttctaagaaaaactattaaagtacttcctagtaggg

SEQ ID NO: 296188 - DNA, 2426 bp, Homo sapiens
agcggtcttcagttgtctgctactcagaggaaggggcggttggtgcggcctccattgttcgtgttttaaggcgccatgaggggtgacagaggccgtggtcgtggtgggcgctttggttccagaggaggcccaggaggagggttcaggccctttgtaccacatatcccatttgacttctatttgtgtgaaatggcctttccccgggtcaagccagcacctgatgaaacttccttcagtgaggccttgctgaagaggaatcaggacctggctcccaattctgctgaacaggcatctatcctttctctggtgacaaaaataaacaatgtgattgataatctgattgtggctccagggacatttgaagtgcaaattgaagaagttcgacaggtgggatcctataaaaaggggacaatgactacaggacacaatgtggctgacctggtggtgatactcaagattctgccaacgttggaagctgttgctgccctggggaacaaagtcgtggaaagcctaagagcacaggatccttctgaagttttaaccatgctgaccaacgaaactggctttgaaatcagttcttctgatgctacagtgaagattctcattacaacagtgccacccaatcttcgaaaactggatccagaactccatttggatatcaaagtattgcagagtgccttagcagccatccgacatgcccgctggttcgaggaaaatgcttctcagtccacagttaaagttctcatcagactactgaaggacttgaggattcgttttcctggctttgagcccctcacaccctggatccttgacctactaggccattatgctgtgatgaacaaccccaccagacagcctttggccctaaacgttgcatacaggcgctgcttgcagattctggctgcaggactgttcctgccaggttcagtgggtatcactgacccctgtgagagtggcaactttagagtacacacagtcatgaccctagaacagcaggacatggtctgctatacagctcagactctcgtccgaatcctctcacatggtggctttaggaagatccttggccaggagggtgatgccagctatcttgcttctgaaatatctacctgggatggagtgatagtaacaccttcagaaaaggcttatgagaagccaccagagaagaaggaaggagaggaagaagaggagaatacagaagaaccacctcaaggagaggaagaagaaagcatggaaactcaggagtgacattcccttcactccttttcctacccaagggggaagactggagcctaagctgcctgatggtgacagacatttccgtgggatagggaagatagcaggaagaaaagtaaactccatagaagtgtcattccactgggttttgatattggcttagctgccagtctcccatttgtgacctatgccatccatctataatggaggataccaacatttcttcctaatattctataatctccaactcctgaaaacccctctctcaactaatactttgctgttgaaatgttgtgaaatgttaagtgtctggaaatttttttttctaagaaaaactattaaagtacttcctagtagggctcttggtctttctggttggtgttttttgtttgtttgtttttttgcatgtggcaaccttttttgcttttggctttgtgtactcttttgttgaaaatgataattgagtcatttaattataaatactcagatcacaatttgaagctgtctttgaattaaaggacaaactcctggaacctttccatataccagagtaaactagaatatcattttaagtatttattgaataaaatgattctatcaacactgctactgtattcaagccagtgcaataaaaaagtgggtggacagaggtcattcactttgactttgcctgccccctccaaatccccagtgtaaacaggaaaatgagaagtcacaggtagaggacatgctgtccaggcccatgtaaccaggcatgtaacatacaaaggaagcccctctggttaactagtcctgaagaaggtaagcctcaagtatgcagcttaaaaaaaaaagtagaggcctcagctcatttgtgaaaggaagcaagagccataattaatgtaagtcctttgggaacctcattctggctgtgtgtaggtttcctggggcccctacataaatgggtaagacgaagtgcttcaaacaaactgtacggctccctttttaatgtctgaaggtctatggggactgtctcctaggatctttgcatgtctgttgaaacaaggcagctggggaacagtacttgtgctactgagtccataggctcatctgttatttgcctggggagccaggggggtaaattcccgaatccagcattgctctcctgcgggctgtttccttggcaacactgtggtttagccgtctcagtc

SEQ ID NO: 296189 - DNA, 1518 bp, Homo sapiens
agcggtcttcagttgtctgctactcagaggaaggggcggttggtgcggcctccattgttcgtgttttaaggcgccatgaggggtgacagaggccgtggtcgtggtgggcgctttggttccagaggaggcccaggaggagggttcaggccctttgtaccacatatcccatttgacttctatttgtgtgaaatggcctttccccgggtcaagccagcacctgatgaaacttccttcagtgaggccttgctgaagaggaatcaggacctggctcccaattctgctgaacaggcatctatcctttctctggtgacaaaaataaacaatgtgattgataatctgattgtggctccagggacatttgaagtgcaaattgaagaagttcgacaggtgggatcctataaaaaggggacaatgactacaggacacaatgtggctgacctggtggtgatactcaagattctgccaacgttggaagctgttgctgccctggggaacaaagtcgtggaaagcctaagagcacaggatccttctgaagttttaaccatgctgaccaacgaaactggctttgaaatcagttcttctgatgctacagtgaagattctcattacaacagtgccacccaatcttcgaaaactggatccagaactccatttggatatcaaagtattgcagagtgccttagcagccatccgacatgcccgctggttcgaggaaaatgcttctcagtccacagttaaagttctcatcagactactgaaggacttgaggattcgttttcctggctttgagcccctcacaccctggatccttgacctactaggccattatgctgtgatgaacaaccccaccagacagcctttggccctaaacgttgcatacaggcgctgcttgcagattctggctgcaggactgttcctgccaggttcagtgggtatcactgacccctgtgagagtggcaactttagagtacacacagtcatgaccctagaacagcagatcttgcttctgaaatatctacctgggatggagtgatagtaacaccttcagaaaaggcttatgagaagccaccagagaagaaggaaggagaggaagaagaggagaatacagaagaaccacctcaaggagaggaagaagaaagcatggaaactcaggagtgacattcccttcactccttttcctacccaagggggaagactggagcctaagctgcctgctactgggctttacatggtgacagacatttccgtgggatagggaagatagcaggaagaaaagtaaactccatagaagtgtcattccactgggttttgatattggcttagctgccagtctcccatttgtgacctatgccatccatctataatggaggataccaacatttcttcctaatattctataatctccaactcctgaaaacccctctctcaactaatactttgctgttgaaatgttgtgaaatgttaagtgtctggaaatttttttttctaagaaaaactattaaagtacttcctagtaggg

SEQ ID NO: 296190 - DNA, 1913 bp, Homo sapiens
agcggtcttcagttgtctgctactcagaggaaggggcggttggtgcggcctccattgttcgtgttttaaggcgccatgaggggtgacagaggccgtggtcgtggtgggcgctttggttccagaggaggcccaggaggagggttcaggccctttgtaccacatatcccatttgacttctatttgtgtgaaatggcctttccccgggtcaagccagcacctgatgaaacttccttcagtgaggccttgctgaagaggaatcaggacctggctcccaattctgctgaacaggcatctatcctttctctggtgacaaaaataaacaatgtgattgataatctgattgtggctccagggacatttgaagtgcaaattgaagaagttcgacaggtgggatcctataaaaaggggacaatgactacaggacacaatgtggctgacctggtggtgatactcaagattctgccaacgttggaagctgttgctgccctggggaacaaagtcgtggaaagcctaagagcacaggatccttctgaagttttaaccatgctgaccaacgaaactggctttgaaatcagttcttctgatgctacagtgaagattctcattacaacagtgccacccaatcttcgaaaactggatccagaactccatttggatatcaaagtattgcagagtgccttagcagccatccgacatgcccgctggttcgaggaaaatgcttctcagtccacagttaaagttctcatcagactactgaaggacttgaggattcgttttcctggctttgagcccctcacaccctggatccttgacctactaggccattatgctgtgatgaacaaccccaccagacagcctttggccctaaacgttgcatacaggtacagcatgctttgggtttagggttggttgtaaactattttgtgcattcctttaatacctcatacctccctgtgttctaggcgctgcttgcagattctggctgcaggactgttcctgccaggttcagtgggtatcactgacccctgtgagagtggcaactttagagtacacacagtcatgaccctagaacagcaggtattgggacagatatgaactgagttgttttgccccactcttttgaatactgctgctcagcaggcaaagtggaatatggtctttacgggtcaggaatttggggattctgaaagactttggtcctgagatttaaaaagctgtcttaatctctgttttcagaagggtattactcaaataaggtcctttgattttccttgcttactctcactttgctttccttcaggacatggtctgctatacagctcagactctcgtccgaatcctctcacatggtggctttaggaagatccttggccaggagggtgatgccagctatcttgcttctgaaatatctacctgggatggagtgatagtaacaccttcagaaaaggcttatgagaagccaccagagaagaaggaaggagaggaagaagaggagaatacagaagaaccacctcaaggagaggaagaagaaagcatggaaactcaggagtgacattcccttcactccttttcctacccaagggggaagactggagcctaagctgcctgctactgggctttacatggtgacagacatttccgtgggatagggaagatagcaggaagaaaagtaaactccatagaagtgtcattccactgggttttgatattggcttagctgccagtctcccatttgtgacctatgccatccatctataatggaggataccaacatttcttcctaatattctataatctccaactcctgaaaacccctctctcaactaatactttgctgttgaaatgttgtgaaatgttaagtgtctggaaatttttttttctaagaaaaactattaaagtacttcctagtaggg

SEQ ID NO: 296191 - DNA, 1519 bp, Homo sapiens
agcggtcttcagttgtctgctactcagaggaaggggcggttggtgcggcctccattgttcgtgttttaaggcgccatgaggggtgacagaggccgtggtcgtggtgggcgctttggttccagaggaggcccaggaggagggttcaggccctttgtaccacatatcccatttgacttctatttgtgtgaaatggcctttccccgggtcaagccagcacctgatgaaacttccttcagtgaggccttgctgaagaggaatcaggacctggctcccaattctgctgaacaggcatctatcctttctctggtgacaaaaataaacaatgtgattgataatctgattgtggctccagggacatttgaagtgcaaattgaagaagttcgacaggtgggatcctataaaaaggggacaatgactacaggacacaatgtggctgacctggtggtgatactcaagattctgccaacgttggaagctgttgctgccctggggaacaaagtcgtggaaagcctaagagcacaggatccttctgaagttttaaccatgctgaccaacgaaactggctttgaaatcagttcttctgatgctacagtgaagattctcattacaacagtgccacccaatcttcgaaaactggatccagaactccatttggatatcaaagtattgcagagtgccttagcagccatccgacatgcccgctggttcgaggaaaatgcttctcagtccacagttaaagttctcatcagactactgaaggacttgaggattcgttttcctggctttgagcccctcacaccctggatccttgacctactaggccattatgctgtgatgaacaaccccaccagacagcctttggccctaaacgttgcatacaggcgctgcttgcagattctggctgcaggactgttcctgccaggttcagtgggtatcactgacccctgtgagagtggcaactttagagtacacacagtcatgaccctagaacagcaggacatggtctgctatacagctcagactctcgtccgaatcctctcacatggtggctttaggaagatccttggccaggagggtgatgccagctatcttgcttctgaaatatctacctgggatggagtgatagtaacaccttcagaaaaggcttatgagaagccaccagagaagaaggaaggagaggaagaagaggagaatacagaagaaccacctcaaggagaggaagaagaaagcatggaaactcaggagtgacattcccttcactccttttcctacccaagggggaagactggagcctaagctgcctgctactgggctttacatggtgacagacatttccgtgggatagggaagatagcaggaagaaaagtaaactccatagaagtgtcattccactgggttttgatattggcttagctgccagtctcccatttgtgacctatgccatccatctataatggaggataccatgtctggaaatttttttttctaagaaaaactattaaagtacttcctagtaggg

SEQ ID NO: 296192 - DNA, 1385 bp, Homo sapiens
ggacgcgtgggtcgacccacgcgtcgagaggaatcaggacctggctcccaattctgctgaacaggcatctatcctttctctggtgacaaaaataaacaatgtgattgataatctgattgtggctccagggacatttgaagtgcaaattgaagaagttcgacaggtgggatcctataaaaaggggacaatgactacaggacacaatgtggctgacctggtggtgatactcaagattctgccaacgttggaagctgttgctgccctggggaacaaagtcgtggaaagcctaagagcacaggatccttctgaagttttaaccatgctgaccaacgaaactggctttgaaatcagttcttctgatgctacagtgaagattctcattacaacagtgccacccaatcttcgaaaactggatccagaactccatttggatatcaaagtattgcagagtgccttagcagccatccgacatgcccgctggttcgaggaaaatgcttctcagtccacagttaaagttctcatcagactactgaaggacttgaggattcgttttcctggctttgagcccctcacaccctggatccttgacctactaggccattatgctgtgatgaacaaccccaccagacagcctttggccctaaacgttgcatacaggcgctgcttgcagattctggctgcaggactgttcctgccaggttcagtgggtatcactgacccctgtgagagtggcaactttagagtacacacagtcatgaccctagaacagcaggacatggtctgctatacagctcagactctcgtccgaatcctctcacatggtggctttaggaagatccttggccaggagggtgatgccagctatcttgcttctgaaatatctacctgggatggagtgatagtaacaccttcagaaaaggcttatgagaagccaccagagaagaaggaaggagaggaagaagaggagaatacagaagaaccacctcaaggagaggaagaagaaagcatggaaactcaggagtgacattcccttcactccttttcctacccaagggggaagactggagcctaagctgcctgctactgggctttacatggtgacagacatttccgtgggatagggaagatagcaggaagaaaagtaaactccatagaagtgtcattccactgggttttgatattggcttagctgccagtctcccatttgtgacctatgccatccatctataatggaggataccaacatttcttcctaatattctataatctccaactcctgaaaacccctctctcaactaatactttgctgttgaaatgttgtgaaatgttaagtgtctggaaatttttttttctaagaaaaactattaaagtacttcctagtaggg

SEQ ID NO: 296193 - DNA, 1363 bp, Homo sapiens
aaaccaataacatataattattctcaaataaaagcagaaaatagctctatcctttctctggtgacaaaaataaacaatgtgattgataatctgattgtggctccagggacatttgaagtgcaaattgaagaagttcgacaggtgggatcctataaaaaggggacaatgactacaggacacaatgtggctgacctggtggtgatactcaagattctgccaacgttggaagctgttgctgccctggggaacaaagtcgtggaaagcctaagagcacaggatccttctgaagttttaaccatgctgaccaacgaaactggctttgaaatcagttcttctgatgctacagtgaagattctcattacaacagtgccacccaatcttcgaaaactggatccagaactccatttggatatcaaagtattgcagagtgccttagcagccatccgacatgcccgctggttcgaggaaaatgcttctcagtccacagttaaagttctcatcagactactgaaggacttgaggattcgttttcctggctttgagcccctcacaccctggatccttgacctactaggccattatgctgtgatgaacaaccccaccagacagcctttggccctaaacgttgcatacaggcgctgcttgcagattctggctgcaggactgttcctgccaggttcagtgggtatcactgacccctgtgagagtggcaactttagagtacacacagtcatgaccctagaacagcaggacatggtctgctatacagctcagactctcgtccgaatcctctcacatggtggctttaggaagatccttggccaggagggtgatgccagctatcttgcttctgaaatatctacctgggatggagtgatagtaacaccttcagaaaaggcttatgagaagccaccagagaagaaggaaggagaggaagaagaggagaatacagaagaaccacctcaaggagaggaagaagaaagcatggaaactcaggagtgacattcccttcactccttttcctacccaagggggaagactggagcctaagctgcctgctactgggctttacatggtgacagacatttccgtgggatagggaagatagcaggaagaaaagtaaactccatagaagtgtcattccactgggttttgatattggcttagctgccagtctcccatttgtgacctatgccatccatctataatggaggataccaacatttcttcctaatattctataatctccaactcctgaaaacccctctctcaactaatactttgctgttgaaatgttgtgaaatgttaagtgtctggaaatttttttttctaagaaaaactattaaagtacttcctagtaggg

SEQ ID NO: 296194 - DNA, 1178 bp, Homo sapiens
  misc_feature (1150)..(1150): n is a, c, g, or t
  misc_feature (1153)..(1154): n is a, c, g, or t
  misc_feature (1156)..(1156): n is a, c, g, or t
  misc_feature (1163)..(1163): n is a, c, g, or t
agcggtcttcagttgtctgctactcagaggaaggggcggttggtgcggcctccattgttcgtgttttaaggcgccatgaggggtgacagaggccgtggtcgtggtgggcgctttggttccagaggaggcccaggaggagggttcaggccctttgtaccacatatcccatttgacttctatttgtgtgaaatggcctttccccgggtcaagccagcacctgatgaaacttccttcagtgaggccttgctgaagaggaatcaggacctggctcccaattctgctgaacaggcatctatcctttctctggtgacaaaaataaacaatgtgattgataatctgattgtggctccagggacatttgaagtgcaaattgaagaagttcgacaggtgggatcctataaaaaggggacaatgactacaggacacaatgtggctgacctggtggtgatactcaagattctgccaacgttggaagctgttgctgccctggggaacaaagtcgtggaaagcctaagagcacaggatccttctgaagttttaaccatgctgaccaacgaaactggctttgaaatcagttcttctgatgctacagtgaagattctcattacaacagtgccacccaatcttcgaaaactggatccagaactccatttggatatcaaagtattgcagagtgccttagcagccatccgacatgcccgctggttcgaggaaaatgcttctcagtccacagttaaagttctcatcagactactgaaggacttgaggattcgttttcctggctttgagcccctcacaccctggatccttgacctactaggccattatgctgtgatgaacaaccccaccagacagcctttggccctaaacgttgcatacaggcgctgcttgcagattctggctgcaggactgttcctgccaggttcagtgggtatcactgacccctgtgagagtggcaactttagagtacacacagtcatgaccctagaacagcaggacatggtctgctatacagctcagactctcgtccgaatcctctcacatggtggctttaggaagatccttggccaggagggtgatgccagctatcttgcttctgaaatatctacctgggatggagtgatagtaacaccttcagatcagaagaccnccnnangagaggnagagaagccttgaat

SEQ ID NO: 296195 - DNA, 1108 bp, Homo sapiens
agcggtcttcagttgtctgctactcagaggaaggggcggttggtgcggcctccattgttcgtgttttaaggcgccatgaggggtgacagaggccgtggtcgtggtgggcgctttggttccagaggaggcccaggaggagggttcaggccctttgtaccacatatcccatttgacttctatttgtgtgaaatggcctttccccgggtcaagccagcacctgatgaaacttccttcagtgaggccttgctgaagaggaatcaggacctggctcccaattctgctgaacaggcatctatcctttctctggtgacaaaaataaacaatgtgattgataatctgattgtggctccagggacatttgaagtgcaaattgaagaagttcgacaggtgggatcctataaaaaggggacaatgactacaggacacaatgtggctgacctggtggtgatactcaagattctgccaacgttggaagctgttgctgccctggggaacaaagtcgtggaaagcctaagagcacaggatccttctgaagttttaaccatgctgaccaacgaaactggctttgaaatcagttcttctgatgctacagtgaagattctcattacaacagtgccacccaatcttcgaaaactggatccagaactccatttggatatcaaagtattgcagagtgccttagcagccatccgacatgcccgctggttcgaggaaaatgcttctcagtccacagttaaagttctcatcagactactgaaggacttgaggattcgttttcctggctttgagcccctcacaccctggatccttgacctactaggccattatgctgtgatgaacaaccccaccagacagcctttggccctaaacgttgcatacaggcgctgcttgcagattctggctgcaggactgttcctgccaggttcagtgggtatcactgacccctgtgagagtggcaactttagagtacacacagtcatgaccctagaacagcaggacatggtctgctatacagctcagactctcgtccgaatcctctcacatggtggctttaggaagatccttggccaggagggtgatgccagctgtgagtgaccactgtgggtca

SEQ ID NO: 296196 - DNA, 1349 bp, Homo sapiens
ctctagaggatccgggtcaatttctacacagactggaaatcataaaaagtgacaccactgaaaaaaattgccaaataggaattctaggaccaaaaaataaaataagcaaattgaagaagttcgacaggtgggatcctataaaaaggggacaatgactacaggacacaatgtggctgacctggtggtgatactcaagattctgccaacgttggaagctgttgctgccctggggaacaaagtcgtggaaagcctaagagcacaggatccttctgaagttttaaccatgctgaccaacgaaactggctttgaaatcagttcttctgatgctacagtgaagattctcattacaacagtgccacccaatcttcgaaaactggatccagaactccatttggatatcaaagtattgcagagtgccttagcagccatccgacatgcccgctggttcgaggaaaatgcttctcagtccacagttaaagttctcatcagactactgaaggacttgaggattcgttttcctggctttgagcccctcacaccctggatccttgacctactaggccattatgctgtgatgaacaaccccaccagacagcctttggccctaaacgttgcatacaggcgctgcttgcagattctggctgcaggactgttcctgccaggttcagtgggtatcactgacccctgtgagagtggcaactttagagtacacacagtcatgaccctagaacagcaggacatggtctgctatacagctcagactctcgtccgaatcctctcacatggtggctttaggaagatccttggccaggagggtgatgccagctatcttgcttctgaaatatctacctgggatggagtgatagtaacaccttcagaaaaggcttatgagaagccaccagagaagaaggaaggagaggaagaagaggagaatacagaagaaccacctcaaggagaggaagaagaaagcatggaaactcaggagtgacattcccttcactccttttcctacccaagggggaagactggagcctaagctgcctgctactgggctttacatggtgacagacatttccgtgggatagggaagatagcaggaagaaaagtaaactccatagaagtgtcattccactgggttttgatattggcttagctgccagtctcccatttgtgacctatgccatccatctataatggaggataccaacatttcttcctaatattctataatctccaactcctgaaaacccctctctcaactaatactttgctgttgaaatgttgtgaaatgttaagtgtctggaaatttttttttctaagaaaaactattaaagtacttcctagtaggg

SEQ ID NO: 296197 - DNA, 1874 bp, Homo sapiens
agcggtcttcagttgtctgctactcagaggaaggggcggttggtgcggcctccattgttcgtgttttaaggcgccatgaggggtgacagaggccgtggtcgtggtgggcgctttggttccagaggaggcccaggaggagggttcaggccctttgtaccacatatcccatttgacttctatttgtgtgaaatggcctttccccgggtcaagccagcacctgatgaaacttccttcagtgaggccttgctgaagaggaatcaggacctggctcccaattctgctgaacaggcatctatcctttctctggtgacaaaaataaacaatgtgattgataatctgattgtggctccagggacatttgaagtgcaaattgaagaagttcgacaggtgggatcctataaaaaggggacaatgactacaggacacaatgtggctgacctggtggtgatactcaagattctgccaacgttggaagctgttgctgccctggggaacaaagtcgtggaaagcctaagagcacaggatccttctgaagttttaaccatgctgaccaacgaaactggctttgaaatcagttcttctgatgctacagtgaagattctcattacaacagtgccacccaatcttcgaaaactggatccagaactccatttggatatcaaagtattgcagagtgccttagcagccatccgacatgcccgctggttcgaggaaaatgcttctcagtccacgtgagtccctctctaaccatttggattaagataaactttttaactgcagtgaatagcaggatacccccatacttcctctgacagaactattttgcctgtgacctcgtgtctggatttttatttttaccttaaggaagcaaattaagatttagagaaagcagagaatgtatagttctggaaatagcatagtcagcttcaattctaccttaggcatggaaatacatgatcgtattgattttaatgtttgggtcactattactttcagagttaaagttctcatcagactactgaaggacttgaggattcgttttcctggctttgagcccctcacaccctggatccttgacctactaggccattatgctgtgatgaacaaccccaccagacagcctttggccctaaacgttgcatacaggcgctgcttgcagattctggctgcaggactgttcctgccaggttcagtgggtatcactgacccctgtgagagtggcaactttagagtacacacagtcatgaccctagaacagcaggacatggtctgctatacagctcagactctcgtccgaatcctctcacatggtggctttaggaagatccttggccaggagggtgatgccagctatcttgcttctgaaatatctacctgggatggagtgatagtaacaccttcagaaaaggcttatgagaagccaccagagaagaaggaaggagaggaagaagaggagaatacagaagaaccacctcaaggagaggaagaagaaagcatggaaactcaggagtgacattcccttcactccttttcctacccaagggggaagactggagcctaagctgcctgctactgggctttacatggtgacagacatttccgtgggatagggaagatagcaggaagaaaagtaaactccatagaagtgtcattccactgggttttgatattggcttagctgccagtctcccatttgtgacctatgccatccatctataatggaggataccaacatttcttcctaatattctataatctccaactcctgaaaacccctctctcaactaatactttgctgttgaaatgttgtgaaatgttaagtgtctggaaatttttttttctaagaaaaactattaaagtacttcctagtaggg

SEQ ID NO: 296198 - DNA, 2354 bp, Homo sapiens
agcggtcttcagttgtctgctactcagaggaaggggcggttggtgcggcctccattgttcgtgttttaaggcgccatgaggggtgacagaggccgtggtcgtggtgggcgctttggttccagaggaggcccaggaggagggttcaggccctttgtaccacatatcccatttgacttctatttgtgtgaaatggcctttccccgggtcaagccagcacctgatgaaacttccttcagtgaggccttgctgaagaggaatcaggacctggctcccaattctgctgaacaggcatctatcctttctctggtgacaaaaataaacaatgtgattgataatctgattgtggctccagggacatttgaagtgcaaattgaagaagttcgacaggtgggatcctataaaaaggggacaatgactacaggacacaatgtggctgacctggtggtgatactcaagattctgccaacgttggaagctgttgctgccctggggaacaaagtcgtggaaagcctaagagcacaggatccttctgaagttttaaccatgctgaccaacgaaactggctttgaaatcagttcttctgatgctacagtgaagattctcattacaacagtgccacccaatcttcgaaaactggatccagaactccattgttagttcttttttttccattgctggaaaatttaggggatattcaaaacatggtattgttgctgtttagtttacttagcttgttgctattccacatgcagcttcctgggaattgaagaacttaggtttattctgaactttgctctctccctctgtaatttggaaatagtttatcagcttgctagtggaattttcagatggggtgaccaagaaagcatttggaggacttaaaaaggactgagaaaatatttatggagggggataggcttttgaagaaaacagatcttgcatgtttctagtgatttttagacaagtgatttgctgatatgagaaacacagggtggcttaaagaattgcagagttggtcgggtgcggtggctcacgcctgtaatcccagcactttgggaggctgaggcaggcagatcacctgaggtcaggagttggagaccatcctggccaacatgatgaaaccccgtctctactaaaataaaaaattagtggggcatgatggcggttacctgtaatcccagctactcaggaggctgaggcaggagaattgctcgaacccgggaggcggaggttgcagtgagctgagatcacgccactgtacgcaatccagcctggacaacagagcgagactccgtctatcctgccctccttccaagtttttaagactgtagcagtggtaatgagtagcttgtttaatgaaaatgtttcatcctggcatatcatgcttgtctttttagtggatatcaaagtattgcagagtgccttagcagccatccgacatgcccgctggttcgaggaaaatgcttctcagtccacagttaaagttctcatcagactactgaaggacttgaggattcgttttcctggctttgagcccctcacaccctggatccttgacctactaggccattatgctgtgatgaacaaccccaccagacagcctttggccctaaacgttgcatacaggcgctgcttgcagattctggctgcaggactgttcctgccaggttcagtgggtatcactgacccctgtgagagtggcaactttagagtacacacagtcatgaccctagaacagcaggacatggtctgctatacagctcagactctcgtccgaatcctctcacatggtggctttaggaagatccttggccaggagggtgatgccagctatcttgcttctgaaatatctacctgggatggagtgatagtaacaccttcagaaaaggcttatgagaagccaccagagaagaaggaaggagaggaagaagaggagaatacagaagaaccacctcaaggagaggaagaagaaagcatggaaactcaggagtgacattcccttcactccttttcctacccaagggggaagactggagcctaagctgcctgctactgggctttacatggtgacagacatttccgtgggatagggaagatagcaggaagaaaagtaaactccatagaagtgtcattccactgggttttgatattggcttagctgccagtctcccatttgtgacctatgccatccatctataatggaggataccaacatttcttcctaatattctataatctccaactcctgaaaacccctctctcaactaatactttgctgttgaaatgttgtgaaatgttaagtgtctggaaatttttttttctaagaaaaactattaaagtacttcctagtaggg

SEQ ID NO: 296199 - DNA, 1555 bp, Homo sapiens
agcggtcttcagttgtctgctactcagaggaaggggcggttggtgcggcctccattgttcgtgttttaaggcgccatgaggggtgacagaggccgtggtcgtggtgggcgctttggttccagaggaggcccaggaggagggttcaggccctttgtaccacatatcccatttgacttctatttgtgtgaaatggcctttccccgggtcaagccagcacctgatgaaacttccttcagtgaggccttgctgaagaggaatcaggacctggctcccaattctgctgaacaggcatctatcctttctctggtgacaaaaataaacaatgtgattgataatctgattgtggctccagggacatttgaagtgcaaattgaagaagttcgacaggtgggatcctataaaaaggggacaatgactacaggacacaatgtggctgacctggtggtgatactcaagattctgccaacgttggaagctgttgctgccctggggaacaaagtcgtggaaagcctaagagcacaggatccttctgaagttttaaccatgctgaccaacgaaactggctttgaaatcagttcttctgatgctacagtgaagattctcattacaacagtgccacccaatcttcgaaaactggatccagaactccatttggatatcaaagtattgcagagtgccttagcagccatccgacatgcccgctggttcgaggagattcgttttcctggctttgagcccctcacaccctggatccttgacctactaggccattatgctgtgatgaacaaccccaccagacagcctttggccctaaacgttgcatacaggcgctgcttgcagattctggctgcaggactgttcctgccaggttcagtgggtatcactgacccctgtgagagtggcaactttagagtacacacagtcatgaccctagaacagcaggacatggtctgctatacagctcagactctcgtccgaatcctctcacatggtggctttaggaagatccttggccaggagggtgatgccagctatcttgcttctgaaatatctacctgggatggagtgatagtaacaccttcagaaaaggcttatgagaagccaccagagaagaaggaaggagaggaagaagaggagaatacagaagaaccacctcaaggagaggaagaagaaagcatggaaactcaggagtgacattcccttcactccttttcctacccaagggggaagactggagcctaagctgcctgctactgggctttacatggtgacagacatttccgtgggatagggaagatagcaggaagaaaagtaaactccatagaagtgtcattccactgggttttgatattggcttagctgccagtctcccatttgtgacctatgccatccatctataatggaggataccaacatttcttcctaatattctataatctccaactcctgaaaacccctctctcaactaatactttgctgttgaaatgttgtgaaatgttaagtgtctggaaatttttttttctaagaaaaactattaaagtacttcctagtaggg

SEQ ID NO: 296200 - DNA, 1045 bp, Homo sapiens
atccagaactccatttggatccagttttcgaagattgggtggcactgttgtaatgagaatcttcgaaaactggatccagaactccatttggatatcaaagtattgcagagtgccttagcagccatccgacatgcccgctggttcgaggaaaatgcttctcagtccacagttaaagttctcatcagactactgaaggacttgaggattcgttttcctggctttgagcccctcacaccctggatccttgacctactaggccattatgctgtgatgaacaaccccaccagacagcctttggccctaaacgttgcatacaggcgctgcttgcagattctggctgcaggactgttcctgccaggttcagtgggtatcactgacccctgtgagagtggcaactttagagtacacacagtcatgaccctagaacagcaggacatggtctgctatacagctcagactctcgtccgaatcctctcacatggtggctttaggaagatccttggccaggagggtgatgccagctatcttgcttctgaaatatctacctgggatggagtgatagtaacaccttcagaaaaggcttatgagaagccaccagagaagaaggaaggagaggaagaagaggagaatacagaagaaccacctcaaggagaggaagaagaaagcatggaaactcaggagtgacattcccttcactccttttcctacccaagggggaagactggagcctaagctgcctgctactgggctttacatggtgacagacatttccgtgggatagggaagatagcaggaagaaaagtaaactccatagaagtgtcattccactgggttttgatattggcttagctgccagtctcccatttgtgacctatgccatccatctataatggaggataccaacatttcttcctaatattctataatctccaactcctgaaaacccctctctcaactaatactttgctgttgaaatgttgtgaaatgttaagtgtctggaaatttttttttctaagaaaaactattaaagtacttcctagtaggg

SEQ ID NO: 296201 - DNA, 961 bp, Homo sapiens
cttaggctaggtacgaggctgggtgttaacttagcagccatccgacatgcccgctggttcgaggaaaatgcttctcagtccacagttaaagttctcatcagactactgaaggacttgaggattcgttttcctggctttgagcccctcacaccctggatccttgacctactaggccattatgctgtgatgaacaaccccaccagacagcctttggccctaaacgttgcatacaggcgctgcttgcagattctggctgcaggactgttcctgccaggttcagtgggtatcactgacccctgtgagagtggcaactttagagtacacacagtcatgaccctagaacagcaggacatggtctgctatacagctcagactctcgtccgaatcctctcacatggtggctttaggaagatccttggccaggagggtgatgccagctatcttgcttctgaaatatctacctgggatggagtgatagtaacaccttcagaaaaggcttatgagaagccaccagagaagaaggaaggagaggaagaagaggagaatacagaagaaccacctcaaggagaggaagaagaaagcatggaaactcaggagtgacattcccttcactccttttcctacccaagggggaagactggagcctaagctgcctgctactgggctttacatggtgacagacatttccgtgggatagggaagatagcaggaagaaaagtaaactccatagaagtgtcattccactgggttttgatattggcttagctgccagtctcccatttgtgacctatgccatccatctataatggaggataccaacatttcttcctaatattctataatctccaactcctgaaaacccctctctcaactaatactttgctgttgaaatgttgtgaaatgttaagtgtctggaaatttttttttctaagaaaaactattaaagtacttcctagtaggg

SEQ ID NO: 296202 - DNA, 1324 bp, Homo sapiens
agcggtcttcagttgtctgctactcagaggaaggggcggttggtgcggcctccattgttcgtgttttaaggcgccatgaggggtgacagaggccgtggtcgtggtgggcgctttggttccagaggaggcccaggaggagggttcaggccctttgtaccacatatcccatttgacttctatttgtgtgaaatggcctttccccgggtcaagccagcacctgatgaaacttccttcagtgaggccttgctgaagaggaatcaggacctggctcccaattctgctgaacaggcatctatcctttctctggtgacaaaaataaacaatgtgattgataatctgattgtggctccagggacatttgaagtgcaaattgaagaagttcgacaggtgggatcctataaaaaggggacaatgactacaggacacaatgtggctgacctggtggtgatactcaagattctgccaacgttggaagctgttgctgccctggggaacaaagtcgtggaaagcctaagagcacaggatccttctgaaggccattatgctgtgatgaacaaccccaccagacagcctttggccctaaacgttgcatacaggcgctgcttgcagattctggctgcaggactgttcctgccaggttcagtgggtatcactgacccctgtgagagtggcaactttagagtacacacagtcatgaccctagaacagcaggacatggtctgctatacagctcagactctcgtccgaatcctctcacatggtggctttaggaagatccttggccaggagggtgatgccagctatcttgcttctgaaatatctacctgggatggagtgatagtaacaccttcagaaaaggcttatgagaagccaccagagaagaaggaaggagaggaagaagaggagaatacagaagaaccacctcaaggagaggaagaagaaagcatggaaactcaggagtgacattcccttcactccttttcctacccaagggggaagactggagcctaagctgcctgctactgggctttacatggtgacagacatttccgtgggatagggaagatagcaggaagaaaagtaaactccatagaagtgtcattccactgggttttgatattggcttagctgccagtctcccatttgtgacctatgccatccatctataatggaggataccaacatttcttcctaatattctataatctccaactcctgaaaacccctctctcaactaatactttgctgttgaaatgttgtgaaatgttaagtgtctggaaatttttttttctaagaaaaactattaaagtacttcctagtaggg

SEQ ID NO: 296203 - DNA, 770 bp, Homo sapiens
gtacccccgtccgatggcccatgggctaaacgttgcatacaggcgctgcttgcagattctggctgcaggactgttcctgccaggttcagtgggtatcactgacccctgtgagagtggcaactttagagtacacacagtcatgaccctagaacagcaggacatggtctgctatacagctcagactctcgtccgaatcctctcacatggtggctttaggaagatccttggccaggagggtgatgccagctatcttgcttctgaaatatctacctgggatggagtgatagtaacaccttcagaaaaggcttatgagaagccaccagagaagaaggaaggagaggaagaagaggagaatacagaagaaccacctcaaggagaggaagaagaaagcatggaaactcaggagtgacattcccttcactccttttcctacccaagggggaagactggagcctaagctgcctgctactgggctttacatggtgacagacatttccgtgggatagggaagatagcaggaagaaaagtaaactccatagaagtgtcattccactgggttttgatattggcttagctgccagtctcccatttgtgacctatgccatccatctataatggaggataccaacatttcttcctaatattctataatctccaactcctgaaaacccctctctcaactaatactttgctgttgaaatgttgtgaaatgttaagtgtctggaaatttttttttctaagaaaaactattaaagtacttcctagtaggg

SEQ ID NO: 296204 - DNA, 1141 bp, Homo sapiens
agaagtgccattttgatggcacacctactggatttattatttttcagggccattatgctgtgatgaacaaccccaccagacagcctttggccctaaacgttgcatacaggtacagcatgctttgggtttagggttggttgtaaactattttgtgcattcctttaatacctcatacctccctgtgttctaggcgctgcttgcagattctggctgcaggactgttcctgccaggttcagtgggtatcactgacccctgtgagagtggcaactttagagtacacacagtcatgaccctagaacagcaggtattgggacagatatgaactgagttgttttgccccactcttttgaatactgctgctcagcaggcaaagtggaatatggtctttacgggtcaggaatttggggattctgaaagactttggtcctgagatttaaaaagctgtcttaatctctgttttcagaagggtattactcaaataaggtcctttgattttccttgcttactctcactttgctttccttcaggacatggtctgctatacagctcagactctcgtccgaatcctctcacatggtggctttaggaagatccttggccaggagggtgatgccagctatcttgcttctgaaatatctacctgggatggagtgatagtaacaccttcagaaaaggcttatgagaagccaccagagaagaaggaaggagaggaagaagaggagaatacagaagaaccacctcaaggagaggaagaagaaagcatggaaactcaggagtgacattcccttcactccttttcctacccaagggggaagactggagcctaagctgcctgctactgggctttacatggtgacagacatttccgtgggatagggaagatagcaggaagaaaagtaaactccatagaagtgtcattccactgggttttgatattggcttagctgccagtctcccatttgtgacctatgccatccatctataatggaggataccaacatttcttcctaatattctataatctccaactcctgaaaacccctctctcaactaatactttgctgttgaaatgttgtgaaatgttaagtgtctggaaatttttttttctaagaaaaactattaaagtacttcctagtaggg

SEQ ID NO: 296205 - DNA, 885 bp, Homo sapiens
agcggtcttcagttgtctgctactcagaggaaggggcggttggtgcggcctccattgttcgtgttttaaggcgccatgaggggtgacagaggccgtggtcgtggtgggcgctttggttccagaggaggcccaggaggagggttcaggccctttgtaccacatatcccatttgacttctatttgtgtgaaatggcctttccccgggtcaagccagcacctgatgaaacttccttcagtgaggccttgctgaagaggaatcaggacctggctcccaattctgctgaacaggcatctatcctttctctggtgacaaaaataaacaatgtgattgataatctgattgtggctccagggacatttgaagtgcaaattgaagaagttcgacaggtgggatcctataaaaaggggacaatgactacaggacacaatgtggctgacctggtggtgatactcaagattctgccaacgttggaagctgttgctgccctggggaacaaagtcgtggaaagcctaagagcacaggatccttctgaagttttaaccatgctgaccaacgaaactggctttgaaatcagttcttctgatgctacagtgaagattctcattacaacagtgccacccaatcttcgaaaactggatccagaactccatttggatatcaaagtattgcagagtgccttagcagccatccgacatgcccgctggttcgaggaaaatgcttctcagtccacagttaaagttctcatcagactactgaaggacttgaggattcgttttcctggctttgagcccctcacaccctggatccttgacctactaggccgttatgctgtgatgaacaaccccgcacactgatacaaccccgaacgcggatagaagtccgag

SEQ ID NO: 296206 - DNA, 1439 bp, Homo sapiens
agcggtcttcagttgtctgctactcagaggaaggggcggttggtgcggcctccattgttcgtgttttaaggcgccatgaggggtgacagaggccgtggtcgtggtgggcgctttggttccagaggaggcccaggaggagggttcaggccctttgtaccacatatcccatttgacttctatttgtgtgaaatggcctttccccgggtcaagccagcacctgatgaaacttccttcagtgaggccttgctgaagaggaatcaggacctggctcccaattctgctgaacaggcatctatcctttctctggtgacaaaaataaacaatgtgattgataatctgattgtggctccagggacatttgaagtgcaaattgaagaagttcgacaggtgggatcctataaaaaggggacaatgactacaggacacaatgtggctgacctggtggtgatactcaagattctgccaacgttggaagctgttgctgccctggggaacaaagtcgtggaaagcctaagagcacaggatccttctgaagttttaaccatgctgaccaacgaaactggctttgaaatcagttcttctgatgctacagtgaagattctcattacaacagtgccacccaatcttcgaaaactggatccagaactccatttggatatcaaagtattgcagagtgccttagcagccatccgacatgcccgctggttcgaggaaaatgcttctcagtccacagttaaagttctcatcagactactgaaggacttgaggattcgttttcctggctttgagcccctcacaccctggatccttgacctactagtaagtaaagatgggcaattggagttcctcatcatccttatttactagtagtagtagtagtagtagtagtagtagtagtagtagtaactctgaaattcaccagagtctgaaatttggtgaagcttaaaagaaattttattggtagacaagtaatccaataaaaattcaacatttacatgactcagagacatttgtttaaaaaaaaagaaaaaattcaaagtttttttttttttttgtatattcaatgaaatgagtagttactgagttatagtgtcccgttttcttctcatgactgctaccatttaatcatggtagtagagagaaatgagtgagcagccatttcagaattgcttctgaacatgaaaattttggctagacttagaccttaatgaccagttttcctcgtgatcatttaaggttttagtttgatgcctgtaatcccagcactttgggaggctgaggccagaggatcacttgaagccaggagtttgagaccagcctgggcaaaatagcgagactctgtctctacaagagaaaaaaaaagagtcaggagggttgcttgagcccaggagttcgcggttacagtgaactatgattgcgccactgcactccagcctgga

SEQ ID NO: 296207 - DNA, 842 bp, Homo sapiens
agcggtcttcagttgtctgctactcagaggaaggggcggttggtgcggcctccattgttcgtgttttaaggcgccatgaggggtgacagaggccgtggtcgtggtgggcgctttggttccagaggaggcccaggaggagggttcaggccctttgtaccacatatcccatttgacttctatttgtgtgaaatggcctttccccgggtcaagccagcacctgatgaaacttccttcagtgaggccttgctgaagaggaatcaggacctggctcccaattctgctgaacaggcatctatcctttctctggtgacaaaaataaacaatgtgattgataatctgattgtggctccagggacatttgaagtgcaaattgaagaagttcgacaggtgggatcctataaaaaggggacaatgactacaggacacaatgtggctgacctggtggtgatactcaagattctgccaacgttggaagctgttgctgccctggggaacaaagtcgtggaaagcctaagagcacaggatccttctgaagttttaaccatgctgaccaacgaaactggctttgaaatcagttcttctgatgctacagtgaagattctcattacaacagtgccacccaatcttcgaaaactggatccagaactccatttggatatcaaagtattgcagagtgccttagcagccatccgacatgcccgctggttcgaggaaaatgcttctcagtccacagttaaagttctcatcagactactgaaggacttgaggattcgttttcctggctttgagcccctcacaccctggatccttgacctactagtcaagccagcaccaccaataca

SEQ ID NO: 296208 - DNA, 2184 bp, Homo sapiens
agcggtcttcagttgtctgctactcagaggaaggggcggttggtgcggcctccattgttcgtgttttaaggcgccatgaggggtgacagaggccgtggtcgtggtgggcgctttggttccagaggaggcccaggaggagggttcaggccctttgtaccacatatcccatttgacttctatttgtgtgaaatggcctttccccgggtcaagccagcacctgatgaaacttccttcagtgaggccttgctgaagaggaatcaggacctggctcccaattctgctgaacaggcatctatcctttctctggtgacaaaaataaacaatgtgattgataatctgattgtggctccagggacatttgaagtgcaaattgaagaagttcgacaggtgggatcctataaaaaggggacaatgactacaggacacaatgtggctgacctggtggtgatactcaagattctgccaacgttggaagctgttgctgccctggggaacaaagtcgtggaaagcctaagagcacaggatccttctgaagttttaaccatgctgaccaacgaaactggctttgaaatcagttcttctgatgctacagtgaagattctcattacaacagtgccacccaatcttcgaaaactggatccagaactccattgttagttcttttttttccattgctggaaaatttaggggatattcaaaacatggtattgttgctgtttagtttacttagcttgttgctattccacatgcagcttcctgggaattgaagaacttaggtttattctgaactttgctctctccctctgtaatttggaaatagtttatcagcttgctagtggaattttcagatggggtgaccaagaaagcatttggaggacttaaaaaggactgagaaaatatttatggagggggataggcttttgaagaaaacagatcttgcatgtttctagtgatttttagacaagtgatttgctgatatgagaaacacagggtggcttaaagaattgcagagttggtcgggtgcggtggctcacgcctgtaatcccagcactttgggaggctgaggcaggcagatcacctgaggtcaggagttggagaccatcctggccaacatgatgaaaccccgtctctactaaaataaaaaattagtggggcatgatggcggttacctgtaatcccagctactcaggaggctgaggcaggagaattgctcgaacccgggaggcggaggttgcagtgagctgagatcacgccactgtacgcaatccagcctggacaacagagcgagactccgtctatcctgccctccttccaagtttttaagactgtagcagtggtaatgagtagcttgtttaatgaaaatgtttcatcctggcatatcatgcttgtctttttagtggatatcaaagtattgcagagtgccttagcagccatccgacatgcccgctggttcgaggaaaatgcttctcagtccacagttaaagttctcatcagactactgaaggacttgaggattcgttttcctggctttgagcccctcacaccctggatccttgacctactagtaagtaaagatgggcaattggagttcctcatcatccttatttactagtagtagtagtagtagtagtagtagtagtagtagtagtaactctgaaattcaccagagtctgaaatttggtgaagcttaaaagaaattttattggtagacaagtaatccaataaaaattcaacatttacatgactcagagacatttgtttaaaaaaaaagaaaaaattcaaagtttttttttttttttgtatattcaatgaaatgagtagttactgagttatagtgtcccgttttcttctcatgactgctaccatttaatcatggtagtagagagaaatgagtgagcagccatttcagaattgcttctgaacatgaaaattttggctagacttagaccttaatgaccagttttcctcgtgatcatttaaggttttagtttgatgcctgtaatcccagcactttgggaggctgaggccagaggatcacttgaagccaggagtttgagaccagcctgggcaaaatagcgagactctgtctctacaagagaaaaaaaaagagtcaggagggttgcttgagcccaggagttcgcggttacagtgaactatgattgcgccactgcactccagcctgga

SEQ ID NO: 296209 - DNA, 336 bp, Homo sapiens
ccagaggatcacttgaagccaggagtttgagaccagcctgggcaaaatagcgagactctgtctctacaagagaaaaaaaaaaaaattagccagttgtagtggcttgaacttatagtcctagcttctcaggaggctgagtcaggagggttgcttgagcccaggagttcgcggttacagtgaactatgattgcgccactgcactccagcctggatgacaaagtgaggccctgtctctaaaaaataaagttctagttatcagaagtgccattttgatggcacacctactggatttattatttttcagggccattatgctgtgatgaacaaccccaccag

SEQ ID NO: 296210 - DNA, 529 bp, Homo sapiens
ccggctagcccgacagttggggtgtggtggccttggtatgtgcgttctcgtgttacatcgcgccatcgttggtatatggttagtttgttggttagttaggcctagtatgaggagcgttatggagtggaagtgaaatcacatggctaggccggaggtcattaggagggctgagagggcccctgttaggggtcatgggctgggtcttgtgggtggaaacgcgctggctgactggggtcggcgtttagttcagcgcagcgactcggggacctggagctgacgcctagacacttgtattagctttaatagaagagaaatggaggagccatagaatattaaggatgaattcaggaaggcctgagaccatggaaaacttgcctgctctctacactattttccaaggagaggttgctatggtgacagactatggggcctttatcaaaatcccaggctgtcggaagcaagtctgtccatcgactcatatgtcatcctgtcggctagtcgggggtccgagctcgatctaatcatgtct

SEQ ID NO: 296211 - DNA, 1809 bp, Homo sapiens
ccggctagcccgacagttggggtgtggtggccttggtatgtgcgttctcgtgttacatcgcgccatcgttggtatatggttagtttgttggttagttaggcctagtatgaggagcgttatggagtggaagtgaaatcacatggctaggccggaggtcattaggagggctgagagggcccctgttaggggtcatgggctgggtcttgtgggtggaaacgcgctggctgactggggtcggcgtttagttcagcgcagcgactcggggacctggagctgacgcctagacacttgtattagctttaatagaagagaaatggaggagccatagaatattaaggatgaattcaggaaggcctgagaccatggaaaacttgcctgctctctacactattttccaaggagaggttgctatggtgacagactatggggcctttatcaaaatcccaggctgtcggaagcaaggtctggtccatcgaactcatatgtcatcctgtcgggtggataagccctctgagatagtagatgttggagataaagtgtgggtgaagcttattggccgagagatgaaaaatgatagaataaaagtatccctctccatgaaggttgtcaatcaagggactgggaaagaccttgatcccaacaatgttatcattgagcaagaagagaggcggaggcgatccttccaggattacactgggcagaagatcacccttgaggctgtcttgaacactacctgcaagaagtgtggctgtaaaggccactttgcaaaagattgtttcatgcaaccaggtgggactaaatactctctgatacctgatgaggaagaggaaaaggaagaggcaaagtcagcagagtttgagaagcctgaccctacaaggaatccttctagaaaaagaaagaaggagaagaagaaaaagaaacatagagataggaagtcatctgactctgacagctcagactctgagagtgatacaggcaagagggcaaggcacacatcaaaagacagcaaggcagcaaagaagaagaaaaagaagaagaagcacaagaagaagcacaaggagtgagagtataaagagtgtagggggtggttgagagtaagaaaccaggagccttgtgccttgagactcctggaaagactcaatagtgagaatatagcctcccaccccattaacttcgctcccatgggagatggcttcccctcatgcaacaggcaggtttgggagttagaggtcaaaagcagctgcctgaatgagttgttgtttccttatcactcctggtccctttgcaagtgaaccctgcagctcacccattcattcacccaacttccttcattcagcaggaggccctattaccctctccagctgccactgccagagctggattcctgtaaaggagtccaggctagagccacagagactgttgtggaggtgagttcggctgtagttagagtgattggacccttcctattggtctgtcctgggccaactggtgggtgatctctgctgcatccaacatgggagcagagactggcagcaggaggggggaacatggtgagaagtggtgctcacttttcccattcctcctaacatagttctactatgctagaagtggcatccagcggccacagctagaaaacagtctgcagtgtgacttaacttgtgtattgcattccagcagaccactgaaccagacagcgaagccaagatcattgttctactttgtatttactactgtgtgaatcagttgattctacttcaggtccttgcttaaattcctgtcactaaatggaaatgtgtttggttttaaact

SEQ ID NO: 296212 - DNA, 1928 bp, Homo sapiens
ccggctagcccgacagttggggtgtggtggccttggtatgtgcgttctcgtgttacatcgcgccatcgttggtatatggttagtttgttggttagttaggcctagtatgaggagcgttatggagtggaagtgaaatcacatggctaggccggaggtcattaggagggctgagagggcccctgttaggggtcatgggctgggtcttgtgggtggaaacgcgctggctgactggggtcggcgtttagttcagcgcagcgactcggggacctggagctgacgcctagacacttgtattagctttaatagaagagaaatggaggagccatagaatattaaggatgaattcaggaaggcctgagaccatggaaaacttgcctgctctctacactattttccaaggagaggttgctatggtgacagactatggggcctttatcaaaatcccaggctgtcggaagcaaggtctggtccatcgaactcatatgtcatcctgtcgggtggataagccctctgagatagtagatgttggagataaagtgtgggtgaagcttattggccgagagatgaaaaatgatagaataaaagtatccctctccatgaaggttgtcaatcaagggactgggaaagaccttgatcccaacaatgttatcattgagcaagaagagaggcggaggcgatccttccaggattacactgggcagaagatcacccttgaggctgtcttgaacactacctgcaagaagtgtggctgtaaaggccactttgcaaaagattgtttcatgcaaccaggtgggactaaatactctctgatacctgatgaggaagaggaaaaggaagaggcaaagtcagcagagtttgagaagcctgaccctacaaggaatccttctagaaaaagaaagaaggagaagaagaaaaagaaacatagagataggaagtcatctgactctgacagctcagactctgagagtgatacaggcaagagggcaaggcacacatcaaaagacagcaaggcagcaaagaagaagaaaaagaagaagaagcacaagaagaagcacaaggagtgagagtataaagagtgtagggggtggttgagagtaagaaaccaggagccttgtgccttgagactcctggaaagactcaatagtgagaatatagcctcccaccccattaacttcgctcccatgggagatggcttcccctcatgcaacaggcaggtttgggagttagaggtcaaaagcagctgcctgaatgagttgttgtttccttatcactcctggtccctttgcaagtgaaccctgcagctcacccattcattcacccaacttccttcattcagcaggaggccctattaccctctccagctgccactgccagagctggattcctgtaaaggagtccaggctagagccacagagactgttgtggaggtgagttcggctgtagttagagtgattggacccttcctattggtctgtcctgggccaactggtgggtgatctctgctgcatccaacatgggagcagagactggcagcaggaggggggaacatggtgagaagtggtgctcacttttcccattcctcctaacatagttctactatgctagaagtggcatccagcggccacagctagaaaacagtctgcagtgtgacttaacttgtgtattgcattccagcagaccactgaaccagacagcgaagccaagatcattgttctactttgtatttactactgtgtgaatcagttgattctacttcaggtccttgcttaaattcctgtcactaaatggaaatgtgtttggttttaaacttactgagttatttttcctataatccttcttcctgggtaacttacagacttaaagtcactgagcctgcattagctgacaaaaacatttaatatgttaccttagaccttggagagatgccc

SEQ ID NO: 296213 - DNA, 1784 bp, Homo sapiens
ccggctagcccgacagttggggtgtggtggccttggtatgtgcgttctcgtgttacatcgcgccatcgttggtatatggttagtttgttggttagttaggcctagtatgaggagcgttatggagtggaagtgaaatcacatggctaggccggaggtcattaggagggctgagagggcccctgttaggggtcatgggctgggtcttgtgggtggaaacgcgctggctgactggggtcggcgtttagttcagcgcagcgactcggggacctggagctgacgcctagacacttgtattagctttaatagaagagaaatggaggagccatagaatattaaggatgaattcaggaaggcctgagaccatggaaaacttgcctgctctctacactattttccaaggagaggttgctatggtgacagactatggggcctttatcaaaatcccaggctgtcggaagcaaggtctggtccatcgaactcatatgtcatcctgtcgggtggataagccctctgagatagtagatgttggagataaagtgtgggtgaagcttattggccgagagatgaaaaatgatagaataaaagtatccctctccatgaaggttgtcaatcaagggactgggaaagaccttgatcccaacaatgttatcattgagcaagaagagaggcggaggcgatccttccaggattacactgggcagaagatcacccttgaggctgtcttgaacactacctgcaagaagtgtggctgtaaaggccactttgcaaaagattgtttcatgcaaccaggtgggactaaatactctctgatacctgatgaggaagaggaaaaggaagaggcaaagtcagcagagtttgagaagcctgaccctacaaggaatccttctagaaaaagaaagaaggagaagaagaaaaagaaacatagagataggaagtcatctgactctgacagctcagactctgagagtgatacaggcaagagggcaaggcacacatcaaaagacagcaaggcagcaaagaagaagaaaaagaagaagaagcacaagaagaagcacaaggagtgagagtataaagagtgtagggggtggttgagagtaagaaaccaggagccttgtgccttgagactcctggaaagactcaatagtgagaatatagcctcccaccccattaacttcgctcccatgggagatggcttcccctcatgcaacaggcaggtttgggagttagaggtcaaaagcagctgcctgaatgagttgttgtttccttatcactcctggtccctttgcaagtgaaccctgcagctcacccattcattcacccaacttccttcattcagcaggaggccctattaccctctccagctgccactgccagagctggattcctgtaaaggagtccaggctagagccacagagactgttgtggaggtgagttcggctgtagttagagtgattggacccttcctattggtctgtcctgggccaactggtgggtgatctctgctgcatccaacatgggagcagagactggcagcaggaggggggaacatggtgagaagtggtgctcacttttcccattcctcctaacatagttccctatcgtcattaccggcatctcctgccctcattcgagtagacagtcttttattgttcagaatgtgtgcattgcagtcaatttgaccactgggacatccagcggaacccacataaacggaatactgtgttgttattactgagacaaaccatggaattaccattggtcttaaattaaactcccgtcaatta

SEQ ID NO: 296214 - DNA, 1948 bp, Homo sapiens
  misc_feature (285)..(285): n is a, c, g, or t
  misc_feature (289)..(289): n is a, c, g, or t
ccggctagcccgacagttggggtgtggtggccttggtatgtgcgttctcgtgttacatcgcgccatcgttggtatatggttagtttgttggttagttaggcctagtatgaggagcgttatggagtggaagtgaaatcacatggctaggccggaggtcattaggagggctgagagggcccctgttaggggtcatgggctgggtcttgtgggtggaaacgcgctggctgactggggtcggcgtttagttcagcgcagcgactcggggacctggagctgacgcctagnacgngacgaggaagaacggggtgggtggctgcctgagtctggaggcgacgcctcggttgtgcagtctgaacctgcccttctcagctgagggtgctgacagcaaggggtgggaggcgggccccgagtccccagctgtggacacttgtattagctttaatagaagagaaatggaggagccatagaatattaaggatgaattcaggaaggcctgagaccatggaaaacttgcctgctctctacactattttccaaggagaggttgctatggtgacagactatggggcctttatcaaaatcccaggctgtcggaagcaaggtctggtccatcgaactcatatgtcatcctgtcgggtggataagccctctgagatagtagatgttggagataaagtgtgggtgaagcttattggccgagagatgaaaaatgatagaataaaagtatccctctccatgaaggttgtcaatcaagggactgggaaagaccttgatcccaacaatgttatcattgagcaagaagagaggcggaggcgatccttccaggattacactgggcagaagatcacccttgaggctgtcttgaacactacctgcaagaagtgtggctgtaaaggccactttgcaaaagattgtttcatgcaaccaggtgggactaaatactctctgatacctgatgaggaagaggaaaaggaagaggcaaagtcagcagagtttgagaagcctgaccctacaaggaatccttctagaaaaagaaagaaggagaagaagaaaaagaaacatagagataggaagtcatctgactctgacagctcagactctgagagtgatacaggcaagagggcaaggcacacatcaaaagacagcaaggcagcaaagaagaagaaaaagaagaagaagcacaagaagaagcacaaggagtgagagtataaagagtgtagggggtggttgagagtaagaaaccaggagccttgtgccttgagactcctggaaagactcaatagtgagaatatagcctcccaccccattaacttcgctcccatgggagatggcttcccctcatgcaacaggcaggtttgggagttagaggtcaaaagcagctgcctgaatgagttgttgtttccttatcactcctggtccctttgcaagtgaaccctgcagctcacccattcattcacccaacttccttcattcagcaggaggccctattaccctctccagctgccactgccagagctggattcctgtaaaggagtccaggctagagccacagagactgttgtggaggtgagttcggctgtagttagagtgattggacccttcctattggtctgtcctgggccaactggtgggtgatctctgctgcatccaacatgggagcagagactggcagcaggaggggggaacatggtgagaagtggtgctcacttttcccattcctcctaacatagttctactatgctagaagtggcatccagcggccacagctagaaaacagtctgcagtgtgacttaacttgtgtattgcattccagcagaccactgaaccagacagcgaagccaagatcattgttctactttgtatttactactgtgtgaatcagttgattctacttcaggtccttgcttaaattcctgtcactaaatggaaatgtgtttggttttaaact

SEQ ID NO: 296215 - DNA, 1699 bp, Homo sapiens
cgacagcaatgtcagcaaagaagaagaaaaagaagaagaagcacaagaagaagcacaaggagtgagagtataaagagtgtagggggtggttgagagtaagaaaccaggagccttgtgccttgagactcctggaaagactcaatagtgaggcgggccccgagtccccagctgtggacacttgtattagctttaatagaagagaaatggaggagccatagaatattaaggatgaattcaggaaggcctgagaccatggaaaacttgcctgctctctacactattttccaaggagaggttgctatggtgacagactatggggcctttatcaaaatcccaggctgtcggaagcaaggtctggtccatcgaactcatatgtcatcctgtcgggtggataagccctctgagatagtagatgttggagataaagtgtgggtgaagcttattggccgagagatgaaaaatgatagaataaaagtatccctctccatgaaggttgtcaatcaagggactgggaaagaccttgatcccaacaatgttatcattgagcaagaagagaggcggaggcgatccttccaggattacactgggcagaagatcacccttgaggctgtcttgaacactacctgcaagaagtgtggctgtaaaggccactttgcaaaagattgtttcatgcaaccaggtgggactaaatactctctgatacctgatgaggaagaggaaaaggaagaggcaaagtcagcagagtttgagaagcctgaccctacaaggaatccttctagaaaaagaaagaaggagaagaagaaaaagaaacatagagataggaagtcatctgactctgacagctcagactctgagagtgatacaggcaagagggcaaggcacacatcaaaagacagcaaggcagcaaagaagaagaaaaagaagaagaagcacaagaagaagcacaaggagtgagagtataaagagtgtagggggtggttgagagtaagaaaccaggagccttgtgccttgagactcctggaaagactcaatagtgagaatatagcctcccaccccattaacttcgctcccatgggagatggcttcccctcatgcaacaggcaggtttgggagttagaggtcaaaagcagctgcctgaatgagttgttgtttccttatcactcctggtccctttgcaagtgaaccctgcagctcacccattcattcacccaacttccttcattcagcaggaggccctattaccctctccagctgccactgccagagctggattcctgtaaaggagtccaggctagagccacagagactgttgtggaggtgagttcggctgtagttagagtgattggacccttcctattggtctgtcctgggccaactggtgggtgatctctgctgcatccaacatgggagcagagactggcagcaggaggggggaacatggtgagaagtggtgctcacttttcccattcctcctaacatagttctactatgctagaagtggcatccagcggccacagctagaaaacagtctgcagtgtgacttaacttgtgtattgcattccagcagaccactgaaccagacagcgaagccaagatcattgttctactttgtatttactactgtgtgaatcagttgattctacttcaggtccttgcttaaattcctgtcactaaatggaaatgtgtttggttttaaact

SEQ ID NO: 296216 - DNA, 1827 bp, Homo sapiens
  misc_feature (285)..(285): n is a, c, g, or t
  misc_feature (289)..(289): n is a, c, g, or t
ccggctagcccgacagttggggtgtggtggccttggtatgtgcgttctcgtgttacatcgcgccatcgttggtatatggttagtttgttggttagttaggcctagtatgaggagcgttatggagtggaagtgaaatcacatggctaggccggaggtcattaggagggctgagagggcccctgttaggggtcatgggctgggtcttgtgggtggaaacgcgctggctgactggggtcggcgtttagttcagcgcagcgactcggggacctggagctgacgcctagnacgngacgaggaagaacggggtgggtggctgcctgagtctggaggcgacgcctcggttgtgcagtctgaacctgcccttctcagctgagggtgctgacagcaaggggtgggaggcgggccccgagtccccagctgtggttgctatggtgacagactatggggcctttatcaaaatcccaggctgtcggaagcaaggtctggtccatcgaactcatatgtcatcctgtcgggtggataagccctctgagatagtagatgttggagataaagtgtgggtgaagcttattggccgagagatgaaaaatgatagaataaaagtatccctctccatgaaggttgtcaatcaagggactgggaaagaccttgatcccaacaatgttatcattgagcaagaagagaggcggaggcgatccttccaggattacactgggcagaagatcacccttgaggctgtcttgaacactacctgcaagaagtgtggctgtaaaggccactttgcaaaagattgtttcatgcaaccaggtgggactaaatactctctgatacctgatgaggaagaggaaaaggaagaggcaaagtcagcagagtttgagaagcctgaccctacaaggaatccttctagaaaaagaaagaaggagaagaagaaaaagaaacatagagataggaagtcatctgactctgacagctcagactctgagagtgatacaggcaagagggcaaggcacacatcaaaagacagcaaggcagcaaagaagaagaaaaagaagaagaagcacaagaagaagcacaaggagtgagagtataaagagtgtagggggtggttgagagtaagaaaccaggagccttgtgccttgagactcctggaaagactcaatagtgagaatatagcctcccaccccattaacttcgctcccatgggagatggcttcccctcatgcaacaggcaggtttgggagttagaggtcaaaagcagctgcctgaatgagttgttgtttccttatcactcctggtccctttgcaagtgaaccctgcagctcacccattcattcacccaacttccttcattcagcaggaggccctattaccctctccagctgccactgccagagctggattcctgtaaaggagtccaggctagagccacagagactgttgtggaggtgagttcggctgtagttagagtgattggacccttcctattggtctgtcctgggccaactggtgggtgatctctgctgcatccaacatgggagcagagactggcagcaggaggggggaacatggtgagaagtggtgctcacttttcccattcctcctaacatagttctactatgctagaagtggcatccagcggccacagctagaaaacagtctgcagtgtgacttaacttgtgtattgcattccagcagaccactgaaccagacagcgaagccaagatcattgttctactttgtatttactactgtgtgaatcagttgattctacttcaggtccttgcttaaattcctgtcactaaatggaaatgtgtttggttttaaact

SEQ ID NO: 296217 - DNA, 1879 bp, Homo sapiens
ccggctagcccgacagttggggtgtggtggccttggtatgtgcgttctcgtgttacatcgcgccatcgttggtatatggttagtttgttggttagttaggcctagtatgaggagcgttatggagtggaagtgaaatcacatggctaggccggaggtcattaggagggctgagagggcccctgttaggggtcatgggctgggtcttgtgggtggaaacgcgctggctgactggggtcggcgtttagttcagcgcagcgactcggggacctggagctgacgcctagacacttgtattagctttaatagaagagaaatggaggagccatagaatattaaggatgaattcaggaaggcctgagaccatggaaaacttgcctgctctctacactattttccaaggagagttatggtgaagctgaaacagtgctcaagatgaagcagctaattgaagacactgaaaagaataaagtttatgttgctatggtgacagactatggggcctttatcaaaatcccaggctgtcggaagcaaggtctggtccatcgaactcatatgtcatcctgtcgggtggataagccctctgagatagtagatgttggagataaagtgtgggtgaagcttattggccgagagatgaaaaatgatagaataaaagtatccctctccatgaaggttgtcaatcaagggactgggaaagaccttgatcccaacaatgttatcattgagcaagaagagaggcggaggcgatccttccaggattacactgggcagaagatcacccttgaggctgtcttgaacactacctgcaagaagtgtggctgtaaaggccactttgcaaaagattgtttcatgcaaccaggtgggactaaatactctctgatacctgatgaggaagaggaaaaggaagaggcaaagtcagcagagtttgagaagcctgaccctacaaggaatccttctagaaaaagaaagaaggagaagaagaaaaagaaacatagagataggaagtcatctgactctgacagctcagactctgagagtgatacaggcaagagggcaaggcacacatcaaaagacagcaaggcagcaaagaagaagaaaaagaagaagaagcacaagaagaagcacaaggagtgagagtataaagagtgtagggggtggttgagagtaagaaaccaggagccttgtgccttgagactcctggaaagactcaatagtgagaatatagcctcccaccccattaacttcgctcccatgggagatggcttcccctcatgcaacaggcaggtttgggagttagaggtcaaaagcagctgcctgaatgagttgttgtttccttatcactcctggtccctttgcaagtgaaccctgcagctcacccattcattcacccaacttccttcattcagcaggaggccctattaccctctccagctgccactgccagagctggattcctgtaaaggagtccaggctagagccacagagactgttgtggaggtgagttcggctgtagttagagtgattggacccttcctattggtctgtcctgggccaactggtgggtgatctctgctgcatccaacatgggagcagagactggcagcaggaggggggaacatggtgagaagtggtgctcacttttcccattcctcctaacatagttctactatgctagaagtggcatccagcggccacagctagaaaacagtctgcagtgtgacttaacttgtgtattgcattccagcagaccactgaaccagacagcgaagccaagatcattgttctactttgtatttactactgtgtgaatcagttgattctacttcaggtccttgcttaaattcctgtcactaaatggaaatgtgtttggttttaaact

SEQ ID NO: 296218 - DNA, 1717 bp, Homo sapiens
ccggctagcccgacagttggggtgtggtggccttggtatgtgcgttctcgtgttacatcgcgccatcgttggtatatggttagtttgttggttagttaggcctagtatgaggagcgttatggagtggaagtgaaatcacatggctaggccggaggtcattaggagggctgagagggcccctgttaggggtcatgggctgggtcttgtgggtggaaacgcgctggctgactggggtcggcgtttagttcagcgcagcgactcggggacctggagctgacgcctagacacttgtattagctttaatagaagagaaatggaggagccatagaatattaaggatgaattcaggaaggcctgagaccatggaaaacttgcctgctctctacactattttccaaggagaggttgctatggtgacagactatggggcctttatcaaaatcccaggctgtcggaagcaaggtctggtccatcgaactcatatgtcatcctgtcgggtggataagccctctgagatagtagatgttggagataaagtgtgggtgaagcttattggccgagaggcaagaagagaggcggaggcgatccttccaggattacactgggcagaagatcacccttgaggctgtcttgaacactacctgcaagaagtgtggctgtaaaggccactttgcaaaagattgtttcatgcaaccaggtgggactaaatactctctgatacctgatgaggaagaggaaaaggaagaggcaaagtcagcagagtttgagaagcctgaccctacaaggaatccttctagaaaaagaaagaaggagaagaagaaaaagaaacatagagataggaagtcatctgactctgacagctcagactctgagagtgatacaggcaagagggcaaggcacacatcaaaagacagcaaggcagcaaagaagaagaaaaagaagaagaagcacaagaagaagcacaaggagtgagagtataaagagtgtagggggtggttgagagtaagaaaccaggagccttgtgccttgagactcctggaaagactcaatagtgagaatatagcctcccaccccattaacttcgctcccatgggagatggcttcccctcatgcaacaggcaggtttgggagttagaggtcaaaagcagctgcctgaatgagttgttgtttccttatcactcctggtccctttgcaagtgaaccctgcagctcacccattcattcacccaacttccttcattcagcaggaggccctattaccctctccagctgccactgccagagctggattcctgtaaaggagtccaggctagagccacagagactgttgtggaggtgagttcggctgtagttagagtgattggacccttcctattggtctgtcctgggccaactggtgggtgatctctgctgcatccaacatgggagcagagactggcagcaggaggggggaacatggtgagaagtggtgctcacttttcccattcctcctaacatagttctactatgctagaagtggcatccagcggccacagctagaaaacagtctgcagtgtgacttaacttgtgtattgcattccagcagaccactgaaccagacagcgaagccaagatcattgttctactttgtatttactactgtgtgaatcagttgattctacttcaggtccttgcttaaattcctgtcactaaatggaaatgtgtttggttttaaact

SEQ ID NO: 296219 - DNA, 1663 bp, Homo sapiens
ccggctagcccgacagttggggtgtggtggccttggtatgtgcgttctcgtgttacatcgcgccatcgttggtatatggttagtttgttggttagttaggcctagtatgaggagcgttatggagtggaagtgaaatcacatggctaggccggaggtcattaggagggctgagagggcccctgttaggggtcatgggctgggtcttgtgggtggaaacgcgctggctgactggggtcggcgtttagttcagcgcagcgactcggggacctggagctgacgcctagacacttgtattagctttaatagaagagaaatggaggagccatagaatattaaggatgaattcaggaaggcctgagaccatggaaaacttgcctgctctctacactattttccaaggagaggttgctatggtgacagactatggggcctttatcaaaatcccaggctgtcggaagcaaggtctggtccatcgaactcatatgtcatcctgtcgggtggataagccctctgagatagtagatgttggagataaagtgtgggtgaagcttattggccgagagatgaaaaatgatagaataaaagtatccctctccatgaaggttgtcaatcaagggactgggaaagaccttgatcccaacaatgttatcattgagcaagaagagaggcggaggcgatccttccaggattacactgggcagaagatcacccttgaggctgtcttgaacactacctgcaagaagtgtggctgtaaaggagaagaagaaaaagaaacatagagataggaagtcatctgactctgacagctcagactctgagagtgatacaggcaagagggcaaggcacacatcaaaagacagcaaggcagcaaagaagaagaaaaagaagaagaagcacaagaagaagcacaaggagtgagagtataaagagtgtagggggtggttgagagtaagaaaccaggagccttgtgccttgagactcctggaaagactcaatagtgagaatatagcctcccaccccattaacttcgctcccatgggagatggcttcccctcatgcaacaggcaggtttgggagttagaggtcaaaagcagctgcctgaatgagttgttgtttccttatcactcctggtccctttgcaagtgaaccctgcagctcacccattcattcacccaacttccttcattcagcaggaggccctattaccctctccagctgccactgccagagctggattcctgtaaaggagtccaggctagagccacagagactgttgtggaggtgagttcggctgtagttagagtgattggacccttcctattggtctgtcctgggccaactggtgggtgatctctgctgcatccaacatgggagcagagactggcagcaggaggggggaacatggtgagaagtggtgctcacttttcccattcctcctaacatagttctactatgctagaagtggcatccagcggccacagctagaaaacagtctgcagtgtgacttaacttgtgtattgcattccagcagaccactgaaccagacagcgaagccaagatcattgttctactttgtatttactactgtgtgaatcagttgattctacttcaggtccttgcttaaattcctgtcactaaatggaaatgtgtttggttttaaact

SEQ ID NO: 296220 - DNA, 1562 bp, Homo sapiens
ccggctagcccgacagttggggtgtggtggccttggtatgtgcgttctcgtgttacatcgcgccatcgttggtatatggttagtttgttggttagttaggcctagtatgaggagcgttatggagtggaagtgaaatcacatggctaggccggaggtcattaggagggctgagagggcccctgttaggggtcatgggctgggtcttgtgggtggaaacgcgctggctgactggggtcggcgtttagttcagcgcagcgactcggggacctggagctgacgcctagacacttgtattagctttaatagaagagaaatggaggagccatagaatattaaggatgaattcaggaaggcctgagaccatggaaaacttgcctgctctctacactattttccaaggagaggttgctatggtgacagactatggggcctttatcaaaatcccaggctgtcggaagcaaggtctggtccatcgaactcatatgtcatcctgtcgggtggataagccctctgagatagtagatgttggagataaagtgtgggtgaagcttattggccgagagatgaaaaatgatagaataaaagtatccctctccatgaaggttgtcaatcaagggactgggaaagaccttgatcccaacaatgttatcattgagagaagaagaaaaagaaacatagagataggaagtcatctgactctgacagctcagactctgagagtgatacaggcaagagggcaaggcacacatcaaaagacagcaaggcagcaaagaagaagaaaaagaagaagaagcacaagaagaagcacaaggagtgagagtataaagagtgtagggggtggttgagagtaagaaaccaggagccttgtgccttgagactcctggaaagactcaatagtgagaatatagcctcccaccccattaacttcgctcccatgggagatggcttcccctcatgcaacaggcaggtttgggagttagaggtcaaaagcagctgcctgaatgagttgttgtttccttatcactcctggtccctttgcaagtgaaccctgcagctcacccattcattcacccaacttccttcattcagcaggaggccctattaccctctccagctgccactgccagagctggattcctgtaaaggagtccaggctagagccacagagactgttgtggaggtgagttcggctgtagttagagtgattggacccttcctattggtctgtcctgggccaactggtgggtgatctctgctgcatccaacatgggagcagagactggcagcaggaggggggaacatggtgagaagtggtgctcacttttcccattcctcctaacatagttctactatgctagaagtggcatccagcggccacagctagaaaacagtctgcagtgtgacttaacttgtgtattgcattccagcagaccactgaaccagacagcgaagccaagatcattgttctactttgtatttactactgtgtgaatcagttgattctacttcaggtccttgcttaaattcctgtcactaaatggaaatgtgtttggttttaaact

SEQ ID NO: 296221 - DNA, 1733 bp, Homo sapiens
ccggctagcccgacagttggggtgtggtggccttggtatgtgcgttctcgtgttacatcgcgccatcgttggtatatggttagtttgttggttagttaggcctagtatgaggagcgttatggagtggaagtgaaatcacatggctaggccggaggtcattaggagggctgagagggcccctgttaggggtcatgggctgggtcttgtgggtggaaacgcgctggctgactggggtcggcgtttagttcagcgcagcgactcggggacctggagctgacgcctagacacttgtattagctttaatagaagagaaatggaggagccatagaatattaaggatgaattcaggaaggcctgagaccatggaaaacttgcctgctctctacactattttccaaggagagttatggtgaagctgaaacagtgctcaagatgaagcagctaattgaagacactgaaaagaataaagtttatgttgctatggtgacagactatggggcctttatcaaaatcccaggctgtcggaagcaaggtctggtccatcgaactcatatgtcatcctgtcgggtggataagccctctgagatagtagatgttggagataaagtgtgggtgaagcttattggccgagagatgaaaaatgatagaataaaagtatccctctccatgaaggttgtcaatcaagggactgggaaagaccttgatcccaacaatgttatcattgagcaagaagagaggcggaggcgatccttccaggattacactgggcagaagatcacccttgaggctgtcttgaacactacctgcaagaagtgtggctgtaaaggagaagaagaaaaagaaacatagagataggaagtcatctgactctgacagctcagactctgagagtgatacaggcaagagggcaaggcacacatcaaaagacagcaaggcagcaaagaagaagaaaaagaagaagaagcacaagaagaagcacaaggagtgagagtataaagagtgtagggggtggttgagagtaagaaaccaggagccttgtgccttgagactcctggaaagactcaatagtgagaatatagcctcccaccccattaacttcgctcccatgggagatggcttcccctcatgcaacaggcaggtttgggagttagaggtcaaaagcagctgcctgaatgagttgttgtttccttatcactcctggtccctttgcaagtgaaccctgcagctcacccattcattcacccaacttccttcattcagcaggaggccctattaccctctccagctgccactgccagagctggattcctgtaaaggagtccaggctagagccacagagactgttgtggaggtgagttcggctgtagttagagtgattggacccttcctattggtctgtcctgggccaactggtgggtgatctctgctgcatccaacatgggagcagagactggcagcaggaggggggaacatggtgagaagtggtgctcacttttcccattcctcctaacatagttctactatgctagaagtggcatccagcggccacagctagaaaacagtctgcagtgtgacttaacttgtgtattgcattccagcagaccactgaaccagacagcgaagccaagatcattgttctactttgtatttactactgtgtgaatcagttgattctacttcaggtccttgcttaaattcctgtcactaaatggaaatgtgtttggttttaaact

SEQ ID NO: 296222 - DNA, 931 bp, Homo sapiens
tgatttttaaaattttcttttcaggagaagaagaaaaagaaacatagagataggaagtcatctgactctgacagctcagactctgagagtgatacaggcaagagggcaaggcacacatcaaaagacagcaaggcagcaaagaagaagaaaaagaagaagaagcacaagaagaagcacaaggagtgagagtataaagagtgtagggggtggttgagagtaagaaaccaggagccttgtgccttgagactcctggaaagactcaatagtgagaatatagcctcccaccccattaacttcgctcccatgggagatggcttcccctcatgcaacaggcaggtttgggagttagaggtcaaaagcagctgcctgaatgagttgttgtttccttatcactcctggtccctttgcaagtgaaccctgcagctcacccattcattcacccaacttccttcattcagcaggaggccctattaccctctccagctgccactgccagagctggattcctgtaaaggagtccaggctagagccacagagactgttgtggaggtgagttcggctgtagttagagtgattggacccttcctattggtctgtcctgggccaactggtgggtgatctctgctgcatccaacatgggagcagagactggcagcaggaggggggaacatggtgagaagtggtgctcacttttcccattcctcctaacatagttctactatgctagaagtggcatccagcggccacagctagaaaacagtctgcagtgtgacttaacttgtgtattgcattccagcagaccactgaaccagacagcgaagccaagatcattgttctactttgtatttactactgtgtgaatcagttgattctacttcaggtccttgcttaaattcctgtcactaaatggaaatgtgtttggttttaaact

SEQ ID NO: 296223 - DNA, 925 bp, Homo sapiens
ccggctagcccgacagttggggtgtggtggccttggtatgtgcgttctcgtgttacatcgcgccatcgttggtatatggttagtttgttggttagttaggcctagtatgaggagcgttatggagtggaagtgaaatcacatggctaggccggaggtcattaggagggctgagagggcccctgttaggggtcatgggctgggtcttgtgggtggaaacgcgctggctgactggggtcggcgtttagttcagcgcagcgactcggggacctggagctgacgcctagacacttgtattagctttaatagaagagaaatggaggagccatagaatattaaggatgaattcaggaaggcctgagaccatggaaaacttgcctgctctctacactattttccaaggagaggttgctatggtgacagactatggggcctttatcaaaatcccaggctgtcggaagcaaggtctggtccatcgaactcatatgtcatcctgtcgggtggataagccctctgagatagtagatgttggagataaagtgtgggtgaagcttattggccgagagatgaaaaatgatagaataaaagtatccctctccatgaaggttgtcaatcaagggactgggaaagaccttgatcccaacaatgttatcattgagcaagaagagaggcggaggcgatccttccaggattacactgggcagaagatcacccttgaggctgtcttgaacactacctgcaagaagtgtggctgtaaaggccactttgcaaaagattgtttcatgcaaccaggtgggactaaatactctctgatacctgatgaggaagaggtccaatcttccggagaggtccaatcttccggggaggtccaatcttccggagaggtccactcttccggagaggtccatcttccagagaggtccactct

SEQ ID NO: 296224 - DNA, 1036 bp, Homo sapiens
ccggctagcccgacagttggggtgtggtggccttggtatgtgcgttctcgtgttacatcgcgccatcgttggtatatggttagtttgttggttagttaggcctagtatgaggagcgttatggagtggaagtgaaatcacatggctaggccggaggtcattaggagggctgagagggcccctgttaggggtcatgggctgggtcttgtgggtggaaacgcgctggctgactggggtcggcgtttagttcagcgcagcgactcggggacctggagctgacgcctagacacttgtattagctttaatagaagagaaatggaggagccatagaatattaaggatgaattcaggaaggcctgagaccatggaaaacttgcctgctctctacactattttccaaggagagttatggtgaagctgaaacagtgctcaagatgaagcagctaattgaagacactgaaaagaataaagtttatgttgctatggtgacagactatggggcctttatcaaaatcccaggctgtcggaagcaaggtctggtccatcgaactcatatgtcatcctgtcgggtggataagccctctgagatagtagatgttggagataaagtgtgggtgaagcttattggccgagagatgaaaaatgatagaataaaagtatccctctccatgaaggttgtcaatcaagggactgggaaagaccttgatcccaacaatgttatcattgagcaagaagagaggcggaggcgatccttccaggattacactgggcagaagatcacccttgaggctgtcttgaacactacctgcaagaagtgtggctgtaaaggccactttgcaaaagattgtttcatgcaaccaggtgggactaaatactctctgatacctgatgaggaagaggaaaaggaagaggcaaagtcagcagagtttgagaagcctgaccctacaaggaatccttctagaaaaagaaagaaggaaggagaagaagaaaagaaacatagagataggaagtcatctgactctgacagctcagatctaa

SEQ ID NO: 296225 - DNA, 915 bp, Homo sapiens
  misc_feature (683)..(683): n is a, c, g, or t
  misc_feature (693)..(693): n is a, c, g, or t
ccggctagcccgacagttggggtgtggtggccttggtatgtgcgttctcgtgttacatcgcgccatcgttggtatatggttagtttgttggttagttaggcctagtatgaggagcgttatggagtggaagtgaaatcacatggctaggccggaggtcattaggagggctgagagggcccctgttaggggtcatgggctgggtcttgtgggtggaaacgcgctggctgactggggtcggcgtttagttcagcgcagcgactcggggacctggagctgacgcctagacacttgtattagctttaatagaagagaaatggaggagccatagaatattaaggatgaattcaggaaggcctgagaccatggaaaacttgcctgctctctacactattttccaaggagaggttgctatggtgacagactatggggcctttatcaaaatcccaggctgtcggaagcaaggtctggtccatcgaactcatatgtcatcctgtcgggtggataagccctctgagatagtagatgttggagataaagtgtgggtgaagcttattggccgagagatgaaaaatgatagaataaaagtatccctctccatgaaggttgtcaatcaagggactgggaaagaccttgatcccaacaatgttatcattgaaagaagaaggcggggagggcgaatcccnttccccaggnaattaaccactggggccaggaagaatcaccccctaaggcgtctgacactactgcaagtgtgctaaggctgcgatgtctgcacgtggtttctctgatctgatgagagagaagagagcagtcgagtgaaagctgactacaggaatcttctagaaaagaaagaaggagaagaagaaaagaaacatagagataggaagtcatctgactctgacagctcagatctaa

SEQ ID NO: 296226 - DNA, 496 bp, Homo sapiens
tttcctgagccagctagcccatttcaggagacttggggaaagattcacttgctgagaagagagactacttcctttttctataccttttctacttttcttctgcaggccactttgcaaaagattgtttcatgcaaccaggtgggactaaatactctctgatacctgatgaggaagaggaaaaggaagaggcaaagtcagcagagtttgagaagcctgaccctacaaggaatccttctagaaaaagaaagaagggtgaatgctactttgcttttattttatcatgtctttttcaagttttaagatgaaaatctgaaaagcctcatgcagcagtacacacctgtagtcccagctacttgggaggataaggtgggaggattgctcgaggccagaagtttaaggctgcggtgcgctatgattatgcctgtgaatagccactgcattccactctgaacaacatagtgagacccaatctctaaaaagaaattttttttgttaa

SEQ ID NO: 296227 - DNA, 883 bp, Homo sapiens
  misc_feature (5)..(5): n is a, c, g, or t
  misc_feature (7)..(7): n is a, c, g, or t
  misc_feature (495)..(497): n is a, c, g, or t
  misc_feature (509)..(509): n is a, c, g, or t
  misc_feature (517)..(517): n is a, c, g, or t
  misc_feature (557)..(557): n is a, c, g, or t
  misc_feature (589)..(589): n is a, c, g, or t
  misc_feature (594)..(595): n is a, c, g, or t
  misc_feature (624)..(624): n is a, c, g, or t
  misc_feature (632)..(632): n is a, c, g, or t
  misc_feature (638)..(638): n is a, c, g, or t
  misc_feature (659)..(659): n is a, c, g, or t
  misc_feature (673)..(673): n is a, c, g, or t
  misc_feature (689)..(689): n is a, c, g, or t
  misc_feature (691)..(691): n is a, c, g, or t
  misc_feature (694)..(694): n is a, c, g, or t
  misc_feature (697)..(697): n is a, c, g, or t
  misc_feature (699)..(699): n is a, c, g, or t
  misc_feature (711)..(711): n is a, c, g, or t
  misc_feature (713)..(714): n is a, c, g, or t
  misc_feature (721)..(721): n is a, c, g, or t
  misc_feature (724)..(724): n is a, c, g, or t
  misc_feature (745)..(745): n is a, c, g, or t
  misc_feature (782)..(784): n is a, c, g, or t
  misc_feature (790)..(791): n is a, c, g, or t
  misc_feature (806)..(806): n is a, c, g, or t
  misc_feature (819)..(819): n is a, c, g, or t
  misc_feature (845)..(845): n is a, c, g, or t
ggcangnggggatgttgctgtcaggtctgagtcggttggagtctgacgggtaggcgagacgcgcaggcgcagagagccccagccacgccggcccaggtggcctcaggtgagggggggcggagcgcacctgtggggacgggacgacgagttcaagcctccgtgggtgcagttggtcgccagcgagggatgcggagacgcccctgaacgaccatggcatcggccgacgagctgaccttccatgaattcgaggaggccactaatcttctggctgacaccccagatgcagccaccaccagcagaagcgatcagctgaccccacaagggcacgtggctgtggccgtgggctcaggtggcagctatggagccgaggatgaggtggaggaggagagtgacaaggccgcgctcctgcaggagcagcagcagcagcagcagccgggattctggaccttcagctactatcagagcttctttgacgtggacacctcacagtttccnnnaccgtaacaaantcccaccnccgcgcgcgttcgcgcgcgacaacgtttttttcgttcacngatcgttcgttaatcgttccgttatcgtttantttcnncgttcgtttatcgttttcgacgtttttcngtttttcngtttcngttcacgtttcaaccgttacncgtttttcgtttcncgatatttattttacncngcngancngacgtacgatcncnngatttcnganaatttttaccgttttcgattngacgacgatcgtacgtcgtattcgttttcgtttttcnnngtttcnngttttttttcgttcngttcgttttttcncgaatttttttccgatttatcgcgantttttcgcgtacacgttccggtttatacgttttttcga

SEQ ID NO: 296228 - DNA, 2172 bp, Homo sapiens
  misc_feature (5)..(5): n is a, c, g, or t
  misc_feature (7)..(7): n is a, c, g, or t
ggcangnggggatgttgctgtcaggtctgagtcggttggagtctgacgggtaggcgagacgcgcaggcgcagagagccccagccacgccggcccaggtggcctcaggtgagggggggcggagcgcacctgtggggacgggacgacgagttcaagcctccgtgggtgcagttggtcgccagcgagggatgcggagacgcccctgaacgaccatggcatcggccgacgagctgaccttccatgaattcgaggaggccactaatcttctggctgacaccccagatgcagccaccaccagcagaagcgatcagctgaccccacaagggcacgtggctgtggccgtgggctcaggtggcagctatggagccgaggatgaggtggaggaggagagtgacaaggccgcgctcctgcaggagcagcagcagcagcagcagccgggattctggaccttcagctactatcagagcttctttgacgtggacacctcacaggtcctggaccggatcaaaggctcactgctgccccggcctggccacaactttgtgcggcaccatctgcggaatcggccggatctgtatggccccttctggatctgtgccacgttggcctttgtcctggccgtcactggcaacctgacgctggtgctggcccagaggagggacccctccatccactacagcccccagttccacaaggtgaccgtggcaggcatcagcatctactgctatgcgtggctggtgcccctggccctgtggggcttcctgcggtggcgcaagggtgtccaggagcgcatggggccctacaccttcctggagactgtgtgcatctacggctactccctctttgtcttcatccccatggtggtcctgtggctcatccctgtgccttggctgcagtggctctttggggcgctggccctgggcctgtcagccgccgggctggtattcaccctctggcccgtggtccgtgaggacaccaggctggtggccacagtgctgctgtccgtggtcgtgctgctccacgccctcctggccatgggctgtaagttgtacttcttccagtcgctgcctccggagaacgtggctcctccaccccaaatcacatctctgccctcaaacatcgcgctgtcccctaccttgccgcagtccctggccccctcctaggaaggcccgggtcccacaggcaacacctaagtggaccaacccctctgcctgtcctgccccccagacgatgactgaaggctcctttgacaccttgagatgattctgctactttccagacttttcttacaaagcaaacacttttattttctatgcaaaggtgattcagagaatttatataaaggcgggcgaggggcagccgagcagggagctttgggacagggctggggcccccatatcccccccgggccacctgctttccctcctatggctcccctggaacaggagggagagccaagggggcggcccagcctggacagcgcccgctcctgcctgggtgcacacacggcgggcctgagctccagcatctgagtttgggggtatgagaaacaggggagcagaaggagaagaaaactgcctgtgctgcaacacgtttcctcatttattttttctttctttttctttttttctttttttggagggagaggtccctgcaaggtcccttcccgggcaggggagggatggaaatgccgtcacagtagtagggactggagcgtctacaaggatggaggggagctactcaggcctaacgttagctacaaggaaaaaggacgccttccgtgacagatccttgaggtgtctgtgtctgccccaagtggccggcagtggccttccctccgggcccaaggcctgcagccacctgctctaactcttgagtgggggggcggggggggacctgcaggggctcggggacaggacagcagcaagaggcaggggccgaggacggaggccttcccgacagtggggtgggttgtacattcaagtgtgaggtgaaccctttggtggggagggggcccctgaagcctcggcggggccacccctccccgcggcgcctctgagtctagggagaggggctgctggctcggcccggccggcctggcttcacagagggtctgcggattgacactggttcttttcataaaaaaataaaattaaaaaaagcagcatgtcacg

SEQ ID NO: 296229 - DNA, 2118 bp, Homo sapiens
  misc_feature (5)..(5): n is a, c, g, or t
  misc_feature (7)..(7): n is a, c, g, or t
ggcangnggggatgttgctgtcaggtctgagtcggttggagtctgacgggtaggcgagacgcgcaggcgcagagagccccagccacgccggcccaggtggcctcaggtgagggggggcggagcgcacctgtggggacgggacgacgagttcaagcctccgtgggtgcagttggtcgccagcgagggatgcggagacgcccctgaacgaccatggcatcggccgacgagctgaccttccatgaattcgaggaggccactaatcttctggctgacaccccagatgcagccaccaccagcagaagcgatcagctgaccccacaagggcacgtggctgtggccgtgggctcaggtggcagctatggagccgaggatgaggtggaggaggagagtgacaaggccgcgctcctgcaggagcagcagcagcagcagcagccgggattctggaccttcagctactatcagagcttctttgacgtggacacctcacaggtcctggaccggatcaaaggctcactgctgccccggcctggccacaactttgtgcggcaccatctgcggaatcggccggatctgtatggccccttctggatctgtgccacgttggcctttgtcctggccgtcactggcaacctgacgctggtgctggcccagaggagggacccctccatccactacagcccccagttccacaaggtgaccgtggcaggcatcagcatctactgctatgcgtggctggtgcccctggccctgtggggcttcctgcggtggcgcaagggtgtccaggagcgcatggggccctacaccttcctggagactgtgtgcatctacggctactccctctttgtcttcatccccatggtggtcctgtggctcatccctgtgccttggctgcagtggctctttggggcgctggccctgggcctgtcagccgccgggctggtattcaccctctggcccgtggtccgtgaggacaccaggctggtggccacagtgctgctgtccgtggtcgtgctgctccacgccctcctggccatgggctgtaagttgtacttcttccagtcgctgcctccggagaacgtggctcctccaccccaaatcacatctctgccctcaaacatcgcgctgtcccctaccttgccgcagtccctggccccctcctaggaaggcccgggtcccacaggcaacacctaagtggaccaacccctctgcctgtcctgccccccagacgatgactgaaggctcctttgacaccttgagatgattctgctactttccagacttttcttacaaagcaaacacttttattttctatgcaaaggtgattcagagaatttatataaaggcgggcgaggggcagccgagcagggagctttgggacagggctggggcccccatatcccccccgggccacctgctttccctcctatggctcccctggaacaggagggagagccaagggggcggcccagcctggacagcgcccgctcctgcctgggtgcacacacggcgggcctgagctccagcatctgagtttgggggtatgagaaacaggggagcagaaggagaagaaaactgcctgtgctgcaacacgtttcctcatttattttttctttctttttctttttttctttttttggagggagaggtccctgcaaggtcccttcccgggcaggggagggatggaaatgccgtcacagtagtagggactggagcgtctacaaggatggaggggagctactcaggcctaacgttagctacaaggaccggcagtggccttccctccgggcccaaggcctgcagccacctgctctaactcttgagtgggggggcggggggggacctgcaggggctcggggacaggacagcagcaagaggcaggggccgaggacggaggccttcccgacagtggggtgggttgtacattcaagtgtgaggtgaaccctttggtggggagggggcccctgaagcctcggcggggccacccctccccgcggcgcctctgagtctagggagaggggctgctggctcggcccggccggcctggcttcacagagggtctgcggattgacactggttcttttcataaaaaaataaaattaaaaaaagcagcatgtcacg

SEQ ID NO: 296230 - DNA, 2098 bp, Homo sapiens
  misc_feature (5)..(5): n is a, c, g, or t
  misc_feature (7)..(7): n is a, c, g, or t
ggcangnggggatgttgctgtcaggtctgagtcggttggagtctgacgggtaggcgagacgcgcaggcgcagagagccccagccacgccggcccaggtggcctcagcgagggatgcggagacgcccctgaacgaccatggcatcggccgacgagctgaccttccatgaattcgaggaggccactaatcttctggctgacaccccagatgcagccaccaccagcagaagcgatcagctgaccccacaagggcacgtggctgtggccgtgggctcaggtggcagctatggagccgaggatgaggtggaggaggagagtgacaaggccgcgctcctgcaggagcagcagcagcagcagcagccgggattctggaccttcagctactatcagagcttctttgacgtggacacctcacaggtcctggaccggatcaaaggctcactgctgccccggcctggccacaactttgtgcggcaccatctgcggaatcggccggatctgtatggccccttctggatctgtgccacgttggcctttgtcctggccgtcactggcaacctgacgctggtgctggcccagaggagggacccctccatccactacagcccccagttccacaaggtgaccgtggcaggcatcagcatctactgctatgcgtggctggtgcccctggccctgtggggcttcctgcggtggcgcaagggtgtccaggagcgcatggggccctacaccttcctggagactgtgtgcatctacggctactccctctttgtcttcatccccatggtggtcctgtggctcatccctgtgccttggctgcagtggctctttggggcgctggccctgggcctgtcagccgccgggctggtattcaccctctggcccgtggtccgtgaggacaccaggctggtggccacagtgctgctgtccgtggtcgtgctgctccacgccctcctggccatgggctgtaagttgtacttcttccagtcgctgcctccggagaacgtggctcctccaccccaaatcacatctctgccctcaaacatcgcgctgtcccctaccttgccgcagtccctggccccctcctaggaaggcccgggtcccacaggcaacacctaagtggaccaacccctctgcctgtcctgccccccagacgatgactgaaggctcctttgacaccttgagatgattctgctactttccagacttttcttacaaagcaaacacttttattttctatgcaaaggtgattcagagaatttatataaaggcgggcgaggggcagccgagcagggagctttgggacagggctggggcccccatatcccccccgggccacctgctttccctcctatggctcccctggaacaggagggagagccaagggggcggcccagcctggacagcgcccgctcctgcctgggtgcacacacggcgggcctgagctccagcatctgagtttgggggtatgagaaacaggggagcagaaggagaagaaaactgcctgtgctgcaacacgtttcctcatttattttttctttctttttctttttttctttttttggagggagaggtccctgcaaggtcccttcccgggcaggggagggatggaaatgccgtcacagtagtagggactggagcgtctacaaggatggaggggagctactcaggcctaacgttagctacaaggaaaaaggacgccttccgtgacagatccttgaggtgtctgtgtctgccccaagtggccggcagtggccttccctccgggcccaaggcctgcagccacctgctctaactcttgagtgggggggcggggggggacctgcaggggctcggggacaggacagcagcaagaggcaggggccgaggacggaggccttcccgacagtggggtgggttgtacattcaagtgtgaggtgaaccctttggtggggagggggcccctgaagcctcggcggggccacccctccccgcggcgcctctgagtctagggagaggggctgctggctcggcccggccggcctggcttcacagagggtctgcggattgacactggttcttttcataaaaaaataaaattaaaaaaagcagcatgtcacg

SEQ ID NO: 296231 - DNA, 2269 bp, Homo sapiens
  misc_feature (5)..(5): n is a, c, g, or t
  misc_feature (7)..(7): n is a, c, g, or t
ggcangnggggatgttgctgtcaggtctgagtcggttggagtctgacgggtaggcgagacgcgcaggcgcagagagccccagccacgccggcccaggtggcctcaggtgagggggggcggagcgcacctgtggggacgggacgacgagttcaagcctccgtgggtgcagttggtcgccagcgagggatgcggagacgcccctgaacgaccatggcatcggccgacgagctgaccttccatgaattcgaggaggccactaatcttctggctgacaccccagatgcagccaccaccagcagaagcgatcagctgaccccacaagggcacgtggctgtggccgtgggctcaggtggcagctatggagccgaggatgaggtggaggaggagagtgacaaggccgcgctcctgcaggagcagcagcagcagcagcagccgggattctggaccttcagctactatcagagcttctttgacgtggacacctcacaggtcctggaccggatcaaaggctcactgctgccccggcctggccacaactttgtgcggcaccatctgcggaatcggccggatctgtatggccccttctggatctgtgccacgttggcctttgtcctggccgtcactggcaacctgacgctggtgctggcccagaggagggacccctccatccactacagcccccagttccacaaggtgaccgtggcaggcatcagcatctactgctatgcgtggctggtgcccctggccctgtggggcttcctgcggtggcgcaagggtgtccaggagcgcatggggccctacaccttcctggagactgtgtgcatctacggctactccctctttgtcttcatccccatggtggtcctgtggctcatccctgtgccttggctgcagtggctctttggggcgctggccctgggcctgtcagccgccgggctggtattcaccctctggcccgtggtccgtgaggacaccaggctggtggccacagtgctgctgtccgtggtcgtgctgctccacgccctcctggccatgggctgtaagttgtacttcttccagtcgctgcctccggagaacgtggctcctccaccccaaatcacatctctgccctcaaacatcgcgctgtcccctaccttgccgcagtccctggccccctcctaggaaggcccgggtcccacaggtaaggactattcccagctgggctaagggggctgccctcccactcccagtcaaggcgagaggttctggggccactcccagacaattctttctttcaggcaacacctaagtggaccaacccctctgcctgtcctgccccccagacgatgactgaaggctcctttgacaccttgagatgattctgctactttccagacttttcttacaaagcaaacacttttattttctatgcaaaggtgattcagagaatttatataaaggcgggcgaggggcagccgagcagggagctttgggacagggctggggcccccatatcccccccgggccacctgctttccctcctatggctcccctggaacaggagggagagccaagggggcggcccagcctggacagcgcccgctcctgcctgggtgcacacacggcgggcctgagctccagcatctgagtttgggggtatgagaaacaggggagcagaaggagaagaaaactgcctgtgctgcaacacgtttcctcatttattttttctttctttttctttttttctttttttggagggagaggtccctgcaaggtcccttcccgggcaggggagggatggaaatgccgtcacagtagtagggactggagcgtctacaaggatggaggggagctactcaggcctaacgttagctacaaggaaaaaggacgccttccgtgacagatccttgaggtgtctgtgtctgccccaagtggccggcagtggccttccctccgggcccaaggcctgcagccacctgctctaactcttgagtgggggggcggggggggacctgcaggggctcggggacaggacagcagcaagaggcaggggccgaggacggaggccttcccgacagtggggtgggttgtacattcaagtgtgaggtgaaccctttggtggggagggggcccctgaagcctcggcggggccacccctccccgcggcgcctctgagtctagggagaggggctgctggctcggcccggccggcctggcttcacagagggtctgcggattgacactggttcttttcataaaaaaataaaattaaaaaaagcagcatgtcacg

SEQ ID NO: 296232 - DNA, 2011 bp, Homo sapiens
  misc_feature (5)..(5): n is a, c, g, or t
  misc_feature (7)..(7): n is a, c, g, or t
ggcangnggggatgttgctgtcaggtctgagtcggttggagtctgacgggtaggcgagacgcgcaggcgcagagagccccagccacgccggcccaggtggcctcagcgagggatgcggagacgcccctgaacgaccatggcatcggccgacgagctgaccttccatgaattcgaggaggccactaatcttctggctgacaccccagatgcagccaccaccagcagaagcgatcagctgaccccacaagggcacgtggctgtggccgtgggctcaggtggcagctatggagccgaggatgaggtggaggaggagagtgacaaggccgcggtcctggaccggatcaaaggctcactgctgccccggcctggccacaactttgtgcggcaccatctgcggaatcggccggatctgtatggccccttctggatctgtgccacgttggcctttgtcctggccgtcactggcaacctgacgctggtgctggcccagaggagggacccctccatccactacagcccccagttccacaaggtgaccgtggcaggcatcagcatctactgctatgcgtggctggtgcccctggccctgtggggcttcctgcggtggcgcaagggtgtccaggagcgcatggggccctacaccttcctggagactgtgtgcatctacggctactccctctttgtcttcatccccatggtggtcctgtggctcatccctgtgccttggctgcagtggctctttggggcgctggccctgggcctgtcagccgccgggctggtattcaccctctggcccgtggtccgtgaggacaccaggctggtggccacagtgctgctgtccgtggtcgtgctgctccacgccctcctggccatgggctgtaagttgtacttcttccagtcgctgcctccggagaacgtggctcctccaccccaaatcacatctctgccctcaaacatcgcgctgtcccctaccttgccgcagtccctggccccctcctaggaaggcccgggtcccacaggcaacacctaagtggaccaacccctctgcctgtcctgccccccagacgatgactgaaggctcctttgacaccttgagatgattctgctactttccagacttttcttacaaagcaaacacttttattttctatgcaaaggtgattcagagaatttatataaaggcgggcgaggggcagccgagcagggagctttgggacagggctggggcccccatatcccccccgggccacctgctttccctcctatggctcccctggaacaggagggagagccaagggggcggcccagcctggacagcgcccgctcctgcctgggtgcacacacggcgggcctgagctccagcatctgagtttgggggtatgagaaacaggggagcagaaggagaagaaaactgcctgtgctgcaacacgtttcctcatttattttttctttctttttctttttttctttttttggagggagaggtccctgcaaggtcccttcccgggcaggggagggatggaaatgccgtcacagtagtagggactggagcgtctacaaggatggaggggagctactcaggcctaacgttagctacaaggaaaaaggacgccttccgtgacagatccttgaggtgtctgtgtctgccccaagtggccggcagtggccttccctccgggcccaaggcctgcagccacctgctctaactcttgagtgggggggcggggggggacctgcaggggctcggggacaggacagcagcaagaggcaggggccgaggacggaggccttcccgacagtggggtgggttgtacattcaagtgtgaggtgaaccctttggtggggagggggcccctgaagcctcggcggggccacccctccccgcggcgcctctgagtctagggagaggggctgctggctcggcccggccggcctggcttcacagagggtctgcggattgacactggttcttttcataaaaaaataaaattaaaaaaagcagcatgtcacg

SEQ ID NO: 296233 - DNA, 2153 bp, Homo sapiens
  misc_feature (5)..(5): n is a, c, g, or t
  misc_feature (7)..(7): n is a, c, g, or t
ggcangnggggatgttgctgtcaggtctgagtcggttggagtctgacgggtaggcgagacgcgcaggcgcagagagccccagccacgccggcccaggtggcctcaggtgagggggggcggagcgcacctgtggggacgggacgacgagttcaagcctccgtgggtgcagttggtcgccagcgagggatgcggagacgcccctgaacgaccatggcatcggccgacgagctgaccttccatgaattcgaggaggccactaatcttctggctgacaccccagatgcagccaccaccagcagaagcgatcagctgaccccacaagggcacgtggctgtggccgtgggctcaggtggcagctatggagccgaggatgaggtggaggaggagagtgacaaggccgcgctcctgcaggagcagcagcagcagcagcagccgggattctggaccttcagctactatcagagcttctttgacgtggacacctcacaggtcctggaccggatcaaaggctcactgctgccccggcctggccacaactttgtgcggcaccatctgcggaatcggccggatctgtatggccccttctggatctgtgccacgttggcctttgtcctggccgtcactggcaacctgacgctggtgctggcccagaggagggacccctccatccactacagcccccagttccacaaggcatctactgctatgcgtggctggtgcccctggccctgtggggcttcctgcggtggcgcaagggtgtccaggagcgcatggggccctacaccttcctggagactgtgtgcatctacggctactccctctttgtcttcatccccatggtggtcctgtggctcatccctgtgccttggctgcagtggctctttggggcgctggccctgggcctgtcagccgccgggctggtattcaccctctggcccgtggtccgtgaggacaccaggctggtggccacagtgctgctgtccgtggtcgtgctgctccacgccctcctggccatgggctgtaagttgtacttcttccagtcgctgcctccggagaacgtggctcctccaccccaaatcacatctctgccctcaaacatcgcgctgtcccctaccttgccgcagtccctggccccctcctaggaaggcccgggtcccacaggcaacacctaagtggaccaacccctctgcctgtcctgccccccagacgatgactgaaggctcctttgacaccttgagatgattctgctactttccagacttttcttacaaagcaaacacttttattttctatgcaaaggtgattcagagaatttatataaaggcgggcgaggggcagccgagcagggagctttgggacagggctggggcccccatatcccccccgggccacctgctttccctcctatggctcccctggaacaggagggagagccaagggggcggcccagcctggacagcgcccgctcctgcctgggtgcacacacggcgggcctgagctccagcatctgagtttgggggtatgagaaacaggggagcagaaggagaagaaaactgcctgtgctgcaacacgtttcctcatttattttttctttctttttctttttttctttttttggagggagaggtccctgcaaggtcccttcccgggcaggggagggatggaaatgccgtcacagtagtagggactggagcgtctacaaggatggaggggagctactcaggcctaacgttagctacaaggaaaaaggacgccttccgtgacagatccttgaggtgtctgtgtctgccccaagtggccggcagtggccttccctccgggcccaaggcctgcagccacctgctctaactcttgagtgggggggcggggggggacctgcaggggctcggggacaggacagcagcaagaggcaggggccgaggacggaggccttcccgacagtggggtgggttgtacattcaagtgtgaggtgaaccctttggtggggagggggcccctgaagcctcggcggggccacccctccccgcggcgcctctgagtctagggagaggggctgctggctcggcccggccggcctggcttcacagagggtctgcggattgacactggttcttttcataaaaaaataaaattaaaaaaagcagcatgtcacg

SEQ ID NO: 296234 - DNA, 899 bp, Homo sapiens
tttgctttgtaagaaaagtctggaaagtagcagaatcatctcaaggtgattcagagaatttatataaaggcgggcgaggggcagccgagcagggagctttgggacagggctggggcccccatatcccccccgggccacctgctttccctcctatggctcccctggaacaggagggagagccaagggggcggcccagcctggacagcgcccgctcctgcctgggtgcacacacggcgggcctgagctccagcatctgagtttgggggtatgagaaacaggggagcagaaggagaagaaaactgcctgtgctgcaacacgtttcctcatttattttttctttctttttctttttttctttttttggagggagaggtccctgcaaggtcccttcccgggcaggggagggatggaaatgccgtcacagtagtagggactggagcgtctacaaggatggaggggagctactcaggcctaacgttagctacaaggaaaaaggacgccttccgtgacagatccttgaggtgtctgtgtctgccccaagtggccggcagtggccttccctccgggcccaaggcctgcagccacctgctctaactcttgagtgggggggcggggggggacctgcaggggctcggggacaggacagcagcaagaggcaggggccgaggacggaggccttcccgacagtggggtgggttgtacattcaagtgtgaggtgaaccctttggtggggagggggcccctgaagcctcggcggggccacccctccccgcggcgcctctgagtctagggagaggggctgctggctcggcccggccggcctggcttcacagagggtctgcggattgacactggttcttttcataaaaaaataaaattaaaaaaagcagcatgtcacg

SEQ ID NO: 296235 - DNA, 3950 bp, Homo sapiens
acaaaaatacctggaaaaaatatgggttattactgaggaaatgtacgagtattccaaggtccgctcatggggcaaacagcttctccataaccaccaagccactaatatgatagcattactcacaggggccttggtgactggagtagataaaggatctaaagcaaatatatggaaacaggctgtagtggatgtcatggaaaagacaatgtttctattgagtcatattgttgatggttctttggatgaaggtgtggcctatggaagctacacagctaaatccgtcacacagtatgtttttctggcccagcgccattttaatatcaacaacttggataataactggttaaagatgcacttttggttctattatgccacccttttacctggcttccaaagaactgtgggtatagcagattccaattataattggttttatggtccagaaagccagctagttttcttggataagttcatcttaaagaatggagctggaaattggttagctcagcaaattagaaagcaccgacctaaagatggaccgatggttccttcaactgcccaaaggtggagtactcttcacactgaatacatctggtatgatccccagctcacaccacagccacctgctgattatggtactgcaaaaatacacacattccctaactggggtgtggttacttatggggctgggttgccaaacacacagaccaacacctttgtgtcttttaaatctgggaagctggggggacgagctgtgtatgacatagttcattttcagccatattcctggattgatgggtggagaagttttaacccaggacatgagcatccagatcagaactcatttacttttgcccccaatggacaagtatttgtttctgaagctctctatggacccaagttgagccaccttaacaatgtattggtgtttgctccatcaccctcaagccagtgtaataagccctgggaaggtcaactgggagaatgtgcgcagtggcttaagtggactggcgaggaggttggtgatgcagctggggaaataatcactgcctctcaacatggggaaatggtatttgtgagtggggaagccgtgtctgcttattcttcagcaatgagactgaaaagtgtatatcgtgctttgcttctcttaaattcccaaactctgctagttgttgatcatattgagaggcaagaagattccccaataaattctgtcagtgccttctttcataatttggatattgattttaaatatatcccatataagtttatgaataggtataatggtgccatgatggatgtgtgggatgcacattacaaaatgttttggtttgatcatcatggcaatagtcccatggccagtatacaggaagcagagcaagctgctgaatttaaaaaacgatggactcaatttgttaatgttacttttcagatggaatccacaatcacaagaattgcatatgtcttttatgggccatatatcaatgtctccagctgcagatttattgatagttccaatcctggacttcagatttctctcaatgtcaataatactgaacatgttgtttctattgtaactgattaccataacctgaagacaagattcaattatctgggattcggtggctttgccagtgtggctgatcaaggccaaataacccgatttggtttgggcactcaagcaatagtaaagcctgtaagacatgataggattattttcccctttggatttaaatttaatatagcagttggattaattttgtgcattagcttggtgattttaactttccaatggcgtttttacctttcttttagaaaactaatgcgatggatattaatacttgttattgccttgtggtttattgagcttttggatgtgtggagcacttgtagtcagcccatttgtgcaaaatggacaaggacagaggctgagggaagcaagaagtctttgtcttctgaagggcaccacatggatcttcctgatgttgtcattacctcacttcctggttcaggagctgaaattctcaaacaactttttttcaacagtagtgattttctctacatcagggttcctacagcctacattgatattcctgaaactgagttggaaatcgactcatttgtagatgcttgtgaatggaaggtgtcagatatccgcagtgggcattttcgtttactccgaggctggttgcagtctttagtccaggacacaaaattacatttgcaaaacatccatctgcatgaacccaataggggtaaactggcccaatattttgcaatgaataaggacaaaaaaagaaaatttaaaaggagagagtctttgccagaacaaagaagtcaaatgaaaggcgcctttgatagagatgctgaatatattagggctttgaggagacacctggtttactatccaagtgcacgtcctgtgctcagtttaagcagtggaagctggacgttaaagcttcatttttttcaggaagttttaggagcttcgatgagggcattgtacatagtaagagaccctcgggcatggatttattcaatgttgtacaatagtaaaccaagtctttattctttgaagaatgtaccagagcatttagcaaaattgtttaaaatagagggaggtaaaggcaaatgtaacttaaattcgggttatgctttcgagtatgaaccattgaggaaagaattatcaaaatccaaatcaaatgcagtgtccctcttgtctcacttgtggctagcaaatacagcagcagccttgagaataaatacagatttgctgcctactagctaccagctggtcaagtttgaagatattgtgcattttcctcagaaaactactgaaaggatttttgcctttcttggaattcctttgtctcctgctagtttaaaccaaatattgtttgccacctctacaaaccttttttaccttccctatgaaggggaaatatcaccaactaatactaatgtttggaaacagaacttgcctagagatgaaattaaactaattgaaaacatctgctggactctgatggatcgcctaggatatccaaagtttatggactaaatgctgcaggtcagcagaaatttgcactaataatacttaccaacccactttgtggatatgaatcagaagagtttgtttattctttagtgtgtgtgtgtgtgtgcacgcgtgtatgtgttcagtgttgtttgcacagagagattgttttaaaaaatggcaccatatttggcctagcaggatttatttttatgtcatcacctcccttgcctttgtttctgaaaattttgtctgctaaaaagtttctgctacagagtggtagatgaagttatatcatggggtcaggggagatgggaaaattttaagtttttgtctaactccccttcatctgtaactgtgctaatctatctagagacctcaaacactgctaaaggccttgcaattgctgctttacccacgcatctcttgctttcaagatggactacaaaagttccttatccttttgaaaaggtcttctgacacacttatcttgcacaaagaaaaagaaaatttcttttactgtgtttaatgttcagtgatatcactgaggaaatggtgaaagctcctatcagaactataggatttcttctgggaaatacagatggaaatacagaatgaatatgtttttttgaggtcggaaactgactttaaaagcctccttgaagttttttacttagaaatataaggaataagtctttgaacaatctgggtggcaagggctggtagattattttagacatgattgtctgtttaaaactctcctttcactttttatcctccctggagctacagctgttcgccatcacatcactcccatcctatcctttctgtcactgtcaagcaaaacaatcagtagttactaatcgctgaactctcaatattgtggggcattttccccccagttgattaattt

SEQ ID NO: 296236 - DNA, 3301 bp, Homo sapiens
acaaaaatacctggaaaaaatatgggttattactgaggaaatgtacgagtattccaaggtccgctcatggggcaaacagcttctccataaccaccaagccactaatatgatagcattactcacaggggccttggtgactggagtagataaaggatctaaagcaaatatatggaaacaggctgtagtggatgtcatggaaaagacaatgtttctattgagtcatattgttgatggttctttggatgaaggtgtggcctatggaagctacacagctaaatccgtcacacagtatgtttttctggcccagcgccattttaatatcaacaacttggataataactggttaaagatgcacttttggttctattatgccacccttttacctggcttccaaagaactgtgggtatagcagattccaattataattggttttatggtccagaaagccagctagttttcttggataagttcatcttaaagaatggagctggaaattggttagctcagcaaattagaaagcaccgacctaaagatggaccgatggttccttcaactgcccaaaggtggagtactcttcacactgaatacatctggtatgatccccagctcacaccacagccacctgctgattatggtactgcaaaaatacacacattccctaactggggtgtggttacttatggggctgggttgccaaacacacagaccaacacctttgtgtcttttaaatctgggaagctggggggacgagctgtgtatgacatagttcattttcagccatattcctggattgatgggtggagaagttttaacccaggacatgagcatccagatcagaactcatttacttttgcccccaatggacaagtatttgtttctgaagctctctatggacccaagttgagccaccttaacaatgtattggtgtttgctccatcaccctcaagccagtgtaataagccctgggaaggtcaactgggagaatgtgcgcagtggcttaagtggactggcgaggaggttggtgatgcagctggggaaataatcactgcctctcaacatggggaaatggtatttgtgagtggggaagccgtgtctgcttattcttcagcaatgagactgaaaagtgtatatcgtgctttgcttctcttaaattcccaaactctgctagttgttgatcatattgagaggcaagaagattccccaataaattctgtcagtgccttctttcataatttggatattgattttaaatatatcccatataagtttatgaataggtataatggtgccatgatggatgtgtgggatgcacattacaaaatgttttggtttgatcatcatggcaatagtcccatggccagtatacaggaagcagagcaagctgctgaatttaaaaaacgatggactcaatttgttaatgttacttttcagatggaatccacaatcacaagaattgcatatgtcttttatgggccatatatcaatgtctccagctgcagatttattgatagttccaatcctggacttcagatttctctcaatgtcaataatactgaacatgttgtttctattgtaactgattaccataacctgaagacaagattcaattatctgggattcggtggctttgccagtgtggctgatcaaggccaaataacccgatttggtttgggcactcaagcaatagtaaagcctgtaagacatgataggattattttcccctttggatttaaatttaatatagcagttggattaattttgtgcattagcttggtgattttaactttccaatggcgtttttacctttcttttagaaaactaatgcgatggatattaatacttgttattgccttgtggtttattgagcttttggatgtgtggagcacttgtagtcagcccatttgtgcaaaatggacaaggacagaggctgagggaagcaagaagtctttgtcttctgaagggcaccacatggatcttcctgatgttgtcattacctcacttcctggttcaggagctgaaattctcaaacaactttttttcaacagtagtgattttctctacatcagggttcctacagcctacattgatattcctgaaactgagttggaaatcgactcatttgtagatgcttgtgaatggaaggtgtcagatatccgcagtgggcattttcgtttactccgaggctggttgcagtctttagtccaggacacaaaattacatttgcaaaacatccatctgcatgaacccaataggggtaaactggcccaatattttgcaatgaataaggacaaaaaaagaaaatttaaaaggagagagtctttgccagaacaaagaagtcaaatgaaaggcgcctttgatagagatgctgaatatattagggctttgaggagacacctggtttactatccaagtgcacgtcctgtgctcagtttaagcagtggaagctggacgttaaagcttcatttttttcaggaagttttaggagcttcgatgagggcattgtacatagtaagagaccctcgggcatggatttattcaatgttgtacaatagtaaaccaagtctttattctttgaagaatgtaccagagcatttagcaaaattgtttaaaatagagggaggtaaaggcaaatgtaacttaaattcgggttatgctttcgagtatgaaccattgaggaaagaattatcaaaatccaaatcaaatgcagtgtccctcttgtctcacttgtggctagcaaatacagcagcagccttgagaataaatacagatttgctgcctactagctaccagctggtcaagtttgaagatattgtgcattttcctcagaaaactactgaaaggatttttgcctttcttggaattcctttgtctcctgctagtttaaaccaaatattgtttgccacctctacaaaccttttttaccttccctatgaaggggaaatatcaccaactaatactaatgtttggaaacagaacttgcatagagtacaatagacacttcaaacaatagattctaacattctctgaaacacttgagatgtttgagctaccatttatatgggttatttatatttagtctaagtaacacatacatgtttaattgattctgttttcatggatagattcaactaagtcttccaagcaattaattttttgttcgtcgtcgtttttccttcatacgttatctagttatgcagcactggaaacagactgaagatcataaaccagttttatcagacctatgtgtaataagactcctgttaatacaaaaataaaaagctaaaagcaacttgtctatga

SEQ ID NO: 296237 - DNA, 771 bp, Homo sapiens
gggatggagtctcactttgttgcccaggctggagtgcagtggtctgatctcggctcactgcaacctccgcctaccgggttcaagtgattctcctacgtcagcctcctgaatagctgggattacaggtgcacgccaccatgcttggctcatttttgtatttttagtagtgacagcgtttcaccacattggtcaggctggtctcaatctcttgacctggtgatctgcccacctgggcctcccaaaatgctgggattacaggcatgagccaccacacctggcaagggtacctgacattctaagatatcaagacacttaatatgtgggctattagctgcttatttaaatgttgaccaaattgtctgatatatctgattaatcatgatttcacttcatttcggaagaaaaattatccatatcatttttaaagacgcaaatgactttggatttttgcatagagtacaatagacacttcaaacaatagattctaacattctctgaaacacttgagatgtttgagctaccatttatatgggttatttatatttagtctaagtaacacatacatgtttaattgattctgttttcatggatagattcaactaagtcttccaagcaattaattttttgttcgtcgtcgtttttccttcatacgttatctagttatgcagcactggaaacagactgaagatcataaaccagttttatcagacctatgtgtaataagactcctgttaatacaaaaataaaaagctaaaagcaacttgtctatga

SEQ ID NO: 296238 - DNA, 3826 bp, Homo sapiens
cggagctggcacagaggatcctcggccgcggcgacatcaccgcctggggacgcgggcgctgctctggatacggcgccaccgagagaacccgccgcccgcgggtctctgtcctgcggtccgtggttgcccccacaagcgtccggcgtttcctgagggcgggcgtgtccgggccgtgcgggtcgcggggaccgagcgcggctgaggagaccgagctggggcagcgcctgccgtagcgcgggagacgacgcgggggtcttgcggagccccgcgggagcctggcccgccgtgcagagcagttttctggaactctccacctccgtctcccttggggcccagtgcggcgccgagcccccgtcgggatctgcctgagaaaagtgtcatgaaaaaagagcagaagagagacctcactgttgctgaaaggggaattttctttccccgttggcggttacttcatgatcggacgagaagtatctaggtgactgaagatattccatttttatgtttgtacacatgaagctgataaaagaagatgtgaacatgatttctctttgtcataataggctgatgagtaagtaagcctgaaaaatatttgaaatgaaggcaagaattttgaatttttaaaaaccaactaagactttgatcacttgttgaggatgtttctctctcataaatgaaagaaaaacgtattcacaagacaagaagtataaaaagttgagaggaatgacaactgagtccactcactcgaagaatgtcagtacttcatcatcttctttgggcaaacatacacaaatgcatcatacatgtgtggtgagcttatcaccagtgatggttttctgtgctagaaatgactcttaatttgaattttggagtgctttttctctttttttacaatgtgtgttccaactctttgtgttaaatagatttaagtaaaggaggtaaatgctaaattcatagtgttttttacctgtatcacttccctgtgtattatggaaaaattagagattttaacgttattcaaagttttactggaagcaaaactgtgccagggacagagatatacaatttaagttttctctttttggcaactgcacttgcttaaaatgtactgaatgtcagctggatttcacagcatatcagatttacagtctttgtcttatcaaggcctttactgtatgttttatactaaccagatgggaaacacattgagcatcatatctgacatgtatgcctaagggaggagctcccccatggatcatggcgttaatgtttacaggacacttactattcttagcattattgatgtttgctttctctacttttgaggaatctgtgagcaattattccgaatgggcagttttcacagatgatatagatcagtttaaaacacagaaagtgcaagatttcagacccaaccaaaagctgaagaaaagtatgcttcatccaagtttatattttgatgctggagaaatccaagcaatgagacaaaagtctcgtgcaagccatttgcatctttttagagctatcagaagtgcagtgacagttatgctgtccaacccaacatactacctacctccaccaaagcatgctgattttgctgccaagtggaatgaaatttatggtaacaatctgcctcctttagcattgtactgtttgttatgcccagaagacaaagttgcctttgaatttgtcttggaatatatggacaggatggttggctacaaagactggctagtagagaatgcaccaggagatgaggttccaattggccattccttaacaggttttgccactgcctttgactttttatataactgcaagaagtctttgtcttctgaagggcaccacatggatcttcctgatgttgtcattacctcacttcctggttcaggagctgaaattctcaaacaactttttttcaacagtagtgattttctctacatcagggttcctacagcctacattgatattcctgaaactgagttggaaatcgactcatttgtagatgcttgtgaatggaaggtgtcagatatccgcagtgggcattttcgtttactccgaggctggttgcagtctttagtccaggacacaaaattacatttgcaaaacatccatctgcatgaacccaataggggtaaactggcccaatattttgcaatgaataaggacaaaaaaagaaaatttaaaaggagagagtctttgccagaacaaagaagtcaaatgaaaggcgcctttgatagagatgctgaatatattagggctttgaggagacacctggtttactatccaagtgcacgtcctgtgctcagtttaagcagtggaagctggacgttaaagcttcatttttttcaggaagttttaggagcttcgatgagggcattgtacatagtaagagaccctcgggcatggatttattcaatgttgtacaatagtaaaccaagtctttattctttgaagaatgtaccagagcatttagcaaaattgtttaaaatagagggaggtaaaggcaaatgtaacttaaattcgggttatgctttcgagtatgaaccattgaggaaagaattatcaaaatccaaatcaaatgcagtgtccctcttgtctcacttgtggctagcaaatacagcagcagccttgagaataaatacagatttgctgcctactagctaccagctggtcaagtttgaagatattgtgcattttcctcagaaaactactgaaaggatttttgcctttcttggaattcctttgtctcctgctagtttaaaccaaatattgtttgccacctctacaaaccttttttaccttccctatgaaggggaaatatcaccaactaatactaatgtttggaaacagaacttgcctagagatgaaattaaactaattgaaaacatctgctggactctgatggatcgcctaggatatccaaagtttatggactaaatgctgcaggtcagcagaaatttgcactaataatacttaccaacccactttgtggatatgaatcagaagagtttgtttattctttagtgtgtgtgtgtgtgtgcacgcgtgtatgtgttcagtgttgtttgcacagagagattgttttaaaaaatggcaccatatttggcctagcaggatttatttttatgtcatcacctcccttgcctttgtttctgaaaattttgtctgctaaaaagtttctgctacagagtggtagatgaagttatatcatggggtcaggggagatgggaaaattttaagtttttgtctaactccccttcatctgtaactgtgctaatctatctagagacctcaaacactgctaaaggccttgcaattgctgctttacccacgcatctcttgctttcaagatggactacaaaagttccttatccttttgaaaaggtcttctgacacacttatcttgcacaaagaaaaagaaaatttcttttactgtgtttaatgttcagtgatatcactgaggaaatggtgaaagctcctatcagaactataggatttcttctgggaaatacagatggaaatacagaatgaatatgtttttttgaggtcggaaactgactttaaaagcctccttgaagttttttacttagaaatataaggaataagtctttgaacaatctgggtggcaagggctggtagattattttagacatgattgtctgtttaaaactctcctttcactttttatcctccctggagctacagctgttcgccatcacatcactcccatcctatcctttctgtcactgtcaagcaaaacaatcagtagttactaatcgctgaactctcaatattgtggggcattttccccccagttgattaattt

SEQ ID NO: 296239 - DNA, 945 bp, Homo sapiens
cggagctggcacagaggatcctcggccgcggcgacatcaccgcctggggacgcgggcgctgctctggatacggcgccaccgagagaacccgccgcccgcgggtctctgtcctgcggtccgtggttgcccccacaagcgtccggcgtttcctgagggcgggcgtgtccgggccgtgcgggtcgcggggaccgagcgcggctgaggagaccgagctggggcagcgcctgccgtagcgcgggagacgacgcgggggtcttgcggagccccgcgggagcctggcccgccgtgcagagcagttttctggaactctccacctccgtctcccttggggcccagtgcggcgccgagcccccgtcgggatctgcctgagaaaagtgtcatgaaaaaagagcagaagagagacctcactgttgctgaaaggggaattttctttccccgttggcggttacttcatgatcggacgagaagtatctaggtgactgaagatattccatttttatgtttgtacacatgaagctgataaaagaagatgtgaacatgatttctctttgtcataataggctgatgagtaagtaagcctgaaaaatatttgaaatgaaggcaagaattttgaatttttaaaaaccaactaagactttgatcacttgttgaggatgtttctctctcataaatgaaagaaaaacgtattcacaagacaagaagtataaaaagttgagaggaatgacaactgagtccactcactcgaagaatgtcagtacttcatcatcttctttgggcaaacatacacaaatgcatcatacatgtgtggtgagcttatcaccagtgatggttttctgtgctagaaatgactcttaatttgaattttggagtgctttttctctttttttacaatgtgtgttccaactctttgtgttaaatagatttaagtaaaggaggtaaatgcta

SEQ ID NO: 296240 - DNA, 338 bp, Homo sapiens
cgagctcgggtaccctatattgtccggccgcgcagctggaggcggcggagcggaagccttgacttcatctcagctccagagcccgccctctcttcctgcagcctgggaacttcagccggctgggccccaccatggctgcaatccgaaagaagctggtgatcgttggggatggtgcctgtgggaagacctgcctcctcatcgtcttcagcaaggatcagtttccggaggtctacgtccctactgtctttgagaactatattgcggacattgaggtggacggcaagcttaaacctagacgcaaagggacttactccgctgacagagccagtctgctgcta

SEQ ID NO: 296241 - DNA, 845 bp, Homo sapiens
gagaaaatgagattgagaatcctccttcttcatactcgaaccaagaaagagtatcctggggtttgggactgggatcccgaggccgagtcccgccctcactctggttttaaagttgagaatgcagtatctcttggtatctccagaacggattccttccctaggtgtagggtgggccggcaaagtcaaccggccgctctggatcatctgggaattcaagagagcgattggagagaggtctgatgtagccacactgtcttgtcttggggaaggccccagaagttccaggctccattccaggccctgtgtggggctcagttgcccctcttaaggggtcagtgggacagtccctctggggctgcctctcacagggagttgtccatgccatcttggccttgggcctagtgtcctggcctgggctgcctgctgttctggcccaatcatagcctggagggaaagtcttctaattgggctggaggctccaggtcccttaacgcatgcctcaaccccgggtttctgtcctctgcctcccaccactctggtgccgtctgaattaccctgctggggggacagcagtggcatactcatgcctaagtgactggctttcaccccagtagtgattgccctccatcaacactgcccaccccaggttggggctaccccagcccatcttcacaaaacagggcaaggtgaactaatggagtgggtggaggagttggaagaaatcccagcgtcagtcaccgggatagaattcccaaggaaccctctttttggaggatggtttccatttctggaggcgatctgccgacagggtgaatgccttcttgcttgtcttctggggaatcaga

SEQ ID NO: 296242 - DNA, 357 bp, Homo sapiens
cggaaggtaccatgggccggggctgcgggcggtggggcgtcttgggaactcgtccccaggagagcactttcccttcctcgctggcccggagatcggggcccgtgcgaggaggggcttcggcctgggcgtggaccccgttccctccaagcggagtcggcatccgggctgggcggtggtcggaccgcgtcggcccctccccgggctgcagcgagggggcccggacctgccggcaggggctctggcctcctgaggtccgagtcggagccccttcccttctcctcccagcttcccggaacctgccccgccgggcgaggggcgagggaacttcaactcagacgccccagcccccagggtggg

SEQ ID NO: 296243 - DNA, 1145 bp, Homo sapiens
tccttgtaatccaagcagtcggggggtcagtctgagcctccggcaccggccgcgcagctggaggcggcggagcggaagccttgacttcatctcagctccagagcccgccctctcttcctgcagcctgggaacttcagccggctggagccccaccatggctgcaatccgaaagaagctggtgatcgttggggatggtgcctgtgggaagacctgcctcctcatcgtcttcagcaaggatcagtttccggaggtctacgtccctactgtctttgagaactatattgcggacattgaggtggacggcaagcaggtggagctggctctgtgggacacagcagggcaggaagactatgatcgactgcggcctctctcctacccggacactgatgtcatcctcatgtgcttctccatcgacagccctgacagcctggaaaacattcctgagaagtggaccccagaggtgaagcacttctgccccaacgtgcccatcatcctggtggggaataagaaggacctgaggcaagacgagcacaccaggagagagctggccaagatgaagcaggagcccgttcggtctgaggaaggccgggacatggcgaaccggatcagtgcctttggctaccttgagtgctcagccaagaccaaggagggagtgcgggaggtgtttgagatggccactcgggctggcctccaggtccgcaagaacaagcgtcggaggggctgtcccattctctgagatccccaaggcctttcctacatgccccctcccttcacaggggtacagaaattatccccctacaaccccagcctcctgagggctccatgctgaaggctcccattttcagttccctcctgcccaggactgcattgttttctagccccgaggtggtggcacgggccctccctcccagcgctctgggagccacgcctatgccctgcccttcctcagggcccctggggatcttgccccctttgaccttccccaaaggatggtcacacaccagcactttatacacttctggctcacaggaaagtgtctgcagtaggggacccagagtcccaggcccctggagttgttttcggcaggggccttgtctctcactgcatttggtcaggggggcatgaataaaggctacaggctccaa

SEQ ID NO: 296244 - DNA, 1095 bp, Homo sapiens
tccttgtaatccaagcagtcggggggtcagtctgagcctccggcaccggccgcgcagctggaggcggcggagcggagggaacttcagccggctggagccccaccatggctgcaatccgaaagaagctggtgatcgttggggatggtgcctgtgggaagacctgcctcctcatcgtcttcagcaaggatcagtttccggaggtctacgtccctactgtctttgagaactatattgcggacattgaggtggacggcaagcaggtggagctggctctgtgggacacagcagggcaggaagactatgatcgactgcggcctctctcctacccggacactgatgtcatcctcatgtgcttctccatcgacagccctgacagcctggaaaacattcctgagaagtggaccccagaggtgaagcacttctgccccaacgtgcccatcatcctggtggggaataagaaggacctgaggcaagacgagcacaccaggagagagctggccaagatgaagcaggagcccgttcggtctgaggaaggccgggacatggcgaaccggatcagtgcctttggctaccttgagtgctcagccaagaccaaggagggagtgcgggaggtgtttgagatggccactcgggctggcctccaggtccgcaagaacaagcgtcggaggggctgtcccattctctgagatccccaaggcctttcctacatgccccctcccttcacaggggtacagaaattatccccctacaaccccagcctcctgagggctccatgctgaaggctcccattttcagttccctcctgcccaggactgcattgttttctagccccgaggtggtggcacgggccctccctcccagcgctctgggagccacgcctatgccctgcccttcctcagggcccctggggatcttgccccctttgaccttccccaaaggatggtcacacaccagcactttatacacttctggctcacaggaaagtgtctgcagtaggggacccagagtcccaggcccctggagttgttttcggcaggggccttgtctctcactgcatttggtcaggggggcatgaataaaggctacaggctccaa

SEQ ID NO: 296245 - DNA, 1091 bp, Homo sapiens
  misc_feature (1)..(1): n is a, c, g, or t
  misc_feature (18)..(18): n is a, c, g, or t
nattcggaacgaggcggnggaaagccttgacttcatctcagctccagagcccgccctctcttcctgcagcctgggaacttcagccggctggagccccaccatggctgcaatccgaaagaagctggtgatcgttggggatggtgcctgtgggaagacctgcctcctcatcgtcttcagcaaggatcagtttccggaggtctacgtccctactgtctttgagaactatattgcggacattgaggtggacggcaagcaggtggagctggctctgtgggacacagcagggcaggaagactatgatcgactgcggcctctctcctacccggacactgatgtcatcctcatgtgcttctccatcgacagccctgacagcctggaaaacattcctgagaagtggaccccagaggtgaagcacttctgccccaacgtgcccatcatcctggtggggaataagaaggacctgaggcaagacgagcacaccaggagagagctggccaagatgaagcaggagcccgttcggtctgaggaaggccgggacatggcgaaccggatcagtgcctttggctaccttgagtgctcagccaagaccaaggagggagtgcgggaggtgtttgagatggccactcgggctggcctccaggtccgcaagaacaagcgtcggaggggctgtcccattctctgagatccccaaggcctttcctacatgccccctcccttcacaggggtacagaaattatccccctacaaccccagcctcctgagggctccatgctgaaggctcccattttcagttccctcctgcccaggactgcattgttttctagccccgaggtggtggcacgggccctccctcccagcgctctgggagccacgcctatgccctgcccttcctcagggcccctggggatcttgccccctttgaccttccccaaaggatggtcacacaccagcactttatacacttctggctcacaggaaagtgtctgcagtaggggacccagagtcccaggcccctggagttgttttcggcaggggccttgtctctcactgcatttggtcaggggggcatgaataaaggctacaggctccaa

SEQ ID NO: 296246 - DNA, 1276 bp, Homo sapiens
tccttgtaatccaagcagtcggggggtcagtctgagcctccggcaccggccgcgcagctggaggcggcggagcggaagggcaaggtgaactaatggagtgggtggaggagttggaagaaatcccagcgtcagtcaccgggatagaattcccaaggaaccctctttttggaggatggtttccatttctggaggcgatctgccgacaggagccttgacttcatctcagctccagagcccgccctctcttcctgcagcctgggaacttcagccggctggagccccaccatggctgcaatccgaaagaagctggtgatcgttggggatggtgcctgtgggaagacctgcctcctcatcgtcttcagcaaggatcagtttccggaggtctacgtccctactgtctttgagaactatattgcggacattgaggtggacggcaagcaggtggagctggctctgtgggacacagcagggcaggaagactatgatcgactgcggcctctctcctacccggacactgatgtcatcctcatgtgcttctccatcgacagccctgacagcctggaaaacattcctgagaagtggaccccagaggtgaagcacttctgccccaacgtgcccatcatcctggtggggaataagaaggacctgaggcaagacgagcacaccaggagagagctggccaagatgaagcaggagcccgttcggtctgaggaaggccgggacatggcgaaccggatcagtgcctttggctaccttgagtgctcagccaagaccaaggagggagtgcgggaggtgtttgagatggccactcgggctggcctccaggtccgcaagaacaagcgtcggaggggctgtcccattctctgagatccccaaggcctttcctacatgccccctcccttcacaggggtacagaaattatccccctacaaccccagcctcctgagggctccatgctgaaggctcccattttcagttccctcctgcccaggactgcattgttttctagccccgaggtggtggcacgggccctccctcccagcgctctgggagccacgcctatgccctgcccttcctcagggcccctggggatcttgccccctttgaccttccccaaaggatggtcacacaccagcactttatacacttctggctcacaggaaagtgtctgcagtaggggacccagagtcccaggcccctggagttgttttcggcaggggccttgtctctcactgcatttggtcaggggggcatgaataaaggctacaggctccaa

SEQ ID NO: 296247 - DNA, 1067 bp, Homo sapiens
aagtcccacacttagtcatagtacgaggccggtgtgaatcggccgagggggaacttcagccggctggagccccaccatggctgcaatccgaaagaagctggtgatcgttggggatggtgcctgtgggaagacctgcctcctcatcgtcttcagcaaggatcagtttccggaggtctacgtccctactgtctttgagaactatattgcggacattgaggtggacggcaagcaggtggagctggctctgtgggacacagcagggcaggaagactatgatcgactgcggcctctctcctacccggacactgatgtcatcctcatgtgcttctccatcgacagccctgacagcctggaaaacattcctgagaagtggaccccagaggtgaagcacttctgccccaacgtgcccatcatcctggtggggaataagaaggacctgaggcaagacgagcacaccaggagagagctggccaagatgaagcaggagcccgttcggtctgaggaaggccgggacatggcgaaccggatcagtgcctttggctaccttgagtgctcagccaagaccaaggagggagtgcgggaggtgtttgagatggccactcgggctggcctccaggtccgcaagaacaagcgtcggaggggctgtcccattctctgagatccccaaggcctttcctacatgccccctcccttcacaggggtacagaaattatccccctacaaccccagcctcctgagggctccatgctgaaggctcccattttcagttccctcctgcccaggactgcattgttttctagccccgaggtggtggcacgggccctccctcccagcgctctgggagccacgcctatgccctgcccttcctcagggcccctggggatcttgccccctttgaccttccccaaaggatggtcacacaccagcactttatacacttctggctcacaggaaagtgtctgcagtaggggacccagagtcccaggcccctggagttgttttcggcaggggccttgtctctcactgcatttggtcaggggggcatgaataaaggctacaggctccaa

SEQ ID NO: 296248 - DNA, 1073 bp, Homo sapiens
cgagctcgggtaccctatattgtccggccgcgcagctggaggcggcggagcggagggaacttcagccggctggagccccaccatggctgcaatccgaaagaagctggtgatcgttggggatggtgcctgtgggaagacctgcctcctcatcgtcttcagcaaggatcagtttccggaggtctacgtccctactgtctttgagaactatattgcggacattgaggtggacggcaagcaggtggagctggctctgtgggacacagcagggcaggaagactatgatcgactgcggcctctctcctacccggacactgatgtcatcctcatgtgcttctccatcgacagccctgacagcctggaaaacattcctgagaagtggaccccagaggtgaagcacttctgccccaacgtgcccatcatcctggtggggaataagaaggacctgaggcaagacgagcacaccaggagagagctggccaagatgaagcaggagcccgttcggtctgaggaaggccgggacatggcgaaccggatcagtgcctttggctaccttgagtgctcagccaagaccaaggagggagtgcgggaggtgtttgagatggccactcgggctggcctccaggtccgcaagaacaagcgtcggaggggctgtcccattctctgagatccccaaggcctttcctacatgccccctcccttcacaggggtacagaaattatccccctacaaccccagcctcctgagggctccatgctgaaggctcccattttcagttccctcctgcccaggactgcattgttttctagccccgaggtggtggcacgggccctccctcccagcgctctgggagccacgcctatgccctgcccttcctcagggcccctggggatcttgccccctttgaccttccccaaaggatggtcacacaccagcactttatacacttctggctcacaggaaagtgtctgcagtaggggacccagagtcccaggcccctggagttgttttcggcaggggccttgtctctcactgcatttggtcaggggggcatgaataaaggctacaggctccaa

SEQ ID NO: 296249 - DNA, 1073 bp, Homo sapiens
ggcgactcccgagcatttctatgccggccgcgccacctgcggcgatagcacgtcgggaacttcagccggctggagccccaccatggctgcaatccgaaagaagctggtgatcgttggggatggtgcctgtgggaagacctgcctcctcatcgtcttcagcaaggatcagtttccggaggtctacgtccctactgtctttgagaactatattgcggacattgaggtggacggcaagcaggtggagctggctctgtgggacacagcagggcaggaagactatgatcgactgcggcctctctcctacccggacactgatgtcatcctcatgtgcttctccatcgacagccctgacagcctggaaaacattcctgagaagtggaccccagaggtgaagcacttctgccccaacgtgcccatcatcctggtggggaataagaaggacctgaggcaagacgagcacaccaggagagagctggccaagatgaagcaggagcccgttcggtctgaggaaggccgggacatggcgaaccggatcagtgcctttggctaccttgagtgctcagccaagaccaaggagggagtgcgggaggtgtttgagatggccactcgggctggcctccaggtccgcaagaacaagcgtcggaggggctgtcccattctctgagatccccaaggcctttcctacatgccccctcccttcacaggggtacagaaattatccccctacaaccccagcctcctgagggctccatgctgaaggctcccattttcagttccctcctgcccaggactgcattgttttctagccccgaggtggtggcacgggccctccctcccagcgctctgggagccacgcctatgccctgcccttcctcagggcccctggggatcttgccccctttgaccttccccaaaggatggtcacacaccagcactttatacacttctggctcacaggaaagtgtctgcagtaggggacccagagtcccaggcccctggagttgttttcggcaggggccttgtctctcactgcatttggtcaggggggcatgaataaaggctacaggctccaa

SEQ ID NO: 296250 - DNA, 1144 bp, Homo sapiens
tccttgtaatccaagcagtcggggggtcagtctgagcctccggcaccggccgcgcagctggaggcggcggagcggaagccttgacttcatctcagctccagagcccgccctctcttcctgcagcctgggaacttcagccggctgggccccaccatggctgcaatccgaaagaagctggtgatcgttggggatggtgcctgtgggaagacctgcctcctcatcgtcttcagcaaggatcagtttccggaggtctacgtccctactgtctttgagaactatattgcggacattgaggtggacggcaagcaggtggagctggctctgtgggacacagcagggcaggaagactatgatcgactgcggcctctctcctacccggacactgatgtcatcctcatgtgcttctccatcgacagccctgacagcctggaaaacattcctgagaagtggaccccagaggtgaagcacttctgccccaacgtgcccatcatcctggtggggaataagaaggacctgaggcaagacgagcacaccaggagagagctggccaagatgaagcaggagcccgttcggtctgaggaaggccgggacatggcgaaccggatcagtgcctttggctaccttgagtgctcagccaagaccaaggagggagtgcgggaggtgtttgagatggccactcgggctggcctccaggtccgcaagaacaagcgtcggaggggctgtcccattctctgagatccccaaggcctttcctacatgccccctcccttcacaggggtacagaaattatccccctacaaccccagcctcctgagggctccatgctgaaggctcccattttcagttccctcctgcccaggactgcattgttttctagccccgaggtggtggcacgggccctccctcccagcgctctgggagccacgcctatgccctgcccttcctcagggcccctggggatcttgccccctttgaccttccccaaaggatggtcacacaccagcactttatacacttctggctcacaggaaagtgtctgcagtaggggacccagagtcccaggcccctggagttgttttcggcaggggccttgtctctcactgcatttggtcaggggggcatgaataaaggctacaggctccaa

SEQ ID NO: 296251 - DNA, 1191 bp, Homo sapiens
tccttgtaatccaagcagtcggggggtcagtctgagcctccggcaccggccgcgcagctggaggcggcggagcggaagccttgacttcatctcagctccagagcccgccctctcttcctgcagcctgggaacttcagccggctggggtcagttcccctccccagggaaggaggaagtgagggaagctgcgaagccccaccatggctgcaatccgaaagaagctggtgatcgttggggatggtgcctgtgggaagacctgcctcctcatcgtcttcagcaaggatcagtttccggaggtctacgtccctactgtctttgagaactatattgcggacattgaggtggacggcaagcaggtggagctggctctgtgggacacagcagggcaggaagactatgatcgactgcggcctctctcctacccggacactgatgtcatcctcatgtgcttctccatcgacagccctgacagcctggaaaacattcctgagaagtggaccccagaggtgaagcacttctgccccaacgtgcccatcatcctggtggggaataagaaggacctgaggcaagacgagcacaccaggagagagctggccaagatgaagcaggagcccgttcggtctgaggaaggccgggacatggcgaaccggatcagtgcctttggctaccttgagtgctcagccaagaccaaggagggagtgcgggaggtgtttgagatggccactcgggctggcctccaggtccgcaagaacaagcgtcggaggggctgtcccattctctgagatccccaaggcctttcctacatgccccctcccttcacaggggtacagaaattatccccctacaaccccagcctcctgagggctccatgctgaaggctcccattttcagttccctcctgcccaggactgcattgttttctagccccgaggtggtggcacgggccctccctcccagcgctctgggagccacgcctatgccctgcccttcctcagggcccctggggatcttgccccctttgaccttccccaaaggatggtcacacaccagcactttatacacttctggctcacaggaaagtgtctgcagtaggggacccagagtcccaggcccctggagttgttttcggcaggggccttgtctctcactgcatttggtcaggggggcatgaataaaggctacaggctccaa

SEQ ID NO: 296252 - DNA, 1256 bp, Homo sapiens
tccttgtaatccaagcagtcggggggtcagtctgagcctccggcaccggccgcgcagctggaggcggcggagcggagggaacttcagccggctggagccccaccatggctgcaatccgaaagaagctggtgatcgttggggatggtgcctgtgggaagacctgcctcctcatcgtcttcagcaaggatcagtttccggaggtctacgtccctactgtctttgagaactatattgcggacattgaggtggacggcaagcaggtggagctggctctgtgggacacagcagggcaggaagactatgatcgactgcggcctctctcctacccggacactgatgtcatcctcatgtgcttctccatcgacagccctgacagcctggaaaacattcctgagaagtggaccccagaggtgaagcacttctgccccaacgtgcccatcatcctggtggggaataagaaggacctgaggcaagacgagcacaccaggagagagctggccaagatgaagcaggagcccgttcggtctgaggaaggccgggacatggcgaaccggatcagtgcctttggctaccttgagtgctcagccaagaccaaggagggagtgcgggaggtgtttgagatggccactcgggctggcctccaggtccgcaagaacaagcgtcggaggggctgtcccattctctgagatccccaaggcctttcctacatgccccctcccttcacaggggtacagaaattatccccctacaaccccagcctcctgagggctccatgctgaaggctcccattttcagttccctcctgcccaggactgcattgttttctagccccgaggtggtggcacgggccctccctcccagcgctctgggagccacgcctatgccctgcccttcctcagggcccctggggatcttgccccctttgaccttccccaaaggatggtcacacaccagcactttatacacttctggctcacaggaaagtgtctgcagtaggggacccagagtcccaggcccctggagttgttttcggcaggggccttgtctctcactgcatttggtcaggggggcatgaataaaggctacaggctccaaaaaaaaaaaaaaaaaaaaaaaaaaatttggcgggcttgggcttggaaaagtttttagacacattctgtgtgggggggggccagtatggtagtaaattggcaaatgttcaaggaaccgggtagatagggtggtttccacaaaaaagcgggaacggttttgaa

SEQ ID NO: 296253 - DNA, 1120 bp, Homo sapiens
tccttgtaatccaagcagtcggggggtcagtctgagcctccggcaccggccgcgcagctggaggcggcggagcggagggaacttcagccggctggagccccaccatggctgcaatccgaaagaagctggtgatcgttggggatggtgcctgtgggaagacctgcctcctcatcgtcttcagcaaggatcagtttccggaggtctacgtccctactgtctttgagaactatattgcggacattgaggtggacggcaagcaggtggagctggctctgtgggacacagcagggcaggaagactatgatcgactgcggcctctctcctacccggacactgatgtcatcctcatgtgcttctccatcgacagccctgacagcctggaaaacattcctgagaagtggaccccagaggtgaagcacttctgccccaacgtgcccatcatcctggtggggaataagaaggacctgaggcaagacgagcacaccaggagagagctggccaagatgaagcaggagcccgttcggtctgaggaaggccgggacatggcgaaccggatcagtgcctttggctaccttgagtgctcagccaagaccaaggagggagtgcgggaggtgtttgagatggccactcgggctggcctccaggtccgcaagaacaagcgtcggaggggctgtcccattctctgagatccccaaggcctttcctacatgccccctcccttcacaggggtacagaaattatccccctacaaccccagcctcctgagggctccatgctgaaggctcccattttcagttccctcctgcccaggactgcattgttttctagccccgaggtggtggcacgggccctccctcccagcgctctgggagccacgcctatgccctgcccttcctcagggcccctggggatcttgccccctttgaccttccccaaaggatggtcacacaccagcactttatacacttctggctcacaggaaagtgtctgcagtaggggacccagagtcccaggcccctggagttgttttcggcaggggccttgtctctcactgcatttggtcaggggggcatgaataaaggctacaggctccaacgtgtgtggcagctttcggtctttc

SEQ ID NO: 296254 - DNA, 1519 bp, Homo sapiens
  misc_feature (1171)..(1171): n is a, c, g, or t
  misc_feature (1189)..(1189): n is a, c, g, or t
tccttgtaatccaagcagtcggggggtcagtctgagcctccggcaccggccgcgcagctggaggcggcggagcggagggaacttcagccggctggagccccaccatggctgcaatccgaaagaagctggtgatcgttggggatggtgcctgtgggaagacctgcctcctcatcgtcttcagcaaggatcagtttccggaggtctacgtccctactgtctttgagaactatattgcggacattgaggtggacggcaagcaggtggagctggctctgtgggacacagcagggcaggaagactatgatcgactgcggcctctctcctacccggacactgatgtcatcctcatgtgcttctccatcgacagccctgacagcctggaaaacattcctgagaagtggaccccagaggtgaagcacttctgccccaacgtgcccatcatcctggtggggaataagaaggacctgaggcaagacgagcacaccaggagagagctggccaagatgaagcaggagcccgttcggtctgaggaaggccgggacatggcgaaccggatcagtgcctttggctaccttgagtgctcagccaagaccaaggagggagtgcgggaggtgtttgagatggccactcgggctggcctccaggtccgcaagaacaagcgtcggaggggctgtcccattctctgagatccccaaggcctttcctacatgccccctcccttcacaggggtacagaaattatccccctacaaccccagcctcctgagggctccatgctgaaggctcccattttcagttccctcctgcccaggactgcattgttttctagccccgaggtggtggcacgggccctccctcccagcgctctgggagccacgcctatgccctgcccttcctcagggcccctggggatcttgccccctttgaccttccccaaaggatggtcacacaccagcactttatacacttctggctcacaggaaagtgtctgcagtaggggacccagagtcccaggcccctggagttgttttcggcaggggccttgtctctcactgcatttggtcaggggggcatgaataaaggctacaggctccaacgtgaaaaaaaaaaaaaaaaaaaaaaaaaaaaaaaaaaaaaaaaaaaaaaaaaaaaaaaaaaaaaaaaaaaaaaanaaaaaaaaaaaaaaaacnaaaaaaaaaaaaaaaagaggggggggggcggaaaaaatccccgggggggggaaaatgagattacgggcacgccgcactagtcaagtagaacagggaggcgccccacacaaaggagggtgtaatataaaaaaaggacggcgggaccgccgcaaacaacagcacgggtgaggatagaaaaccactgctgtcgcgtcaagcttggacgacagcacacccatggtgtggggggaaccaggcagacaacccacacggaaagataggccgggcgaacacaacaacgaggcggaggaggaacaccacacttgctagaaaaggtcggtaaacatttcg

SEQ ID NO: 296255 - DNA, 1365 bp, Homo sapiens
tccttgtaatccaagcagtcggggggtcagtctgagcctccggcaccggccgcgcagctggaggcggcggagcggagggaacttcagccggctggagccccaccatggctgcaatccgaaagaagctggtgatcgttggggatggtgcctgtgggaagacctgcctcctcatcgtcttcagcaaggatcagtttccggaggtctacgtccctactgtctttgagaactatattgcggacattgaggtggacggcaagcaggtggagctggctctgtgggacacagcagggcaggaagactatgatcgactgcggcctctctcctacccggacactgatgtcatcctcatgtgcttctccatcgacagccctgacagcctggaaaacattcctgagaagtggaccccagaggtgaagcacttctgccccaacgtgcccatcatcctggtggggaataagaaggacctgaggcaagacgagcacaccaggagagagctggccaagatgaagcaggagcccgttcggtctgaggaaggccgggacatggcgaaccggatcagtgcctttggctaccttgagtgctcagccaagaccaaggagggagtgcgggaggtgtttgagatggccactcgggctggcctccaggtccgcaagaacaagcgtcggaggggctgtcccattctctgagatccccaaggcctttcctacatgccccctcccttcacaggggtacagaaattatccccctacaaccccagcctcctgagggctccatgctgaaggctcccattttcagttccctcctgcccaggactgcattgttttctagccccgaggtggtggcacgggccctccctcccagcgctctgggagccacgcctatgccctgcccttcctcagggcccctggggatcttgccccctttgaccttccccaaaggatggtcacacaccagcactttatacacttctggctcacaggaaagtgtctgcagtaggggacccagagtcccaggcccctggagttgttttcggcaggggccttgtctctcactgcatttggtcaggggggcatgaataaaggctacaggctccaaaggttccaaaaaaaaaaaaaaaaaaacaaacaaaagacaccatcagaaaaacaaaaaaaactcgcctgagggctattctttttcgtcggggtggcgagaacaacgcgagcggttttagtaaaggggccactttgtttcaactattgttggtttcctgcgcaaccccccttttttctttgttccaagggggtggaaaattctgcgcgggcccccctattaagaggagcagaattaatttgaaaaaacgcgggtaccccggtttaaacagcg

SEQ ID NO: 296256 - DNA, 1395 bp, Homo sapiens
  misc_feature (1096)..(1100): n is a, c, g, or t
tccttgtaatccaagcagtcggggggtcagtctgagcctccggcaccggccgcgcagctggaggcggcggagcggagggaacttcagccggctggagccccaccatggctgcaatccgaaagaagctggtgatcgttggggatggtgcctgtgggaagacctgcctcctcatcgtcttcagcaaggatcagtttccggaggtctacgtccctactgtctttgagaactatattgcggacattgaggtggacggcaagcaggtggagctggctctgtgggacacagcagggcaggaagactatgatcgactgcggcctctctcctacccggacactgatgtcatcctcatgtgcttctccatcgacagccctgacagcctggaaaacattcctgagaagtggaccccagaggtgaagcacttctgccccaacgtgcccatcatcctggtggggaataagaaggacctgaggcaagacgagcacaccaggagagagctggccaagatgaagcaggagcccgttcggtctgaggaaggccgggacatggcgaaccggatcagtgcctttggctaccttgagtgctcagccaagaccaaggagggagtgcgggaggtgtttgagatggccactcgggctggcctccaggtccgcaagaacaagcgtcggaggggctgtcccattctctgagatccccaaggcctttcctacatgccccctcccttcacaggggtacagaaattatccccctacaaccccagcctcctgagggctccatgctgaaggctcccattttcagttccctcctgcccaggactgcattgttttctagccccgaggtggtggcacgggccctccctcccagcgctctgggagccacgcctatgccctgcccttcctcagggcccctggggatcttgccccctttgaccttccccaaaggatggtcacacaccagcactttatacacttctggctcacaggaaagtgtctgcagtaggggacccagagtcccaggcccctggagttgttttcggcaggggccttgtctctcactgcatttggtcaggggggcatgaataaaggctacaggctccaannnnnaaaaaaaaaaaaaaaaaaaaatttttgggcggcttgggccttgaaaaatgtttttaaaacatttgtgttggggacgcgcccggggccccaggagcggtacgtgacacatgtggcgccgaaacgctggtcccaagggagaacccggggccaacacacacggcgcgggatttccccaccagttaaaaaacgcccgggtggccgccgaaagtggtctagacacatcccaagggggtccggagggccaagggggtcgcattacaagggagtgccaaaggaacgtccgatataattatcc

SEQ ID NO: 296257 - DNA, 1545 bp, Homo sapiens
  misc_feature (1096)..(1100): n is a, c, g, or t
  misc_feature (1197)..(1197): n is a, c, g, or t
  misc_feature (1215)..(1215): n is a, c, g, or t
tccttgtaatccaagcagtcggggggtcagtctgagcctccggcaccggccgcgcagctggaggcggcggagcggagggaacttcagccggctggagccccaccatggctgcaatccgaaagaagctggtgatcgttggggatggtgcctgtgggaagacctgcctcctcatcgtcttcagcaaggatcagtttccggaggtctacgtccctactgtctttgagaactatattgcggacattgaggtggacggcaagcaggtggagctggctctgtgggacacagcagggcaggaagactatgatcgactgcggcctctctcctacccggacactgatgtcatcctcatgtgcttctccatcgacagccctgacagcctggaaaacattcctgagaagtggaccccagaggtgaagcacttctgccccaacgtgcccatcatcctggtggggaataagaaggacctgaggcaagacgagcacaccaggagagagctggccaagatgaagcaggagcccgttcggtctgaggaaggccgggacatggcgaaccggatcagtgcctttggctaccttgagtgctcagccaagaccaaggagggagtgcgggaggtgtttgagatggccactcgggctggcctccaggtccgcaagaacaagcgtcggaggggctgtcccattctctgagatccccaaggcctttcctacatgccccctcccttcacaggggtacagaaattatccccctacaaccccagcctcctgagggctccatgctgaaggctcccattttcagttccctcctgcccaggactgcattgttttctagccccgaggtggtggcacgggccctccctcccagcgctctgggagccacgcctatgccctgcccttcctcagggcccctggggatcttgccccctttgaccttccccaaaggatggtcacacaccagcactttatacacttctggctcacaggaaagtgtctgcagtaggggacccagagtcccaggcccctggagttgttttcggcaggggccttgtctctcactgcatttggtcaggggggcatgaataaaggctacaggctccaannnnnaaaaaaaaaaaaaaaaaaaaacgtgaaaaaaaaaaaaaaaaaaaaaaaaaaaaaaaaaaaaaaaaaaaaaaaaaaaaaaaaaaaaaaaaaaaaaaanaaaaaaaaaaaaaaaacnaaaaaaaaaaaaaaaagaggggggggggcggaaaaaatccccgggggggggaaaatgagattacgggcacgccgcactagtcaagtagaacagggaggcgccccacacaaaggagggtgtaatataaaaaaaggacggcgggaccgccgcaaacaacagcacgggtgaggatagaaaaccactgctgtcgcgtcaagcttggacgacagcacacccatggtgtggggggaaccaggcagacaacccacacggaaagataggccgggcgaacacaacaacgaggcggaggaggaacaccacacttgctagaaaaggtcggtaaacatttcg

SEQ ID NO: 296258 - DNA, 1221 bp, Homo sapiens
tccttgtaatccaagcagtcggggggtcagtctgagcctccggcaccggccgcgcagctggaggcggcggagcggaagccttgacttcatctcagctccagagcccgccctctcttcctgcagcctgggaacttcagccggctgggccccaccatggctgcaatccgaaagaagctggtgatcgttggggatggtgcctgtgggaagacctgcctcctcatcgtcttcagcaaggatcagtttccggaggtctacgtccctactgtctttgagaactatattgcggacattgaggtggacggcaagcagactggctctgtaacctgggccgagtccctttgcctctgggtttaagctcccccacctgcaaaatggggatgatgcaggtggagctggctctgtgggacacagcagggcaggaagactatgatcgactgcggcctctctcctacccggacactgatgtcatcctcatgtgcttctccatcgacagccctgacagcctggaaaacattcctgagaagtggaccccagaggtgaagcacttctgccccaacgtgcccatcatcctggtggggaataagaaggacctgaggcaagacgagcacaccaggagagagctggccaagatgaagcaggagcccgttcggtctgaggaaggccgggacatggcgaaccggatcagtgcctttggctaccttgagtgctcagccaagaccaaggagggagtgcgggaggtgtttgagatggccactcgggctggcctccaggtccgcaagaacaagcgtcggaggggctgtcccattctctgagatccccaaggcctttcctacatgccccctcccttcacaggggtacagaaattatccccctacaaccccagcctcctgagggctccatgctgaaggctcccattttcagttccctcctgcccaggactgcattgttttctagccccgaggtggtggcacgggccctccctcccagcgctctgggagccacgcctatgccctgcccttcctcagggcccctggggatcttgccccctttgaccttccccaaaggatggtcacacaccagcactttatacacttctggctcacaggaaagtgtctgcagtaggggacccagagtcccaggcccctggagttgttttcggcaggggccttgtctctcactgcatttggtcaggggggcatgaataaaggctacaggctccaa

SEQ ID NO: 296259 - DNA, 1171 bp, Homo sapiens
tccttgtaatccaagcagtcggggggtcagtctgagcctccggcaccggccgcgcagctggaggcggcggagcggagggaacttcagccggctgggccccaccatggctgcaatccgaaagaagctggtgatcgttggggatggtgcctgtgggaagacctgcctcctcatcgtcttcagcaaggatcagtttccggaggtctacgtccctactgtctttgagaactatattgcggacattgaggtggacggcaagcagactggctctgtaacctgggccgagtccctttgcctctgggtttaagctcccccacctgcaaaatggggatgatgcaggtggagctggctctgtgggacacagcagggcaggaagactatgatcgactgcggcctctctcctacccggacactgatgtcatcctcatgtgcttctccatcgacagccctgacagcctggaaaacattcctgagaagtggaccccagaggtgaagcacttctgccccaacgtgcccatcatcctggtggggaataagaaggacctgaggcaagacgagcacaccaggagagagctggccaagatgaagcaggagcccgttcggtctgaggaaggccgggacatggcgaaccggatcagtgcctttggctaccttgagtgctcagccaagaccaaggagggagtgcgggaggtgtttgagatggccactcgggctggcctccaggtccgcaagaacaagcgtcggaggggctgtcccattctctgagatccccaaggcctttcctacatgccccctcccttcacaggggtacagaaattatccccctacaaccccagcctcctgagggctccatgctgaaggctcccattttcagttccctcctgcccaggactgcattgttttctagccccgaggtggtggcacgggccctccctcccagcgctctgggagccacgcctatgccctgcccttcctcagggcccctggggatcttgccccctttgaccttccccaaaggatggtcacacaccagcactttatacacttctggctcacaggaaagtgtctgcagtaggggacccagagtcccaggcccctggagttgttttcggcaggggccttgtctctcactgcatttggtcaggggggcatgaataaaggctacaggctccaa

SEQ ID NO: 296260 - DNA, 969 bp, Homo sapiens
tccttgtaatccaagcagtcggggggtcagtctgagcctccggcaccggccgcgcagctggaggcggcggagcggagggaacttcagccggctggagccccaccatggctgcaatccgaaagaagctggtgatcgttggggatggtgcctgtgggaagacctgcctcctcatcgtcttcagcaaggatcagtttccggaggtctacgtccctactgtctttgagaactatattgcggacattgaggtggacggcaagcaggtggagctggctctgtgggacacagcagggcaggaagactatgatcgactgcggcctctctcctacccggacactgatgtcatcctcatgtgcttctccatcgacagccctgacagcctggaaaacattcctgagaagtggaccccagaggtgaagcacttctgccccaacgtgcccatcatcctggtggggaataagaaggacctgaggcaagacgagcacaccaggagagagctggccaagatgaagcaggagcccgttcggtctgaggaaggccgggacatggcgaaccggatcagtgcctttggctaccttgagtgctcagccaagaccaaggagggagtgcgggaggtgtttgagatggccactcgggctggcctccaggtccgcaagaacaagcgtcggaggggctgtcccattctctgagatccccaaggcctttcctacatgccccctcccttcacaggggtacagaaattatccccctacaaccccagcctcctgagggctccatgctgaaggctcccattttcagttccctcctgcccaggactgcattgttttctagccccgaggtggtggcacgggccctccctcccagcgctctgggagccacgcctatgccctgcccttcctcagggcccctggggatcttgcccacctcggccacccaaagtgctgggattacaggtgagagccactgcactag

SEQ ID NO: 296261 - DNA, 1450 bp, Homo sapiens
tccttgtaatccaagcagtcggggggtcagtctgagcctccggcaccggccgcgcagctggaggcggcggagcggaagccttgacttcatctcagctccagagcccgccctctcttcctgcagcctgggaacttcagccggctggagccccaccatggctgcaatccgaaagaagctggtgatcgttggggatggtgcctgtgggaagacctgcctcctcatcgtcttcagcaaggatcagtttccggaggtctacgtccctactgtctttgagaactatattgcggacattgaggtggacggcaagcaggtggagctggctctgtgggacacagcagggcaggaagactatgatcgactgcggcctctctcctacccggacactgatgtcatcctcatgtgcttctccatcgacagccctgacagcctgggtgaggggattggagggaggggactgagaaccccttggaatcagccagaggtctcgtgccttggcctgtcttcagtcatcttcagaggtgggggtggggatgcaggggagcactcaggccctgttggtctcctttactgtggtaactggccctctgagggcatactactgttgaggttttgagctgtgaaagggaccatcatgctgaatggcttctaagactgctctgggaagatgagggcccccccaggggagctttctagcttaagtggaggcaccgacacctgttggtgcatgtctacacagaaaacattcctgagaagtggaccccagaggtgaagcacttctgccccaacgtgcccatcatcctggtggggaataagaaggacctgaggcaagacgagcacaccaggagagagctggccaagatgaagcaggagcccgttcggtctgaggaaggccgggacatggcgaaccggatcagtgcctttggctaccttgagtgctcagccaagaccaaggagggagtgcgggaggtgtttgagatggccactcgggctggcctccaggtccgcaagaacaagcgtcggaggggctgtcccattctctgagatccccaaggcctttcctacatgccccctcccttcacaggggtacagaaattatccccctacaaccccagcctcctgagggctccatgctgaaggctcccattttcagttccctcctgcccaggactgcattgttttctagccccgaggtggtggcacgggccctccctcccagcgctctgggagccacgcctatgccctgcccttcctcagggcccctggggatcttgccccctttgaccttccccaaaggatggtcacacaccagcactttatacacttctggctcacaggaaagtgtctgcagtaggggacccagagtcccaggcccctggagttgttttcggcaggggccttgtctctcactgcatttggtcaggggggcatgaataaaggctacaggctccaa

SEQ ID NO: 296262 - DNA, 769 bp, Homo sapiens
cgagctcgggtaccctatattgtccggccgcgcagctggaggcggcggagcggagaaaacattcctgagaagtggaccccagaggtgaagcacttctgccccaacgtgcccatcatcctggtggggaataagaaggacctgaggcaagacgagcacaccaggagagagctggccaagatgaagcaggagcccgttcggtctgaggaaggccgggacatggcgaaccggatcagtgcctttggctaccttgagtgctcagccaagaccaaggagggagtgcgggaggtgtttgagatggccactcgggctggcctccaggtccgcaagaacaagcgtcggaggggctgtcccattctctgagatccccaaggcctttcctacatgccccctcccttcacaggggtacagaaattatccccctacaaccccagcctcctgagggctccatgctgaaggctcccattttcagttccctcctgcccaggactgcattgttttctagccccgaggtggtggcacgggccctccctcccagcgctctgggagccacgcctatgccctgcccttcctcagggcccctggggatcttgccccctttgaccttccccaaaggatggtcacacaccagcactttatacacttctggctcacaggaaagtgtctgcagtaggggacccagagtcccaggcccctggagttgttttcggcaggggccttgtctctcactgcatttggtcaggggggcatgaataaaggctacaggctccaa

SEQ ID NO: 296263 - DNA, 1090 bp, Homo sapiens
tccttgtaatccaagcagtcggggggtcagtctgagcctccggcaccggccgcgcagctggaggcggcggagcggaagccttgacttcatctcagctccagagcccgccctctcttcctgcagcctgggaacttcagccggctggagccccaccatggctgcaatccgaaagaagctggtgatcgttggggatggtgcctgtgggaagacctgcctcctcatcgtcttcagcaaggatcagtttccggaggtctacgtccctactgtctttgagaactatattgcggacattgaggtggacggcaagcaggtggagctggctctgtgggacacagcagggcaggaagactatgatcgactgcggcctctctcctacccggacactgatgtcatcctcatgtgcttctccatcgacagccctgacagcctgccatcatcctggtggggaataagaaggacctgaggcaagacgagcacaccaggagagagctggccaagatgaagcaggagcccgttcggtctgaggaaggccgggacatggcgaaccggatcagtgcctttggctaccttgagtgctcagccaagaccaaggagggagtgcgggaggtgtttgagatggccactcgggctggcctccaggtccgcaagaacaagcgtcggaggggctgtcccattctctgagatccccaaggcctttcctacatgccccctcccttcacaggggtacagaaattatccccctacaaccccagcctcctgagggctccatgctgaaggctcccattttcagttccctcctgcccaggactgcattgttttctagccccgaggtggtggcacgggccctccctcccagcgctctgggagccacgcctatgccctgcccttcctcagggcccctggggatcttgccccctttgaccttccccaaaggatggtcacacaccagcactttatacacttctggctcacaggaaagtgtctgcagtaggggacccagagtcccaggcccctggagttgttttcggcaggggccttgtctctcactgcatttggtcaggggggcatgaataaaggctacaggctccaa

SEQ ID NO: 296264 - DNA, 1395 bp, Homo sapiens
tccttgtaatccaagcagtcggggggtcagtctgagcctccggcaccggccgcgcagctggaggcggcggagcggaagccttgacttcatctcagctccagagcccgccctctcttcctgcagcctgggaacttcagccggctggagccccaccatggctgcaatccgaaagaagctggtgatcgttggggatggtgcctgtgggaagacctgcctcctcatcgtcttcagcaaggatcagtttccggaggtctacgtccctactgtctttgagaactatattgcggacattgaggtggacggcaagcaggtggagctggctctgtgggacacagcagggcaggaagactatgatcgactgcggcctctctcctacccggacactgatgtcatcctcatgtgcttctccatcgacagccctgacagcctgggtgaggggattggagggaggggactgagaaccccttggaatcagccagaggtctcgtgccttggcctgtcttcagtcatcttcagaggtgggggtggggatgcaggggagcactcaggccctgttggtctcctttactgtggtaactggccctctgagggcatactactgttgaggttttgagctgtgaaagggaccatcatgctgaatggcttctaagactgctctgggaagatgagggcccccccaggggagctttctagcttaagtggaggcaccgacacctgttggtgcatgtctacacaccatcatcctggtggggaataagaaggacctgaggcaagacgagcacaccaggagagagctggccaagatgaagcaggagcccgttcggtctgaggaaggccgggacatggcgaaccggatcagtgcctttggctaccttgagtgctcagccaagaccaaggagggagtgcgggaggtgtttgagatggccactcgggctggcctccaggtccgcaagaacaagcgtcggaggggctgtcccattctctgagatccccaaggcctttcctacatgccccctcccttcacaggggtacagaaattatccccctacaaccccagcctcctgagggctccatgctgaaggctcccattttcagttccctcctgcccaggactgcattgttttctagccccgaggtggtggcacgggccctccctcccagcgctctgggagccacgcctatgccctgcccttcctcagggcccctggggatcttgccccctttgaccttccccaaaggatggtcacacaccagcactttatacacttctggctcacaggaaagtgtctgcagtaggggacccagagtcccaggcccctggagttgttttcggcaggggccttgtctctcactgcatttggtcaggggggcatgaataaaggctacaggctccaa

SEQ ID NO: 296265 - DNA, 1221 bp, Homo sapiens
tccttgtaatccaagcagtcggggggtcagtctgagcctccggcaccggccgcgcagctggaggcggcggagcggaagggcaaggtgaactaatggagtgggtggaggagttggaagaaatcccagcgtcagtcaccgggatagaattcccaaggaaccctctttttggaggatggtttccatttctggaggcgatctgccgacaggagccttgacttcatctcagctccagagcccgccctctcttcctgcagcctgggaacttcagccggctggagccccaccatggctgcaatccgaaagaagctggtgatcgttggggatggtgcctgtgggaagacctgcctcctcatcgtcttcagcaaggatcagtttccggaggtctacgtccctactgtctttgagaactatattgcggacattgaggtggacggcaagcaggtggagctggctctgtgggacacagcagggcaggaagactatgatcgactgcggcctctctcctacccggacactgatgtcatcctcatgtgcttctccatcgacagccctgacagcctgccatcatcctggtggggaataagaaggacctgaggcaagacgagcacaccaggagagagctggccaagatgaagcaggagcccgttcggtctgaggaaggccgggacatggcgaaccggatcagtgcctttggctaccttgagtgctcagccaagaccaaggagggagtgcgggaggtgtttgagatggccactcgggctggcctccaggtccgcaagaacaagcgtcggaggggctgtcccattctctgagatccccaaggcctttcctacatgccccctcccttcacaggggtacagaaattatccccctacaaccccagcctcctgagggctccatgctgaaggctcccattttcagttccctcctgcccaggactgcattgttttctagccccgaggtggtggcacgggccctccctcccagcgctctgggagccacgcctatgccctgcccttcctcagggcccctggggatcttgccccctttgaccttccccaaaggatggtcacacaccagcactttatacacttctggctcacaggaaagtgtctgcagtaggggacccagagtcccaggcccctggagttgttttcggcaggggccttgtctctcactgcatttggtcaggggggcatgaataaaggctacaggctccaa

SEQ ID NO: 296266 - DNA, 1142 bp, Homo sapiens
  misc_feature (492)..(492): n is a, c, g, or t
  misc_feature (501)..(501): n is a, c, g, or t
tccttgtaatccaagcagtcggggggtcagtctgagcctccggcaccggccgcgcagctggaggcggcggagcggaagccttgacttcatctcagctccagagcccgccctctcttcctgcagcctgggaacttcagccggctggagccccaccatggctgcaatccgaaagaagctggtgatcgttggggatggtgcctgtgggaagacctgcctcctcatcgtcttcagcaaggatcagtttccggaggtctacgtccctactgtctttgagaactatattgcggacattgaggtggacggcaagcaggtggagctggctctgtgggacacagcagggcaggaagactatgatcgactgcggcctctctcctacccggacactgatgtcatcctcatgtgcttctccatcgacagccctgacagcctggaaaacattcctgagaagtggaccccagaggtgaagcacttctgccccaacgtgcccatatnctggtgggnataagaggacctgaggcaagacgagcacaccaggagagagctggccaagatgaagcaggagcccgttcggtctgaggaaggccgggacatggcgaaccggatcagtgcctttggctaccttgagtgctcagccaagaccaaggagggagtgcgggaggtgtttgagatggccactcgggctggcctccaggtccgcaagaacaagcgtcggaggggctgtcccattctctgagatccccaaggcctttcctacatgccccctcccttcacaggggtacagaaattatccccctacaaccccagcctcctgagggctccatgctgaaggctcccattttcagttccctcctgcccaggactgcattgttttctagccccgaggtggtggcacgggccctccctcccagcgctctgggagccacgcctatgccctgcccttcctcagggcccctggggatcttgccccctttgaccttccccaaaggatggtcacacaccagcactttatacacttctggctcacaggaaagtgtctgcagtaggggacccagagtcccaggcccctggagttgttttcggcaggggccttgtctctcactgcatttggtcaggggggcatgaataaaggctacaggctccaa

SEQ ID NO: 296267 - DNA, 1009 bp, Homo sapiens
tccttgtaatccaagcagtcggggggtcagtctgagcctccggcaccggccgcgcagctggaggcggcggagcggaagccttgacttcatctcagctccagagcccgccctctcttcctgcagcctgggaacttcagccggctggagccccaccatggctgcaatccgaaagaagctggtgatcgttggggatggtgcctgtgggaagacctgcctcctcatcgtcttcagcaaggatcagtttccggaggtctacgtccctactgtctttgagaactatattgcggacattgaggtggacggcaagcaggtggagctggctctgtgggacacagcagggcaggaagactatgatcgactgcggcctctctcctacccggacactgatgtcatcctcatgtgcttctccatcgacagccctgacagcctgccgttcggtctgaggaaggccgggacatggcgaaccggatcagtgcctttggctaccttgagtgctcagccaagaccaaggagggagtgcgggaggtgtttgagatggccactcgggctggcctccaggtccgcaagaacaagcgtcggaggggctgtcccattctctgagatccccaaggcctttcctacatgccccctcccttcacaggggtacagaaattatccccctacaaccccagcctcctgagggctccatgctgaaggctcccattttcagttccctcctgcccaggactgcattgttttctagccccgaggtggtggcacgggccctccctcccagcgctctgggagccacgcctatgccctgcccttcctcagggcccctggggatcttgccccctttgaccttccccaaaggatggtcacacaccagcactttatacacttctggctcacaggaaagtgtctgcagtaggggacccagagtcccaggcccctggagttgttttcggcaggggccttgtctctcactgcatttggtcaggggggcatgaataaaggctacaggctccaa

SEQ ID NO: 296268 - DNA, 1024 bp, Homo sapiens
tccttgtaatccaagcagtcggggggtcagtctgagcctccggcaccggccgcgcagctggaggcggcggagcggagccccaccatggctgcaatccgaaagaagctggtgatcgttggggatggtgcctgtgggaagacctgcctcctcatcgtcttcagcaaggatcagtttccggaggtctacgtccctactgtctttgagaactatattgcggacattgaggtggacggcaagcaggtggagctggctctgtgggacacagcagggcaggaagactatgatcgactgcggcctctctcctacccggacactgatgtcatcctcatgtgcttctccatcgacagccctgacagcctggaaaacattcctgagaagtggaccccagaggtgaagcacttctgccccaacgtgcccatcatcctggtggggaataagaaggaccccgttcggtctgaggaaggccgggacatggcgaaccggatcagtgcctttggctaccttgagtgctcagccaagaccaaggagggagtgcgggaggtgtttgagatggccactcgggctggcctccaggtccgcaagaacaagcgtcggaggggctgtcccattctctgagatccccaaggcctttcctacatgccccctcccttcacaggggtacagaaattatccccctacaaccccagcctcctgagggctccatgctgaaggctcccattttcagttccctcctgcccaggactgcattgttttctagccccgaggtggtggcacgggccctccctcccagcgctctgggagccacgcctatgccctgcccttcctcagggcccctggggatcttgccccctttgaccttccccaaaggatggtcacacaccagcactttatacacttctggctcacaggaaagtgtctgcagtaggggacccagagtcccaggcccctggagttgttttcggcaggggccttgtctctcactgcatttggtcaggggggcatgaataaaggctacaggctccaa

SEQ ID NO: 296269 - DNA, 1055 bp, Homo sapiens
tccttgtaatccaagcagtcggggggtcagtctgagcctccggcaccggccgcgcagctggaggcggcggagcggaagccttgacttcatctcagctccagagcccgccctctcttcctgcagcctgggaacttcagccggctggagccccaccatggctgcaatccgaaagaagctggtgatcgttggggatggtgcctgtgggaagacctgcctcctcatcgtcttcagcaaggatcagtttccggaggtctacgtccctactgtctttgagaactatattgcggacattgaggtggacggcaagcaggtggagctggctctgtgggacacagcagggcaggaagactatgatcgactgcggcctctctcctacccggacactgatgtcatcctcatgtgcttctccatcgacagccctgacagcctggaaaacattcctgagaagtggaccccagaggtgaagcacttctgccccaacgtgcccatcatcctggtggggaataagaaggacctgaggcaagacgagcacaccaggagagagctggccaagatgaagcaggagcccgttcggtctgaggaaggccgggacatggcgaaccggatcagtgcctttggctaccttgagtgctcagccattctctgagatccccaaggcctttcctacatgccccctcccttcacaggggtacagaaattatccccctacaaccccagcctcctgagggctccatgctgaaggctcccattttcagttccctcctgcccaggactgcattgttttctagccccgaggtggtggcacgggccctccctcccagcgctctgggagccacgcctatgccctgcccttcctcagggcccctggggatcttgccccctttgaccttccccaaaggatggtcacacaccagcactttatacacttctggctcacaggaaagtgtctgcagtaggggacccagagtcccaggcccctggagttgttttcggcaggggccttgtctctcactgcatttggtcaggggggcatgaataaaggctacaggctccaa

SEQ ID NO: 296270 - DNA, 984 bp, Homo sapiens
tccttgtaatccaagcagtcggggggtcagtctgagcctccggcaccggccgcgcagctggaggcggcggagcggaagccttgacttcatctcagctccagagcccgccctctcttcctgcagcctgggaacttcagccggctggagccccaccatggctgcaatccgaaagaagctggtgatcgttggggatggtgcctgtgggaagacctgcctcctcatcgtcttcagcaaggatcagtttccggaggtctacgtccctactgtctttgagaactatattgcggacattgaggtggacggcaagcaggtggagctggctctgtgggacacagcagggcaggaagactatgatcgactgcggcctctctcctacccggacactgatgtcatcctcatgtgcttctccatcgacagccctgacagcctggaaaacattcctgagaagtggaccccagaggtgaagcacttctgccccaacgtgcccatcatcctggtggggaataagaaggacctgaggcaagacgagcacaccaggagagagctggccaagatgaagcaggagcattctctgagatccccaaggcctttcctacatgccccctcccttcacaggggtacagaaattatccccctacaaccccagcctcctgagggctccatgctgaaggctcccattttcagttccctcctgcccaggactgcattgttttctagccccgaggtggtggcacgggccctccctcccagcgctctgggagccacgcctatgccctgcccttcctcagggcccctggggatcttgccccctttgaccttccccaaaggatggtcacacaccagcactttatacacttctggctcacaggaaagtgtctgcagtaggggacccagagtcccaggcccctggagttgttttcggcaggggccttgtctctcactgcatttggtcaggggggcatgaataaaggctacaggctccaa

SEQ ID NO: 296271 - DNA, 704 bp, Homo sapiens
tccttgtaatccaagcagtcggggggtcagtctgagcctccggcaccggccgcgcagctggaggcggcggagcggagggaacttcagccggctggagccccaccatggctgcaatccgaaagaagctggtgatcgttggggatggtgcctgtgggaagacctgcctcctcatcgtcttcagcaaggatcagtttccggaggtctacgtccctactgtctttgagaactatattgcggacattgaggtggacggcaagcaggtggagctggctctgtgggacacagcagggcaggaagactatgatcgactgcggcctctctcctacccggacactgatgtcatcctcatgtgcttctccatcgacagccctgacagcctggaaaacattcctgagaagtggaccccagaggtgaagcacttctgccccaacgtgcccatcatcctggtggggaataagaaggacctgaggcaagacgagcacaccaggagagagctggccaagatgaagcaggagcccgttcggtctgaggaaggccgggacatggcgaaccggatcagtgcctttggctaccttgagtgctcagccaagaccaaggagggagtgcgggaggtgtttgagatggccactcgggctggcctccaggtccgcaagaacaagcgtcggaggggctgtcccattctctgaggatccccaagtccttta

SEQ ID NO: 296272 - DNA, 907 bp, Homo sapiens
  misc_feature (702)..(702): n is a, c, g, or t
  misc_feature (831)..(831): n is a, c, g, or t
  misc_feature (865)..(865): n is a, c, g, or t
tccttgtaatccaagcagtcggggggtcagtctgagcctccggcaccggccgcgcagctggaggcggcggagcggagggaacttcagccggctggagccccaccatggctgcaatccgaaagaagctggtgatcgttggggatggtgcctgtgggaagacctgcctcctcatcgtcttcagcaaggatcagtttccggaggtctacgtccctactgtctttgagaactatattgcggacattgaggtggacggcaagcaggtggagctggctctgtgggacacagcagggcaggaagactatgatcgactgcggcctctctcctacccggacactgatgtcatcctcatgtgcttctccatcgacagccctgacagcctggaaaacattcctgagaagtggaccccagaggtgaagcacttctgccccaacgtgcccatcatcctggtggggaataagaaggacctgaggcaagacgagcacaccaggagagagctggccaagatgaagcaggagcccgttcggtctgaggaaggccgggacatggcgaaccggatcagtgcctttggctaccttgagtgctcagccaagaccaaggagggagtgcgggaggtgtttgagatggccactcgggctggcctccaggtccgcaagaacaagcgtcggaggggctgtcccattctgcagcgatgtcagggaacanaccagaggcagccatacttcatctattttcctcaaatcaagacagagaagtcaggtagcattggtgctgcagatagtcctgagaactgggagaaagtctgggacaactggaggctgctgacaatggccnggatctttgacttgctgggagcccccagaggganggagatgtcctgtatttcctattaccatcattacagtgggat

SEQ ID NO: 296273 - DNA, 744 bp, Homo sapiens
tccttgtaatccaagcagtcggggggtcagtctgagcctccggcaccggccgcgcagctggaggcggcggagcggagggaacttcagccggctggagccccaccatggctgcaatccgaaagaagctggtgatcgttggggatggtgcctgtgggaagacctgcctcctcatcgtcttcagcaaggatcagtttccggaggtctacgtccctactgtctttgagaactatattgcggacattgaggtggacggcaagcaggtggagctggctctgtgggacacagcagggcaggaagactatgatcgactgcggcctctctcctacccggacactgatgtcatcctcatgtgcttctccatcgacagccctgacagcctggaaaacattcctgagaagtggaccccagaggtgaagcacttctgccccaacgtgcccatcatcctggtggggaataagaaggacctgaggcaagacgagcacaccaggagagagctggccaagatgaagcaggagcccgttcggtctgaggaaggccgggacatggcgaaccggatcagtgcctttggctaccttgagtgctcagccaagaccaaggagggagtgcgggaggtgtttgagatggccactcgggctggcctccaggtccgcaagaacaagcgtcggaggggctgtcccgcagcccccgcaagacgtgggaaggagtgctgtctgcgcctgccctccgctgggcacagcgtggctg

SEQ ID NO: 296274 - DNA, 1479 bp, Homo sapiens
  misc_feature (1131)..(1131): n is a, c, g, or t
  misc_feature (1149)..(1149): n is a, c, g, or t
tccttgtaatccaagcagtcggggggtcagtctgagcctccggcaccggccgcgcagctggaggcggcggagcggaagccttgacttcatctcagctccagagcccgccctctcttcctgcagcctgggaacttcagccggctggagccccaccatggctgcaatccgaaagaagctggtgatcgttggggatggtgcctgtgggaagacctgcctcctcatcgtcttcagcaaggatcagtttccggaggtctacgtccctactgtctttgagaactatattgcggacattgaggtggacggcaagcaggtggagctggctctgtgggacacagcagggcaggaagactatgatcgactgcggcctctctcctacccggacactgatgtcatcctcatgtgcttctccatcgacagccctgacagcctggaaaacattcctgagaagtggaccccagaggtgaagcacttctgccccaacgtgcccatcatcctggtggggaataagaaggacctgaggcaagacgagcacaccaggagagagctggccaagatgaagcaggagcccgttcggtctgaggaaggccgggacatggcgaaccggatcagtgcctttggctaccttgagtgctcagccattctctgagatccccaaggcctttcctacatgccccctcccttcacaggggtacagaaattatccccctacaaccccagcctcctgagggctccatgctgaaggctcccattttcagttccctcctgcccaggactgcattgttttctagccccgaggtggtggcacgggccctccctcccagcgctctgggagccacgcctatgccctgcccttcctcagggcccctggggatcttgccccctttgaccttccccaaaggatggtcacacaccagcactttatacacttctggctcacaggaaagtgtctgcagtaggggacccagagtcccaggcccctggagttgttttcggcaggggccttgtctctcactgcatttggtcaggggggcatgaataaaggctacaggctccaacgtgaaaaaaaaaaaaaaaaaaaaaaaaaaaaaaaaaaaaaaaaaaaaaaaaaaaaaaaaaaaaaaaaaaaaaaanaaaaaaaaaaaaaaaacnaaaaaaaaaaaaaaaagaggggggggggcggaaaaaatccccgggggggggaaaatgagattacgggcacgccgcactagtcaagtagaacagggaggcgccccacacaaaggagggtgtaatataaaaaaaggacggcgggaccgccgcaaacaacagcacgggtgaggatagaaaaccactgctgtcgcgtcaagcttggacgacagcacacccatggtgtggggggaaccaggcagacaacccacacggaaagataggccgggcgaacacaacaacgaggcggaggaggaacaccacacttgctagaaaaggtcggtaaacatttcg

SEQ ID NO: 296275 - DNA, 653 bp, Homo sapiens
tccttgtaatccaagcagtcggggggtcagtctgagcctccggcaccggccgcgcagctggaggcggcggagcggagggaacttcagccggctggagccccaccatggctgcaatccgaaagaagctggtgatcgttggggatggtgcctgtgggaagacctgcctcctcatcgtcttcagcaaggatcagtttccggaggtctacgtccctactgtctttgagaactatattgcggacattgaggtggacggcaagcaggtggagctggctctgtgggacacagcagggcaggaagactatgatcgactgcggcctctctcctacccggacactgaaggctcccattttcagttccctcctgcccaggactgcattgttttctagccccgaggtggtggcacgggccctccctcccagcgctctgggagccacgcctatgccctgcccttcctcagggcccctggggatcttgccccctttgaccttccccaaaggatggtcacacaccagcactttatacacttctggctcacaggaaagtgtctgcagtaggggacccagagtcccaggcccctggagttgttttcggcaggggccttgtctctcactgcatttggtcaggggggcatgaataaaggctacaggctccaa

SEQ ID NO: 296276 - DNA, 1334 bp, Homo sapiens
  misc_feature (681)..(681): n is a, c, g, or t
  misc_feature (1056)..(1056): n is a, c, g, or t
  misc_feature (1167)..(1167): n is a, c, g, or t
  misc_feature (1236)..(1236): n is a, c, g, or t
  misc_feature (1267)..(1267): n is a, c, g, or t
  misc_feature (1271)..(1271): n is a, c, g, or t
  misc_feature (1301)..(1301): n is a, c, g, or t
  misc_feature (1304)..(1304): n is a, c, g, or t
tccttgtaatccaagcagtcggggggtcagtctgagcctccggcaccggccgcgcagctggaggcggcggagcggaagccttgacttcatctcagctccagagcccgccctctcttcctgcagcctgggaacttcagccggctggagccccaccatggctgcaatccgaaagaagctggtgatcgttggggatggtgcctgtgggaagacctgcctcctcatcgtcttcagcaaggatcagtttccggaggtctacgtccctactgtctttgagaactatattgcggacattgaggtggacggcaagcaggtggagctggctctgtgggacacagcagggcaggaagactatgatcgactgcggcctctctcctacccggacactgatgtcatcctcatgtgcttctccatcgacagccctgacagcctggaaaacattcctgagaagtggaccccagaggtgaagcacttctgccccaacgtgcccatcatcctggtggggaataagaaggacctgaggcaagacgagcacaccaggagagagctggccaagatgaagcaggagcccgttcggtctgaggaaggccgggacatggcgaaccggatcagtgcctttggctaccttgagtgctcagccaagaccaaagatggagagagagaggtttttgaaatggctacganagctgccctgcaagctagacgtgggaagaaaaaatctgggtgccttgtcttgtgaaaccttgctgcaagcacagcccttatgcggttaattttgaagtgctgtttattaatcttagtgtatgattactggcctttttcatttatctataatttacctaagattacaaatcagaagtcatcttgctaccagtatttagaagccaactatgattattaacgatgtccaacccgtctggcccaccagggtccttttgacactgctctaacagccctcctctgcactcccacctgacacaccaggcgctaattcaaggaatttcttaacttcttgcttctttctagaaagagaaacagttggtaacttttgtgaattangctgtaactactttataactaacatgtcctgcctattatctgtcagctgcaaggtactctggtgagtcaccacttcagggctttactccgtaacagattttgttggcatanctctggggtgggcagttttttgaaaatgggctcaaccagaaaaacccaagttcatgccagctgtggcanaattacagttctgttgggtttccatgtttanttanccttaataatttactgtgttaattaagtgnccncttaatgttttgtttacccaaaaataaatt

SEQ ID NO: 296277 - DNA, 682 bp, Homo sapiens
tccttgtaatccaagcagtcggggggtcagtctgagcctccggcaccggccgcgcagctggaggcggcggagcggaagccttgacttcatctcagctccagagcccgccctctcttcctgcagcctgggaacttcagccggctggagccccaccatggctgcaatccgaaagaagctggtgatcgttggggatggtgcctgtgggaagacctgcctcctcatcgtcttcagcaaggatcagtttccggaggtctacgtccctactgtctttgagaactatattgcggacattgaggtggacggcaagcaggtggagctggctctgtgggacacagcagggcaggaagactatgatcgactgcggcctctctcctacccggacactgatgtcatcctcatgtgcttctccatcgacagccctgacagcctggaaaacattcctgagaagtggaccccagaggtgaagcacttctgccccaacgtgcccatcatcctggtggggaataagaaggacctgaggcaagacgagcacaccaggagagagctggccaagatgaagcaggagcgcaggagaattgcttgagcccaggaggcggaggttgcagtgagctgagatcacaccaccgcactccagcctgggcgacagagcaagactccatctcaaaacaaaaacaaaaaacaa

SEQ ID NO: 296278 - DNA, 457 bp, Homo sapiens
tccttgtaatccaagcagtcggggggtcagtctgagcctccggcaccggccgcgcagctggaggcggcggagcggagggaacttcagccggctggagccccaccatggctgcaatccgaaagaagctggtgatcgttggggatggtgcctgtgggaagacctgcctcctcatcgtcttcagcaaggatcagtttccggaggtctacgtccctactgtctttgagaactatattgcggacattgaggtggacggcaagcaggtggagctggctctgtgggacacagcagggcaggaagactatgatcgactgcggcctctctcctacccggacactgatgtcatcctcatgtgcttctccatcgacagccctgacagcctggaaaacattcctgagaagtggaccccagaggtgaagcacttctgccccaacgtgccggtaccgagctcgatttacca

SEQ ID NO: 296279 - DNA, 826 bp, Homo sapiens
  misc_feature (623)..(623): n is a, c, g, or t
  misc_feature (632)..(632): n is a, c, g, or t
  misc_feature (663)..(663): n is a, c, g, or t
  misc_feature (711)..(711): n is a, c, g, or t
tccttgtaatccaagcagtcggggggtcagtctgagcctccggcaccggccgcgcagctggaggcggcggagcggaagggcaaggtgaactaatggagtgggtggaggagttggaagaaatcccagcgtcagtcaccgggatagaattcccaaggaaccctctttttggaggatggtttccatttctggaggcgatctgccgacaggagccttgacttcatctcagctccagagcccgccctctcttcctgcagcctgggaacttcagccggctggagccccaccatggctgcaatccgaaagaagctggtgatcgttggggatggtgcctgtgggaagacctgcctcctcatcgtcttcagcaaggatcagtttccggaggtctacgtccctactgtctttgagaactatattgcggacattgaggtggacggcaagcaggtggagctggctctgtgggacacagcagggcaggaagactatgatcgactgcggcctctctcctacccggacactgatgtcatcctcatgtgcttctccatcgacagccctgacagcctggaaaacattcctgagaagtggaccccagaggtgaagcacttctgccccaacgtgcccatatnctggtgggnataagaggacctgaggcagaacagcacacangagagagctggccacatgagcacgagcccgttcgtctgaggaggccgnacatagggaaccgatcagagctttggtacctgagtgtcagccacaccacgaggagtgcgggagtgtttaatggcactcggctgcctcagtcgcagaccgtggagggtgtctcttt

SEQ ID NO: 296280 - DNA, 460 bp, Homo sapiens
tccttgtaatccaagcagtcggggggtcagtctgagcctccggcaccggccgcgcagctggaggcggcggagcggaagccttgacttcatctcagctccagagcccgccctctcttcctgcagcctgggaacttcagccggctgggccccaccatggctgcaatccgaaagaagctggtgatcgttggggatggtgcctgtgggaagacctgcctcctcatcgtcttcagcaaggatcagtttccggaggtctacgtccctactgtctttgagaactatattgcggacattgaggtggacggcaagcaggtgaaggcagaaatgcccttcccaccccaccctgagaccccgccccccagtcactgaatgacctagtatgtccttccccattcctacccctgtctttgcttcattctccctgctggaaccagtaaaagttaggaagtaaatctgcagtctt

SEQ ID NO: 296281 - DNA, 1748 bp, Homo sapiens
cccgggacatgaggaaaggaacaagggaaagagccggtgaaggggcagaacaggcaggttccctcgacccaggaccccctgttcccaggctatggcccccagtgccctgtagacctggcaggccccccgtgcttgcgacccctatttgggggtctgggtggctactggagggccttgcagaggggcagagaaggcaggaccatgacatctagggcctctgaactttctccggggcgcagcgtgacggctggcatcatcattgttggagatgagatccttaagggacacactcaggacaccaacaccttctttctgtgccggacactgcgctccctaggggtccaggtttgccgagtctcagttgtacctgatgaggtagccaccattgcagctgaggtcacttctttctccaaccgcttcacccatgtcctcacagcagggggcatcggccccactcatgatgatgtgacctttgaggcagtggcacaggcctttggagatgagctgaagccacaccccaagttggaagcagccaccaaagccctaggaggggaaggctgggagaagctatcattggtgccctcctctgcccgcctgcattatggcacagatccttgcactggtcaacctttcagattccctctggtctccgtccgaaacgtctacctcttcccaggcattccagagctgctgcggcgggtgctggaggggatgaagggactattccaaaacccagctgttcagttccactcaaaggagctatatgtggctgctgatgaagcctccatcgcccccattctggctgaggcccaggcccactttggacgtaggcttggcctgggttcctaccctgactggggcagcaactactatcaggtgaagctgactctagactcagaggaagaaggacccctggaggaatgcttggcctacctgactgcccgtttgccccagggatcgctggtcccctacatgcccaacgctgtggagcaggccagtgaggctgtatacaaactcgctgaatcagggtcttctttggggaaaaaggtggcaggtgccctacagaccattgagacctccctggctcagtacagcctcacccagctctgtgtgggcttcaacgggggcaaagactgcactgccctcctgcacctcttccatgcagctgtgcagaggaaattacctgatgttccaaaccccctccagatcctgtatatccgcagcatctcccctttccctgagctggaacagtttctacaggacactatcaagaggtataatctgcagatgttggaagctgagggcagcatgaagcaggccctgggtgaactgcaggcacggcacccccagctggaggctgtccttatgggcacccgccggactgacccctactcctgtagcctctgccctttcagccccactgacccaggctggcccgcattcatgcgcatcaacccactgctggactggacctacagagacatctgggattttctgcgtcagctgtttgtcccatactgtatcctgtatgaccgaggatacacatcactggggagtcgggagaataccgtgcggaacccggccctgaagtgcctgagcccaggaggacaccccacataccgtccagcctatctactggagaacgaagaagaggagcggaactcccgcacatgacctcccaccctaggagggagggaaggacaccgtcctagggtataacctggcaataaaccgtgcctctcactgtg

SEQ ID NO: 296282 - DNA, 1830 bp, Homo sapiens
cccgggacatgaggaaaggaacaagggaaagagccggtgaaggggcagaacaggcaggttccctcgacccaggaccccctgttcccaggctatggcccccagtgccctgtagacctggcaggccccccgtgcttgcgacccctatttgggggtctgggtggctactggagggccttgcagaggggcagagaaggcaggaccatgacatctagggcctctgaactttctccggggcgcagcgtgacggctggcatcatcattgttggagatgagatccttaaggttggaaacaacaaatggcttttgagtccaagagtgatgcaatcacagtgacgcattaaaacggttactccggagacatcagagcactgtggctggaggctgggagcctggccaggaagctgtcgccattgtccaggtgaaaggtgctaaggacctgcttggtggcagtggggacagaaagaagaaagcaggccaggcgtggtggctcacacctataattccagcactttgggaggctgaggcaggaggatcacttgagaccaggaattcaacaccagcctgggcaacatggcaagaccccatttctacaaaaaaaatttaaaatgagctgaatgtggtggcacgcgcctgtagtcccagctactcggaaggctggggtggcccttgaagccaggaggttgaggctgcagtgaactgtgactgagccactatactccagcctgggtgacagagacccagctttaaaaccaaacaaatggattttcccactcttgtgtccagtccaggcccctcagcagcctgaggtggtgtccttcaaagagcagagcactgcatcatcaggtggatgcagccatcatcttcaacccctccccttcatccctacagtactgatggcctcatcttccccttcaacccccagggacacactcaggacaccaacaccttctttctgtgccggacactgcgctccctaggggtccaggtttgccgagtctcagttgtacctgatgaggtagccaccattgcagctgaggtcacttctttctccaaccgcttcacccatgtcctcacagcagggggcatcggccccactcatgatgatgtgacctttgaggcagtggcacaggcctttggagatgagctgaagccacaccccaagttggaagcagccaccaaagccctaggaggggaaggctgggagaagctatcattggtgccctcctctgcccgcctgcattatggcacagatccttgcactggtcaacctttcagattccctctggtctccgtccgaaacgtctacctcttcccaggcattccagagctgctgcggcgggtgctggaggggatgaagggactattccaaaacccagctgttcagttccactcaaaggagctatatgtggctgctgatgaagcctccatcgcccccattctggctgaggcccaggcccactttggacgtaggcttggcctgggttcctaccctgactggggcagcaactactatcaggtgaagctgactctagactcagaggaagaaggacccctggaggaatgcttggcctacctgactgcccgtttgccccagggatcgctggtcccctacatgcccaacgctgtggagcaggccagtgaggctgtatacaaactcgctgaatcaggtagggaccttatggaggaggggcattatgcccaaagccattggtggcaccccagatctcagtaatgcaggggctgttgggtgcttcctgcaaatccctgagagggcagaagatagcttctgttaattcattattcttccaataaatgttgattgagtaccta

SEQ ID NO: 296283 - DNA, 1857 bp, Homo sapiens
agctggtacggtccgagttctttaggatcggtgaaggggcagaacaggcaggttccctcgacccaggaccccctgttcccaggctatggcccccagtgccctgtagacctggcaggccccccgtgcttgcgacccctatttgggggtctgggtggctactggagggccttgcagaggggcagagaaggcaggaccatgacatctagggcctctgaactttctccggggcgcagcgtgacggctggcatcatcattgttggagatgagatccttaagggacacactcaggacaccaacaccttctttctgtgccggacactgcgctccctaggggtccaggtttgccgagtctcagttgtacctgatgaggtagccaccattgcagctgaggtcacttctttctccaaccgcttcacccatgtcctcacagcagggggcatcggccccactcatgatgatgtgacctttgaggcagtggcacaggcctttggagatgagctgaagccacaccccaagttggaagcagccaccaaagccctaggaggggaaggctgggagaagctatcattggtgccctcctctgcccgcctgcattatggcacagatccttgcactggtcaacctttcagattccctctggtctccgtccgaaacgtctacctcttcccaggcattccagagctgctgcggcgggtgctggaggggatgaagggactattccaaaacccagctgttcagttccactcaaaggagctatatgtggctgctgatgaagcctccatcgcccccattctggctgaggcccaggcccactttggacgtaggcttggcctgggttcctaccctgactggggcagcaactactatcaggtgaagctgactctagactcagaggaagaaggacccctggaggaatgcttggcctacctgactgcccgtttgccccagggatcgctggtcccctacatgcccaacgctgtggagcaggccagtgaggctgtatacaaactcgctgaatcagggtcttctttggggaaaaaggtggcaggtgccctacagaccattgagacctccctggctcagtacagcctcacccagctctgtgtgggcttcaacgggggcaaagactgcactgccctcctgcacctcttccatgcagctgtgcagaggaaattacctgatgttccaaaccccctccagatcctgtatatccgcagcatctcccctttccctgagctggaacagtttctacaggacactatcaagaggtataatctgcagatgttggaagctgagggcagcatgaagcaggccctgggtgaactgcaggcacggcacccccagctggaggctgtccttatgggcacccgccggactgacccctactcctgtagcctctgccctttcagccccactgacccaggctggcccgcattcatgcgcatcaacccactgctggactggacctacagagacatctgggattttctgcgtcagctgtttgtcccatactgtatcctgtatgaccgagggtaagggtattaggggaagggaatgggtaagggagtttttagggtgctgggatagggagggccaataggatcgcccaccctaccacatgcttgccctccaccctccctgctccagatacacatcactggggagtcgggagaataccgtgcggaacccggccctgaagtgcctgagcccaggaggacaccccacataccgtccagcctatctactggagaacgaagaagaggagcggaactcccgcacatgacctcccaccctaggagggagggaaggacaccgtcctagggtataacctggcaataaaccgtgcctctcactgtg

SEQ ID NO: 296284 - DNA, 616 bp, Homo sapiens
ctctagaggattactggggcaattctggactgaggcacttcagtgccgggttccgacgttattctcccgactccccagtgatgtgtatcctcggtcatacaggatacagtatgggacaaacagttgacgcagaagatcccaggtataatctgcagatgttggaagctgagggcagcatgaagcaggccctgggtgaactgcaggcacggcacccccagctggaggctgtccttatgggcacccgccggactgacccctactcctgtagcctctgccctttcagccccactgacccaggctggcccgcattcatgcgcatcaacccactgctggactggacctacagagacatctgggattttctgcgtcagctgtttgtcccatactgtatcctgtatgaccgaggatacacatcactggggagtcgggagaataccgtgcggaacccggccctgaagtgcctgagcccaggaggacaccccacataccgtccagcctatctactggagaacgaagaagaggagcggaactcccgcacatgacctcccaccctaggagggagggaaggacaccgtcctagggtataacctggcaataaaccgtgcctctcactgtg

SEQ ID NO: 296285 - DNA, 2223 bp, Homo sapiens
  misc_feature (1966)..(1966): n is a, c, g, or t
cccgggacatgaggaaaggaacaagggaaagagccggtgaaggggcagaacaggcaggttccctcgacccaggaccccctgttcccaggctatggcccccagtgccctgtagacctggcaggccccccgtgcttgcgacccctatttgggggtctgggtggctactggagggccttgcagaggggcagagaaggcaggaccatgacatctagggcctctgaactttctccggggcgcagcgtgacggctggcatcatcattgttggagatgagatccttaagggacacactcaggacaccaacaccttctttctgtgccggacactgcgctccctaggggtccaggtttgccgagtctcagttgtacctgatgaggtagccaccattgcagctgaggtcacttctttctccaaccgcttcacccatgtcctcacagcagggggcatcggccccactcatgatgatgtgacctttgaggcagtggcacaggcctttggagatgagctgaagccacaccccaagttggaagcagccaccaaagccctaggaggggaaggctgggagaagctatcattggtgccctcctctgcccgcctgcattatggcacagatccttgcactggtcaacctttcagattccctctggtctccgtccgaaacgtctacctcttcccaggcattccagagctgctgcggcgggtgctggaggggatgaagggactattccaaaacccagctgttcagttccactcaaaggagctatatgtggctgctgatgaagcctccatcgcccccattctggctgaggcccaggcccactttggacgtaggcttggcctgggttcctaccctgactggggcagcaactactatcaggtgaagctgactctagactcagaggaagaaggacccctggaggaatgcttggcctacctgactgcccgtttgccccagggatcgctggtcccctacatgcccaacgctgtggagcaggccagtgaggctgtatacaaactcgctgaatcagggtcttctttggggaaaaaggtggcaggtgccctacagaccattgagacctccctggctcagtacagcctcacccagctctgtgtgggcttcaacgggggcaaagactgcactgccctcctgcacctcttccatgcagctgtgcagaggaaattacctgatgttccaaaccccctccagatcctgtatatccgcagcatctcccctttccctgagctggaacagtttctacaggacactatcaagaggtataatctgcagatgttggaagctgagggcagcatgaagcaggccctgggtgaactgcaggcacggcacccccagctggaggctgtccttatgggcacccgccggactgacccctactcctgtagcctctgccctttcagccccactgacccaggctggcccgcattcatgcgcatcaacccactgctggactggacctacagagacatctgggattttctgcgtcagctgtttgtcccatactgtatcctgtatgaccgaggatacacatcactggggagtcgggagaataccgtgcggaacccggccctgaagtgcctgagcccaggaggacaccccacataccgtccagcctatctactggagaacgaagaagaggagcggaactcccgcacatgacctcccaccctaggagggagggaaggacaccgtcctagggtataacctggcaataaaccgtgcctctcactgtgaaaaaaaaaataaaagaagataaaacaaaaaaaaaaaataaaaaaaagaaaaaaaaaaaagaaaaaaaaataaaaagaaaaagaaaaaaaaaaaaaaactggtgggccgcttgggccaatgcgattttagactggggcaggtttttgaatgcggccgaatttggggctaattgggccaattcgcctttaggggggccgtttaaaattcaatggcccgnggtttaaaaaggacggaacgggaaaacccttggggttcccaactttaatcgcctggtggaaaatccccttttcgccagttggggaaaataccaaaagggcccgacccgttggcctttccaaaaaggtggccaacctttaagggtaattggaaatggaaggcgttaaatttttggtaaaaattgcgggtaaattttttggtaaacaaagctcatttttaaaccaaagggccgaaaatgcggaaaatacccttataaat

SEQ ID NO: 296286 - DNA, 2192 bp, Homo sapiens
cccgggacatgaggaaaggaacaagggaaagagccggtgaaggggcagaacaggcaggtgagagtctaagagggctcagtaatctgaagcttggtgggaagaagggattctgggctagaaagggtgcagaagcctgaagtagaaagagacgggattttggtccggggtggagagcgaatgcattgaaaagggccaaggcccaggataaggtagacatttaaaggggtacggatgcccaaggtagagcagacacttgaggagaccagctcagcaaacggaagacacttaaagtggtaggttctcaagagagaagaagtttttaagactagagctaagcaagacatttaaaaggacatgggttgggatttgggaacacgtttattccagaggcaggaacaaaggagtcgcttgtcaaggatctggttagagaagactagggtcttcctcgaaggaagcacgcgcacgcctgctctcccccattgtcttttctggcttctccaggttccctcgacccaggaccccctgttcccaggctatggcccccagtgccctgtagacctggcaggccccccgtgcttgcgacccctatttgggggtctgggtggctactggagggccttgcagaggggcagagaaggcaggaccatgacatctagggcctctgaactttctccggggcgcagcgtgacggctggcatcatcattgttggagatgagatccttaagggacacactcaggacaccaacaccttctttctgtgccggacactgcgctccctaggggtccaggtttgccgagtctcagttgtacctgatgaggtagccaccattgcagctgaggtcacttctttctccaaccgcttcacccatgtcctcacagcagggggcatcggccccactcatgatgatgtgacctttgaggcagtggcacaggcctttggagatgagctgaagccacaccccaagttggaagcagccaccaaagccctaggaggggaaggctgggagaagctatcattggtgccctcctctgcccgcctgcattatggcacagatccttgcactggtcaacctttcagattccctctggtctccgtccgaaacgtctacctcttcccaggcattccagagctgctgcggcgggtgctggaggggatgaagggactattccaaaacccagctgttcagttccactcaaaggagctatatgtggctgctgatgaagcctccatcgcccccattctggctgaggcccaggcccactttggacgtaggcttggcctgggttcctaccctgactggggcagcaactactatcaggtgaagctgactctagactcagaggaagaaggacccctggaggaatgcttggcctacctgactgcccgtttgccccagggatcgctggtcccctacatgcccaacgctgtggagcaggccagtgaggctgtatacaaactcgctgaatcagggtcttctttggggaaaaaggtggcaggtgccctacagaccattgagacctccctggctcagtacagcctcacccagctctgtgtgggcttcaacgggggcaaagactgcactgccctcctgcacctcttccatgcagctgtgcagaggaaattacctgatgttccaaaccccctccagatcctgtatatccgcagcatctcccctttccctgagctggaacagtttctacaggacactatcaagaggtataatctgcagatgttggaagctgagggcagcatgaagcaggccctgggtgaactgcaggcacggcacccccagctggaggctgtccttatgggcacccgccggactgacccctactcctgtagcctctgccctttcagccccactgacccaggctggcccgcattcatgcgcatcaacccactgctggactggacctacagagacatctgggattttctgcgtcagctgtttgtcccatactgtatcctgtatgaccgaggatacacatcactggggagtcgggagaataccgtgcggaacccggccctgaagtgcctgagcccaggaggacaccccacataccgtccagcctatctactggagaacgaagaagaggagcggaactcccgcacatgacctcccaccctaggagggagggaaggacaccgtcctagggtataacctggcaataaaccgtgcctctcactgtg

SEQ ID NO: 296287 - DNA, 2041 bp, Homo sapiens
cccgggacatgaggaaaggaacaagggaaagagccggtgaaggggcagaacaggcaggttccctcgacccaggaccccctgttcccaggctatggcccccagtgccctgtagacctggcaggccccccgtgcttgcgacccctatttgggggtctgggtggctactggagggccttgcagaggggcagagaaggcaggaccatgacatctagggcctctgaactttctccggggcgcagcgtgacggctggcatcatcattgttggagatgagatccttaagggacacactcaggacaccaacaccttctttctgtgccggacactgcgctccctaggggtccaggtttgccgagtctcagttgtacctgatgaggtagccaccattgcagctgaggtcacttctttctccaaccgcttcacccatgtcctcacagcagggggcatcggccccactcatgatgatgtgacctttgaggcagtggcacaggcctttggagatgagctgaagccacaccccaagttggaagcagccaccaaagccctaggaggggaaggctgggagaagctatcattggtgccctcctctgcccgcctgcattatggcacagatccttgcactggtcaacctttcagattccctctggtctccgtccgaaacgtctacctcttcccaggcattccagagctgctgcggcgggtgctggaggggatgaagggactattccaaaacccagctgttcagttccactcaaaggagctatatgtggctgctgatgaagcctccatcgcccccattctggctgaggcccaggcccactttggacgtaggcttggcctgggttcctaccctgactggggcagcaactactatcaggtgaagctgactctagactcagaggaagaaggacccctggaggaatgcttggcctacctgactgcccgtttgccccagggatcgctggtcccctacatgcccaacgctgtggagcaggccagtgaggctgtatacaaactcgctgaatcagggtcttctttggggaaaaaggtggcaggtgccctacagaccattgagacctccctggctcagtacagcctcacccagctctgtgtgggcttcaacgggggcaaagactgcactgccctcctgcacctcttccatgcagctgtgcagaggaaattacctgatgttccaaaccccctccagatcctgtatatccgcagcatctcccctttccctgagctggaacagtttctacaggacactatcaagaggtataatctgcagatgttggaagctgagggcagcatgaagcaggccctgggtgaactgcaggcacggcacccccagctggaggctgtccttatgggcacccgccggactgacccctactcctgtagcctctgccctttcagccccactgacccaggctggcccgcattcatgcgcatcaacccactgctggactggacctacagagacatctgggattttctgcgtcagctgtttgtcccatactgtatcctgtatgaccgaggatacacatcactggggagtcgggagaataccgtgcggaacccggccctgaagtgcctgagcccaggaggacaccccacataccgtccagcctatctactggagaacgaagaagaggagcggaactcccgcacatgacctcccaccctaggagggagggaaggacaccgtcctagggtataacctggcaataaaccgtgcctctcactgtgaaagaccacgatcagcaacccaaccaccagcaccccaccaacaccatacagaccgggacggcgccgacaaaaataccacggcaggggccacatagcacgcccccccagttgtctgcaaaagcacacccactaagaagccagttaagacgacgcacggcccggacaaacaaggaacgggaaacacgagctaggatgatggaaagccacattcgggggaaatggcacaccaaagtcagcccgggaacatccgtgatgcggaacccaccgcgcaagccgtaatataaagacacaag

SEQ ID NO: 296288 - DNA, 1831 bp, Homo sapiens
cccgggacatgaggaaaggaacaagggaaagagccggtgaaggggcagaacaggcaggttccctcgacccaggaccccctgttcccaggctatggcccccagtgccctgtagacctggcaggccccccgtgcttgcgacccctatttgggggtctgggtggctactggagggccttgcagaggggcagagaaggcaggaccatgacatctagggcctctgaactttctccggggcgcagcgtgacggctggcatcatcattgttggagatgagatccttaagggacacactcaggacaccaacaccttctttctgtgccggacactgcgctccctaggggtccaggtttgccgagtctcagttgtacctgatgaggtagccaccattgcagctgaggtcacttctttctccaaccgcttcacccatgtcctcacagcagggggcatcggccccactcatgatgatgtgacctttgaggcagtggcacaggcctttggagatgagctgaagccacaccccaagttggaagcagccaccaaagccctaggaggggaaggctgggagaagctatcattggtgccctcctctgcccgcctgcattatggcacagatccttgcactggtcaacctttcagattccctctggtctccgtccgaaacgtctacctcttcccaggcattccagagctgctgcggcgggtgctggaggggatgaagggactattccaaaacccagctgttcagttccactcaaaggagctatatgtggctgctgatgaagcctccatcgcccccattctggctgaggcccaggcccactttggacgtaggcttggcctgggttcctaccctgactggggcagcaactactatcaggtgaagctgactctagactcagaggaagaaggacccctggaggaatgcttggcctacctgactgcccgtttgccccagggatcgctggtcccctacatgcccaacgctgtggagcaggccagtgaggctgtatacaaactcgctgaatcagggtcttctttggggaaaaaggtggcaggtgccctacagaccattgagacctccctggctcagtacagcctcacccagctctgtgtgggcttcaacgggggcaaagactgcactgccctcctgcacctcttccatgcagctgtgcagaggaaattacctgatgttccaaaccccctccagatcctgtatatccgcagcatctcccctttccctgagctggaacagtttctacaggacactatcaagaggtactaggggcctggaggtttgggctccaagagaagcttgacagagcccacgcccgacccctacttctgtttcttcctaaggtgtataatctgcagatgttggaagctgagggcagcatgaagcaggccctgggtgaactgcaggcacggcacccccagctggaggctgtccttatgggcacccgccggactgacccctactcctgtagcctctgccctttcagccccactgacccaggctggcccgcattcatgcgcatcaacccactgctggactggacctacagagacatctgggattttctgcgtcagctgtttgtcccatactgtatcctgtatgaccgaggatacacatcactggggagtcgggagaataccgtgcggaacccggccctgaagtgcctgagcccaggaggacaccccacataccgtccagcctatctactggagaacgaagaagaggagcggaactcccgcacatgacctcccaccctaggagggagggaaggacaccgtcctagggtataacctggcaataaaccgtgcctctcactgtg

SEQ ID NO: 296289 - DNA, 1984 bp, Homo sapiens
cccgggacatgaggaaaggaacaagggaaagagccggtgaaggggcagaacaggcaggtgagagtctaagagggctcagtaatctgaagcttggtgggaagaagggattctgggctagaaagggtgcagaagcctgaagtagaaagagacgggattttggtccggggtggagagcgaatgcattgaaaagggccaaggcccaggataaggtagacatttaaaggggtacggatgcccaaggtagagcagacacttgaggagaccagctcagcaaacggaagacacttaaagtggttccctcgacccaggaccccctgttcccaggctatggcccccagtgccctgtagacctggcaggccccccgtgcttgcgacccctatttgggggtctgggtggctactggagggccttgcagaggggcagagaaggcaggaccatgacatctagggcctctgaactttctccggggcgcagcgtgacggctggcatcatcattgttggagatgagatccttaagggacacactcaggacaccaacaccttctttctgtgccggacactgcgctccctaggggtccaggtttgccgagtctcagttgtacctgatgaggtagccaccattgcagctgaggtcacttctttctccaaccgcttcacccatgtcctcacagcagggggcatcggccccactcatgatgatgtgacctttgaggcagtggcacaggcctttggagatgagctgaagccacaccccaagttggaagcagccaccaaagccctaggaggggaaggctgggagaagctatcattggtgccctcctctgcccgcctgcattatggcacagatccttgcactggtcaacctttcagattccctctggtctccgtccgaaacgtctacctcttcccaggcattccagagctgctgcggcgggtgctggaggggatgaagggactattccaaaacccagctgttcagttccactcaaaggagctatatgtggctgctgatgaagcctccatcgcccccattctggctgaggcccaggcccactttggacgtaggcttggcctgggttcctaccctgactggggcagcaactactatcaggtgaagctgactctagactcagaggaagaaggacccctggaggaatgcttggcctacctgactgcccgtttgccccagggatcgctggtcccctacatgcccaacgctgtggagcaggccagtgaggctgtatacaaactcgctgaatcagggtcttctttggggaaaaaggtggcaggtgccctacagaccattgagacctccctggctcagtacagcctcacccagctctgtgtgggcttcaacgggggcaaagactgcactgccctcctgcacctcttccatgcagctgtgcagaggaaattacctgatgttccaaaccccctccagatcctgtatatccgcagcatctcccctttccctgagctggaacagtttctacaggacactatcaagaggtataatctgcagatgttggaagctgagggcagcatgaagcaggccctgggtgaactgcaggcacggcacccccagctggaggctgtccttatgggcacccgccggactgacccctactcctgtagcctctgccctttcagccccactgacccaggctggcccgcattcatgcgcatcaacccactgctggactggacctacagagacatctgggattttctgcgtcagctgtttgtcccatactgtatcctgtatgaccgaggatacacatcactggggagtcgggagaataccgtgcggaacccggccctgaagtgcctgagcccaggaggacaccccacataccgtccagcctatctactggagaacgaagaagaggagcggaactcccgcacatgacctcccaccctaggagggagggaaggacaccgtcctagggtataacctggcaataaaccgtgcctctcactgtg

SEQ ID NO: 296290 - DNA, 2388 bp, Homo sapiens
cccgggacatgaggaaaggaacaagggaaagagccggtgaaggggcagaacaggcaggttccctcgacccaggaccccctgttcccaggctatggcccccagtgccctgtagacctggcaggccccccgtgcttgcgacccctatttgggggtctgggtggctactggagggccttgcagaggggcagagaaggcaggaccatgacatctagggcctctgaactttctccggggcgcagcgtgacggctggcatcatcattgttggagatgagatccttaaggttggaaacaacaaatggcttttgagtccaagagtgatgcaatcacagtgacgcattaaaacggttactccggagacatcagagcactgtggctggaggctgggagcctggccaggaagctgtcgccattgtccaggtgaaaggtgctaaggacctgcttggtggcagtggggacagaaagaagaaagcaggccaggcgtggtggctcacacctataattccagcactttgggaggctgaggcaggaggatcacttgagaccaggaattcaacaccagcctgggcaacatggcaagaccccatttctacaaaaaaaatttaaaatgagctgaatgtggtggcacgcgcctgtagtcccagctactcggaaggctggggtggcccttgaagccaggaggttgaggctgcagtgaactgtgactgagccactatactccagcctgggtgacagagacccagctttaaaaccaaacaaatggattttcccactcttgtgtccagtccaggcccctcagcagcctgaggtggtgtccttcaaagagcagagcactgcatcatcaggtggatgcagccatcatcttcaacccctccccttcatccctacagtactgatggcctcatcttccccttcaacccccagggacacactcaggacaccaacaccttctttctgtgccggacactgcgctccctaggggtccaggtttgccgagtctcagttgtacctgatgaggtagccaccattgcagctgaggtcacttctttctccaaccgcttcacccatgtcctcacagcagggggcatcggccccactcatgatgatgtgacctttgaggcagtggcacaggcctttggagatgagctgaagccacaccccaagttggaagcagccaccaaagccctaggaggggaaggctgggagaagctatcattggtgccctcctctgcccgcctgcattatggcacagatccttgcactggtcaacctttcagattccctctggtctccgtccgaaacgtctacctcttcccaggcattccagagctgctgcggcgggtgctggaggggatgaagggactattccaaaacccagctgttcagttccactcaaaggagctatatgtggctgctgatgaagcctccatcgcccccattctggctgaggcccaggcccactttggacgtaggcttggcctgggttcctaccctgactggggcagcaactactatcaggtgaagctgactctagactcagaggaagaaggacccctggaggaatgcttggcctacctgactgcccgtttgccccagggatcgctggtcccctacatgcccaacgctgtggagcaggccagtgaggctgtatacaaactcgctgaatcagggtcttctttggggaaaaaggtggcaggtgccctacagaccattgagacctccctggctcagtacagcctcacccagctctgtgtgggcttcaacgggggcaaagactgcactgccctcctgcacctcttccatgcagctgtgcagaggaaattacctgatgttccaaaccccctccagatcctgtatatccgcagcatctcccctttccctgagctggaacagtttctacaggacactatcaagaggtataatctgcagatgttggaagctgagggcagcatgaagcaggccctgggtgaactgcaggcacggcacccccagctggaggctgtccttatgggcacccgccggactgacccctactcctgtagcctctgccctttcagccccactgacccaggctggcccgcattcatgcgcatcaacccactgctggactggacctacagagacatctgggattttctgcgtcagctgtttgtcccatactgtatcctgtatgaccgaggatacacatcactggggagtcgggagaataccgtgcggaacccggccctgaagtgcctgagcccaggaggacaccccacataccgtccagcctatctactggagaacgaagaagaggagcggaactcccgcacatgacctcccaccctaggagggagggaaggacaccgtcctagggtataacctggcaataaaccgtgcctctcactgtg

SEQ ID NO: 296291 - DNA, 1742 bp, Homo sapiens
agctggtacggtccgagttctttaggatcggtgaaggggcagaacaggcaggttccctcgacccaggaccccctgttcccaggctatggcccccagtgccctgtagacctggcaggccccccgtgcttgcgacccctatttgggggtctgggtggctactggagggccttgcagaggggcagagaaggcaggaccatgacatctagggcctctgaactttctccggggcgcagcgtgacggctggcatcatcattgttggagatgagatccttaagggacacactcaggacaccaacaccttctttctgtgccggacactgcgctccctaggggtccaggtttgccgagtctcagttgtacctgatgaggtagccaccattgcagctgaggtcacttctttctccaaccgcttcacccatgtcctcacagcagggggcatcggccccactcatgatgatgtgacctttgaggcagtggcacaggcctttggagatgagctgaagccacaccccaagttggaagcagccaccaaagccctaggaggggaaggctgggagaagctatcattggtgccctcctctgcccgcctgcattatggcacagatccttgcactggtcaacctttcagattccctctggtctccgtccgaaacgtctacctcttcccaggcattccagagctgctgcggcgggtgctggaggggatgaagggactattccaaaacccagctgttcagttccactcaaaggagctatatgtggctgctgatgaagcctccatcgcccccattctggctgaggcccaggcccactttggacgtaggcttggcctgggttcctaccctgactggggcagcaactactatcaggtgaagctgactctagactcagaggaagaaggacccctggaggaatgcttggcctacctgactgcccgtttgccccagggatcgctggtcccctacatgcccaacgctgtggagcaggccagtgaggctgtatacaaactcgctgaatcagggtcttctttggggaaaaaggtggcaggtgccctacagaccattgagacctccctggctcagtacagcctcacccagctctgtgtgggcttcaacgggggcaaagactgcactgccctcctgcacctcttccatgcagctgtgcagaggaaattacctgatgttccaaaccccctccagatcctgtatatccgcagcatctcccctttccctgagctggaacagtttctacaggacactatcaagaggtataatctgcagatgttggaagctgagggcagcatgaagcaggccctgggtgaactgcaggcacggcacccccagctggaggctgtccttatgggcacccgccggactgacccctactcctgtagcctctgccctttcagccccactgacccaggctggcccgcattcatgcgcatcaacccactgctggactggacctacagagacatctgggattttctgcgtcagctgtttgtcccatactgtatcctgtatgaccgaggatacacatcactggggagtcgggagaataccgtgcggaacccggccctgaagtgcctgagcccaggaggacaccccacataccgtccagcctatctactggagaacgaagaagaggagcggaactcccgcacatgacctcccaccctaggagggagggaaggacaccgtcctagggtataacctggcaataaaccgtgcctctcactgtg

SEQ ID NO: 296292 - DNA, 2113 bp, Homo sapiens
ctgaggtgggaggatcactggaggctgaggtgggaggatcacttgagcctggaaggttaaagttgcagtaagttgtgattgagccactgcactccagcctgggcaacagagtgagacagtgtctccaaaaaataacttataaattggactttacaaaattaatatttatgtgccaaaaggctattaagaagatgaaaagccaggcgtggtggctcacacctataattccagcactttgggaggctgaggcaggaggatcacttgagaccaggaattcaacaccagcctgggcaacatggcaagaccccatttctacaaaaaaaatttaaaatgagctgaatgtggtggcacgcgcctgtagtcccagctactcggaaggctggggtggcccttgaagccaggaggttgaggctgcagtgaactgtgactgagccactatactccagcctgggtgacagagacccagctttaaaaccaaacaaatggattttcccactcttgtgtccagtccaggcccctcagcagcctgaggtggtgtccttcaaagagcagagcactgcatcatcaggtggatgcagccatcatcttcaacccctccccttcatccctacagtactgatggcctcatcttccccttcaacccccagggacacactcaggacaccaacaccttctttctgtgccggacactgcgctccctaggggtccaggtttgccgagtctcagttgtacctgatgaggtagccaccattgcagctgaggtcacttctttctccaaccgcttcacccatgtcctcacagcagggggcatcggccccactcatgatgatgtgacctttgaggcagtggcacaggcctttggagatgagctgaagccacaccccaagttggaagcagccaccaaagccctaggaggggaaggctgggagaagctatcattggtgccctcctctgcccgcctgcattatggcacagatccttgcactggtcaacctttcagattccctctggtctccgtccgaaacgtctacctcttcccaggcattccagagctgctgcggcgggtgctggaggggatgaagggactattccaaaacccagctgttcagttccactcaaaggagctatatgtggctgctgatgaagcctccatcgcccccattctggctgaggcccaggcccactttggacgtaggcttggcctgggttcctaccctgactggggcagcaactactatcaggtgaagctgactctagactcagaggaagaaggacccctggaggaatgcttggcctacctgactgcccgtttgccccagggatcgctggtcccctacatgcccaacgctgtggagcaggccagtgaggctgtatacaaactcgctgaatcagggtcttctttggggaaaaaggtggcaggtgccctacagaccattgagacctccctggctcagtacagcctcacccagctctgtgtgggcttcaacgggggcaaagactgcactgccctcctgcacctcttccatgcagctgtgcagaggaaattacctgatgttccaaaccccctccagatcctgtatatccgcagcatctcccctttccctgagctggaacagtttctacaggacactatcaagaggtataatctgcagatgttggaagctgagggcagcatgaagcaggccctgggtgaactgcaggcacggcacccccagctggaggctgtccttatgggcacccgccggactgacccctactcctgtagcctctgccctttcagccccactgacccaggctggcccgcattcatgcgcatcaacccactgctggactggacctacagagacatctgggattttctgcgtcagctgtttgtcccatactgtatcctgtatgaccgaggatacacatcactggggagtcgggagaataccgtgcggaacccggccctgaagtgcctgagcccaggaggacaccccacataccgtccagcctatctactggagaacgaagaagaggagcggaactcccgcacatgacctcccaccctaggagggagggaaggacaccgtcctagggtataacctggcaataaaccgtgcctctcactgtg

SEQ ID NO: 296293 - DNA, 2075 bp, Homo sapiens
  misc_feature (1818)..(1818): n is a, c, g, or t
cccgggacatgaggaaaggaacaagggaaagagccggtgaaggggcagaacaggcaggttccctcgacccaggaccccctgttcccaggctatggcccccagtgccctgtagacctggcaggccccccgtgcttgcgacccctatttgggggtctgggtggctactggagggccttgcagaggggcagagaaggcaggaccatgacatctagggcctctgaactttctccggggcgcagcgtgacggctggcatcatcattgttggagatgagatccttaagggacacactcaggacaccaacaccttctttctgtgccggacactgcgctccctaggggtccaggtttgccgagtctcagttgtacctgatgaggtagccaccattgcagctgaggtcacttctttctccaaccgcttcacccatgtcctcacagcagggggcatcggccccactcatgatgatgtgacctttgaggcagtggcacaggcctttggagatgagctgaagccacaccccaagttggaagcagccaccaaagccctaggaggggaaggctgggagaagctatcattggtgccctcctctgcccgcctgcattatggcacagatccttgcactggtcaacctttcagattccctctggtctccgtccgaaacgtctacctcttcccaggcattccagagctgctgcggcgggtgctggaggggatgaagggactattccaaaacccagctgttcagttccactcaaaggagctatatgtggctgctgatgaagcctccatcgcccccattctggctgaggcccaggcccactttggacgtaggcttggcctgggttcctaccctgactggggcagcaactactatcaggtgaagctgactctagactcagaggaagaaggacccctggaggaatgcttggcctacctgactgcccgtttgccccagggatcgctggtcccctacatgcccaacgctgtggagcaggccagtgaggctgtatacaaactcgctgaatcaggaaattacctgatgttccaaaccccctccagatcctgtatatccgcagcatctcccctttccctgagctggaacagtttctacaggacactatcaagaggtataatctgcagatgttggaagctgagggcagcatgaagcaggccctgggtgaactgcaggcacggcacccccagctggaggctgtccttatgggcacccgccggactgacccctactcctgtagcctctgccctttcagccccactgacccaggctggcccgcattcatgcgcatcaacccactgctggactggacctacagagacatctgggattttctgcgtcagctgtttgtcccatactgtatcctgtatgaccgaggatacacatcactggggagtcgggagaataccgtgcggaacccggccctgaagtgcctgagcccaggaggacaccccacataccgtccagcctatctactggagaacgaagaagaggagcggaactcccgcacatgacctcccaccctaggagggagggaaggacaccgtcctagggtataacctggcaataaaccgtgcctctcactgtgaaaaaaaaaataaaagaagataaaacaaaaaaaaaaaataaaaaaaagaaaaaaaaaaaagaaaaaaaaataaaaagaaaaagaaaaaaaaaaaaaaactggtgggccgcttgggccaatgcgattttagactggggcaggtttttgaatgcggccgaatttggggctaattgggccaattcgcctttaggggggccgtttaaaattcaatggcccgnggtttaaaaaggacggaacgggaaaacccttggggttcccaactttaatcgcctggtggaaaatccccttttcgccagttggggaaaataccaaaagggcccgacccgttggcctttccaaaaaggtggccaacctttaagggtaattggaaatggaaggcgttaaatttttggtaaaaattgcgggtaaattttttggtaaacaaagctcatttttaaaccaaagggccgaaaatgcggaaaatacccttataaat

SEQ ID NO: 296294 - DNA, 1897 bp, Homo sapiens
cccgggacatgaggaaaggaacaagggaaagagccggtgaaggggcagaacaggcaggttccctcgacccaggaccccctgttcccaggctatggcccccagtgccctgtagacctggcaggccccccgtgcttgcgacccctatttgggggtctgggtggctactggagggccttgcagaggggcagagaaggcaggaccatgacatctagggcctctgaactttctccggggcgcagcgtgacggctggcatcatcattgttggagatgagatccttaagggacacactcaggacaccaacaccttctttctgtgccggacactgcgctccctaggggtccaggtttgccgagtctcagttgtacctgatgaggtagccaccattgcagctgaggtcacttctttctccaaccgcttcacccatgtcctcacagcagggggcatcggccccactcatgatgatgtgacctttgaggcagtggcacaggcctttggagatgagctgaagccacaccccaagttggaagcagccaccaaagccctaggaggggaaggctgggagaagctatcattggtgccctcctctgcccgcctgcattatggcacagatccttgcactggtcaacctttcagattccctctggtctccgtccgaaacgtctacctcttcccaggcattccagagctgctgcggcgggtgctggaggggatgaagggactattccaaaacccagctgttcagttccactcaaaggagctatatgtggctgctgatgaagcctccatcgcccccattctggctgaggcccaggcccactttggacgtaggcttggcctgggttcctaccctgactggggcagcaactactatcaggtgaagctgactctagactcagaggaagaaggacccctggaggaatgcttggcctacctgactgcccgtttgccccagggatcgctggtcccctacatgcccaacgctgtggagcaggccagtgaggctgtatacaaactcgctgaatcagggtcttctttggggaaaaaggtggcaggtgccctacagaccattgagacctccctggctcagtacagcctcacccagctctgtgtgggcttcaacgggggcaaagactgcactgccctcctgcacctcttccatgcagctgtgcagaggaaattacctgatgttccaaaccccctccagatcctgtatatccgcagcatctcccctttccctgagctggaacagtttctacaggacactatcaagaggtataatctgcagatgttggaagctgagggcagcatgaagcaggccctgggtgaactgcaggcacggcacccccagctggaggctgtccttatgggcacccgccggactgacccctactcctgtagcctctgccctttcagccccactgacccaggctggcccgcattcatgcgcatcaacccactgctgagcaagctataccagagaatcagatagcaagccctccctcagaggccaagggagcagaagagccatggatgggccccttcccaggacagcaggggtagaagtgggaaaggtgagcatttgtgactattctattactctgacctcccagggactggacctacagagacatctgggattttctgcgtcagctgtttgtcccatactgtatcctgtatgaccgaggatacacatcactggggagtcgggagaataccgtgcggaacccggccctgaagtgcctgagcccaggaggacaccccacataccgtccagcctatctactggagaacgaagaagaggagcggaactcccgcacatgacctcccaccctaggagggagggaaggacaccgtcctagggtataacctggcaataaaccgtgcctctcactgtg

SEQ ID NO: 296295 - DNA, 1783 bp, Homo sapiens
cccgggacatgaggaaaggaacaagggaaagagccggtgaaggggcagaacaggcaggttccctcgacccaggaccccctgttcccaggctatggcccccagtgccctgtagacctggcaggccccccgtgcttgcgacccctatttgggggtctgggtggctactggagggccttgcagaggggcagagaaggcaggaccatgacatctagggcctctgaactttctccggggcgcagcgtgacggctggcatcatcattgttggagatgagatccttaagggacacactcaggacaccaacaccttctttctgtgccggacactgcgctccctaggggtccaggtttgccgagtctcagttgtacctgatgaggtagccaccattgcagctgaggtcacttctttctccaaccgcttcacccatgtcctcacagcagggggcatcggccccactcatgatgatgtgacctttgaggcagtggcacaggcctttggagatgagctgaagccacaccccaagttggaagcagccaccaaagccctaggaggggaaggctgggagaagctatcattggtgccctcctctgcccgcctgcattatggcacagatccttgcactggtcaacctttcagattccctctggtctccgtccgaaacgtctacctcttcccaggcattccagagctgctgcggcgggtgctggaggggatgaagggactattccaaaacccagctgttcagttccactcaaaggagctatatgtggctgctgatgaagcctccatcgcccccattctggctgaggcccaggcccactttggacgtaggcttggcctgggttcctaccctgactggggcagcaactactatcaggtgaagctgactctagactcagaggaagaaggacccctggaggaatgcttggcctacctgactgcccgtttgccccagggatcgctggtcccctacatgcccaacgctgtggagcaggccagtgaggctgtatacaaactcgctgaatcagggtcttctttggggaaaaaggtggcaggtgccctacagaccattgagacctccctggctcagtacagcctcacccagctctgtgtgggcttcaacgggggcaaagactgcactgccctcctgcacctcttccatgcagctgtgcagaggaaattacctgatgttccaaaccccctccagatcctgtatatccgcagcatctcccctttccctgagctggaacagtttctacaggacactatcaagaggtataatctgcagatgttggaagctgagggcagcatgaagcaggccctgggtgaactgcaggcacggcacccccagctggaggctgtccttatgggcacccgccggactgacccctactcctgtagcctctgccctttcagccccactgacccaggctggcccgcattcatgcgcatcaacccactgctgagcaagctataccagagaatcagatagcaagccctccctcagaggccaagggagcagaagagccatggatgggccccttcccaggacagcaggggtagaagtgggaaagatacacatcactggggagtcgggagaataccgtgcggaacccggccctgaagtgcctgagcccaggaggacaccccacataccgtccagcctatctactggagaacgaagaagaggagcggaactcccgcacatgacctcccaccctaggagggagggaaggacaccgtcctagggtataacctggcaataaaccgtgcctctcactgtg

SEQ ID NO: 296296 - DNA, 1190 bp, Homo sapiens
cccgggacatgaggaaaggaacaagggaaagagccggtgaaggggcagaacaggcaggttccctcgacccaggaccccctgttcccaggctatggcccccagtgccctgtagacctggcaggccccccgtgcttgcgacccctatttgggggtctgggtggctactggagggccttgcagaggggcagagaaggcaggaccatgacatctagggcctctgaactttctccggggcgcagcgtgacggctggcatcatcattgttggagatgagatccttaagggacacactcaggacaccaacaccttctttctgtgccggacactgcgctccctaggggtccaggtttgccgagtctcagttgtacctgatgaggtagccaccattgcagctgaggtcacttctttctccaaccgcttcacccatgtcctcacagcagggggcatcggccccactcatgatgatgtgacctttgaggcagtggcacaggcctttggagatgagctgaagccacaccccaagttggaagcagccaccaaagccctaggaggggaaggctgggagaagctatcattggtgccctcctctgcccgcctgcattatggcacagatccttgcactggtcaacctttcagattccctctggtctccgtccgaaacgtctacctcttcccaggcattccagagctgctgcggcgggtgctggaggggatgaagggactattccaaaacccagctgttcagttccactcaaaggagctatatgtggctgctgatgaagcctccatcgcccccattctggctgaggcccaggcccactttggacgtaggcttggcctgggttcctaccctgactggggcagcaactactatcaggtgaagctgactctagactcagaggaagaaggacccctggaggaatgcttggcctacctgactgcccgtttgccccagggatcgctggtcccctacatgcccaacgctgtggagcaggccagtgaggctgtatacaaactcgctgaatcaggtagggaccttatggaggaggggcattatgcccaaagccattggtggcaccccagatctcagtaatgcaggggctgttgggtgcttcctgcaaatccctgagagggcagaagatagcttctgttaattcattattcttccaataaatgttgattgagtaccta

SEQ ID NO: 296297 - DNA, 1553 bp, Homo sapiens
cccgggacatgaggaaaggaacaagggaaagagccggtgaaggggcagaacaggcaggttccctcgacccaggaccccctgttcccaggctatggcccccagtgccctgtagacctggcaggccccccgtgcttgcgacccctatttgggggtctgggtggctactggagggccttgcagaggggcagagaaggcaggaccatgacatctagggcctctgaactttctccggggcgcagcgtgacggctggcatcatcattgttggagatgagatccttaagggacacactcaggacaccaacaccttctttctgtgccggacactgcgctccctaggggtccaggtttgccgagtctcagttgtacctgatgaggtagccaccattgcagctgaggtcacttctttctccaaccgcttcacccatgtcctcacagcagggggcatcggccccactcatgatgatgtgacctttgaggcagtggcacaggcctttggagatgagctgaagccacaccccaagttggaagcagccaccaaagccctaggaggggaaggctgggagaagctatcattggtgccctcctctgcccgcctgcattatggcacagatccttgcactggtcaacctttcagattccctctggtctccgtccgaaacgtctacctcttcccaggcattccagagctgctgcggcgggtgctggaggggatgaagggactattccaaaacccagctgttcagttccactcaaaggagctatatgtggctgctgatgaagcctccatcgcccccattctggctgaggcccaggcccactttggacgtaggcttggcctgggttcctaccctgactggggcagcaactactatcaggtgaagctgactctagactcagaggaagaaggacccctggaggaatgcttggcctacctgactgcccgtttgccccagggatcgctggtcccctacatgcccaacgctgtggagcaggccagtgaggctgtatacaaactcgctgaatcagggtcttctttggggaaaaaggtggcaggtgccctacagaccattgagacctccctggctcagtacagcctcacccagctctgtgtgggcttcaacgggggcaaagactgcactgccctcctgcacctcttccatgcagctgtgcagaggaaattacctgatgttccaaaccccctccagatcctgtatatccgcagcattgacccaggctggcccgcattcatgcgcatcaacccactgctggactggacctacagagacatctgggattttctgcgtcagctgtttgtcccatactgtatcctgtatgaccgaggatacacatcactggggagtcgggagaataccgtgcggaacccggccctgaagtgcctgagcccaggaggacaccccacataccgtccagcctatctactggagaacgaagaagaggagcggaactcccgcacatgacctcccaccctaggagggagggaaggacaccgtcctagggtataacctggcaataaaccgtgcctctcactgtg

SEQ ID NO: 296298 - DNA, 1538 bp, Homo sapiens
cccgggacatgaggaaaggaacaagggaaagagccggtgaaggggcagaacaggcaggttccctcgacccaggaccccctgttcccaggctatggcccccagtgccctgtagacctggcaggccccccgtgcttgcgacccctatttgggggtctgggtggctactggagggccttgcagaggggcagagaaggcaggaccatgacatctagggcctctgaactttctccggggcgcagcgtgacggctggcatcatcattgttggagatgagatccttaagggacacactcaggacaccaacaccttctttctgtgccggacactgcgctccctaggggtccaggtttgccgagtctcagttgtacctgatgaggtagccaccattgcagctgaggtcacttctttctccaaccgcttcacccatgtcctcacagcagggggcatcggccccactcatgatgatgtgacctttgaggcagtggcacaggcctttggagatgagctgaagccacaccccaagttggaagcagccaccaaagccctaggaggggaaggctgggagaagctatcattggtgccctcctctgcccgcctgcattatggcacagatccttgcactggtcaacctttcagattccctctggtctccgtccgaaacgtctacctcttcccaggcattccagagctgctgcggcgggtgctggaggggatgaagggactattccaaaacccagctgttcagttccactcaaaggagctatatgtggctgctgatgaagcctccatcgcccccattctggctgaggcccaggcccactttggacgtaggcttggcctgggttcctaccctgactggggcagcaactactatcaggtgaagctgactctagactcagaggaagaaggacccctggaggaatgcttggcctacctgactgcccgtttgccccagggatcgctggtcccctacatgcccaacgctgtggagcaggccagtgaggctgtatacaaactcgctgaatcagggtcttctttggggaaaaaggtggcaggtgccctacagaccattgagacctccctggctcagtacagcctcacccagctctgtgtgggcttcaacgggggcaaagactgcactgccctcctgcacctcttccatgcagctgtgcagaggaaattacctgatgttccaaaccccctccagatcctgtatatccgcagcatctcccctttccctgagctggaacagtttgactggacctacagagacatctgggattttctgcgtcagctgtttgtcccatactgtatcctgtatgaccgaggatacacatcactggggagtcgggagaataccgtgcggaacccggccctgaagtgcctgagcccaggaggacaccccacataccgtccagcctatctactggagaacgaagaagaggagcggaactcccgcacatgacctcccaccctaggagggagggaaggacaccgtcctagggtataacctggcaataaaccgtgcctctcactgtg

SEQ ID NO: 296299 - DNA, 1405 bp, Homo sapiens
cccgggacatgaggaaaggaacaagggaaagagccggtgaaggggcagaacaggcaggttccctcgacccaggaccccctgttcccaggctatggcccccagtgccctgtagacctggcaggccccccgtgcttgcgacccctatttgggggtctgggtggctactggagggccttgcagaggggcagagaaggcaggaccatgacatctagggcctctgaactttctccggggcgcagcgtgacggctggcatcatcattgttggagatgagatccttaagggacacactcaggacaccaacaccttctttctgtgccggacactgcgctccctaggggtccaggtttgccgagtctcagttgtacctgatgaggtagccaccattgcagctgaggtcacttctttctccaaccgcttcacccatgtcctcacagcagggggcatcggccccactcatgatgatgtgacctttgaggcagtggcacaggcctttggagatgagctgaagccacaccccaagttggaagcagccaccaaagccctaggaggggaaggctgggagaagctatcattggtgccctcctctgcccgcctgcattatggcacagatccttgcactggtcaacctttcagattccctctggtctccgtccgaaacgtctacctcttcccaggcattccagagctgctgcggcgggtgctggaggggatgaagggactattccaaaacccagctgttcagttccactcaaaggagctatatgtggctgctgatgaagcctccatcgcccccattctggctgaggcccaggcccactttggacgtaggcttggcctgggttcctaccctgactggggcagcaactactatcaggtgaagctgactctagactcagaggaagaaggacccctggaggaatgcttggcctacctgactgcccgtttgccccagggatcgctggtcccctacatgcccaacgctgtggagcaggccagtgaggctgtatacaaactcgctgaatcaggaaattacctgatgttccaaaccccctccagatcctgtatatccgcagcattgacccaggctggcccgcattcatgcgcatcaacccactgctggactggacctacagagacatctgggattttctgcgtcagctgtttgtcccatactgtatcctgtatgaccgaggatacacatcactggggagtcgggagaataccgtgcggaacccggccctgaagtgcctgagcccaggaggacaccccacataccgtccagcctatctactggagaacgaagaagaggagcggaactcccgcacatgacctcccaccctaggagggagggaaggacaccgtcctagggtataacctggcaataaaccgtgcctctcactgtg

SEQ ID NO: 296300 - DNA, 2052 bp, Homo sapiens
  misc_feature (1795)..(1795): n is a, c, g, or t
cccgggacatgaggaaaggaacaagggaaagagccggtgaaggggcagaacaggcaggttccctcgacccaggaccccctgttcccaggctatggcccccagtgccctgtagacctggcaggccccccgtgcttgcgacccctatttgggggtctgggtggctactggagggccttgcagaggggcagagaaggcaggaccatgacatctagggcctctgaactttctccggggcgcagcgtgacggctggcatcatcattgttggagatgagatccttaagggacacactcaggacaccaacaccttctttctgtgccggacactgcgctccctaggggtccaggtttgccgagtctcagttgtacctgatgaggtagccaccattgcagctgaggtcacttctttctccaaccgcttcacccatgtcctcacagcagggggcatcggccccactcatgatgatgtgacctttgaggcagtggcacaggcctttggagatgagctgaagccacaccccaagttggaagcagccaccaaagccctaggaggggaaggctgggagaagctatcattggtgccctcctctgcccgcctgcattatggcacagatccttgcactggtcaacctttcagattccctctggtctccgtccgaaacgtctacctcttcccaggcattccagagctgctgcggcgggtgctggaggggatgaagggactattccaaaacccagctgttcagttccactcaaaggagctatatgtggctgctgatgaagcctccatcgcccccattctggctgaggcccaggcccactttggacgtaggcttggcctgggttcctaccctgactggggcagcaactactatcaggtggcaggtgccctacagaccattgagacctccctggctcagtacagcctcacccagctctgtgtgggcttcaacgggggcaaagactgcactgccctcctgcacctcttccatgcagctgtgcagaggaaattacctgatgttccaaaccccctccagatcctgtatatccgcagcatctcccctttccctgagctggaacagtttctacaggacactatcaagaggtataatctgcagatgttggaagctgagggcagcatgaagcaggccctgggtgaactgcaggcacggcacccccagctggaggctgtccttatgggcacccgccggactgacccctactcctgtagcctctgccctttcagccccactgacccaggctggcccgcattcatgcgcatcaacccactgctggactggacctacagagacatctgggattttctgcgtcagctgtttgtcccatactgtatcctgtatgaccgaggatacacatcactggggagtcgggagaataccgtgcggaacccggccctgaagtgcctgagcccaggaggacaccccacataccgtccagcctatctactggagaacgaagaagaggagcggaactcccgcacatgacctcccaccctaggagggagggaaggacaccgtcctagggtataacctggcaataaaccgtgcctctcactgtgaaaaaaaaaataaaagaagataaaacaaaaaaaaaaaataaaaaaaagaaaaaaaaaaaagaaaaaaaaataaaaagaaaaagaaaaaaaaaaaaaaactggtgggccgcttgggccaatgcgattttagactggggcaggtttttgaatgcggccgaatttggggctaattgggccaattcgcctttaggggggccgtttaaaattcaatggcccgnggtttaaaaaggacggaacgggaaaacccttggggttcccaactttaatcgcctggtggaaaatccccttttcgccagttggggaaaataccaaaagggcccgacccgttggcctttccaaaaaggtggccaacctttaagggtaattggaaatggaaggcgttaaatttttggtaaaaattgcgggtaaattttttggtaaacaaagctcatttttaaaccaaagggccgaaaatgcggaaaatacccttataaat

SEQ ID NO: 296301 - DNA, 2146 bp, Homo sapiens
cccgggacatgaggaaaggaacaagggaaagagccggtgaaggggcagaacaggcaggtgagagtctaagagggctcagtaatctgaagcttggtgggaagaagggattctgggctagaaagggtgcagaagcctgaagtagaaagagacgggattttggtccggggtggagagcgaatgcattgaaaagggccaaggcccaggataaggtagacatttaaaggggtacggatgcccaaggtagagcagacacttgaggagaccagctcagcaaacggaagacacttaaagtggtaggttctcaagagagaagaagtttttaagactagagctaagcaagacatttaaaaggacatgggttgggatttgggaacacgtttattccagaggcaggaacaaaggagtcgcttgtcaaggatctggttagagaagactagggtcttcctcgaaggaagcacgcgcacgcctgctctcccccattgtcttttctggcttctccaggttccctcgacccaggaccccctgttcccaggctatggcccccagtgccctgtagacctggcaggccccccgtgcttgcgacccctatttgggggtctgggtggctactggagggccttgcagaggggcagagaaggcaggaccatgacatctagggcctctgaactttctccggggcgcagcgtgacggctggcatcatcattgttggagatgagatccttaagggacacactcaggacaccaacaccttctttctgtgccggacactgcgctccctaggggtccaggtttgccgagtctcagttgtacctgatgaggtagccaccattgcagctgaggtcacttctttctccaaccgcttcacccatgtcctcacagcagggggcatcggccccactcatgatgatgtgacctttgaggcagtggcacaggcctttggagatgagctgaagccacaccccaagttggaagcagccaccaaagccctaggaggggaaggctgggagaagctatcactggtcaacctttcagattccctctggtctccgtccgaaacgtctacctcttcccaggcattccagagctgctgcggcgggtgctggaggggatgaagggactattccaaaacccagctgttcagttccactcaaaggagctatatgtggctgctgatgaagcctccatcgcccccattctggctgaggcccaggcccactttggacgtaggcttggcctgggttcctaccctgactggggcagcaactactatcaggtgaagctgactctagactcagaggaagaaggacccctggaggaatgcttggcctacctgactgcccgtttgccccagggatcgctggtcccctacatgcccaacgctgtggagcaggccagtgaggctgtatacaaactcgctgaatcagggtcttctttggggaaaaaggtggcaggtgccctacagaccattgagacctccctggctcagtacagcctcacccagctctgtgtgggcttcaacgggggcaaagactgcactgccctcctgcacctcttccatgcagctgtgcagaggaaattacctgatgttccaaaccccctccagatcctgtatatccgcagcatctcccctttccctgagctggaacagtttctacaggacactatcaagaggtataatctgcagatgttggaagctgagggcagcatgaagcaggccctgggtgaactgcaggcacggcacccccagctggaggctgtccttatgggcacccgccggactgacccctactcctgtagcctctgccctttcagccccactgacccaggctggcccgcattcatgcgcatcaacccactgctggactggacctacagagacatctgggattttctgcgtcagctgtttgtcccatactgtatcctgtatgaccgaggatacacatcactggggagtcgggagaataccgtgcggaacccggccctgaagtgcctgagcccaggaggacaccccacataccgtccagcctatctactggagaacgaagaagaggagcggaactcccgcacatgacctcccaccctaggagggagggaaggacaccgtcctagggtataacctggcaataaaccgtgcctctcactgtg

SEQ ID NO: 296302 - DNA, 1229 bp, Homo sapiens
cccgggacatgaggaaaggaacaagggaaagagccggtgaaggggcagaacaggcaggttccctcgacccaggaccccctgttcccaggctatggcccccagtgccctgtagacctggcaggccccccgtgcttgcgacccctatttgggggtctgggtggctactggagggccttgcagaggggcagagaaggcaggaccatgacatctagggcctctgaactttctccggggcgcagcgtgacggctggcatcatcattgttggagatgagatccttaagggacacactcaggacaccaacaccttctttctgtgccggacactgcgctccctaggggtccaggtttgccgagtctcagttgtacctgatgaggtagccaccattgcagctgaggtcacttctttctccaaccgcttcacccatgtcctcacagcagggggcatcggccccactcatgatgatgtgacctttgaggcagtggcacaggcctttggagatgagctgaagccacaccccaagttggaagcagccaccaaagccctaggaggggaaggctgggagaagctatcattggtgccctcctctgcccgcctgcattatggcacagatccttgcactggtcaacctttcagattccctctggtctccgtccgaaacgtctacctcttcccaggcattccagagctgctgcggcgggtgctggaggggatgaagggactattccaaaacccagctgttcagttccactcaaaggagctatatgtggctgctgatgaagcctccatcgcccccattctggctgaggcccaggcccactttggacgtaggcttggcctgggttcctaccctgactggggcagcaactactatcaggtgaagctgactctagactcagaggaagaaggacccctggaggaatgcttggcctacctgactgcccgtttgccccagggatcgctggtcccctacatgcccaacgctgtggagcaggccagtgaggctgtatacaaactcgctgaatcaggtagggaccttatggaggaggggcattatgcccaaagccattggtggcaccccagatctcagtaatgcaggggctgttgggtgcttcctgcaaatccctgagagggcagaagatagcttctgttaattcattattcttccaataaatgttgattgagtacctattttcatcagcactgtgctaggtgttggggataacatca

SEQ ID NO: 296303 - DNA, 1140 bp, Homo sapiens
  misc_feature (23)..(23): n is a, c, g, or t
  misc_feature (68)..(69): n is a, c, g, or t
  misc_feature (73)..(73): n is a, c, g, or t
  misc_feature (88)..(88): n is a, c, g, or t
  misc_feature (90)..(90): n is a, c, g, or t
  misc_feature (98)..(99): n is a, c, g, or t
  misc_feature (102)..(102): n is a, c, g, or t
  misc_feature (106)..(106): n is a, c, g, or t
agtttatggcctctctcccctgntttgaaaacctgactgtaacttcaaatcctctgtccgtcgaactnncctntccagcattccaggntntgcgcggnntgngggntgaggactattccaaaacccagctgttcagttccactcaaaggagctatatgtggctgctgatgaagcctccatcgcccccattctggctgaggcccaggcccactttggacgtaggcttggcctgggttcctaccctgactggggcagcaactactatcaggtgaagctgactctagactcagaggaagaaggacccctggaggaatgcttggcctacctgactgcccgtttgccccagggatcgctggtcccctacatgcccaacgctgtggagcaggccagtgaggctgtatacaaactcgctgaatcagggtcttctttggggaaaaaggtggcaggtgccctacagaccattgagacctccctggctcagtacagcctcacccagctctgtgtgggcttcaacgggggcaaagactgcactgccctcctgcacctcttccatgcagctgtgcagaggaaattacctgatgttccaaaccccctccagatcctgtatatccgcagcatctcccctttccctgagctggaacagtttctacaggacactatcaagaggtataatctgcagatgttggaagctgagggcagcatgaagcaggccctgggtgaactgcaggcacggcacccccagctggaggctgtccttatgggcacccgccggactgacccctactcctgtagcctctgccctttcagccccactgacccaggctggcccgcattcatgcgcatcaacccactgctggactggacctacagagacatctgggattttctgcgtcagctgtttgtcccatactgtatcctgtatgaccgaggatacacatcactggggagtcgggagaataccgtgcggaacccggccctgaagtgcctgagcccaggaggacaccccacataccgtccagcctatctactggagaacgaagaagaggagcggaactcccgcacatgacctcccaccctaggagggagggaaggacaccgtcctagggtataacctggcaataaaccgtgcctctcactgtg

SEQ ID NO: 296304 - DNA, 2715 bp, Homo sapiens
  misc_feature (2458)..(2458): n is a, c, g, or t
cccgggacatgaggaaaggaacaagggaaagagccggtgaaggggcagaacaggcaggttccctcgacccaggaccccctgttcccaggctatggcccccagtgccctgtagacctggcaggccccccgtgcttgcgacccctatttgggggtctgggtggctactggagggccttgcagaggggcagagaaggcaggaccatgacatctagggcctctgaactttctccggggcgcagcgtgacggctggcatcatcattgttggagatgagatccttaaggttggaaacaacaaatggcttttgagtccaagagtgatgcaatcacagtgacgcattaaaacggttactccggagacatcagagcactgtggctggaggctgggagcctggccaggaagctgtcgccattgtccaggtgaaaggtgctaaggacctgcttggtggcagtggggacagaaagaagaaagcaggccaggcgtggtggctcacacctataattccagcactttgggaggctgaggcaggaggatcacttgagaccaggaattcaacaccagcctgggcaacatggcaagaccccatttctacaaaaaaaatttaaaatgagctgaatgtggtggcacgcgcctgtagtcccagctactcggaaggctggggtggcccttgaagccaggaggttgaggctgcagtgaactgtgactgagccactatactccagcctgggtgacagagacccagctttaaaaccaaacaaatggattttcccactcttgtgtccagtccaggcccctcagcagcctgaggtggtgtccttcaaagagcagagcactgcatcatcaggtggatgcagccatcatcttcaacccctccccttcatccctacagtactgatggcctcatcttccccttcaacccccagggacacactcaggacaccaacaccttctttctgtgccggacactgcgctccctaggggtccaggtttgccgagtctcagttgtacctgatgaggtagccaccattgcagctgaggtcacttctttctccaaccgcttcacccatgtcctcacagcagggggcatcggccccactcatgatgatgtgacctttgaggcagtggcacaggcctttggagatgagctgaagccacaccccaagttggaagcagccaccaaagccctaggaggggaaggctgggagaagctatcattggtgccctcctctgcccgcctgcattatggcacagatccttgcactggtcaacctttcagattccctctggtctccgtccgaaacgtctacctcttcccaggcattccagagctgctgcggcgggtgctggaggggatgaagggactattccaaaacccagctgttcagttccactcaaaggagctatatgtggctgctgatgaagcctccatcgcccccattctggctgaggcccaggcccactttggacgtaggcttggcctgggttcctaccctgactggggcagcaactactatcaggtgaagctgactctagactcagaggaagaaggacccctggaggaatgcttggcctacctgactgcccgtttgccccagggatcgctggtcccctacatgcccaacgctgtggagcaggccagtgaggctgtatacaaactcgctgaatcaggaaattacctgatgttccaaaccccctccagatcctgtatatccgcagcatctcccctttccctgagctggaacagtttctacaggacactatcaagaggtataatctgcagatgttggaagctgagggcagcatgaagcaggccctgggtgaactgcaggcacggcacccccagctggaggctgtccttatgggcacccgccggactgacccctactcctgtagcctctgccctttcagccccactgacccaggctggcccgcattcatgcgcatcaacccactgctggactggacctacagagacatctgggattttctgcgtcagctgtttgtcccatactgtatcctgtatgaccgaggatacacatcactggggagtcgggagaataccgtgcggaacccggccctgaagtgcctgagcccaggaggacaccccacataccgtccagcctatctactggagaacgaagaagaggagcggaactcccgcacatgacctcccaccctaggagggagggaaggacaccgtcctagggtataacctggcaataaaccgtgcctctcactgtgaaaaaaaaaataaaagaagataaaacaaaaaaaaaaaataaaaaaaagaaaaaaaaaaaagaaaaaaaaataaaaagaaaaagaaaaaaaaaaaaaaactggtgggccgcttgggccaatgcgattttagactggggcaggtttttgaatgcggccgaatttggggctaattgggccaattcgcctttaggggggccgtttaaaattcaatggcccgnggtttaaaaaggacggaacgggaaaacccttggggttcccaactttaatcgcctggtggaaaatccccttttcgccagttggggaaaataccaaaagggcccgacccgttggcctttccaaaaaggtggccaacctttaagggtaattggaaatggaaggcgttaaatttttggtaaaaattgcgggtaaattttttggtaaacaaagctcatttttaaaccaaagggccgaaaatgcggaaaatacccttataaat

SEQ ID NO: 296305 - DNA, 2085 bp, Homo sapiens
cccgggacatgaggaaaggaacaagggaaagagccggtgaaggggcagaacaggcaggttccctcgacccaggaccccctgttcccaggctatggcccccagtgccctgtagacctggcaggccccccgtgcttgcgacccctatttgggggtctgggtggctactggagggccttgcagaggggcagagaaggcaggaccatgacatctagggcctctgaactttctccggggcgcagcgtgacggctggcatcatcattgttggagatgagatccttaaggttggaaacaacaaatggcttttgagtccaagagtgatgcaatcacagtgacgcattaaaacggttactccggagacatcagagcactgtggctggaggctgggagcctggccaggaagctgtcgccattgtccaggtgaaaggtgctaaggacctgcttggtggcagtggggacagaaagaagaaagcaggccaggcgtggtggctcacacctataattccagcactttgggaggctgaggcaggaggatcacttgagaccaggaattcaacaccagcctgggcaacatggcaagaccccatttctacaaaaaaaatttaaaatgagctgaatgtggtggcacgcgcctgtagtcccagctactcggaaggctggggtggcccttgaagccaggaggttgaggctgcagtgaactgtgactgagccactatactccagcctgggtgacagagacccagctttaaaaccaaacaaatggattttcccactcttgtgtccagtccaggcccctcagcagcctgaggtggtgtccttcaaagagcagagcactgcatcatcaggtggatgcagccatcatcttcaacccctccccttcatccctacagtactgatggcctcatcttccccttcaacccccagggacacactcaggacaccaacaccttctttctgtgccggacactgcgctccctaggggtccaggtttgccgagtctcagttgtacctgatgaggtagccaccattgcagctgaggtcacttctttctccaaccgcttcacccatgtcctcacagcagggggcatcggccccactcatgatgatgtgacctttgaggcagtggcacaggcctttggagatgagctgaagccacaccccaagttggaagcagccaccaaagccctaggaggggaaggctgggagaagctatcattggtgccctcctctgcccgcctgcattatggcacagatccttgcactggtcaacctttcagattccctctggtctccgtccgaaacgtctacctcttcccaggcattccagagctgctgcggcgggtgctggaggggatgaagggactattccaaaacccagctgttcagttccactcaaaggagctatatgtggctgctgatgaagcctccatcgcccccattctggctgaggcccaggcccactttggacgtaggcttggcctgggttcctaccctgactggggcagcaactactatcaggtgaagctgactctagactcagaggaagaaggacccctggaggaatgcttggcctacctgactgcccgtttgccccagggatcgctggtcccctacatgcccaacgctgtggagcaggccagtgaggctgtatacaaactcgctgaatcaggaaattacctgatgttccaaaccccctccagatcctgtatatccgcagcatctcccctttccctgagctggaacagtttctacaggacactatcaagagagcaagctataccagagaatcagatagcaagccctccctcagaggccaagggagcagaagagccatggatgggccccttcccaggacagcaggggtagaagtgggaaagatacacatcactggggagtcgggagaataccgtgcggaacccggccctgaagtgcctgagcccaggaggacaccccacataccgtccagcctatctactggagaacgaagaagaggagcggaactcccgcacatgacctcccaccctaggagggagggaaggacaccgtcctagggtataacctggcaataaaccgtgcctctcactgtg

SEQ ID NO: 296306 - DNA, 874 bp, Homo sapiens
cccgggacatgaggaaaggaacaagggaaagagccggtgaaggggcagaacaggcaggttccctcgacccaggaccccctgttcccaggctatggcccccagtgccctgtagacctggcaggccccccgtgcttgcgacccctatttgggggtctgggtggctactggagggccttgcagaggggcagagaaggcaggaccatgacatctagggcctctgaactttctccggggcgcagcgtgacggctggcatcatcattgttggagatgagatccttaaggttggaaacaacaaatggcttttgagtccaagagtgatgcaatcacagtgacgcattaaaacggttactccggagacatcagagcactgtggctggaggctgggagcctggccaggaagctgtcgccattgtccaggtgaaaggtgctaaggacctgcttggtggcagtggggacagaaagaagaaagcaggccaggcgtggtggctcacacctataattccagcactttgggaggctgaggcaggaggatcacttgagaccaggaattcaacaccagcctgggcaacatggcaagaccccatttctacaaaaaaaatttaaaatgagctgaatgtggtggcacgcgcctgtagtcccagctactcggaaggctggggtggcccttgaagccaggaggttgaggctgcagtgaactgtgactgagccactatactccagcctgggtgacagacaccccacataccgtccagcctatctactggagaacgaagaagaggagcggaactcccgcacatgacctcccaccctaggagggagggaaggacaccgtcctagggtataacctggcaataaaccgtgcctctcactgtg

SEQ ID NO: 296307 - DNA, 566 bp, Homo sapiens
cccgggacatgaggaaaggaacaagggaaagagccggtgaaggggcagaacaggcaggttccctcgacccaggaccccctgttcccaggctatggcccccagtgccctgtagacctggcaggccccccgtgcttgcgacccctatttgggggtctgggtggctactggagggccttgcagaggggcagagaaggcaggaccatgacatctagggcctctgaactttctccggggcgcagcgtgacggctggcatcatcattgttggagatgagatccttaaggactggacctacagagacatctgggattttctgcgtcagctgtttgtcccatactgtatcctgtatgaccgaggatacacatcactggggagtcgggagaataccgtgcggaacccggccctgaagtgcctgagcccaggaggacaccccacataccgtccagcctatctactggagaacgaagaagaggagcggaactcccgcacatgacctcccaccctaggagggagggaaggacaccgtcctagggtataacctggcaataaaccgtgcctctcactgtg

SEQ ID NO: 296308 - DNA, 1273 bp, Homo sapiens
cccgggacatgaggaaaggaacaagggaaagagccggtgaaggggcagaacaggcaggtgagagtctaagagggctcagtaatctgaagcttggtgggaagaagggattctgggctagaaagggtgcagaagcctgaagtagaaagagacgggattttggtccggggtggagagcgaatgcattgaaaagggccaaggcccaggataaggtagacatttaaaggggtacggatgcccaaggtagagcagacacttgaggagaccagctcagcaaacggaagacacttaaagtggtaggttctcaagagagaagaagtttttaagactagagctaagcaagacatttaaaaggacatgggttgggatttgggaacacgtttattccagaggcaggaacaaaggagtcgcttgtcaaggatctggttagagaagactagggtcttcctcgaaggaagcacgcgcacgcctgctctcccccattgtcttttctggcttctccaggttccctcgacccaggaccccctgttcccaggctatggcccccagtgccctgtagacctggcaggccccccgtgcttgcgacccctatttgggggtctgggtggctactggagggccttgcagaggggcagagaaggcaggaccatgacatctagggcctctgaactttctccggggcgcagcgtgacggctggcatcatcattgttggagatgagatccttaaggtgtgtctgggacagaaaaggggggagggcgctgcgttctcctgtccttaagggcctgctgcacatccctccatggaaggaggtgaaacagggtgggagcctctttgctgcagtaggatcctggagtgaatccagcatattggaggaaaattaaccctcattctttcaattactctactgaaaaacttgtagcaaagtccctacaatttttcaacctgagagagctgattgaaaaaaagaaaaataaaaaggtcattgcaatttaccaagcagtatggtagagggcagaggagctacacaacaatgacaggaagcccctcgagtagaggaggtacaggtgtgtgtattgtatatttaagagttttggccgggtgcggtggctcacgcatgtaatcccagcactttgggaggccgaggcgggtggatcacgagttcaggagttcgagaccagcctcaacatggagaaaccccatctctactaaaaatacaaaattagccaggcgtggtggtgcatgcctgtaatcccagctacttggcaggctgaggc

SEQ ID NO: 296309 - DNA, 374 bp, Homo sapiens
ataagttaaatattgttattctaattccagtcagaatcaccttagcattggtgagatagtatttggagatttgtctttgcattttttcagtctactttttgggtattttatgaatgtgaaagcctaaactttccccttcattaggaagagatacttaataattcttgatagcccattcatcatctaggtgagcagtgcattctggtgctttactcttctcaggtggaaaaaataatggactgtaaatgcagtggtcctatactttacccacatttagctcttaaaaaatacaaaattgaaggcatttttaagattagacctcatgtaaagtttctctttgatgatttttaaaacaatctcctttacttttgaaa

SEQ ID NO: 296310 - DNA, 611 bp, Homo sapiens
agggaagccagatgatatgaacttcagtgatgtaaagcaaatccatcaaacagacactggcagtactttagacacaacaggagcaggatgtgcagtggcgactgaatctatgacattcactctgataagtgtggtgatgttacttcccgggatttgaacaagctgacagagcataggagcatgttatctgggcctctgtattgcaggagctcgctcagaaaaatgaagaaagacgagaaaatgctctgtcattcagcaagaaagcagacggaagcttagaatcacagcttatttaaaaggacagcttataaatatgatgtgtttataattttactatttcattttcctcatttataaaaaaattaaagaaaatctcatgagaatttcatcacagatggttaactgcaataaatttatattgaataatttgatttacttctattttgactacacatctattatagtatgggtgtgattgaatgcaaatccacagacacatgtacacatttatctatatctatccataaaatatacatattcatgtttattgttgctatgattgtattgatgcttatatttatatttgtataaaatttgcctttatgtcagtt

SEQ ID NO: 296311 - DNA, 962 bp, Homo sapiens
agggaagccagatgatatgaacttcagtgatgtaaagcaaatccatcaaacagacactggcagtactttagacacaacaggagcaggatgtgcagtggcgactgaatctatgacattcactctgataagtgtggtgatgttacttcccgggatttggtaactgaactcttctgtcctgacataccttactgaagtctcgatttcttctctctctgcatatgcctggaataagagatcctttttcaatgtaacaattatatttatgaaaagatatgttacactaacttctcagaagccaagctgaaatattcataaagtccctaaaactcaacgtttaaatgacacactttaaaaatatgtcttttttcaatctaactgaaaaccttcttaacttctaatatattaaatctgaagatgtgaagggcacagaagtgactttgaataagaagaatttagtgtatctgtaattttattatcaattccaagccccttcctttctaaattaaaaatgttttcatttgaaagtgtatttgccagacaatgaaaacagtatgcagtatttcttaaagtattgaaattagaatatcatgaaataaatcaaaacatacaatggcaagtagtatgcatgcatattcaagagactcttccatttttgcaagctgtagaaggaaatgtctgaatgtctataagttatggggtagattcttgagaagcatttcatataatttcactgaagaaccttgataattttgacccactgaacttagccactgatgaaccttaagctgagtattttattaacacctgatttgtattccattatattcaaaatgcatctttggtattgtgcctctgctcccatctctctctttgcctcatagatttagctatgttgggaagcacatgcttgctctaggaatatctccaataaagctgttaactatttggtggaaaaatttgaa

SEQ ID NO: 296312 - DNA, 2174 bp, Homo sapiens
tgggagtgcgaggctgacgcggcggctctatctcccgtaactgtgacacgggtgcacgcaagcgtcattgggggtgatgggggccgtgctcggtgcgcttctgcaccggtgacgcaaccgctgtgtctccgccagtccgcgcaggccagcatccttcagaaaaagcatccccgaggaggaagacgaatcgttaaacatcttaggtcagctctagcctctcggaatttgtcttcttcagtggaaaccccgagaagactgatcagttcttcagttctaaaacaatggcccagggtttggtgacgttcgccgacgtagccatagacttttctcaggaggagtgggcctgtctgaactctgctcagagggacctgtactgggacgtgatgctggagaactacagtaacttggtctcactggatttggagtcagcatatgaaaataagagtttacctacagaaaaaaacattcatgaaataagggcttccaaaaggaattcagatagaagaagtaaatcccttggccgtaactggatatgtgaaggtacgcttgaaagaccacagcgctccagagggaggtatgtcaatcagatgatcatcaattatgtcaaaaggcctgctactagagaaggcacccctcctagaacacatcagagacatcataaggagaattcctttgaatgtaaggactgtgggaaggcctttagtcgtggctatcaacttagtcaacatcagaaaatccatactggtgagaaaccttatgaatgtaaagaatgtaagaaggccttccgttggggcaatcagcttactcaacatcaaaaaattcatactggggagaagccctacgaatgtaaagactgtgggaaggcttttcgatggggctcaagcctcgttattcataagaggattcatactggtgaaaaaccctatgaatgtaaagactgtggaaaggcctttcggcgtggtgatgagctcactcagcaccagagattccacactggggagaaagactacgaatgcaaagactgtgggaagacctttagccgtgtgtataaacttattcagcacaagagaattcatagtggggagaagccttacgagtgtaaagactgtgggaaggcttttatttgtggttcaagcctcattcagcataaaagaattcacacaggtgagaaaccctatgaatgtcaagaatgtgggaaggcctttactcgagtcaattaccttactcagcatcagaagatccacaccggtgagaagcctcacgaatgtaaggagtgtgggaaggcctttcgctggggttcgagcctcgttaagcacgagaggatacatacgggcgagaagccgtacaagtgcacagaatgtgggaaggccttcaattgtggctatcacctcactcagcacgagagaatccacacaggcgaaaccccgtataaatgtaaggagtgtgggaaggctttcatttatggatcgagcctcgtgaaacatgagagaattcataccggggtgaaaccctatgggtgtacagaatgtgggaagagctttagtcacggccatcagcttacacaacatcagaaaacgcacagtggggcgaaatcctacgaatgtaaggagtgcgggaaggcatgtaaccacctaaaccatctccgagaacatcagaggatccacaacagttgaagagccttttgaacgcagtagcccgctcgtatctatggtttcgctttccacagtttgttacctgcagtcaactgcagttcaaaaatattaaatggaaaattccagaaataaagaattttaagtctcaaatggtgtgcccttctgagtagcgtgatgaaatctctcgctgtccggctccagccggccggggatgtgagtcatcccttggtccagcacatccacgctgtatacgccacccaccctgctagtgacttagtagccgtcttggtgatcagatcaactatcccagcatcacagtgcctgtgcccaagcagtcctcactttgcttaacagtggccccagagagcaggagtagtgatgctggtgattcggatatgccaaagagaagccacaaagtgcttccttttaaatgaaaaggtgaaagttctcaacttaaaacagaaaagaaaaaaatcatatactgaggttgctaagatctacatgacaataagatattttggg

SEQ ID NO: 296313 - DNA, 2318 bp, Homo sapiens
tgcgtcgaagcttctctggtttcgcattacatttcccagagggccttggggcacagtccaatgaggagcgagccgggtggccggctgaggggcgtgcttcatgctcgcgggatttttaaaaatggtttctcctggatcttatcccaactgcgcctgagaccttgtttcacctcctgatgtgctgggtgtggttaggcctcgagccgggagctatttgcctcccaggaggaagccagggcagggttccgcggggaatggcggtgagggagccactcgggacgcggaggccctaaaatgaagaagcttcggcctgaggcttcgggagcggcgagcagtgtctccgttgcttcctgtgccttggccttccagccatgtggtacctgctagggagcagtggtcccaaagtgacgtgagaggctctacgctgttgtgaaaatgaccaagaagaaggcttcacaagtcacgagatggcagttttggagccagaagtgctctccgtgcacactacctggacgacaagaggaagtaacctcaagaatagaattccttttggggaagaaagagctggccttcaggaaaagcatcccggaggaggaagaagaagtgttatatgtcctaaagtaaggtttcaggccagcatccttcagaaaaagcatccccgaggaggaagacgaatcgttaaacatcttaggtcagctttaccagtgaggaaaccgacactgtgagctctagcctctcggaatttgtcttcttcagtggaaaccccgagaagactgatcagttcttcagttctaaaacaatggcccagggtttggtgacgttcgccgacgtagccatagacttttctcaggaggagtgggcctgtctgaactctgctcagagggacctgtactgggacgtgatgctggagaactacagtaacttggtctcactggatttggagtcagcatatgaaaataagagtttacctacagaaaaaaacattcatgaaataagggcttccaaaaggaattcagatagaagaagtaaatcccttggccgtaactggatatgtgaaggtacgcttgaaagaccacagcgctccagagggaggtatgtcaatcagatgatcatcaattatgtcaaaaggcctgctactagagaaggcacccctcctagaacacatcagagacatcataaggagaattcctttgaatgtaaggactgtgggaaggcctttagtcgtggctatcaacttagtcaacatcagaaaatccatactggtgagaaaccttatgaatgtaaagaatgtaagaaggccttccgttggggcaatcagcttactcaacatcaaaaaattcatactggggagaagccctacgaatgtaaagactgtgggaaggcttttcgatggggctcaagcctcgttattcataagaggattcatactggtgaaaaaccctatgaatgtaaagactgtggaaaggcctttcggcgtggtgatgagctcactcagcaccagagattccacactggggagaaagactacgaatgcaaagactgtgggaagacctttagccgtgtgtataaacttattcagcacaagagaattcatagtggggagaagccttacgagtgtaaagactgtgggaaggcttttatttgtggttcaagcctcattcagcataaaagaattcacacaggtgagaaaccctatgaatgtcaagaatgtgggaaggcctttactcgagtcaattaccttactcagcatcagaagatccacaccggtgagaagcctcacgaatgtaaggagtgtgggaaggcctttcgctggggttcgagcctcgttaagcacgagaggatacatacgggcgagaagccgtacaagtgcacagaatgtgggaaggccttcaattgtggctatcacctcactcagcacgagagaatccacacaggcgaaaccccgtataaatgtaaggagtgtgggaaggctttcatttatggatcgagcctcgtgaaacatgagagaattcataccggggtgaaaccctatgggtgtacagaatgtgggaagagctttagtcacggccatcagcttacacaacatcagaaaacgcacagtggggcgaaatcctacgaatgtaaggagtgcgggaaggcatgtaaccacctaaaccatctccgagaacatcagaggatccacaacagttgaagagccttttgaacgcagtagcccgctcgtatctatggtttcgctttccacagtttgttacctgcagtcaactgcagttcaaaaatattaaatggaaaattccagaaataaagaattttaagtctca

SEQ ID NO: 296314 - DNA, 2627 bp, Homo sapiens
aggctttgggtcaacgcagcccgtgcctgtgaacctcggcggtgcgtccctgggactctgctccgtgaggtgcgctctgggggttgtgcgggggcagcggtcgggacgggtctccgtggcccacggatgcacctctgcaccgtgtggggtggtggggcccgtagcatggccgtgctgggcgttagtgggtatgaggggcgcagatgtgtctcaggacagagtgagctgtggtgaggctgagctgtgcagacttgtgctgggatgggtgatcgggccttctgggtgacgcaggtgtgtgtgacaacacaacctgtagcttcagcgtctctgtgctgggatggatgatcgggccttctgagtgatgcaggtgtgtgtgacagtgcaacttgtagctccagcgtctctgctgcttcccctgccttcacctcctaaccaagcggtacctgcctgagaacaagggccgcggagggacgtgagcgcctgagcctcgcctggaaattcaccagcaagaaggcagaaacagccatgaggccagcatccttcagaaaaagcatccccgaggaggaagacgaatcgttaaacatctgaaagggtcaggccagcatccttcagaaaaagcatccccgaggaggaagacgaatcgttaaacatcttaggtcagctctagcctctcggaatttgtcttcttcagtggaaaccccgagaagactgatcagttcttcagttctaaaacaatggcccagggtttggtgacgttcgccgacgtagccatagacttttctcaggaggagtgggcctgtctgaactctgctcagagggacctgtactgggacgtgatgctggagaactacagtaacttggtctcactggatttggagtcagcatatgaaaataagagtttacctacagaaaaaaacattcatgaaataagggcttccaaaaggaattcagatagaagaagtaaatcccttggccgtaactggatatgtgaaggtacgcttgaaagaccacagcgctccagagggaggtatgtcaatcagatgatcatcaattatgtcaaaaggcctgctactagagaaggcacccctcctagaacacatcagagacatcataaggagaattcctttgaatgtaaggactgtgggaaggcctttagtcgtggctatcaacttagtcaacatcagaaaatccatactggtgagaaaccttatgaatgtaaagaatgtaagaaggccttccgttggggcaatcagcttactcaacatcaaaaaattcatactggggagaagccctacgaatgtaaagactgtgggaaggcttttcgatggggctcaagcctcgttattcataagaggattcatactggtgaaaaaccctatgaatgtaaagactgtggaaaggcctttcggcgtggtgatgagctcactcagcaccagagattccacactggggagaaagactacgaatgcaaagactgtgggaagacctttagccgtgtgtataaacttattcagcacaagagaattcatagtggggagaagccttacgagtgtaaagactgtgggaaggcttttatttgtggttcaagcctcattcagcataaaagaattcacacaggtgagaaaccctatgaatgtcaagaatgtgggaaggcctttactcgagtcaattaccttactcagcatcagaagatccacaccggtgagaagcctcacgaatgtaaggagtgtgggaaggcctttcgctggggttcgagcctcgttaagcacgagaggatacatacgggcgagaagccgtacaagtgcacagaatgtgggaaggccttcaattgtggctatcacctcactcagcacgagagaatccacacaggcgaaaccccgtataaatgtaaggagtgtgggaaggctttcatttatggatcgagcctcgtgaaacatgagagaattcataccggggtgaaaccctatgggtgtacagaatgtgggaagagctttagtcacggccatcagcttacacaacatcagaaaacgcacagtggggcgaaatcctacgaatgtaaggagtgcgggaaggcatgtaaccacctaaaccatctccgagaacatcagaggatccacaacagttgaagagccttttgaacgcagtagcccgctcgtatctatggtttcgctttccacagtttgttacctgcagtcaactgcagttcaaaaatattaaatggaaaattccagaaataaagaattttaagtctcaaatggtgtgcccttctgagtagcgtgatgaaatctctcgctgtccggctccagccggccggggatgtgagtcatcccttggtccagcacatccacgctgtatacgccacccaccctgctagtgacttagtagccgtcttggtgatcagatcaactatcccagcatcacagtgcctgtgcccaagcagtcctcactttgcttaacagtggccccagagagcaggagtagtgatgctggtgattcggatatgccaaagagaagccacaaagtgcttccttttaaatgaaaaggtgaaagttctcaacttaaaacagaaaagaaaaaaatcatatactgaggttgctaagatctacatgacaataagatattttggg

SEQ ID NO: 296315 - DNA, 2315 bp, Homo sapiens
gcggccgctgggtgcgcgtgcgcatgcgcgctggcctccagggggtggcgggaccgagtgtgtgacgcacttgcgtgggagtacgaggctgacgcggcggccctgtccccgtaactgtgacacgggtgcacgcgagcgtcattgggggcgatgggggccgtgctgggtgcgcgtttgcaccagtgacgcagccgctgcatctccgccagtccgcgcaggccagcatccttcagaaaaagcatccccgaggaggaagacgaatcgttaaacatctgaaagggtcaggccagcatccttcagaaaaagcatccccgaggaggaagacgaatcgttaaacatcttaggtcagctctagcctctcggaatttgtcttcttcagtggaaaccccgagaagactgatcagttcttcagttctaaaacaatggcccagggtttggtgacgttcgccgacgtagccatagacttttctcaggaggagtgggcctgtctgaactctgctcagagggacctgtactgggacgtgatgctggagaactacagtaacttggtctcactggatttggagtcagcatatgaaaataagagtttacctacagaaaaaaacattcatgaaataagggcttccaaaaggaattcagatagaagaagtaaatcccttggccgtaactggatatgtgaaggtacgcttgaaagaccacagcgctccagagggaggtatgtcaatcagatgatcatcaattatgtcaaaaggcctgctactagagaaggcacccctcctagaacacatcagagacatcataaggagaattcctttgaatgtaaggactgtgggaaggcctttagtcgtggctatcaacttagtcaacatcagaaaatccatactggtgagaaaccttatgaatgtaaagaatgtaagaaggccttccgttggggcaatcagcttactcaacatcaaaaaattcatactggggagaagccctacgaatgtaaagactgtgggaaggcttttcgatggggctcaagcctcgttattcataagaggattcatactggtgaaaaaccctatgaatgtaaagactgtggaaaggcctttcggcgtggtgatgagctcactcagcaccagagattccacactggggagaaagactacgaatgcaaagactgtgggaagacctttagccgtgtgtataaacttattcagcacaagagaattcatagtggggagaagccttacgagtgtaaagactgtgggaaggcttttatttgtggttcaagcctcattcagcataaaagaattcacacaggtgagaaaccctatgaatgtcaagaatgtgggaaggcctttactcgagtcaattaccttactcagcatcagaagatccacaccggtgagaagcctcacgaatgtaaggagtgtgggaaggcctttcgctggggttcgagcctcgttaagcacgagaggatacatacgggcgagaagccgtacaagtgcacagaatgtgggaaggccttcaattgtggctatcacctcactcagcacgagagaatccacacaggcgaaaccccgtataaatgtaaggagtgtgggaaggctttcatttatggatcgagcctcgtgaaacatgagagaattcataccggggtgaaaccctatgggtgtacagaatgtgggaagagctttagtcacggccatcagcttacacaacatcagaaaacgcacagtggggcgaaatcctacgaatgtaaggagtgcgggaaggcatgtaaccacctaaaccatctccgagaacatcagaggatccacaacagttgaagagccttttgaacgcagtagcccgctcgtatctatggtttcgctttccacagtttgttacctgcagtcaactgcagttcaaaaatattaaatggaaaattccagaaataaagaattttaagtctcaaatggtgtgcccttctgagtagcgtgatgaaatctctcgctgtccggctccagccggccggggatgtgagtcatcccttggtccagcacatccacgctgtatacgccacccaccctgctagtgacttagtagccgtcttggtgatcagatcaactatcccagcatcacagtgcctgtgcccaagcagtcctcactttgcttaacagtggccccagagagcaggagtagtgatgctggtgattcggatatgccaaagagaagccacaaagtgcttccttttaaatgaaaaggtgaaagttctcaacttaaaacagaaaagaaaaaaatcatatactgaggttgctaagatctacatgacaataagatattttggg

SEQ ID NO: 296316 - DNA, 2166 bp, Homo sapiens
aggctttgggtcaacgcagcccgtgcctgtgaacctcggcggtgcgtccctgggactctgctccgtgaggccagcatccttcagaaaaagcatccccgaggaggaagacgaatcgttaaacatctgaaagggtcaggccagcatccttcagaaaaagcatccccgaggaggaagacgaatcgttaaacatcttaggtcagctctagcctctcggaatttgtcttcttcagtggaaaccccgagaagactgatcagttcttcagttctaaaacaatggcccagggtttggtgacgttcgccgacgtagccatagacttttctcaggaggagtgggcctgtctgaactctgctcagagggacctgtactgggacgtgatgctggagaactacagtaacttggtctcactggatttggagtcagcatatgaaaataagagtttacctacagaaaaaaacattcatgaaataagggcttccaaaaggaattcagatagaagaagtaaatcccttggccgtaactggatatgtgaaggtacgcttgaaagaccacagcgctccagagggaggtatgtcaatcagatgatcatcaattatgtcaaaaggcctgctactagagaaggcacccctcctagaacacatcagagacatcataaggagaattcctttgaatgtaaggactgtgggaaggcctttagtcgtggctatcaacttagtcaacatcagaaaatccatactggtgagaaaccttatgaatgtaaagaatgtaagaaggccttccgttggggcaatcagcttactcaacatcaaaaaattcatactggggagaagccctacgaatgtaaagactgtgggaaggcttttcgatggggctcaagcctcgttattcataagaggattcatactggtgaaaaaccctatgaatgtaaagactgtggaaaggcctttcggcgtggtgatgagctcactcagcaccagagattccacactggggagaaagactacgaatgcaaagactgtgggaagacctttagccgtgtgtataaacttattcagcacaagagaattcatagtggggagaagccttacgagtgtaaagactgtgggaaggcttttatttgtggttcaagcctcattcagcataaaagaattcacacaggtgagaaaccctatgaatgtcaagaatgtgggaaggcctttactcgagtcaattaccttactcagcatcagaagatccacaccggtgagaagcctcacgaatgtaaggagtgtgggaaggcctttcgctggggttcgagcctcgttaagcacgagaggatacatacgggcgagaagccgtacaagtgcacagaatgtgggaaggccttcaattgtggctatcacctcactcagcacgagagaatccacacaggcgaaaccccgtataaatgtaaggagtgtgggaaggctttcatttatggatcgagcctcgtgaaacatgagagaattcataccggggtgaaaccctatgggtgtacagaatgtgggaagagctttagtcacggccatcagcttacacaacatcagaaaacgcacagtggggcgaaatcctacgaatgtaaggagtgcgggaaggcatgtaaccacctaaaccatctccgagaacatcagaggatccacaacagttgaagagccttttgaacgcagtagcccgctcgtatctatggtttcgctttccacagtttgttacctgcagtcaactgcagttcaaaaatattaaatggaaaattccagaaataaagaattttaagtctcaaatggtgtgcccttctgagtagcgtgatgaaatctctcgctgtccggctccagccggccggggatgtgagtcatcccttggtccagcacatccacgctgtatacgccacccaccctgctagtgacttagtagccgtcttggtgatcagatcaactatcccagcatcacagtgcctgtgcccaagcagtcctcactttgcttaacagtggccccagagagcaggagtagtgatgctggtgattcggatatgccaaagagaagccacaaagtgcttccttttaaatgaaaaggtgaaagttctcaacttaaaacagaaaagaaaaaaatcatatactgaggttgctaagatctacatgacaataagatattttggg

SEQ ID NO: 296317 - DNA, 3207 bp, Homo sapiens
tgcgtcgaagcttctctggtttcgcattacatttcccagagggccttggggcacagtccaatgaggagcgagccgggtggccggctgaggggcgtgcttcatgctcgcgggatttttaaaaatggtttctcctggatcttatcccaactgcgcctgagaccttgtttcacctcctgatgtgctgggtgtggttaggcctcgagccgggagctatttgcctcccaggaggaagccagggcagggttccgcggggaatggcggtgagggagccactcgggacgcggaggccctaaaatgaagaagcttcggcctgaggcttcgggagcggcgagcagggaagtgggagtgtgtgtgagtggtgtgtgtgtgtgtgtgtgtgtgtgtgtgaataagccagaggctgcctggtggggccccgccgtggcccagtgactgagataattgtcttcgtctgtggggtaatgcgaacaagccccgttcccctaagccgtgatgcatgcggggttgacgcggccgggctctgtccccataaactgtgacacaggtgtgtgtagacgtctatgagggccatagcgccgggctgtaagggcatctgtaggggtgacgcagccgggctgtgtctctgcacctccgttctgtgcgaggtcaatgctggtggggtctgcagaggtggcacggccaggacgggtctccgtgtctctgaaatgtgcctttgcacttctgtcaggttgacagggacaggcagtgtccctctggtgtgagcgtctgtgggtgtgaaagggccagcgagtgtgcggctgtgactggtcgggatcgggcctgggtgcatggccttttgagtgagcacaggtgtgtgcgaccatgtcacctgtctttctagtgtctccgttgcttcctgtgccttggccttccagccatgtggtacctgctagggagcagtggtcccaaagtgacgtgagaggctctacgctgttgtgaaaatgaccaagaagaaggcttcacaagtcacgagatggcagttttggagccagaagtgctctccgtgcacactacctggacgacaagaggaagtaacctcaagaatagaattccttttggggaagaaagagctggccttcaggaaaagcatcccggaggaggaagaagaagtgttatatgtcctaaagtaaggtttcaggccagcatccttcagaaaaagcatccccgaggaggaagacgaatcgttaaacatcttaggtcagctctagcctctcggaatttgtcttcttcagtggaaaccccgagaagactgatcagttcttcagttctaaaacaatggcccagggtttggtgacgttcgccgacgtagccatagacttttctcaggaggagtgggcctgtctgaactctgctcagagggacctgtactgggacgtgatgctggagaactacagtaacttggtctcactggatttggagtcagcatatgaaaataagagtttacctacagaaaaaaacattcatgaaataagggcttccaaaaggaattcagatagaagaagtaaatcccttggccgtaactggatatgtgaaggtacgcttgaaagaccacagcgctccagagggaggtatgtcaatcagatgatcatcaattatgtcaaaaggcctgctactagagaaggcacccctcctagaacacatcagagacatcataaggagaattcctttgaatgtaaggactgtgggaaggcctttagtcgtggctatcaacttagtcaacatcagaaaatccatactggtgagaaaccttatgaatgtaaagaatgtaagaaggccttccgttggggcaatcagcttactcaacatcaaaaaattcatactggggagaagccctacgaatgtaaagactgtgggaaggcttttcgatggggctcaagcctcgttattcataagaggattcatactggtgaaaaaccctatgaatgtaaagactgtggaaaggcctttcggcgtggtgatgagctcactcagcaccagagattccacactggggagaaagactacgaatgcaaagactgtgggaagacctttagccgtgtgtataaacttattcagcacaagagaattcatagtggggagaagccttacgagtgtaaagactgtgggaaggcttttatttgtggttcaagcctcattcagcataaaagaattcacacaggtgagaaaccctatgaatgtcaagaatgtgggaaggcctttactcgagtcaattaccttactcagcatcagaagatccacaccggtgagaagcctcacgaatgtaaggagtgtgggaaggcctttcgctggggttcgagcctcgttaagcacgagaggatacatacgggcgagaagccgtacaagtgcacagaatgtgggaaggccttcaattgtggctatcacctcactcagcacgagagaatccacacaggcgaaaccccgtataaatgtaaggagtgtgggaaggctttcatttatggatcgagcctcgtgaaacatgagagaattcataccggggtgaaaccctatgggtgtacagaatgtgggaagagctttagtcacggccatcagcttacacaacatcagaaaacgcacagtggggcgaaatcctacgaatgtaaggagtgcgggaaggcatgtaaccacctaaaccatctccgagaacatcagaggatccacaacagttgaagagccttttgaacgcagtagcccgctcgtatctatggtttcgctttccacagtttgttacctgcagtcaactgcagttcaaaaatattaaatggaaaattccagaaataaagaattttaagtctcaaatggtgtgcccttctgagtagcgtgatgaaatctctcgctgtccggctccagccggccggggatgtgagtcatcccttggtccagcacatccacgctgtatacgccacccaccctgctagtgacttagtagccgtcttggtgatcagatcaactatcccagcatcacagtgcctgtgcccaagcagtcctcactttgcttaacagtggccccagagagcaggagtagtgatgctggtgattcggatatgccaaagagaagccacaaagtgcttccttttaaatgaaaaggtgaaagttctcaacttaaaacagaaaagaaaaaaatcatatactgaggttgctaagatctacatgacaataagatattttggg

SEQ ID NO: 296318 - DNA, 2086 bp, Homo sapiens
  misc_feature (20)..(20): n is a, c, g, or t
  misc_feature (24)..(24): n is a, c, g, or t
  misc_feature (44)..(44): n is a, c, g, or t
cccgatgcattgtcttccangagnaagacgaatcgttaaacatntgaaagggtcaggccagcatccttcagaaaaagcatccccgaggaggaagacgaatcgttaaacatcttaggtcagctctagcctctcggaatttgtcttcttcagtggaaaccccgagaagactgatcagttcttcagttctaaaacaatggcccagggtttggtgacgttcgccgacgtagccatagacttttctcaggaggagtgggcctgtctgaactctgctcagagggacctgtactgggacgtgatgctggagaactacagtaacttggtctcactggatttggagtcagcatatgaaaataagagtttacctacagaaaaaaacattcatgaaataagggcttccaaaaggaattcagatagaagaagtaaatcccttggccgtaactggatatgtgaaggtacgcttgaaagaccacagcgctccagagggaggtatgtcaatcagatgatcatcaattatgtcaaaaggcctgctactagagaaggcacccctcctagaacacatcagagacatcataaggagaattcctttgaatgtaaggactgtgggaaggcctttagtcgtggctatcaacttagtcaacatcagaaaatccatactggtgagaaaccttatgaatgtaaagaatgtaagaaggccttccgttggggcaatcagcttactcaacatcaaaaaattcatactggggagaagccctacgaatgtaaagactgtgggaaggcttttcgatggggctcaagcctcgttattcataagaggattcatactggtgaaaaaccctatgaatgtaaagactgtggaaaggcctttcggcgtggtgatgagctcactcagcaccagagattccacactggggagaaagactacgaatgcaaagactgtgggaagacctttagccgtgtgtataaacttattcagcacaagagaattcatagtggggagaagccttacgagtgtaaagactgtgggaaggcttttatttgtggttcaagcctcattcagcataaaagaattcacacaggtgagaaaccctatgaatgtcaagaatgtgggaaggcctttactcgagtcaattaccttactcagcatcagaagatccacaccggtgagaagcctcacgaatgtaaggagtgtgggaaggcctttcgctggggttcgagcctcgttaagcacgagaggatacatacgggcgagaagccgtacaagtgcacagaatgtgggaaggccttcaattgtggctatcacctcactcagcacgagagaatccacacaggcgaaaccccgtataaatgtaaggagtgtgggaaggctttcatttatggatcgagcctcgtgaaacatgagagaattcataccggggtgaaaccctatgggtgtacagaatgtgggaagagctttagtcacggccatcagcttacacaacatcagaaaacgcacagtggggcgaaatcctacgaatgtaaggagtgcgggaaggcatgtaaccacctaaaccatctccgagaacatcagaggatccacaacagttgaagagccttttgaacgcagtagcccgctcgtatctatggtttcgctttccacagtttgttacctgcagtcaactgcagttcaaaaatattaaatggaaaattccagaaataaagaattttaagtctcaaatggtgtgcccttctgagtagcgtgatgaaatctctcgctgtccggctccagccggccggggatgtgagtcatcccttggtccagcacatccacgctgtatacgccacccaccctgctagtgacttagtagccgtcttggtgatcagatcaactatcccagcatcacagtgcctgtgcccaagcagtcctcactttgcttaacagtggccccagagagcaggagtagtgatgctggtgattcggatatgccaaagagaagccacaaagtgcttccttttaaatgaaaaggtgaaagttctcaacttaaaacagaaaagaaaaaaatcatatactgaggttgctaagatctacatgacaataagatattttggg

SEQ ID NO: 296319 - DNA, 1466 bp, Homo sapiens
tgcgtcgaagcttctctggtttcgcattacatttcccagagggccttggggcacagtccaatgaggagcgagccgggtggccggctgaggggcgtgcttcatgctcgcgggatttttaaaaatggtttctcctggatcttatcccaactgcgcctgagaccttgtttcacctcctgatgtgctgggtgtggttaggcctcgagccgggagctatttgcctcccaggaggaagccagggcagggttccgcggggaatggcggtgagggagccactcgggacgcggaggccctaaaatgaagaagcttcggcctgaggcttcgggagcggcgagcagggaagtgggagtgtgtgtgagtggtgtgtgtgtgtgtgtgtgtgtgtgtgtgaataagccagaggctgcctggtggggccccgccgtggcccagtgactgagataattgtcttcgtctgtggggtaatgcgaacaagccccgttcccctaagccgtgatgcatgcggggttgacgcggccgggctctgtccccataaactgtgacacaggtgtgtgtagacgtctatgagggccatagcgccgggctgtaagggcatctgtaggggtgacgcagccgggctgtgtctctgcacctccgttctgtgcgaggtcaatgctggtggggtctgcagaggtggcacggccaggacgggtctccgtgtctctgaaatgtgcctttgcacttctgtcaggttgacagggacaggcagtgtccctctggtgtgagcgtctgtgggtgtgaaagggccagcgagtgtgcggctgtgactggtcgggatcgggcctgggtgcatggccttttgagtgagcacaggtgtgtgcgaccatgtcacctgtctttctagtgtctccgttgcttcctgtgccttggccttccagccatgtggtacctgctagggagcagtggtcccaaagtgacgtgagaggctctacgctgttgtgaaaatgaccaagaagaaggcttcacaagtcacgagatggcagttttggagccagaagtgctctccgtgcacactacctggacgacaagaggaagtaacctcaagaatagaattccttttggggaagaaagagctggccttcaggaaaagcatcccggaggaggaagaagaagtgttatatgtcctaaagtaaggtttcaggctggagtgcaatggcatgatctcagctcactggaacctctgcgtcctgggttgcagcgattctcctgcctcagcctcccaagtagctggaattataggcacccaccaccatgcctggctaatttttgtatttttagtagagacggggtttcatcatgttggccaggctggtctcaaactcctgatttcaagttatctgcccgcctcagcctcccaaagtcctgggattacaggtgtgagccaccatgccctgcctttgtcccaatttttaatcaaatttttttttcac

SEQ ID NO: 296320 - DNA, 1240 bp, Homo sapiens
tgcgtcgaagcttctctggtttcgcattacatttcccagagggccttggggcacagtccaatgaggagcgagccgggtggccggctgaggggcgtgcttcatgctcgcgggatttttaaaaatggtttctcctggatcttatcccaactgcgcctgagaccttgtttcacctcctgatgtgctgggtgtggttaggcctcgagccgggagctatttgcctcccaggaggaagccagggcagggttccgcggggaatggcggtgagggagccactcgggacgcggaggccctaaaatgaagaagcttcggcctgaggcttcgggagcggcgagcagggaagtgggagtgtgtgtgagtggtgtgtgtgtgtgtgtgtgtgtgtgtgtgaataagccagaggctgcctggtggggccccgccgtggcccagtgactgagataattgtcttcgtctgtggggtaatgcgaacaagccccgttcccctaagccgtgatgcatgcggggttgacgcggccgggctctgtccccataaactgtgacacaggtgtgtgtagacgtctatgagggccatagcgccgggctgtaagggcatctgtaggggtgacgcagccgggctgtgtctctgcacctccgttctgtgcgaggtcaatgctggtggggtctgcagaggtggcacggccaggacgggtctccgtgtctctgaaatgtgcctttgcacttctgtcaggttgacagggacaggcagtgtccctctggtgtgagcgtctgtgggtgtgaaagggccagcgagtgtgcggctgtgactggtcgggatcgggcctgggtgcatggccttttgagtgagcacaggtgtgtgcgaccatgtcacctgtctttctagtgtctccgttgcttcctgtgccttggccttccagccatgtggtacctgctagggagcagtggtcccaaagtgacgtgagaggctctacgctgttgtgaaaatgaccaagaagaaggcttcacaagtcacgagatggcagttttggagccagaagtgctctccgtgcacactacctggacgacaagaggaagtaacctcaagaatagaattccttttggggaagaaagagctggccttcaggaaaagcatcccggaggaggaagaagaagtgttatatgtcctaaagtaaggtttcagcaagcaagggacaccgaatagcagctccggcagcttgtgctagcggcctgcagagaattccag

SEQ ID NO: 296321 - DNA, 1229 bp, Homo sapiens
tgcgtcgaagcttctctggtttcgcattacatttcccagagggccttggggcacagtccaatgaggagcgagccgggtggccggctgaggggcgtgcttcatgctcgcgggatttttaaaaatggtttctcctggatcttatcccaactgcgcctgagaccttgtttcacctcctgatgtgctgggtgtggttaggcctcgagccgggagctatttgcctcccaggaggaagccagggcagggttccgcggggaatggcggtgagggagccactcgggacgcggaggccctaaaatgaagaagcttcggcctgaggcttcgggagcggcgagcagggaagtgggagtgtgtgtgagtggtgtgtgtgtgtgtgtgtgtgtgtgtgtgaataagccagaggctgcctggtggggccccgccgtggcccagtgactgagataattgtcttcgtctgtggggtaatgcgaacaagccccgttcccctaagccgtgatgcatgcggggttgacgcggccgggctctgtccccataaactgtgacacaggtgtgtgtagacgtctatgagggccatagcgccgggctgtaagggcatctgtaggggtgacgcagccgggctgtgtctctgcacctccgttctgtgcgaggtcaatgctggtggggtctgcagaggtggcacggccaggacgggtctccgtgtctctgaaatgtgcctttgcacttctgtcaggttgacagggacaggcagtgtccctctggtgtgagcgtctgtgggtgtgaaagggccagcgagtgtgcggctgtgactggtcgggatcgggcctgggtgcatggccttttgagtgagcacaggtgtgtgcgaccatgtcacctgtctttctagtgtctccgttgcttcctgtgccttggccttccagccatgtggtacctgctagggagcagtggtcccaaagtgacgtgagaggctctacgctgttgtgaaaatgaccaagaagaaggcttcacaagtcacgagatggcagttttggagccagaagtgctctccgtgcacactacctggacgacaagaggaagtaacctcaagaatagaattccttttggggaagaaagaggtacctgacgtgggaggcggggaggtggtgagaggggcagctccatgtttcagaaccccagttcctagagttttccagcatttctctgaaaaactcacatgcctgtgccctcttatttct

SEQ ID NO: 296322 - DNA, 945 bp, Homo sapiens
aggctttgggtcaacgcagcccgtgcctgtgaacctcggcggtgcgtccctgggactctgctccgtgaggtgcgctctgggggttgtgcgggggcagcggtcgggacgggtctccgtggcccacggatgcacctctgcaccgtgtggggtggtggggcccgtagcatggccgtgctgggcgttagtgggtatgaggggcgcagatgtgtctcaggacagagtgagctgtggtgaggctgagctgtgcagacttgtgctgggatgggtgatcgggccttctgggtgacgcaggtgtgtgtgacaacacaacctgtagcttcagcgtctctgtgctgggatggatgatcgggccttctgagtgatgcaggtgtgtgtgacagtgcaacttgtagctccagcgtctctgctgcttcccctgccttcacctcctaaccaagcggtacctgcctgagaacaagggccgcggagggacgtgagcgcctgagcctcgcctggaaattcaccagcaagaaggcagaaacagccatgaggtgacgctttcagagccagaagtgctgtgcatgcaggccacctgagtgacaggggacggtggcctcaggagtagaattcctcctgtagagggacaggtccctgatgtgggagacagggaggggggcagctccacgcgtcatcatctcaatcgccacagcgtgctcttcaggaatctcccagaaactccatctcggggcctcgtatttctcattggttttattaggtatggcaggtgttacccttccggttctgttttccccaggccagcatccttcagaaaaagcatccccgaggaggaagacgaatcgttaaacatctgaaagggtcaggtgagtatccttttttttttatattaaatgatatgtgtttataagacttaagaccaaacattaaaggtagatgaccaagatttga

SEQ ID NO: 296323 - DNA, 235 bp, Homo sapiens
gcgtgagccaccgcacctggcctgatccatgatactcttcacctttcccagatatgtcacggttatgtgtttgtgttgggaagccaagacagaggagccaaaaggtcatattacatcactatggggaccccagatgcacctcgttttaatctctttttttccacccctagctctagcctctcggaatttgtcttcttcagtggaaaccccgagaagactgatcagttcttcagtt

SEQ ID NO: 296324 - DNA, 326 bp, Homo sapiens
ggtttggtgacgttcgccgacgtagccatagacttttctcaggaggagtgggcctgtctgaactctgctcagagggacctgtactgggacgtgatgctggagaactacagtaacttggtctcactgggtgagttgcacgcctcagataacttagactgcctcctggaatatccgctctcccctgtgaatttcaggaccgcctttcaagaaactagttgaatttcttcttcctgtccccaaggaatgtattgagccttattgatgtggccgtgagcaccacaaccttcccctcccatccatcggttaccttcccacctttgtcgact

SEQ ID NO: 296325 - DNA, 485 bp, Homo sapiens
ggatgctttccattttagatgctttattaacatgttcacctcttaaatggggtaacatttaaatggaagattaggttaaagacttaggttcttttctccctggaatgcttacataacacataatttgtgtgtagttggccttcttcaaggatacttgatttgtattaactgaatttaggctgggcgcagtggctcacacctgtaatcctagcactttgggaggctgaggtgggaagatcacttgagtcaggagttcgagaccagcctggccaatgtggtgaaatcctgtctctactaaaaatacaaaaattagctgggcatcatggcgcacacccataatcccagctactcaggaggctgaggcaggagaattgcttgaacctgggaggcagaggttgcagtaagctaagatcacgccactgcactccagcctgggtgacagagtgagactccgtctcaaaaaaaaaaaaaaaaaaaaaaaagga

SEQ ID NO: 296326 - DNA, 738 bp, Homo sapiens
caaaactggcacacgtgcccatgcaagtgtggcatggatttgatcctggggccatgtttagaaaatggttcccagcgctaagaggatttaaaactcttataataaaagttataatagtaataggaatctgcttactgctcccttgtttgctacctgtacttcttcagatgataaaaagcttcattgttaccttggttcaccaaaatgcttcagcacaagtgtaatatatgaatcactatcgatctgtcttgcaagaaaacataggtagtaaaaataaaagtgagaactcccactattgagagtctcaaagtgggggaataagggaggagaccacccctcatattgtcttatgcccaatttctgcttccaaagaaagaaaaagtaaaaactaaaaggcagaaatgaaatccacaagcagacagcccagcgccacaccctgggcctggtagttaaagatcaacccctgacctaatcggttatgttatctacagattacagacattgtatagaaatgcactgtgaaaatccctatcctgttttgttctaatctaactaccggtgcatgcagcccccagtcatgtaccccctgcttgctcaatcaatcatgaccctctcacacacatccccttagagttgtgaacctttaaaagggacaggaattgctcacttggggagctcagctcttgagacaggagtcttgccaatgcccctggctgaataaaccccttccttctttaa

SEQ ID NO: 296327 - DNA, 1704 bp, Homo sapiens
ggtttcagaaactgcctacttaatttgaaaagaacaatggtaggaaaggctagatcttccaattttaccttatccgaaaagcttgatttgctaaagcttgtgaagccatatgtgaaaattctcgaagaacacactaataaacattcagtaatagtagaaaagaatagatgttgggatatcatagcagttaactataatgcaattggagtagaccgccctcctcgaacagcacagggcctacgcaccctttataaaaggctcaaagaatatgccaaacaggagctattgcagcaaaaagagacccaatcagattttaaaagcaatatttctgagccaaccaagaaagttatggagatgattccccagatttccagtttttgcctggtaagagacaggaaccacatacaaagtgcaaacttggatgaggaggcacaggctggtaccagttcactacaggtaatgttggatcaccatcctgttgctattacagtggaggtgaagcaagaagaagacattaaaccacctcctccactggttttaaattctcaacagagtgatactttagagcaaagagaagaacatgaattagtacatgttatggaaagatccttgtcgccttcactttcctctgttgatatgagaatgacatcgtctccatcttctattccaaggagagatgatttttttcggcatgagagtggtgaacactttaggtcactattagggtatgatcctcagatcctgcaaatgttgaaagaggagcatcagataattttagaaaatcaaaaaaattttggattgtatgttcaggagaagagggatggattgaaaagaaggcagcagctagaggaagagctactaagagcaaaaattgaagtggagaagctgaaagcaattcgcttacggcatgatctacctgaatataacagtctctaagtttttttttcaatcttgcaatttgataattttgattttggccaaattactttaatttgggaatatcctgaaacagaatacacgttcttgaaaaatgttgttaatctctattatggaaaaactttttagatataattttctaattattttcttttgagatattaaaatttactggttggttggcatggttatagtttttattgtcttcttttttttttccctaagtttaattgttgaccttacaaaagatattttattctgatcactaagatatacacaaatgcatatacaaacacatattctttcaaagttctgagtcttcaacatttttagttagaactttgaaagctataattagagatttttaagtcagtctaatttaggagctatactaacctaataccaagaagcttgtctgtatgacattggtttttatgcttttatcttttgaaggagtaaatcctaggattttagagatggaagatatttggagaacactttttttccatctctgcagtttaggggtaatgaaacaggtccagggagaactcaatgacttacttagggtaacaaagctatttatggcagagcagagaccagcacttagtttttctttgtgtaatttccatcccgctattcgatagaagtaaatatccactaaaacattctctagatttaaatattagaagcatttctttcattaaaattgcctttaaagattgttaggttgtgaaatcaggataattacatcaattacccccattctct

SEQ ID NO: 296328 - DNA, 1668 bp, Homo sapiens
ggttaccagaaggacttctttgcagggccagtggtttctgtcagattttcgccggtcacgactgctgaatatgagacgatctgcagcaccaagtcagttgcaggggaattccttcaaaaaaccaaaatttatacctccaggaagaagtaatccaggtctgaatgaagagattacaaaactgaatccagatataaaattatttgagggtgttgcaattaataacacctttctcccgtcacaaaatgatcttagaatatgcagtttaaatctgcctagtgaagaaagtactagagaaatcaataacagagataattgcagtggaaaatattgttttgaagcacctacactggcaacattagatccacctcatacagtgcaaacttggatgaggaggcacaggctggtaccagttcactacaggtaatgttggatcaccatcctgttgctattacagtggaggtgaagcaagaagaagacattaaaccacctcctccactggttttaaattctcaacagagtgatactttagagcaaagagaagaacatgaattagtacatgttatggaaagatccttgtcgccttcactttcctctgttgatatgagaatgacatcgtctccatcttctattccaaggagagatgatttttttcggcatgagagtggtgaacactttaggtcactattagggtatgatcctcagatcctgcaaatgttgaaagaggagcatcagataattttagaaaatcaaaaaaattttggattgtatgttcaggagaagagggatggattgaaaagaaggcagcagctagaggaagagctactaagagcaaaaattgaagtggagaagctgaaagcaattcgcttacggcatgatctacctgaatataacagtctctaagtttttttttcaatcttgcaatttgataattttgattttggccaaattactttaatttgggaatatcctgaaacagaatacacgttcttgaaaaatgttgttaatctctattatggaaaaactttttagatataattttctaattattttcttttgagatattaaaatttactggttggttggcatggttatagtttttattgtcttcttttttttttccctaagtttaattgttgaccttacaaaagatattttattctgatcactaagatatacacaaatgcatatacaaacacatattctttcaaagttctgagtcttcaacatttttagttagaactttgaaagctataattagagatttttaagtcagtctaatttaggagctatactaacctaataccaagaagcttgtctgtatgacattggtttttatgcttttatcttttgaaggagtaaatcctaggattttagagatggaagatatttggagaacactttttttccatctctgcagtttaggggtaatgaaacaggtccagggagaactcaatgacttacttagggtaacaaagctatttatggcagagcagagaccagcacttagtttttctttgtgtaatttccatcccgctattcgatagaagtaaatatccactaaaacattctctagatttaaatattagaagcatttctttcattaaaattgcctttaaagattgttaggttgtgaaatcaggataattacatcaattacccccattctct

SEQ ID NO: 296329 - DNA, 3940 bp, Homo sapiens
tgttaactcctatctgatttttttggatgaaactgttgttttgtttttaaataggagatgaagtaatggatttttttccctcccttaaaatggcatagctgagaaagccccggtactactaattgagatgatctgcttaagagtcttcatattctgaactcgaaaggccttttatgttatattattgctcgctttacgcaactccaaattgctttcctatttaaatgaatgttcttctagtaaactggtgttagatttaaagaaatcactcaagcttcaccttggtaaactgaactcagtttaagattaagaaactgatttcggccgggtgcggtggctcacgcctgtaattccagcactttgggaggcccgggcgggcggatcacctgaggtcaggagttcaagaccagcctgactaatatggtgaaaccccgtttctactaaaaatacaaaaaaattagccgggtgtcgtggcttgtgcctgtagtcccagctactccggagtctgagacaggaaaattgcttgaacccgggaggcggaggttgcagtatgccgagatcgctgcacttcagcctgggcgacagagcgagactccgtaaaaaaaagaaaaaaaaaaaaaataaaagaaactggtttcaaattggccctttggcctctggagcaaattcaaatgtaactcttccccaatcccccttctcttcttccagattaattaaaagaagaatgaactataatccttgaagataactgggcaattttttaagtcggaggctgttcttactggtgtgaggatttacacacgtcttcagtttttcagcacagaccagcagaccatcatttttagaggaaatactccctctgccctcctttttggtttccttggtggtaaagattaaatttggttgcatcattttgacttgtgtttgagtctagattttatggcacaaggaatggcataaacttttcatgtgttttggttaaaacaaaccagaccattgcattgaccctggacatctttaattgagaaattggtaactttattttaatatgtatatctgaagaattcaagaaaacaaaggcatcctcagaggtgtgcctcttttctttattattagaggcaaaacgaacaattttataggatttgtagtgaaattataccagattataaggagaaccaaaactaagtcgcaaaatttattaatttaaggggctctcgctttgaaagtttgagagtaagttacgataggcatttgtatccattcattactttcctcttttcaaataagcaactaaatagaaatgctaatctcagacttaattatttaacagaagagtgtaccatggaaaacctccagacaaatttctccttggttcagggctcaactaaaaaactgaatgggatgggagatgatggcagccccccagcgaaaaaaatgataacggacattcatgtaaatggaaaaacgataaacaaggtgccaacagttaagaaggaacacttggatgactatggagaagcaccagtggaaactgatggagagcatgttaagcgaacctgtacttctgttcctgaaactttgcatttaaatcccagtttgaaacacacattggcacaattccatttaagtagtcagagctcgctgggtggaccagcagcattttctgctcggcattcccaagaaagcatgtcgcctactgtatttctgcctcttccatcacctcaggttcttcctggcccattgctcatcccttcagatagctccacagaactcactcagactgtgttggaaggggaatctatttcttgttttcaagttggaggagaaaagagactctgtttgccccaagtcttaaattctgttctccgagaatttacactccagcaaataaatacagtgtgtgatgaactgtacatatattgttcaaggtgtacttcagaccagcttcatatcttaaaggtactgggcatacttccattcaatgccccatcctgtgggctgattacattaactgatgcacaaagattatgtaatgctttattgcggccacgaacttttcctcaaaatggtagcgtacttcctgctaaaagctcattggcccagttaaaggaaactggcagtgcctttgaagtggagcatgaatgcctaggcaaatgtcagggtttatttgcaccccagttttatgttcagcctgatgctccgtgtattcaatgtctggagtgttgtggaatgtttgcaccccagacgtttgtgatgcattctcacagatcacctgacaaaagaacttgccactggggctttgaatcagctaaatggcattgctatcttcatgtgaaccaaaaatacttaggaacacctgaagaaaagaaactgaagataattttagaagaaatgaaggagaagtttagcatgagaagtggaaagagaaatcaatccaagacagatgcaccatcaggaatggaattacagtcatggtatcctgttataaagcaggaaggtgaccatgtttctcagacacattcatttttacaccccagctactacttatacatgtgtgataaagtggttgccccaaatgtgtcacttacttctgctgtatcccagtctaaagagctcacaaagacagaggcaagtaagtccatatcaagacagtcagagaaggctcacagtagtggtaaacttcaaaaaacagtgtcttatccagatgtctcacttgaggaacaggagaaaatggatttaaaaacaagtagagaattatgtagccgtttagatgcatcaatctcaaataattctacaagtaaaaggaaatctgagtctgccacttgcaacttagtcagagacataaacaaagtgggaattggccttgttgctgccgcttcatctccgcttcttgtgaaagatgtcatttgtgaggatgataagggaaaaatcatggaagaagtaatgagaacttatttaaaacaacaggaaaaactaaacttgattttgcaaaagaagcaacaacttcagatggaagtaaaaatgttgagtagttcaaaatctatgaaggaactcactgaagaacagcagaatttacagaaagagcttgaatctttgcagaatgaacatgctcaaagaatggaagaattttatgttgaacagaaagacttagagaaaaaattggagcagataatgaagcaaaaatgtacctgtgactcaaatttagaaaaagacaaagaggctgaatatgcaggacagttggcagaactgaggcagagattggaccatgctgaggccgataggcaagaactccaagatgaactcagacaggaacgggaagcaagacagaagttagagatgatgataaaagagctaaagctgcaaattctgaaatcatcaaagactgctaaagaatagaaactgttaaagagattcatctgtgtattactgacaaggttttttttgtttgttgcttgctttggtaattgaattctgaagaatttatctgcatgacgataactaggcattctatccatttgtagatcagagaaagtgaagagattatatattagtacttaaatttttacattttccaaatgaatgaaaatgtatgtttctttgtacttttttaaaaaaatcagcttagtaacaatactatatggtttcaactagtaggtaatctgcttatatttctaatgcaaacttaacaattgtgtactttttaaaagctgcaatatgtgttggaaaatagctgtggtcaattttgttatccatatttcagactcaattttagatacaatggtggctttatattttaagtatatagagctactcaaggagttgaatctccccttttctcattaacacaatttttctaagttgatatggtgtactcattaacatacaccaaatttacttttactttgttcagattgtggaatgaatttccaccagttctctt

SEQ ID NO: 296330 - DNA, 3547 bp, Homo sapiens
gagacagagtctcgctgtctcccaggctggagttcagtggtgcaatctcggctcactgcaagctctgcctcctgggttcaagccattctcctgctcccagctactccggagtctgagacaggaaaattgcttgaacccgggaggcggaggttgcagtatgccgagatcgctgcacttcagcctgggcgacagagcgagactccgtaaaaaaaagaaaaaaaaaaaaaataaaagaaactggtttcaaattggccctttggcctctggagcaaattcaaatgtaactcttccccaatcccccttctcttcttccagattaattaaaagaagaatgaactataatccttgaagataactgggcaattttttaagtcggaggctgttcttactggtgtgaggatttacacacgtcttcagtttttcagcacagaccagcagaccatcatttttagaggaaatactccctctgccctcctttttggtttccttggtggtaaagattaaatttggttgcatcattttgacttgtgtttgagtctagattttatggcacaaggaatggcataaacttttcatgtgttttggttaaaacaaaccagaccattgcattgaccctggacatctttaattgagaaattggtaactttattttaatatgtatatctgaagaattcaagaaaacaaaggcatcctcagaggtgtgcctcttttctttattattagaggcaaaacgaacaattttataggatttgtagtgaaattataccagattataaggagaaccaaaactaagtcgcaaaatttattaatttaaggggctctcgctttgaaagtttgagagtaagttacgataggcatttgtatccattcattactttcctcttttcaaataagcaactaaatagaaatgctaatctcagacttaattatttaacagaagagtgtaccatggaaaacctccagacaaatttctccttggttcagggctcaactaaaaaactgaatgggatgggagatgatggcagccccccagcgaaaaaaatgataacggacattcatgtaaatggaaaaacgataaacaaggtgccaacagttaagaaggaacacttggatgactatggagaagcaccagtggaaactgatggagagcatgttaagcgaacctgtacttctgttcctgaaactttgcatttaaatcccagtttgaaacacacattggcacaattccatttaagtagtcagagctcgctgggtggaccagcagcattttctgctcggcattcccaagaaagcatgtcgcctactgtatttctgcctcttccatcacctcaggttcttcctggcccattgctcatcccttcagatagctccacagaactcactcagactgtgttggaaggggaatctatttcttgttttcaagttggaggagaaaagagactctgtttgccccaagtcttaaattctgttctccgagaatttacactccagcaaataaatacagtgtgtgatgaactgtacatatattgttcaaggtgtacttcagaccagcttcatatcttaaaggtactgggcatacttccattcaatgccccatcctgtgggctgattacattaactgatgcacaaagattatgtaatgctttattgcggccacgaacttttcctcaaaatggtagcgtacttcctgctaaaagctcattggcccagttaaaggaaactggcagtgcctttgaagtggagcatgaatgcctaggcaaatgtcagggtttatttgcaccccagttttatgttcagcctgatgctccgtgtattcaatgtctggagtgttgtggaatgtttgcaccccagacgtttgtgatgcattctcacagatcacctgacaaaagaacttgccactggggctttgaatcagctaaatggcattgctatcttcatgtgaaccaaaaatacttaggaacacctgaagaaaagaaactgaagataattttagaagaaatgaaggagaagtttagcatgagaagtggaaagagaaatcaatccaagacagatgcaccatcaggaatggaattacagtcatggtatcctgttataaagcaggaaggtgaccatgtttctcagacacattcatttttacaccccagctactacttatacatgtgtgataaagtggttgccccaaatgtgtcacttacttctgctgtatcccagtctaaagagctcacaaagacagaggcaagtaagtccatatcaagacagtcagagaaggctcacagtagtggtaaacttcaaaaaacagtgtcttatccagatgtctcacttgaggaacaggagaaaatggatttaaaaacaagtagagaattatgtagccgtttagatgcatcaatctcaaataattctacaagtaaaaggaaatctgagtctgccacttgcaacttagtcagagacataaacaaagtgggaattggccttgttgctgccgcttcatctccgcttcttgtgaaagatgtcatttgtgaggatgataagggaaaaatcatggaagaagtaatgagaacttatttaaaacaacaggaaaaactaaacttgattttgcaaaagaagcaacaacttcagatggaagtaaaaatgttgagtagttcaaaatctatgaaggaactcactgaagaacagcagaatttacagaaagagcttgaatctttgcagaatgaacatgctcaaagaatggaagaattttatgttgaacagaaagacttagagaaaaaattggagcagataatgaagcaaaaatgtacctgtgactcaaatttagaaaaagacaaagaggctgaatatgcaggacagttggcagaactgaggcagagattggaccatgctgaggccgataggcaagaactccaagatgaactcagacaggaacgggaagcaagacagaagttagagatgatgataaaagagctaaagctgcaaattctgaaatcatcaaagactgctaaagaatagaaactgttaaagagattcatctgtgtattactgacaaggttttttttgtttgttgcttgctttggtaattgaattctgaagaatttatctgcatgacgataactaggcattctatccatttgtagatcagagaaagtgaagagattatatattagtacttaaatttttacattttccaaatgaatgaaaatgtatgtttctttgtacttttttaaaaaaatcagcttagtaacaatactatatggtttcaactagtaggtaatctgcttatatttctaatgcaaacttaacaattgtgtactttttaaaagctgcaatatgtgttggaaaatagctgtggtcaattttgttatccatatttcagactcaattttagatacaatggtggctttatattttaagtatatagagctactcaaggagttgaatctccccttttctcattaacacaatttttctaagttgatatggtgtactcattaacatacaccaaatttacttttactttgttcagattgtggaatgaatttccaccagttctctt

SEQ ID NO: 296331 - DNA, 3802 bp, Homo sapiens
tgttaactcctatctgatttttttggatgaaactgttgttttgtttttaaataggagatgaagtaatggatttttttccctcccttaaaatggcatagctgagaaagccccggtactactaattgagatgatctgcttaagagtcttcatattctgaactcgaaaggccttttatgttatattattgctcgctttacgcaactccaaattgctttcctatttaaatgaatgttcttctagtaaactggtgttagatttaaagaaatcactcaagcttcaccttggtaaactgaactcagtttaagattaagaaactgatttcggccgggtgcggtggctcacgcctgtaattccagcactttgggaggcccgggcgggcggatcacctgaggtcaggagttcaagaccagcctgactaatatggtgaaaccccgtttctactaaaaatacaaaaaaattagccgggtgtcgtggcttgtgcctgtagtcccagctactccggagtctgagacaggaaaattgcttgaacccgggaggcggaggttgcagtatgccgagatcgctgcacttcagcctgggcgacagagcgagactccgtaaaaaaaagaaaaaaaaaaaaaataaaagaaactggtttcaaattggccctttggcctctggagcaaattcaaatgtaactcttccccaatcccccttctcttcttccagattaattaaaagaagaatgaactataatccttgaagataactgggcaattttttaagtcggaggctgttcttactggtgtgaggatttacacacgtcttcagtttttcagcacagaccagcagaccatcatttttagaggaaatactccctctgccctcctttttggtttccttggtggtaaagattaaatttggttgcatcattttgacttgtgtttgagtctagattttatggcacaaggaatggcataaacttttcatgtgttttggttaaaacaaaccagaccattgcattgaccctggacatctttaattgagaaattggtaactttattttaatatgtatatctgaagaattcaagaaaacaaaggcatcctcagaggtgtgcctcttttctttattattagaggcaaaacgaacaattttataggatttgtagtgaaattataccagattataaggagaaccaaaactaagtcgcaaaatttattaatttaaggggctctcgctttgaaagtttgagagtaagttacgataggcatttgtatccattcattactttcctcttttcaaataagcaactaaatagaaatgctaatctcagacttaattatttaacagaagagtgtaccatggaaaacctccagacaaatttctccttggttcagggctcaactaaaaaactgaatgggatgggagatgatggcagccccccagcgaaaaaaatgataacggacattcatgtaaatggaaaaacgataaacaaggtgccaacagttaagaaggaacacttggatgactatggagaagcaccagtggaaactgatggagagcatgttaagcgaacctgtacttctgttcctgaaactttgcatttaaatcccagtttgaaacacacattggcacaattccatttaagtagtcagagctcgctgggtggaccagcagcattttctgctcggcattcccaagaaagcatgtcgcctactgtatttctgcctcttccatcacctcaggttcttcctggcccattgctcatcccttcagatagctccacagaactcactcagactgtgttggaaggggaatctatttcttgttttcaagttggaggagaaaagagactctgtttgccccaagtcttaaattctgttctccgagaatttacactccagcaaataaatacagtgtgtgatgaactgtacatatattgttcaaggtgtacttcagaccagcttcatatcttaaaggtactgggcatacttccattcaatgccccatcctgtgggctgattacattaactgatgcacaaagattatgtaatgctttattgcggccacgaacttttcctcaaaatggtagcgtacttcctgctaaaagctcattggcccagttaaaggaaactggcagtgcctttgaagtggagcatgaatgcctaggcaaatgtcagggtttatttgcaccccagttttatgttcagcctgatgctccgtgtattcaatgtctggagtgttgtggaatgtttgcaccccagacgtttgtgatgcattctcacagatcacctgacaaaagaacttgccactggggctttgaatcagctaaatggcattgctatcttcatgtgaaccaaaaatacttaggaacacctgaagaaaagaaactgaagataattttagaagaaatgaaggagaagtttagcatgagaagtggaaagagaaatcaatccaagacagatgcaccatcaggaatggaattacagtcatggtatcctgttataaagcaggaaggtgaccatgtttctcagacacattcatttttacaccccagctactacttatacatgtgtgataaagtggttgccccaaatgtgtcacttacttctgctgtatcccagtctaaagagctcacaaagacagaggcaaatgcatcaatctcaaataattctacaagtaaaaggaaatctgagtctgccacttgcaacttagtcagagacataaacaaagtgggaattggccttgttgctgccgcttcatctccgcttcttgtgaaagatgtcatttgtgaggatgataagggaaaaatcatggaagaagtaatgagaacttatttaaaacaacaggaaaaactaaacttgattttgcaaaagaagcaacaacttcagatggaagtaaaaatgttgagtagttcaaaatctatgaaggaactcactgaagaacagcagaatttacagaaagagcttgaatctttgcagaatgaacatgctcaaagaatggaagaattttatgttgaacagaaagacttagagaaaaaattggagcagataatgaagcaaaaatgtacctgtgactcaaatttagaaaaagacaaagaggctgaatatgcaggacagttggcagaactgaggcagagattggaccatgctgaggccgataggcaagaactccaagatgaactcagacaggaacgggaagcaagacagaagttagagatgatgataaaagagctaaagctgcaaattctgaaatcatcaaagactgctaaagaatagaaactgttaaagagattcatctgtgtattactgacaaggttttttttgtttgttgcttgctttggtaattgaattctgaagaatttatctgcatgacgataactaggcattctatccatttgtagatcagagaaagtgaagagattatatattagtacttaaatttttacattttccaaatgaatgaaaatgtatgtttctttgtacttttttaaaaaaatcagcttagtaacaatactatatggtttcaactagtaggtaatctgcttatatttctaatgcaaacttaacaattgtgtactttttaaaagctgcaatatgtgttggaaaatagctgtggtcaattttgttatccatatttcagactcaattttagatacaatggtggctttatattttaagtatatagagctactcaaggagttgaatctccccttttctcattaacacaatttttctaagttgatatggtgtactcattaacatacaccaaatttacttttactttgttcagattgtggaatgaatttccaccagttctctt

SEQ ID NO: 296332 - DNA, 3672 bp, Homo sapiens
  misc_feature (2901)..(2903): n is a, c, g, or t
  misc_feature (3346)..(3346): n is a, c, g, or t
  misc_feature (3349)..(3349): n is a, c, g, or t
tgttaactcctatctgatttttttggatgaaactgttgttttgtttttaaataggagatgaagtaatggatttttttccctcccttaaaatggcatagctgagaaagccccggtactactaattgagatgatctgcttaagagtcttcatattctgaactcgaaaggccttttatgttatattattgctcgctttacgcaactccaaattgctttcctatttaaatgaatgttcttctagtaaactggtgttagatttaaagaaatcactcaagcttcaccttggtaaactgaactcagtttaagattaagaaactgatttcggccgggtgcggtggctcacgcctgtaattccagcactttgggaggcccgggcgggcggatcacctgaggtcaggagttcaagaccagcctgactaatatggtgaaaccccgtttctactaaaaatacaaaaaaattagccgggtgtcgtggcttgtgcctgtagtcccagctactccggagtctgagacaggaaaattgcttgaacccgggaggcggaggttgcagtatgccgagatcgctgcacttcagcctgggcgacagagcgagactccgtaaaaaaaagaaaaaaaaaaaaaataaaagaaactggtttcaaattggccctttggcctctggagcaaattcaaatgtaactcttccccaatcccccttctcttcttccagattaattaaaagaagaatgaactataatccttgaagataactgggcaattttttaagtcggaggctgttcttactggtgtgaggatttacacacgtcttcagtttttcagcacagaccagcagaccatcatttttagaggaaatactccctctgccctcctttttggtttccttggtggtaaagattaaatttggttgcatcattttgacttgtgtttgagtctagattttatggcacaaggaatggcataaacttttcatgtgttttggttaaaacaaaccagaccattgcattgaccctggacatctttaattgagaaattggtaactttattttaatatgtatatctgaagaattcaagaaaacaaaggcatcctcagaggtgtgcctcttttctttattattagaggcaaaacgaacaattttataggatttgtagtgaaattataccagattataaggagaaccaaaactaagtcgcaaaatttattaatttaaggggctctcgctttgaaagtttgagagtaagttacgataggcatttgtatccattcattactttcctcttttcaaataagcaactaaatagaaatgctaatctcagacttaattatttaacagaagagtgtaccatggaaaacctccagacaaatttctccttggttcagggctcaactaaaaaactgaatgggatgggagatgatggcagccccccagcgaaaaaaatgataacggacattcatgtaaatggaaaaacgataaacaaggtgccaacagttaagaaggaacacttggatgactatggagaagcaccagtggaaactgatggagagcatgttaagcgaacctgtacttctgttcctgaaactttgcatttaaatcccagtttgaaacacacattggcacaattccatttaagtagtcagagctcgctgggtggaccagcagcattttctgctcggcattcccaagaaagcatgtcgcctactgtatttctgcctcttccatcacctcaggttcttcctggcccattgctcatcccttcagatagctccacagaactcactcagactgtgttggaaggggaatctatttcttgttttcaagttggaggagaaaagagactctgtttgccccaagtcttaaattctgttctccgagaatttacactccagcaaataaatacagtgtgtgatgaactgtacatatattgttcaaggtgtacttcagaccagcttcatatcttaaaggtactgggcatacttccattcaatgccccatcctgtgggctgattacattaactgatgcacaaagattatgtaatgctttattgcggccacgaacttttcctcaaaatggtagcgtacttcctgctaaaagctcattggcccagttaaaggaaactggcagtgcctttgaagtggagcatgaatgcctaggcaaatgtcagggtttatttgcaccccagttttatgttcagcctgatgctccgtgtattcaatgtctggagtgttgtggaatgtttgcaccccagacgtttgtgatgcattctcacagatcacctgacaaaagaacttgccactggggctttgaatcagctaaatggcattgctatcttcatgtgaaccaaaaatacttaggaacacctgaagaaaagaaactgaagataattttagaagaaatgaaggagaagtttagcatgagaagtggaaagagaaatcaatccaaggcaagttttttatatcaatttttaataatggtaatggtttactttgaaatgaaaattctatgtttagtgtgtaacttaacctgtatgttgaacattgctcatgcaacaacaacaaaataccgattgatatatttgtattgcagtttttaggccataaagtgctttgcagtatgtttcctcatttgactttccaaacatcctgtgagagaagtaagactattattccgttttacagataaagtgaatgaagctcagagagataaaatgactttcccaaaattatgtagccagggagtggaggagttagggcttctttttttttttttttgtgcttttagtagaggccaggtttcagcatgttggccaggctggtcttgaactcctgaccgcgtgatccgcccaccttggcctcccaaagggctgggattacatccttgagcccctgtgtccagccagggcttnnntttcttatcctctttggcacacatcttgcttcttgaccactacatctgttgtttttctaggactcgataatttgcgctttggtgttatctccatttgcaaatggtacaatggccacaattcccgtgggctcaaaacagcattttcagagatacacctatgatttctgatgtttctatgtttggatattcaggcttgctcaatatttgaaacaaatggaaaagacatgtatctgaagaatttgtgatttgaaaggaataacaaaaaaaatgacagctagagtaaggaaaagttattttaaactaataaaatattaatataaaaacctgccgggctcagtggctcacacctgtaatcccaacactttggggggctgaagtaggtggatcacctgaggtcaggagtttgagaccagcctggccaacatggtgaaatcccatctctnctnaaaatacaaaaattagacggatgtggtgtcgcacacttgtaatcccagctactcaggagctgaggcaggagaatcgcttgaaccccggaggcggaggttgtagtgagccgagattgtgccattgcgctccagcgtaggcgtcgagggaaactccatcaaaaaacaaaacaaaacaaacaaacaacctatcaacaggtgggagcaatgaatggctcacaatcccagcactttgggaggcccaggtgggcagatcacttcaggtcaggagtttgagaccagcctggccaacatggtaaaaccccatctctactaaaaatacaaaa

SEQ ID NO: 296333 - DNA, 3369 bp, Homo sapiens
taggggctcccccattctaggtcatgcctcttgctctcttccttggcctgtgttgagtaaggtgtgttcctgtggtggacgaaagtctgtacgatggttggtggcattggtccttaatcctttgggtctgttttaagattaattaaaagaagaatgaactataatccttgaagataactgggcaattttttaagtcggaggctgttcttactggtgtgaggatttacacacgtcttcagtttttcagcacagaccagcagaccatcatttttagaggaaatactccctctgccctcctttttggtttccttggtggtaaagattaaatttggttgcatcattttgacttgtgtttgagtctagattttatggcacaaggaatggcataaacttttcatgtgttttggttaaaacaaaccagaccattgcattgaccctggacatctttaattgagaaattggtaactttattttaatatgtatatctgaagaattcaagaaaacaaaggcatcctcagaggtgtgcctcttttctttattattagaggcaaaacgaacaattttataggatttgtagtgaaattataccagattataaggagaaccaaaactaagtcgcaaaatttattaatttaaggggctctcgctttgaaagtttgagagtaagttacgataggcatttgtatccattcattactttcctcttttcaaataagcaactaaatagaaatgctaatctcagacttaattatttaacagaagagtgtaccatggaaaacctccagacaaatttctccttggttcagggctcaactaaaaaactgaatgggatgggagatgatggcagccccccagcgaaaaaaatgataacggacattcatgtaaatggaaaaacgataaacaaggtgccaacagttaagaaggaacacttggatgactatggagaagcaccagtggaaactgatggagagcatgttaagcgaacctgtacttctgttcctgaaactttgcatttaaatcccagtttgaaacacacattggcacaattccatttaagtagtcagagctcgctgggtggaccagcagcattttctgctcggcattcccaagaaagcatgtcgcctactgtatttctgcctcttccatcacctcaggttcttcctggcccattgctcatcccttcagatagctccacagaactcactcagactgtgttggaaggggaatctatttcttgttttcaagttggaggagaaaagagactctgtttgccccaagtcttaaattctgttctccgagaatttacactccagcaaataaatacagtgtgtgatgaactgtacatatattgttcaaggtgtacttcagaccagcttcatatcttaaaggtactgggcatacttccattcaatgccccatcctgtgggctgattacattaactgatgcacaaagattatgtaatgctttattgcggccacgaacttttcctcaaaatggtagcgtacttcctgctaaaagctcattggcccagttaaaggaaactggcagtgcctttgaagtggagcatgaatgcctaggcaaatgtcagggtttatttgcaccccagttttatgttcagcctgatgctccgtgtattcaatgtctggagtgttgtggaatgtttgcaccccagacgtttgtgatgcattctcacagatcacctgacaaaagaacttgccactggggctttgaatcagctaaatggcattgctatcttcatgtgaaccaaaaatacttaggaacacctgaagaaaagaaactgaagataattttagaagaaatgaaggagaagtttagcatgagaagtggaaagagaaatcaatccaagacagatgcaccatcaggaatggaattacagtcatggtatcctgttataaagcaggaaggtgaccatgtttctcagacacattcatttttacaccccagctactacttatacatgtgtgataaagtggttgccccaaatgtgtcacttacttctgctgtatcccagtctaaagagctcacaaagacagaggcaagtaagtccatatcaagacagtcagagaaggctcacagtagtggtaaacttcaaaaaacagtgtcttatccagatgtctcacttgaggaacaggagaaaatggatttaaaaacaagtagagaattatgtagccgtttagatgcatcaatctcaaataattctacaagtaaaaggaaatctgagtctgccacttgcaacttagtcagagacataaacaaagtgggaattggccttgttgctgccgcttcatctccgcttcttgtgaaagatgtcatttgtgaggatgataagggaaaaatcatggaagaagtaatgagaacttatttaaaacaacaggaaaaactaaacttgattttgcaaaagaagcaacaacttcagatggaagtaaaaatgttgagtagttcaaaatctatgaaggaactcactgaagaacagcagaatttacagaaagagcttgaatctttgcagaatgaacatgctcaaagaatggaagaattttatgttgaacagaaagacttagagaaaaaattggagcagataatgaagcaaaaatgtacctgtgactcaaatttagaaaaagacaaagaggctgaatatgcaggacagttggcagaactgaggcagagattggaccatgctgaggccgataggcaagaactccaagatgaactcagacaggaacgggaagcaagacagaagttagagatgatgataaaagagctaaagctgcaaattctgaaatcatcaaagactgctaaagaatagaaactgttaaagagattcatctgtgtattactgacaaggttttttttgtttgttgcttgctttggtaattgaattctgaagaatttatctgcatgacgataactaggcattctatccatttgtagatcagagaaagtgaagagattatatattagtacttaaatttttacattttccaaatgaatgaaaatgtatgtttctttgtacttttttaaaaaaatcagcttagtaacaatactatatggtttcaactagtaggtaatctgcttatatttctaatgcaaacttaacaattgtgtactttttaaaagctgcaatatgtgttggaaaatagctgtggtcaattttgttatccatatttcagactcaattttagatacaatggtggctttatattttaagtatatagagctactcaaggagttgaatctccccttttctcattaacacaatttttctaagttgatatggtgtactcattaacatacaccaaatttacttttactttgttcagattgtggaatgaatttccaccagttctctt

SEQ ID NO: 296334 - DNA, 403 bp, Homo sapiens
cactgcactccagcctgggcaacagagcgagactacgtctcaaaacgaaacaaacaaacaaaaaaaccgcaaaacccagtcaagataacagtaaatgcagcagataagttcccagatgccaataaggaaatcactgaattatggaagctcttattgcccaggctggagtatccagcctgggcaataagagctactccagcaaagtgtctggcatatagtaggtgctcaacacctgagtgaatggcttctgtgagagcaggaaggtgagtgaatggaaattttttccttaaggcttacaggggcagctccgacctagagacatccgttgcaacctttcattctcacacccttcccaaggccgtcacggtccatatctgcaccccagtctgtgcttatcacacaa

SEQ ID NO: 296335 - DNA, 1084 bp, Homo sapiens
gaagcaaccatgtagatgagagatatttatgatttcttctggacttttttttctccagggcatggagagagtggagaaggaaataaattctcttttcttcttggatccgttttttttgttttttttttcattaaaaaaatgggggtgggggcaagggtcctgagaactcagagatgagcctgtttacacacaaactcttaagtaatagtgaatggaaataacataatgctgtcctgaaacccagagactctgccctcagtccctccctttccccataaaccccactcacaagtcagtctggggcattgcctataaggctcctgtccttcctttaggactcagtgcagtgttctgcattggtgcccccacaacatgtccatcaaacaccttttcattctcagaccattaccttctacagagaatgtctgctcgtattattcattctttcttctttgtcccctaaacttacaccctccttgcttatcacctcattccccaaccagtttcaagaacagatgaagggttaatactggtaaccgtcagtattctctgcccttcctgtagtcccggaaatagaaattgtgagtccggttcctcatccaggaaaggggcagagcatggaagagccagggctgggcgcctactccaagatcaccgtggggaagggatctggcccatgccaagattctgctgctccatcaggtctcttaagtgctctgaagctccatgttctcgactgtaaataaccatgatgctgactgcaccagcttaatgtgaggattaaaggaagtatggaccatggaagactctggagcacagaagctatttaaatgtttgttgaatccacattgtagtctctgaaataatctcgtgctttgccctgtccttctcctggtagtaaggggagcctgagcagtagccctacccccctgcctgctccatccacctctcacctgctgtggccaccttcttgaaaacagcagcctctgcattcctgggccactttctctgctgtgttttaataacacagcactcatcactttctgatatgtgataaatacaattaaatttccacaatggcaag

SEQ ID NO: 296336 - DNA, 384 bp, Homo sapiens
ttctcatcattaggctgtgaaatagatggtattactctgtattagagatgaggagggaacagagtctaagtatgtaattagatcaaaattacacagctagtaattggcagagtgagggtttgaatccaggtcttactgaatacgaagtccattcccttaccattaatctgagtcttcttgttaaaacatgtgttggaggccacacgcggtggctcacgcatgtaatcccagcactttgggaggccgaggcagatggatcacttgaggtcaggagtttgagaccagcctggccaatatggtgaaaccctgtgtctactaaagatacaaaaattagctgcatgtggtggtgcatgcctgtcctcccagctgctcaggaggctgatg

SEQ ID NO: 296337 - DNA, 283 bp, Homo sapiens
tttttctttttttattgataggtaatgtacatagtttcagggtacatgtgataatttaatacattaatataatttgtaaagataaatcagcatacttgggatagccatcaccttaactacttcacagctgaactgtgcagcttttattactgaatattattcccttaatatttatgctaggaacatttgaattaatctagctattttgaaatgtacaatcaaatattataaactctggtcaccctgtgatctatcttaacagtaggtctcattctattataat

SEQ ID NO: 296338 - DNA, 587 bp, Homo sapiens
ccggtctcagctctgggagggaacgggagatgttgcaggcgccgagagggcgggccagggccgcactccggagactcgcggttgctacgcgcaccatggctggagcgcccacggtctcgcttcctgaactccgttcactcctagcctccggacgggcccggctcttcgatgtgcgctctcgcgaggaggcggcagctgggaccatcccaggggcgctcaacatcccggtgtccgagttggagagtgctctgcagatggagccagctgccttccaggctttatattctgctgagaagccaaagctggaagatgagcatctcgttttcttctgtcagatgggcaagcggggcctccaggccacgcagctggcccggagtcttggatacactggggctcgcaactacgctggagcctatagagaatggttggagaaagagagttaggcaggaggcagcttactgattgccaccccctggccccttaatggccaccttaactaagggtgtgaacgggctgacttggtgaattgggcaactccttatagtgttgtgcacacaaaagcatcaaataaagaacatttaatcaaa

SEQ ID NO: 296339 - DNA, 896 bp, Homo sapiens
  misc_feature (896)..(896): n is a, c, g, or t
ccggtctcagctctgggagggaacgggagatgttgcaggcgccgagagggcgggccagggccgcactccggagactcgcggttgctacgcgcaccatggctggagcgcccacggtctcgcttcctgaactccgttcactcctagcctccggacgggcccggctcttcgatgtgcgctctcgcgaggaggcggcagctgggaccatcccaggggcgctcaacatcccggtgtccgagttggagagtgctctgcagatggagccagctgccttccaggctttatattctgctgagaagccaaagctggaagatgagcatctcgttttcttctgtcagatgggcaagcggggcctccaggccacgcagctggcccggagtcttggatacactggggctcgcaactacgctggagcctatagagaatggttggagaaagagagttaggcaggaggcagcttactgattgccaccccctggccccttaatggccaccttaactaagggtgtgaacgggctgacttggtgaattgggcaactccttatagtgttgtgcacacaaaagcatcaaataaagaacatttaatcaaaaaaaaaaaaaaaaaaaaaaaaaaaaaagggcggggagaacaaaaccaccggaggaggaccacatacatcacaccaagtctgttggaaggaagagaccaagaaagaaacacaaaacgaggcgggggccgaacaaacggtggggggaaacggtcgtgtctcggaaaaccctgctggggggcacagccaaccacacaaagagcgacgaaaaataagttggcgacaacctggcgtcaacgtccgttatatgagagtaataagaatagcaacgatgaaacacaaggcaaagagcacagacaactcacaggcagn

SEQ ID NO: 296340 - DNA, 448 bp, Homo sapiens
  misc_feature (9)..(9): n is a, c, g, or t
  misc_feature (17)..(17): n is a, c, g, or t
gctgtggtngatctctnaggatccccgatgcgatgtgcgctctcgcgaggaggcggcagctgggaccatcccaggggcgctcaacatcccggtgtccgagttggagagtgctctgcagatggagccagctgccttccaggctttatattctgctgagaagccaaagctggaagatgagcatctcgttttcttctgtcagatgggcaagcggggcctccaggccacgcagctggcccggagtcttggatacactggggctcgcaactacgctggagcctatagagaatggttggagaaagagagttaggcaggaggcagcttactgattgccaccccctggccccttaatggccaccttaactaagggtgtgaacgggctgacttggtgaattgggcaactccttatagtgttgtgcacacatcgcatacggggactcctctatgagtc

SEQ ID NO: 296341 - DNA, 650 bp, Homo sapiens
aactttaggctaggtacgaggcctgggcgggccagggccgcactccggagactcgcggttgctacgcgcaccatggctggagcgcccacggtctcgcttcctgaactccgttcactcctagcctccggacgggcccggctcttcgatgtgcgctctcgcgaggaggcggcagctgggaccatcccaggggcgctcaacatcccggtgtccgagttggagagtgctctgcagatggagccagctgccttccaggctttatattctgctgagaagccaaagctggaagatgagcatctcgttttcttctgtcagatgggcaagcggggcctccaggccacgcagctggcccggagtcttggatacactgggtacggggaggtgtggctgctagctgggaggtgatggggactgcctgtcattcctgtcagtctctcacgcttctttgtctccacagggctcgcaactacgctggagcctatagagaatggttggagaaagagagttaggcaggaggcagcttactgattgccaccccctggccccttaatggccaccttaactaagggtgtgaacgggctgacttggtgaattgggcaactccttatagtgttgtgcacacaaaagcatcaaataaagaacatttaatcaaa

SEQ ID NO: 296342 - DNA, 926 bp, Homo sapiens
aaatgttagacattcttcaatgtcagtgccttggatgaatttataaggctttgccttaaagttacttgtgggcttataaagcctgtgtcaaagctaaacaaagccagacaatagtttagacaagaagtaaggataggtatttatttatttatttgagatggagtttcgctcttgtcgcccaggctggagggtaatggcgcgatcttggctcaccgcaacctccgtgtccggggttcaagcgattctcctgcctcagcctcctgaatagctgggattgcaggcatgcaccaccacgcccggctaatttttttgtgtttttagtggagacagcgtttctccgtgttggtcaggctggttttgaacttttgaccccaggtgatctgcccgcctcggcctcccaaagtgttgggattacaggcgtgagccactgcacccggcctaggataggtttttttaagtagtaactattgcagtagggaagagggcccaaggtgaactgaacttaacttccttaaaaaaaaaaaaaatgcaggaggccttttgaaggctgggatgtgctaagggataggcatgaagatattaaggagaattgctccatgtgactagacaatctggatttgtgaattggctcttgtccagaagagaaataagcacctatttttacgacaggagctagtagtgcaagttagagcaaggcacccacctggttgggagctggagcaagatttatttcctcaaatgtttgcatttcaaagaaactctcaggtcccagtgaaaatagctctgggtagaagatttacatctcaaagaggcagagaaagatgttttaattgcaagctttctttctaagtaattgcactaagatgaagttcaggggcctgtgtctattgctaggtttgggctgggatgcacagtaaatttttctg

SEQ ID NO: 296343 - DNA, 402 bp, Homo sapiens
gcctgtggtgctgtggagatgtgtgtagtggtcttagctctttgttgagcttgtgtgtgtgttgtgtagtcttagctgtatgctgaaattgggcgtgtgttggagggcttcttagctctttggtgagattgtatttctatgtgtttgtatcagctgctcaggagcctggcaacaagagcaaaactccagctcaaaaaaaaaaaagaaagaaaagaaagctggagctggtggcttaggccatcacccttcccttggctggaactactggacagacccttttgagatgtgcctgtggtgctgtggagatgtgtgtagtggtcttagctctttgttgagcatggtggtgcatgcctgtagtcccagctgctcaggagcctggcaacaagagcaaaactccagctc

SEQ ID NO: 296344 - DNA, 3850 bp, Homo sapiens
aactttaggctaggtacgaggcctgggcgggccagggccgcactccggagactcgcggttgctacgcgcaccatggctggagaggtacttctcagccctctagctccaactgagaacccagccagtcaggaagtcgctacttcgggaacaccaaccaatcagggggccgtcacctgctgaagggctggctctcagtcccctcgctgtagtcgcggagctgtgtctgttcccaggagtccttcggcggctgttgtgtcagtggcctgatcgcgatggggacaaaggcgcaagtcgagaggaaactgttgtgcctcttcatattggcgatcctgttgtgctccctggcattgggcagtgttacagtgcactcttctgaacctgaagtcagaattcctgagaataatcctgtgaagttgtcctgtgcctactcgggcttttcttctccccgtgtggagtggaagtttgaccaaggagacaccaccagactcgtttgctataataacaagatcacagcttcctatgaggaccgggtgaccttcttgccaactggtatcaccttcaagtccgtgacacgggaagacactgggacatacacttgtatggtctctgaggaaggcggcaacagctatggggaggtcaaggtcaagctcatcgtgcttgtgcctccatccaagcctacagttaacatcccctcctctgccaccattgggaaccgggcagtgctgacatgctcagaacaagatggttccccaccttctgaatacacctggttcaaagatgggatagtgatgcctacgaatcccaaaagcacccgtgccttcagcaactcttcctatgtcctgaatcccacaacaggagagctggtctttgatcccctgtcagcctctgatactggagaatacagctgtgaggcacggaatgggtatgggacacccatgacttcaaatgctgtgcgcatggaagctgtggagcggaatgtgggggtcatcgtggcagccgtccttgtaaccctgattctcctgggaatcttggtttttggcatctggtttgcctatagccgaggccactttgacagaacaaagaaagggacttcgagtaagaaggtgatttacagccagcctagtgcccgaagtgaaggagaattcaaacagacctcgtcattcctggtgtgagcctggtcggctcaccgcctatcatctgcatttgccttactcaggtgctaccggactctggcccctgatgtctgtagtttcacaggatgccttatttgtcttctacaccccacagggccccctacttcttcggatgtgtttttaataatgtcagctatgtgccccatcctccttcatgccctccctccctttcctaccactgctgagtggcctggaacttgtttaaagtgtttattccccatttctttgagggatcaggaaggaatcctgggtatgccattgacttcccttctaagtagacagcaaaaatggcgggggtcgcaggaatctgcactcaactgcccacctggctggcagggatctttgaataggtatcttgagcttggttctgggctctttccttgtgtactgacgaccagggccagctgttctagagcgggaattagaggctagagcggctgaaatggttgtttggtgatgacactggggtccttccatctctggggcccactctcttctgtcttcccatgggaagtgccactgggatccctctgccctgtcctcctgaatacaagctgactgacattgactgtgtctgtggaaaatgggagctcttgttgtggagagcatagtaaattttcagagaacttgaagccaaaaggatttaaaaccgctgctctaaagaaaagaaaactggaggctgggcgcagtggctcacgcctataatcccagaggctgaggcaggcggatcacctgaggtcaggagttcaagatcagcctgaccaacatggagaaaccctactgaaaatacaaagttagccaggcatggtggtgcatgcctgtaatcccagctgctcaggagcctggcaacaagagcaaaactccagctcaaaaaaaaaaaagaaagaaaagaaagctggagctggtggcttaggccatcacccttcccttggctggaactactggacagacccttttgagatgtgcctgtggtgctgtggagatgtgtgtagtggtcttagctctttgttgagcttgtgtgtgtgttgtgtagtcttagctgtatgctgaaattgggcgtgtgttggagggcttcttagctctttggtgagattgtatttctatgtgtttgtatcagctgaatgttgctggaaataaaaccttggtttgtcaaggctcttttttgtgggaagtaagtaggggaaaaggtctttgagggttcctaggctcctttgtacaacaggaaaatgcctcaaagccttgcttcccagcaacctggggctggttcccagtgcctggtcctgccccttcctggttcttatctcaaggcagagcttctgaatttcaggccttcattccagagccctcttgtggccaggccttcctttgctggaggaaggtacacagggtgaagctgatgctgtacttgggggatctccttggcctgttccaccaagtgagagaaggtacttactcttgtacctcctgttcagccaggtgcattaacagacctccctacagctgtaggaactactgtcccagagctgaggcaaggggatttctcaggtcatttggagaacaagtgctttagtagtagtttaaagtagtaactgctactgtatttagtggggtggaattcagaagaaatttgaagaccagatcatgggtggtctgcatgtgaatgaacaggaatgagccggacagcctggctgtcattgctttcttcctccccatttggacccttctctgcccttacatttttgtttctccatctaccaccatccaccagtctatttattaacttagcaagaggacaagtaaagggccctcttggcttgattttgcttctttctttctgtggaggatatactaagtgcgactttgccctatcctatttggaaatccctaacagaattgagttttctattaaggatccaaaaagaaaaacaaaatgctaatgaagccatcagtcaagggtcacatgccaataaacaataaattttccagaagaaatgaaatccaactagacaaataaagtagagcttatgaaatggttcagtaaagatgagtttgttgttttttgttttgttttgttttgtttttttaaagacggagtctcgctctgtcacccaggctggagtgcagtggtatgatcttggctcactgtaacctccgcctcccgggttcaagccattctcctgcctcagtctcctgagtagctgggattgcgggtgcgtgccaccatgcctggctaatttttgtgtttttagtagagacagggtttcaccatgttggtcgggctggtctcagactcctgacctcttgatccgcctgccttggcctcccaaagtgatgggattacagatgtgagccaccgtgcctagccaaggatgagatttttaaagtatgtttcagttctgtgtcatggttggaagacagagtaggaaggatatggaaaaggtcatggggaagcagaggtgattcatggctctgtgaatttgaggtgaatggttccttattgtctaggccacttgtgaagaatatgagtcagttattgccagccttggaatttacttctctagcttacaatggaccttttgaactggaaaacaccttgtctgcattcactttaaaatgtcaaaactaatttttataataaatgtttattttcacattga

SEQ ID NO: 296345 - DNA, 4779 bp, Homo sapiens
aactttaggctaggtacgaggcctgggcgggccagggccgcactccggagactcgcggttgctacgcgcaccatggctggagaggtacttctcagccctctagctccaactgagaacccagccagtcaggaagtcgctacttcgggaacaccaaccaatcagggggccgtcacctgctgaagggctggctctcagtcccctcgctgtagtcgcggagctgtgtctgttcccaggagtccttcggcggctgttgtgtcagtggcctgatcgcgatggggacaaaggcgcaagtcgagaggaaactgttgtgcctcttcatattggcgatcctgttgtgctccctggcattgggcagtgttacagtgcactcttctgaacctgaagtcagaattcctgagaataatcctgtgaagttgtcctgtgcctactcgggcttttcttctccccgtgtggagtggaagtttgaccaaggagacaccaccagactcgtttgctataataacaagatcacagcttcctatgaggaccgggtgaccttcttgccaactggtatcaccttcaagtccgtgacacgggaagacactgggacatacacttgtatggtctctgaggaaggcggcaacagctatggggaggtcaaggtcaagctcatcgtgcttgtgcctccatccaagcctacagttaacatcccctcctctgccaccattgggaaccgggcagtgctgacatgctcagaacaagatggttccccaccttctgaatacacctggttcaaagatgggatagtgatgcctacgaatcccaaaagcacccgtgccttcagcaactcttcctatgtcctgaatcccacaacaggagagctggtctttgatcccctgtcagcctctgatactggagaatacagctgtgaggcacggaatgggtatgggacacccatgacttcaaatgctgtgcgcatggaagctgtggagcggaatgtgggggtcatcgtggcagccgtccttgtaaccctgattctcctgggaatcttggtttttggcatctggtttgcctatagccgaggccactttgacagaacaaagaaagggacttcgagtaagaaggtgatttacagccagcctagtgcccgaagtgaaggagaattcaaacagacctcgtcattcctggtgtgagcctggtcggctcaccgcctatcatctgcatttgccttactcaggtgctaccggactctggcccctgatgtctgtagtttcacaggatgccttatttgtcttctacaccccacagggccccctacttcttcggatgtgtttttaataatgtcagctatgtgccccatcctccttcatgccctccctccctttcctaccactgctgagtggcctggaacttgtttaaagtgtttattccccatttctttgagggatcaggaaggaatcctgggtatgccattgacttcccttctaagtagacagcaaaaatggcgggggtcgcaggaatctgcactcaactgcccacctggctggcagggatctttgaataggtatcttgagcttggttctgggctctttccttgtgtactgacgaccagggccagctgttctagagcgggaattagaggctagagcggctgaaatggttgtttggtgatgacactggggtccttccatctctggggcccactctcttctgtcttcccatgggaagtgccactgggatccctctgccctgtcctcctgaatacaagctgactgacattgactgtgtctgtggaaaatgggagctcttgttgtggagagcatagtaaattttcagagaacttgaagccaaaaggatttaaaaccgctgctctaaagaaaagaaaactggaggctgggcgcagtggctcacgcctataatcccagaggctgaggcaggcggatcacctgaggtcaggagttcaagatcagcctgaccaacatggagaaaccctactgaaaatacaaagttagccaggcatggtggtgcatgcctgtaatcccagctgctcaggagcctggcaacaagagcaaaactccagctcaaaaaaaaaaaagaaagaaaagaaagctggagctggtggcttaggccatcacccttcccttggctggaactactggacagacccttttgagatgtgcctgtggtgctgtggagatgtgtgtagtggtcttagctctttgttgagcttgtgtgtgtgttgtgtagtcttagctgtatgctgaaattgggcgtgtgttggagggcttcttagctctttggtgagattgtatttctatgtgtttgtatcagctgaatgttgctggaaataaaaccttggtttgtcaaggctcttttttgtgggaagtaagtaggggaaaaggtctttgagggttcctaggctcctttgtacaacaggaaaatgcctcaaagccttgcttcccagcaacctggggctggttcccagtgcctggtcctgccccttcctggttcttatctcaaggcagagcttctgaatttcaggccttcattccagagccctcttgtggccaggccttcctttgctggaggaaggtacacagggtgaagctgatgctgtacttgggggatctccttggcctgttccaccaagtgagagaaggtacttactcttgtacctcctgttcagccaggtgcattaacagacctccctacagctgtaggaactactgtcccagagctgaggcaaggggatttctcaggtcatttggagaacaagtgctttagtagtagtttaaagtagtaactgctactgtatttagtggggtggaattcagaagaaatttgaagaccagatcatgggtggtctgcatgtgaatgaacaggaatgagccggacagcctggctgtcattgctttcttcctccccatttggacccttctctgcccttacatttttgtttctccatctaccaccatccaccagtctatttattaacttagcaagaggacaagtaaagggccctcttggcttgattttgcttctttctttctgtggaggatatactaagtgcgactttgccctatcctatttggaaatccctaacagaattgagttttctattaaggatccaaaaagaaaaacaaaatgctaatgaagccatcagtcaagggtcacatgccaataaacaataaattttccagaagaaatgaaatccaactagacaaataaagtagagcttatgaaatggttcagtaaagatgagtttgttgttttttgttttgttttgttttgtttttttaaagacggagtctcgctctgtcacccaggctggagtgcagtggtatgatcttggctcactgtaacctccgcctcccgggttcaagccattctcctgcctcagtctcctgagtagctgggattgcgggtgcgtgccaccatgcctggctaatttttgtgtttttagtagagacagggtttcaccatgttggtcgggctggtctcagactcctgacctcttgatccgcctgccttggcctcccaaagtgatgggattacagatgtgagccaccgtgcctagccaaggatgagatttttaaagtatgtttcagttctgtgtcatggttggaagacagagtaggaaggatatggaaaaggtcatggggaagcagaggtgattcatggctctgtgaatttgaggtgaatggttccttattgtctaggccacttgtgaagaatatgagtcagttattgccagccttggaatttacttctctagcttacaatggaccttttgaactggaaaacaccttgtctgcattcactttaaaatgtcaaaactaatttttataataaatgtttattttcacattgagtttgtttaaatcctgaagttcttaccttaagagaattgggactcctagagtgattggacattcaaaatattcctgatagtcttgttaattaagagattaggatatctttccattaccttgataattacgttttaatttagcttttttcattggcctgtgtttaaatgcaaataaccccacaatggacatttcctatgttaaagtgacatttaggggataaaaaatgagagcagttccatggattttggtgtttcccctgagacatgaactcagcataatctgggataaaatgattgagtgttaaggatgtgtttgttgttcctgtcgtttttttattttcttcaaagtatacaacatggtttgatatgcacatacatttgtgtaatgattgccatggtcaattaacacatcaccatttttgtgtgtgtgtgtgtgtgtgtgtgtgagggagtcttgctccgttgccaggctggagtgcaatggtacaaccttggctcactgcaacctccaccatgcccagctaatttttgtatttttagtagagacggggtttcaccatgttggccaggatgatctcgatcccttgacctcatgatccgcccacctcggcctcccaaagtgctgggattacaggcgtgagtcactgcacccggccacatcacctcccatgttctatcttacgtattcagaacttgttcatcttgtaactgaaagcgtgtaccctttgaccaacactgtttttcctgtcttaacaggatctacagatcaaggacaggggaggggatagtggaggaaaacggagttagtctgtttctaaatgaggggacagtatgtttcttggggcctgaggacagcttaataaagtagacaaatgaagaaaaacaacaatttgcattaaaaaatatccaattctttagcttttccagct

SEQ ID NO: 296346 - DNA, 4993 bp, Homo sapiens
aactttaggctaggtacgaggcctgggcgggccagggccgcactccggagactcgcggttgctacgcgcaccatggctggagaggtacttctcagccctctagctccaactgagaacccagccagtcaggaagtcgctacttcgggaacaccaaccaatcagggggccgtcacctgctgaagggctggctctcagtcccctcgctgtagtcgcggagctgtgtctgttcccaggagtccttcggcggctgttgtgtcagtggcctgatcgcgatggggacaaaggcgcaagtcgagaggaaactgttgtgcctcttcatattggcgatcctgttgtgctccctggcattgggcagtgttacagtgcactcttctgaacctgaagtcagaattcctgagaataatcctgtgaagttgtcctgtgcctactcgggcttttcttctccccgtgtggagtggaagtttgaccaaggagacaccaccagactcgtttgctataataacaagatcacagcttcctatgaggaccgggtgaccttcttgccaactggtatcaccttcaagtccgtgacacgggaagacactgggacatacacttgtatggtctctgaggaaggcggcaacagctatggggaggtcaaggtcaagctcatcgtgcttgtgcctccatccaagcctacagttaacatcccctcctctgccaccattgggaaccgggcagtgctgacatgctcagaacaagatggttccccaccttctgaatacacctggttcaaagatgggatagtgatgcctacgaatcccaaaagcacccgtgccttcagcaactcttcctatgtcctgaatcccacaacaggagagctggtctttgatcccctgtcagcctctgatactggagaatacagctgtgaggcacggaatgggtatgggacacccatgacttcaaatgctgtgcgcatggaagctgtggagcggaatgtgggggtcatcgtggcagccgtccttgtaaccctgattctcctgggaatcttggtttttggcatctggtttgcctatagccgaggccactttgacagaacaaagaaagggacttcgagtaagaaggtgatttacagccagcctagtgcccgaagtgaaggagaattcaaacagacctcgtcattcctggtgtgagcctggtcggctcaccgcctatcatctgcatttgccttactcaggtgctaccggactctggcccctgatgtctgtagtttcacaggatgccttatttgtcttctacaccccacagggccccctacttcttcggatgtgtttttaataatgtcagctatgtgccccatcctccttcatgccctccctccctttcctaccactgctgagtggcctggaacttgtttaaagtgtttattccccatttctttgagggatcaggaaggaatcctgggtatgccattgacttcccttctaagtagacagcaaaaatggcgggggtcgcaggaatctgcactcaactgcccacctggctggcagggatctttgaataggtatcttgagcttggttctgggctctttccttgtgtactgacgaccagggccagctgttctagagcgggaattagaggctagagcggctgaaatggttgtttggtgatgacactggggtccttccatctctggggcccactctcttctgtcttcccatgggaagtgccactgggatccctctgccctgtcctcctgaatacaagctgactgacattgactgtgtctgtggaaaatgggagctcttgttgtggagagcatagtaaattttcagagaacttgaagccaaaaggatttaaaaccgctgctctaaagaaaagaaaactggaggctgggcgcagtggctcacgcctataatcccagaggctgaggcaggcggatcacctgaggtcaggagttcaagatcagcctgaccaacatggagaaaccctactgaaaatacaaagttagccaggcatggtggtgcatgcctgtaatcccagctgctcaggagcctggcaacaagagcaaaactccagctcaaaaaaaaaaaagaaagaaaagaaagctggagctggtggcttaggccatcacccttcccttggctggaactactggacagacccttttgagatgtgcctgtggtgctgtggagatgtgtgtagtggtcttagctctttgttgagcttgtgtgtgtgttgtgtagtcttagctgtatgctgaaattgggcgtgtgttggagggcttcttagctctttggtgagattgtatttctatgtgtttgtatcagctgaatgttgctggaaataaaaccttggtttgtcaaggctcttttttgtgggaagtaagtaggggaaaaggtctttgagggttcctaggctcctttgtacaacaggaaaatgcctcaaagccttgcttcccagcaacctggggctggttcccagtgcctggtcctgccccttcctggttcttatctcaaggcagagcttctgaatttcaggccttcattccagagccctcttgtggccaggccttcctttgctggaggaaggtacacagggtgaagctgatgctgtacttgggggatctccttggcctgttccaccaagtgagagaaggtacttactcttgtacctcctgttcagccaggtgcattaacagacctccctacagctgtaggaactactgtcccagagctgaggcaaggggatttctcaggtcatttggagaacaagtgctttagtagtagtttaaagtagtaactgctactgtatttagtggggtggaattcagaagaaatttgaagaccagatcatgggtggtctgcatgtgaatgaacaggaatgagccggacagcctggctgtcattgctttcttcctccccatttggacccttctctgcccttacatttttgtttctccatctaccaccatccaccagtctatttattaacttagcaagaggacaagtaaagggccctcttggcttgattttgcttctttctttctgtggaggatatactaagtgcgactttgccctatcctatttggaaatccctaacagaattgagttttctattaaggatccaaaaagaaaaacaaaatgctaatgaagccatcagtcaagggtcacatgccaataaacaataaattttccagaagaaatgaaatccaactagacaaataaagtagagcttatgaaatggttcagtaaagatgagtttgttgttttttgttttgttttgttttgtttttttaaagacggagtctcgctctgtcacccaggctggagtgcagtggtatgatcttggctcactgtaacctccgcctcccgggttcaagccattctcctgcctcagtctcctgagtagctgggattgcgggtgcgtgccaccatgcctggctaatttttgtgtttttagtagagacagggtttcaccatgttggtcgggctggtctcagactcctgacctcttgatccgcctgccttggcctcccaaagtgatgggattacagatgtgagccaccgtgcctagccaaggatgagatttttaaagtatgtttcagttctgtgtcatggttggaagacagagtaggaaggatatggaaaaggtcatggggaagcagaggtgattcatggctctgtgaatttgaggtgaatggttccttattgtctaggccacttgtgaagaatatgagtcagttattgccagccttggaatttacttctctagcttacaatggaccttttgaactggaaaacaccttgtctgcattcactttaaaatgtcaaaactaatttttataataaatgtttattttcacattgagtttgtttaaatcctgaagttcttaccttaagagaattgggactcctagagtgattggacattcaaaatattcctgatagtcttgttaattaagagattaggatatctttccattaccttgataattacgttttaatttagcttttttcattggcctgtgtttaaatgcaaataaccccacaatggacatttcctatgttaaagtgacatttaggggataaaaaatgagagcagttccatggattttggtgtttcccctgagacatgaactcagcataatctgggataaaatgattgagtgttaaggatgtgtttgttgttcctgtcgtttttttattttcttcaaagtatacaacatggtttgatatgcacatacatttgtgtaatgattgccatggtcaattaacacatcaccatttttgtgtgtgtgtgtgtgtgtgtgtgtgagggagtcttgctccgttgccaggctggagtgcaatggtacaaccttggctcactgcaacctccaccatgcccagctaatttttgtatttttagtagagacggggtttcaccatgttggccaggatgatctcgatcccttgacctcatgatccgcccacctcggcctcccaaagtgttgggattacaggcgtgagccactgcacccggcctaggataggtttttttaagtagtaactattgcagtagggaagagggcccaaggtgaactgaacttaacttccttaaaaaaaaaaaaaatgcaggaggccttttgaaggctgggatgtgctaagggataggcatgaagatattaaggagaattgctccatgtgactagacaatctggatttgtgaattggctcttgtccagaagagaaataagcacctatttttacgacaggagctagtagtgcaagttagagcaaggcacccacctggttgggagctggagcaagatttatttcctcaaatgtttgcatttcaaagaaactctcaggtcccagtgaaaatagctctgggtagaagatttacatctcaaagaggcagagaaagatgttttaattgcaagctttctttctaagtaattgcactaagatgaagttcaggggcctgtgtctattgctaggtttgggctgggatgcacagtaaatttttctg

SEQ ID NO: 296347 - DNA, 5059 bp, Homo sapiens
aactttaggctaggtacgaggcctgggcgggccagggccgcactccggagactcgcggttgctacgcgcaccatggctggagaggtacttctcagccctctagctccaactgagaacccagccagtcaggaagtcgctacttcgggaacaccaaccaatcagggggccgtcacctgctgaagggctggctctcagtcccctcgctgtagtcgcggagctgtgtctgttcccaggagtccttcggcggctgttgtgtcagtggcctgatcgcgatggggacaaaggcgcaagtcgagaggaaactgttgtgcctcttcatattggcgatcctgttgtgctccctggcattgggcagtgttacagtgcactcttctgaacctgaagtcagaattcctgagaataatcctgtgaagttgtcctgtgcctactcgggcttttcttctccccgtgtggagtggaagtttgaccaaggagacaccaccagactcgtttgctataataacaagatcacagcttcctatgaggaccgggtgaccttcttgccaactggtatcaccttcaagtccgtgacacgggaagacactgggacatacacttgtatggtctctgaggaaggcggcaacagctatggggaggtcaaggtcaagctcatcgtgcttgtgcctccatccaagcctacagttaacatcccctcctctgccaccattgggaaccgggcagtgctgacatgctcagaacaagatggttccccaccttctgaatacacctggttcaaagatgggatagtgatgcctacgaatcccaaaagcacccgtgccttcagcaactcttcctatgtcctgaatcccacaacaggagagctggtctttgatcccctgtcagcctctgatactggagaatacagctgtgaggcacggaatgggtatgggacacccatgacttcaaatgctgtgcgcatggaagctgtggagcggaatgtgggggtcatcgtggcagccgtccttgtaaccctgattctcctgggaatcttggtttttggcatctggtttgcctatagccgaggccactttgacagaacaaagaaagggacttcgagtaagaaggtgatttacagccagcctagtgcccgaagtgaaggagaattcaaacagacctcgtcattcctggtgtgagcctggtcggctcaccgcctatcatctgcatttgccttactcaggtgctaccggactctggcccctgatgtctgtagtttcacaggatgccttatttgtcttctacaccccacagggccccctacttcttcggatgtgtttttaataatgtcagctatgtgccccatcctccttcatgccctccctccctttcctaccactgctgagtggcctggaacttgtttaaagtgtttattccccatttctttgagggatcaggaaggaatcctgggtatgccattgacttcccttctaagtagacagcaaaaatggcgggggtcgcaggaatctgcactcaactgcccacctggctggcagggatctttgaataggtatcttgagcttggttctgggctctttccttgtgtactgacgaccagggccagctgttctagagcgggaattagaggctagagcggctgaaatggttgtttggtgatgacactggggtccttccatctctggggcccactctcttctgtcttcccatgggaagtgccactgggatccctctgccctgtcctcctgaatacaagctgactgacattgactgtgtctgtggaaaatgggagctcttgttgtggagagcatagtaaattttcagagaacttgaagccaaaaggatttaaaaccgctgctctaaagaaaagaaaactggaggctgggcgcagtggctcacgcctataatcccagaggctgaggcaggcggatcacctgaggtcaggagttcaagatcagcctgaccaacatggagaaaccctactgaaaatacaaagttagccaggcatggtggtgcatgcctgtaatcccagctgctcaggagcctggcaacaagagcaaaactccagctcaaaaaaaaaaaagaaagaaaagaaagctggagctggtggcttaggccatcacccttcccttggctggaactactggacagacccttttgagatgtgcctgtggtgctgtggagatgtgtgtagtggtcttagctctttgttgagcttgtgtgtgtgttgtgtagtcttagctgtatgctgaaattgggcgtgtgttggagggcttcttagctctttggtgagattgtatttctatgtgtttgtatcagctgaatgttgctggaaataaaaccttggtttgtcaaggctcttttttgtgggaagtaagtaggggaaaaggtctttgagggttcctaggctcctttgtacaacaggaaaatgcctcaaagccttgcttcccagcaacctggggctggttcccagtgcctggtcctgccccttcctggttcttatctcaaggcagagcttctgaatttcaggccttcattccagagccctcttgtggccaggccttcctttgctggaggaaggtacacagggtgaagctgatgctgtacttgggggatctccttggcctgttccaccaagtgagagaaggtacttactcttgtacctcctgttcagccaggtgcattaacagacctccctacagctgtaggaactactgtcccagagctgaggcaaggggatttctcaggtcatttggagaacaagtgctttagtagtagtttaaagtagtaactgctactgtatttagtggggtggaattcagaagaaatttgaagaccagatcatgggtggtctgcatgtgaatgaacaggaatgagccggacagcctggctgtcattgctttcttcctccccatttggacccttctctgcccttacatttttgtttctccatctaccaccatccaccagtctatttattaacttagcaagaggacaagtaaagggccctcttggcttgattttgcttctttctttctgtggaggatatactaagtgcgactttgccctatcctatttggaaatccctaacagaattgagttttctattaaggatccaaaaagaaaaacaaaatgctaatgaagccatcagtcaagggtcacatgccaataaacaataaattttccagaagaaatgaaatccaactagacaaataaagtagagcttatgaaatggttcagtaaagatgagtttgttgttttttgttttgttttgttttgtttttttaaagacggagtctcgctctgtcacccaggctggagtgcagtggtatgatcttggctcactgtaacctccgcctcccgggttcaagccattctcctgcctcagtctcctgagtagctgggattgcgggtgcgtgccaccatgcctggctaatttttgtgtttttagtagagacagggtttcaccatgttggtcgggctggtctcagactcctgacctcttgatccgcctgccttggcctcccaaagtgatgggattacagatgtgagccaccgtgcctagccaaggatgagatttttaaagtatgtttcagttctgtgtcatggttggaagacagagtaggaaggatatggaaaaggtcatggggaagcagaggtgattcatggctctgtgaatttgaggtgaatggttccttattgtctaggccacttgtgaagaatatgagtcagttattgccagccttggaatttacttctctagcttacaatggaccttttgaactggaaaacaccttgtctgcattcactttaaaatgtcaaaactaatttttataataaatgtttattttcacattgagtttgtttaaatcctgaagttcttaccttaagagaattgggactcctagagtgattggacattcaaaatattcctgatagtcttgttaattaagagattaggatatctttccattaccttgataattacgttttaatttagcttttttcattggcctgtgtttaaatgcaaataaccccacaatggacatttcctatgttaaagtgacatttaggggataaaaaatgagagcagttccatggattttggtgtttcccctgagacatgaactcagcataatctgggataaaatgattgagtgttaaggatgtgtttgttgttcctgtcgtttttttattttcttcaaagtatacaacatggtttgatatgcacatacatttgtgtaatgattgccatggtcaattaacacatcaccatttttgtgtgtgtgtgtgtgtgtgtgtgtgagggagtcttgctccgttgccaggctggagtgcaatggtacaaccttggctcactgcaacctccacctcctgggttcaagcaattctcttgcctcagcctcctaagtagctgggactataggcgtgtgccaccatgcccagctaatttttgtatttttagtagagacggggtttcaccatgttggccaggatgatctcgatcccttgacctcatgatccgcccacctcggcctcccaaagtgttgggattacaggcgtgagccactgcacccggcctaggataggtttttttaagtagtaactattgcagtagggaagagggcccaaggtgaactgaacttaacttccttaaaaaaaaaaaaaatgcaggaggccttttgaaggctgggatgtgctaagggataggcatgaagatattaaggagaattgctccatgtgactagacaatctggatttgtgaattggctcttgtccagaagagaaataagcacctatttttacgacaggagctagtagtgcaagttagagcaaggcacccacctggttgggagctggagcaagatttatttcctcaaatgtttgcatttcaaagaaactctcaggtcccagtgaaaatagctctgggtagaagatttacatctcaaagaggcagagaaagatgttttaattgcaagctttctttctaagtaattgcactaagatgaagttcaggggcctgtgtctattgctaggtttgggctgggatgcacagtaaatttttctg

SEQ ID NO: 296348 - DNA, 3842 bp, Homo sapiens
  misc_feature (3769)..(3769): n is a, c, g, or t
aactttaggctaggtacgaggcctgggcgggccagggccgcactccggagactcgcggttgctacgcgcaccatggctggagaggtacttctcagccctctagctccaactgagaacccagccagtcaggaagtcgctacttcgggaacaccaaccaatcagggggccgtcacctgctgaagggctggctctcagtcccctcgctgtagtcgcggagctgtgtctgttcccaggagtccttcggcggctgttgtgtcagtggcctgatcgcgatggggacaaaggcgcaagtcgagaggaaactgttgtgcctcttcatattggcgatcctgttgtgctccctggcattgggcagtgttacagtgcactcttctgaacctgaagtcagaattcctgagaataatcctgtgaagttgtcctgtgcctactcgggcttttcttctccccgtgtggagtggaagtttgaccaaggagacaccaccagactcgtttgctataataacaagatcacagcttcctatgaggaccgggtgaccttcttgccaactggtatcaccttcaagtccgtgacacgggaagacactgggacatacacttgtatggtctctgaggaaggcggcaacagctatggggaggtcaaggtcaagctcatcgtgcttgtgcctccatccaagcctacagttaacatcccctcctctgccaccattgggaaccgggcagtgctgacatgctcagaacaagatggttccccaccttctgaatacacctggttcaaagatgggatagtgatgcctacgaatcccaaaagcacccgtgccttcagcaactcttcctatgtcctgaatcccacaacaggagagctggtctttgatcccctgtcagcctctgatactggagaatacagctgtgaggcacggaatgggtatgggacacccatgacttcaaatgctgtgcgcatggaagctgtggagcggaatgtgggggtcatcgtggcagccgtccttgtaaccctgattctcctgggaatcttggtttttggcatctggtttgcctatagccgaggccactttgacagaacaaagaaagggacttcgagtaagaaggtgatttacagccagcctagtgcccgaagtgaaggagaattcaaacagacctcgtcattcctggtgtgagcctggtcggctcaccgcctatcatctgcatttgccttactcaggtgctaccggactctggcccctgatgtctgtagtttcacaggatgccttatttgtcttctacaccccacagggccccctacttcttcggatgtgtttttaataatgtcagctatgtgccccatcctccttcatgccctccctccctttcctaccactgctgagtggcctggaacttgtttaaagtgtttattccccatttctttgagggatcaggaaggaatcctgggtatgccattgacttcccttctaagtagacagcaaaaatggcgggggtcgcaggaatctgcactcaactgcccacctggctggcagggatctttgaataggtatcttgagcttggttctgggctctttccttgtgtactgacgaccagggccagctgttctagagcgggaattagaggctagagcggctgaaatggttgtttggtgatgacactggggtccttccatctctggggcccactctcttctgtcttcccatgggaagtgccactgggatccctctgccctgtcctcctgaatacaagctgactgacattgactgtgtctgtggaaaatgggagctcttgttgtggagagcatagtaaattttcagagaacttgaagccaaaaggatttaaaaccgctgctctaaagaaaagaaaactggaggctgggcgcagtggctcacgcctataatcccagaggctgaggcaggcggatcacctgaggtcaggagttcaagatcagcctgaccaacatggagaaaccctactgaaaatacaaagttagccaggcatggtggtgcatgcctgtaatcccagctgctcaggagcctggcaacaagagcaaaactccagctcaaaaaaaaaaaagaaagaaaagaaagctggagctggtggcttaggccatcacccttcccttggctggaactactggacagacccttttgagatgtgcctgtggtgctgtggagatgtgtgtagtggtcttagctctttgttgagcttgtgtgtgtgttgtgtagtcttagctgtatgctgaaattgggcgtgtgttggagggcttcttagctctttggtgagattgtatttctatgtgtttgtatcagctgaatgttgctggaaataaaaccttggtttgtcaaggctcttttttgtgggaagtaagtaggggaaaaggtctttgagggttcctaggctcctttgtacaacaggaaaatgcctcaaagccttgcttcccagcaacctggggctggttcccagtgcctggtcctgccccttcctggttcttatctcaaggcagagcttctgaatttcaggccttcattccagagccctcttgtggccaggccttcctttgctggaggaaggtacacagggtgaagctgatgctgtacttgggggatctccttggcctgttccaccaagtgagagaaggtacttactcttgtacctcctgttcagccaggtgcattaacagacctccctacagctgtaggaactactgtcccagagctgaggcaaggggatttctcaggtcatttggagaacaagtgctttagtagtagtttaaagtagtaactgctactgtatttagtggggtggaattcagaagaaatttgaagaccagatcatgggtggtctgcatgtgaatgaacaggaatgagccggacagcctggctgtcattgctttcttcctccccatttggacccttctctgcccttacatttttgtttctccatctaccaccatccaccagtctatttattaacttagcaagaggacaagtaaagggccctcttggcttgattttgcttctttctttctgtggaggatatactaagtgcgactttgccctatcctatttggaaatccctaacagaattgagttttctattaaggatccaaaaagaaaaacaaaatgctaatgaagccatcagtcaagggtcacatgccaataaacaataaattttccagaagaaatgaaatccaactagacaaataaagtagagcttatgaaatggttcagtaaagatgagtttgttgttttttgttttgttttgttttgtttttttaaagacggagtctcgctctgtcacccaggctggagtgcagtggtatgatcttggctcactgtaacctccgcctcccgggttcaagccattctcctgcctcagtctcctgagtagctgggattgcgggtgcgtgccaccatgcctggctaatttttgtgtttttagtagagacagggtttcaccatgttggtcgggctggtctcagactcctgacctcttgatccgcctgccttggcctcccaaagtgatgggattacagatgtgagccaccgtgcctagccaaggatgagatttttaaagtatgtttcagttctgtgtcatggttggaagacagagtaggaaggatatggaaaaggtcatggggaagcagaggtgattcatggctctgtgaatttgaggtgaatggttccttattgtctaggccacttgtgaagaatatgagtcagttattgccagccttggaatttacttctctagcttacaatggacctnggtagtaatttccaggccttctccctgtaactggttgcagaaataaaacctctcttcctccccatttaaaaaa

SEQ ID NO: 296349 - DNA, 3877 bp, Homo sapiens
aactttaggctaggtacgaggcctgggcgggccagggccgcactccggagactcgcggttgctacgcgcaccatggctggagacggagtttcgctcttgatgcccagcaggctggagtgcgatggcgcgatttcggctcactgcaacctcctcctcccagaggtacttctcagccctctagctccaactgagaacccagccagtcaggaagtcgctacttcgggaacaccaaccaatcagggggccgtcacctgctgaaggagtccttcggcggctgttgtgtcagtggcctgatcgcgatggggacaaaggcgcaagtcgagaggaaactgttgtgcctcttcatattggcgatcctgttgtgctccctggcattgggcagtgttacagtgcactcttctgaacctgaagtcagaattcctgagaataatcctgtgaagttgtcctgtgcctactcgggcttttcttctccccgtgtggagtggaagtttgaccaaggagacaccaccagactcgtttgctataataacaagatcacagcttcctatgaggaccgggtgaccttcttgccaactggtatcaccttcaagtccgtgacacgggaagacactgggacatacacttgtatggtctctgaggaaggcggcaacagctatggggaggtcaaggtcaagctcatcgtgcttgtgcctccatccaagcctacagttaacatcccctcctctgccaccattgggaaccgggcagtgctgacatgctcagaacaagatggttccccaccttctgaatacacctggttcaaagatgggatagtgatgcctacgaatcccaaaagcacccgtgccttcagcaactcttcctatgtcctgaatcccacaacaggagagctggtctttgatcccctgtcagcctctgatactggagaatacagctgtgaggcacggaatgggtatgggacacccatgacttcaaatgctgtgcgcatggaagctgtggagcggaatgtgggggtcatcgtggcagccgtccttgtaaccctgattctcctgggaatcttggtttttggcatctggtttgcctatagccgaggccactttgacagaacaaagaaagggacttcgagtaagaaggtgatttacagccagcctagtgcccgaagtgaaggagaattcaaacagacctcgtcattcctggtgtgagcctggtcggctcaccgcctatcatctgcatttgccttactcaggtgctaccggactctggcccctgatgtctgtagtttcacaggatgccttatttgtcttctacaccccacagggccccctacttcttcggatgtgtttttaataatgtcagctatgtgccccatcctccttcatgccctccctccctttcctaccactgctgagtggcctggaacttgtttaaagtgtttattccccatttctttgagggatcaggaaggaatcctgggtatgccattgacttcccttctaagtagacagcaaaaatggcgggggtcgcaggaatctgcactcaactgcccacctggctggcagggatctttgaataggtatcttgagcttggttctgggctctttccttgtgtactgacgaccagggccagctgttctagagcgggaattagaggctagagcggctgaaatggttgtttggtgatgacactggggtccttccatctctggggcccactctcttctgtcttcccatgggaagtgccactgggatccctctgccctgtcctcctgaatacaagctgactgacattgactgtgtctgtggaaaatgggagctcttgttgtggagagcatagtaaattttcagagaacttgaagccaaaaggatttaaaaccgctgctctaaagaaaagaaaactggaggctgggcgcagtggctcacgcctataatcccagaggctgaggcaggcggatcacctgaggtcaggagttcaagatcagcctgaccaacatggagaaaccctactgaaaatacaaagttagccaggcatggtggtgcatgcctgtaatcccagctgctcaggagcctggcaacaagagcaaaactccagctcaaaaaaaaaaaagaaagaaaagaaagctggagctggtggcttaggccatcacccttcccttggctggaactactggacagacccttttgagatgtgcctgtggtgctgtggagatgtgtgtagtggtcttagctctttgttgagcttgtgtgtgtgttgtgtagtcttagctgtatgctgaaattgggcgtgtgttggagggcttcttagctctttggtgagattgtatttctatgtgtttgtatcagctgaatgttgctggaaataaaaccttggtttgtcaaggctcttttttgtgggaagtaagtaggggaaaaggtctttgagggttcctaggctcctttgtacaacaggaaaatgcctcaaagccttgcttcccagcaacctggggctggttcccagtgcctggtcctgccccttcctggttcttatctcaaggcagagcttctgaatttcaggccttcattccagagccctcttgtggccaggccttcctttgctggaggaaggtacacagggtgaagctgatgctgtacttgggggatctccttggcctgttccaccaagtgagagaaggtacttactcttgtacctcctgttcagccaggtgcattaacagacctccctacagctgtaggaactactgtcccagagctgaggcaaggggatttctcaggtcatttggagaacaagtgctttagtagtagtttaaagtagtaactgctactgtatttagtggggtggaattcagaagaaatttgaagaccagatcatgggtggtctgcatgtgaatgaacaggaatgagccggacagcctggctgtcattgctttcttcctccccatttggacccttctctgcccttacatttttgtttctccatctaccaccatccaccagtctatttattaacttagcaagaggacaagtaaagggccctcttggcttgattttgcttctttctttctgtggaggatatactaagtgcgactttgccctatcctatttggaaatccctaacagaattgagttttctattaaggatccaaaaagaaaaacaaaatgctaatgaagccatcagtcaagggtcacatgccaataaacaataaattttccagaagaaatgaaatccaactagacaaataaagtagagcttatgaaatggttcagtaaagatgagtttgttgttttttgttttgttttgttttgtttttttaaagacggagtctcgctctgtcacccaggctggagtgcagtggtatgatcttggctcactgtaacctccgcctcccgggttcaagccattctcctgcctcagtctcctgagtagctgggattgcgggtgcgtgccaccatgcctggctaatttttgtgtttttagtagagacagggtttcaccatgttggtcgggctggtctcagactcctgacctcttgatccgcctgccttggcctcccaaagtgatgggattacagatgtgagccaccgtgcctagccaaggatgagatttttaaagtatgtttcagttctgtgtcatggttggaagacagagtaggaaggatatggaaaaggtcatggggaagcagaggtgattcatggctctgtgaatttgaggtgaatggttccttattgtctaggccacttgtgaagaatatgagtcagttattgccagccttggaatttacttctctagcttacaatggaccttttgaactggaaaacaccttgtctgcattcactttaaaatgtcaaaactaatttttataataaatgtttattttcacattga

SEQ ID NO: 296350 - DNA, 3413 bp, Homo sapiens
aactttaggctaggtacgaggcctgggcgggccagggccgcactccggagactcgcggttgctacgcgcaccatggctggagaggtacttctcagccctctagctccaactgagaacccagccagtcaggaagtcgctacttcgggaacaccaaccaatcagggggccgtcacctgctgaagggctggctctcagtcccctcgctgtagtcgcggagctgtgtctgttcccaggagtccttcggcggctgttgtgtcagtggcctgatcgcgatggggacaaaggcgcaagtcgagaggaaactgttgtgcctcttcatattggcgatcctgttgtgctccctggcattgggcagtgttacagtgcactcttctgaacctgaagtcagaattcctgagaataatcctgtgaagttgtcctgtgcctactcgggcttttcttctccccgtgtggagtggaagtttgaccaaggagacaccaccagactcgtttgctataataacaagatcacagcttcctatgaggaccgggtgaccttcttgccaactggtatcaccttcaagtccgtgacacgggaagacactgggacatacacttgtatggtctctgaggaaggcggcaacagctatggggaggtcaaggtcaagctcatcgtgcttgtgcctccatccaagcctacagttaacatcccctcctctgccaccattgggaaccgggcagtgctgacatgctcagaacaagatggttccccaccttctgaatacacctggttcaaagatgggatagtgatgcctacgaatcccaaaagcacccgtgccttcagcaactcttcctatgtcctgaatcccacaacaggagagctggtctttgatcccctgtcagcctctgatactggagaatacagctgtgaggcacggaatgggtatgggacacccatgacttcaaatgctgtgcgcatggaagctgtggagcggaatgtgggggtcatcgtggcagccgtccttgtaaccctgattctcctgggaatcttggtttttggcatctggtttgcctatagccgaggccactttgacagaacaaagaaagggacttcgagtaagaaggtgatttacagccagcctagtgcccgaagtgaaggagaattcaaacagacctcgtcattcctggtgtgagcctggtcggctcaccgcctatcatctgcatttgccttactcaggtgctaccggactctggcccctgatgtctgtagtttcacaggatgccttatttgtcttctacaccccacagggccccctacttcttcggatgtgtttttaataatgtcagctatgtgccccatcctccttcatgccctccctccctttcctaccactgctgagtggcctggaacttgtttaaagtgtttattccccatttctttgagggatcaggaaggaatcctgggtatgccattgacttcccttctaagtagacagcaaaaatggcgggggtcgcaggaatctgcactcaactgcccacctggctggcagggatctttgaataggtatcttgagcttggttctgggctctttccttgtgtactgacgaccagggccagctgttctagagcgggaattagaggctagagcggctgaaatggttgtttggtgatgacactggggtccttccatctctggggcccactctcttctgtcttcccatgggaagtgccactgggatccctctgccctgtcctcctgaatacaagctgactgacattgactgtgtctgtggaaaatgggagctcttgttgtggagagcatagtaaattttcagagaacttgaagccaaaaggatttaaaaccgctgctctaaagaaaagaaaactggaggctgggcgcagtggctcacgcctataatcccagaggctgaggcaggcggatcacctgaggtcaggagttcaagatcagcctgaccaacatggagaaaccctactgaaaatacaaagttagccaggcatggtggtgcatgcctgtaatcccagctgctcaggagcctggcaacaagagcaaaactccagctcaaaaaaaaaaaagaaagaaaagaaagctggagctggtggcttaggccatcacccttcccttggctggaactactggacagacccttttgagatgtgcctgtggtgctgtggagatgtgtgtagtggtcttagctctttgttgagcttgtgtgtgtgttgtgtagtcttagctgtatgctgaaattgggcgtgtgttggagggcttcttagctctttggtgagattgtatttctatgtgtttgtatcagctgaatgttgctggaaataaaaccttggtttgtcaaggctcttttttgtgggaagtaagtaggggaaaaggtctttgagggttcctaggctcctttgtacaacaggaaaatgcctcaaagccttgcttcccagcaacctggggctggttcccagtgcctggtcctgccccttcctggttcttatctcaaggcagagcttctgaatttcaggccttcattccagagccctcttgtggccaggccttcctttgctggaggaaggtacacagggtgaagctgatgctgtacttgggggatctccttggcctgttccaccaagtgagagaaggtacttactcttgtacctcctgttcagccaggtgcattaacagacctccctacagctgtaggaactactgtcccagagctgaggcaaggggatttctcaggtcatttggagaacaagtgctttagtagtagtttaaagtagtaactgctactgtatttagtggggtggaattcagaagaaatttgaagaccagatcatgggtggtctgcatgtgaatgaacaggaatgagccggacagcctggctgtcattgctttcttcctccccatttggacccttctctgcccttacatttttgtttctccatctaccaccatccaccagtctatttattaacttagcaagaggacaagtaaagggccctcttggcttgattttgcttctttctttctgtggaggatatactaagtgcgactttgccctatcctatttggaaatccctaacagaattgagttttctattaaggatccaaaaagaaaaacaaaatgctaatgaagccatcagtcaagggtcacatgccaataaacaataaattttccagaagaaatgaaatccaactagacaaataaagtagagcttatgaaatggttcagtaaagatgagtttgttgttttttgttttgttttgttttgtttttttaaagacggagtctcgctctgtcacccaggctggagtgcagtggtatgatcttggctcactgtaacctccgcctcccgggttcaagccattctcctgcctcagtagcctgggcaacaagagcaaaactccatctcaa

SEQ ID NO: 296351 - DNA, 3379 bp, Homo sapiens
aactttaggctaggtacgaggcctgggcgggccagggccgcactccggagactcgcggttgctacgcgcaccatggctggagaggtacttctcagccctctagctccaactgagaacccagccagtcaggaagtcgctacttcgggaacaccaaccaatcagggggccgtcacctgctgaagggctggctctcagtcccctcgctgtagtcgcggagctgtgtctgttcccaggagtccttcggcggctgttgtgtcagtggcctgatcgcgatggggacaaaggcgcaagtcgagaggaaactgttgtgcctcttcatattggcgatcctgttgtgctccctggcattgggcagtgttacagtgcactcttctgaacctgaagtcagaattcctgagaataatcctgtgaagttgtcctgtgcctactcgggcttttcttctccccgtgtggagtggaagtttgaccaaggagacaccaccagactcgtttgctataataacaagatcacagcttcctatgaggaccgggtgaccttcttgccaactggtatcaccttcaagtccgtgacacgggaagacactgggacatacacttgtatggtctctgaggaaggcggcaacagctatggggaggtcaaggtcaagctcatcgtgcttgtgcctccatccaagcctacagttaacatcccctcctctgccaccattgggaaccgggcagtgctgacatgctcagaacaagatggttccccaccttctgaatacacctggttcaaagatgggatagtgatgcctacgaatcccaaaagcacccgtgccttcagcaactcttcctatgtcctgaatcccacaacaggagagctggtctttgatcccctgtcagcctctgatactggagaatacagctgtgaggcacggaatgggtatgggacacccatgacttcaaatgctgtgcgcatggaagctgtggagcggaatgtgggggtcatcgtggcagccgtccttgtaaccctgattctcctgggaatcttggtttttggcatctggtttgcctatagccgaggccactttgacagaacaaagaaagggacttcgagtaagaaggtgatttacagccagcctagtgcccgaagtgaaggagaattcaaacagacctcgtcattcctggtgtgagcctggtcggctcaccgcctatcatctgcatttgccttactcaggtgctaccggactctggcccctgatgtctgtagtttcacaggatgccttatttgtcttctacaccccacagggccccctacttcttcggatgtgtttttaataatgtcagctatgtgccccatcctccttcatgccctccctccctttcctaccactgctgagtggcctggaacttgtttaaagtgtttattccccatttctttgagggatcaggaaggaatcctgggtatgccattgacttcccttctaagtagacagcaaaaatggcgggggtcgcaggaatctgcactcaactgcccacctggctggcagggatctttgaataggtatcttgagcttggttctgggctctttccttgtgtactgacgaccagggccagctgttctagagcgggaattagaggctagagcggctgaaatggttgtttggtgatgacactggggtccttccatctctggggcccactctcttctgtcttcccatgggaagtgccactgggatccctctgccctgtcctcctgaatacaagctgactgacattgactgtgtctgtggaaaatgggagctcttgttgtggagagcatagtaaattttcagagaacttgaagccaaaaggatttaaaaccgctgctctaaagaaaagaaaactggaggctgggcgcagtggctcacgcctataatcccagaggctgaggcaggcggatcacctgaggtcaggagttcaagatcagcctgaccaacatggagaaaccctactgaaaatacaaagttagccaggcatggtggtgcatgcctgtaatcccagctgctcaggagcctggcaacaagagcaaaactccagctcaaaaaaaaaaaagaaagaaaagaaagctggagctggtggcttaggccatcacccttcccttggctggaactactggacagacccttttgagatgtgcctgtggtgctgtggagatgtgtgtagtggtcttagctctttgttgagcttgtgtgtgtgttgtgtagtcttagctgtatgctgaaattgggcgtgtgttggagggcttcttagctctttggtgagattgtatttctatgtgtttgtatcagctgaatgttgctggaaataaaaccttggtttgtcaaggctcttttttgtgggaagtaagtaggggaaaaggtctttgagggttcctaggctcctttgtacaacaggaaaatgcctcaaagccttgcttcccagcaacctggggctggttcccagtgcctggtcctgccccttcctggttcttatctcaaggcagagcttctgaatttcaggccttcattccagagccctcttgtggccaggccttcctttgctggaggaaggtacacagggtgaagctgatgctgtacttgggggatctccttggcctgttccaccaagtgagagaaggtacttactcttgtacctcctgttcagccaggtgcattaacagacctccctacagctgtaggaactactgtcccagagctgaggcaaggggatttctcaggtcatttggagaacaagtgctttagtagtagtttaaagtagtaactgctactgtatttagtggggtggaattcagaagaaatttgaagaccagatcatgggtggtctgcatgtgaatgaacaggaatgagccggacagcctggctgtcattgctttcttcctccccatttggacccttctctgcccttacatttttgtttctccatctaccaccatccaccagtctatttattaacttagcaagaggacaagtaaagggccctcttggcttgattttgcttctttctttctgtggaggatatactaagtgcgactttgccctatcctatttggaaatccctaacagaattgagttttctattaaggatccaaaaagaaaaacaaaatgctaatgaagccatcagtcaagggtcacatgccaataaacaataaattttccagaagaaatgaaatccaactagacaaataaagtagagcttatgaaatggttcagtaaagatgagtttgttgttttttgttttgttttgttttgtttttttaaagacggagtaatcgcttgaacccgggaggcagaggttgcgtgagccgagatcacgccattgcactccagcctgggcaacaagagcaaaactccatctcaa

SEQ ID NO: 296352 - DNA, 3293 bp, Homo sapiens
aactttaggctaggtacgaggcctgggcgggccagggccgcactccggagactcgcggttgctacgcgcaccatggctggagaggtacttctcagccctctagctccaactgagaacccagccagtcaggaagtcgctacttcgggaacaccaaccaatcagggggccgtcacctgctgaagggctggctctcagtcccctcgctgtagtcgcggagctgtgtctgttcccaggagtccttcggcggctgttgtgtcagtggcctgatcgcgatggggacaaaggcgcaagtcgagaggaaactgttgtgcctcttcatattggcgatcctgttgtgctccctggcattgggcagtgttacagtgcactcttctgaacctgaagtcagaattcctgagaataatcctgtgaagttgtcctgtgcctactcgggcttttcttctccccgtgtggagtggaagtttgaccaaggagacaccaccagactcgtttgctataataacaagatcacagcttcctatgaggaccgggtgaccttcttgccaactggtatcaccttcaagtccgtgacacgggaagacactgggacatacacttgtatggtctctgaggaaggcggcaacagctatggggaggtcaaggtcaagctcatcgtgcttgtgcctccatccaagcctacagttaacatcccctcctctgccaccattgggaaccgggcagtgctgacatgctcagaacaagatggttccccaccttctgaatacacctggttcaaagatgggatagtgatgcctacgaatcccaaaagcacccgtgccttcagcaactcttcctatgtcctgaatcccacaacaggagagctggtctttgatcccctgtcagcctctgatactggagaatacagctgtgaggcacggaatgggtatgggacacccatgacttcaaatgctgtgcgcatggaagctgtggagcggaatgtgggggtcatcgtggcagccgtccttgtaaccctgattctcctgggaatcttggtttttggcatctggtttgcctatagccgaggccactttgacagaacaaagaaagggacttcgagtaagaaggtgatttacagccagcctagtgcccgaagtgaaggagaattcaaacagacctcgtcattcctggtgtgagcctggtcggctcaccgcctatcatctgcatttgccttactcaggtgctaccggactctggcccctgatgtctgtagtttcacaggatgccttatttgtcttctacaccccacagggccccctacttcttcggatgtgtttttaataatgtcagctatgtgccccatcctccttcatgccctccctccctttcctaccactgctgagtggcctggaacttgtttaaagtgtttattccccatttctttgagggatcaggaaggaatcctgggtatgccattgacttcccttctaagtagacagcaaaaatggcgggggtcgcaggaatctgcactcaactgcccacctggctggcagggatctttgaataggtatcttgagcttggttctgggctctttccttgtgtactgacgaccagggccagctgttctagagcgggaattagaggctagagcggctgaaatggttgtttggtgatgacactggggtccttccatctctggggcccactctcttctgtcttcccatgggaagtgccactgggatccctctgccctgtcctcctgaatacaagctgactgacattgactgtgtctgtggaaaatgggagctcttgttgtggagagcatagtaaattttcagagaacttgaagccaaaaggatttaaaaccgctgctctaaagaaaagaaaactggaggctgggcgcagtggctcacgcctataatcccagaggctgaggcaggcggatcacctgaggtcaggagttcaagatcagcctgaccaacatggagaaaccctactgaaaatacaaagttagccaggcatggtggtgcatgcctgtaatcccagctgctcaggagcctggcaacaagagcaaaactccagctcaaaaaaaaaaaagaaagaaaagaaagctggagctggtggcttaggccatcacccttcccttggctggaactactggacagacccttttgagatgtgcctgtggtgctgtggagatgtgtgtagtggtcttagctctttgttgagcttgtgtgtgtgttgtgtagtcttagctgtatgctgaaattgggcgtgtgttggagggcttcttagctctttggtgagattgtatttctatgtgtttgtatcagctgaatgttgctggaaataaaaccttggtttgtcaaggctcttttttgtgggaagtaagtaggggaaaaggtctttgagggttcctaggctcctttgtacaacaggaaaatgcctcaaagccttgcttcccagcaacctggggctggttcccagtgcctggtcctgccccttcctggttcttatctcaaggcagagcttctgaatttcaggccttcattccagagccctcttgtggccaggccttcctttgctggaggaaggtacacagggtgaagctgatgctgtacttgggggatctccttggcctgttccaccaagtgagagaaggtacttactcttgtacctcctgttcagccaggtgcattaacagacctccctacagctgtaggaactactgtcccagagctgaggcaaggggatttctcaggtcatttggagaacaagtgctttagtagtagtttaaagtagtaactgctactgtatttagtggggtggaattcagaagaaatttgaagaccagatcatgggtggtctgcatgtgaatgaacaggaatgagccggacagcctggctgtcattgctttcttcctccccatttggacccttctctgcccttacatttttgtttctccatctaccaccatccaccagtctatttattaacttagcaagaggacaagtaaagggccctcttggcttgattttgcttctttctttctgtggaggatatactaagtgcgactttgccctatcctatttggaaatccctaacagaattgagttttctattaaggatccaaaaagaaaaacaaaatgctaatgaagccatcagtcaagggtcacatgccaataaacaataaattttccagaagaaatgaaatccaactagacaaataaagtagagcttatgaaatggccctgtttggactctgagaataacttggaaaagcagcccaatgaaacattaggatagaaaataatca

SEQ ID NO: 296353 - DNA, 3821 bp, Homo sapiens
  misc_feature (21)..(22): n is a, c, g, or t
aaataggctaggtacgaggcnnggtggtatgttgcaggcgccgagagggcgggccagggccgcactccggagactcgcggttgctacgcgcaccatggctggagaggtacttctcagccctctagctccaactgagaacccagccagtcaggaagtcgctacttcgggaacaccaaccaatcagggggccgtcacctgctgaaggagtccttcggcggctgttgtgtcagtggcctgatcgcgatggggacaaaggcgcaagtcgagaggaaactgttgtgcctcttcatattggcgatcctgttgtgctccctggcattgggcagtgttacagtgcactcttctgaacctgaagtcagaattcctgagaataatcctgtgaagttgtcctgtgcctactcgggcttttcttctccccgtgtggagtggaagtttgaccaaggagacaccaccagactcgtttgctataataacaagatcacagcttcctatgaggaccgggtgaccttcttgccaactggtatcaccttcaagtccgtgacacgggaagacactgggacatacacttgtatggtctctgaggaaggcggcaacagctatggggaggtcaaggtcaagctcatcgtgcttgtgcctccatccaagcctacagttaacatcccctcctctgccaccattgggaaccgggcagtgctgacatgctcagaacaagatggttccccaccttctgaatacacctggttcaaagatgggatagtgatgcctacgaatcccaaaagcacccgtgccttcagcaactcttcctatgtcctgaatcccacaacaggagagctggtctttgatcccctgtcagcctctgatactggagaatacagctgtgaggcacggaatgggtatgggacacccatgacttcaaatgctgtgcgcatggaagctgtggagcggaatgtgggggtcatcgtggcagccgtccttgtaaccctgattctcctgggaatcttggtttttggcatctggtttgcctatagccgaggccactttgacagaacaaagaaagggacttcgagtaagaaggtgatttacagccagcctagtgcccgaagtgaaggagaattcaaacagacctcgtcattcctggtgtgagcctggtcggctcaccgcctatcatctgcatttgccttactcaggtgctaccggactctggcccctgatgtctgtagtttcacaggatgccttatttgtcttctacaccccacagggccccctacttcttcggatgtgtttttaataatgtcagctatgtgccccatcctccttcatgccctccctccctttcctaccactgctgagtggcctggaacttgtttaaagtgtttattccccatttctttgagggatcaggaaggaatcctgggtatgccattgacttcccttctaagtagacagcaaaaatggcgggggtcgcaggaatctgcactcaactgcccacctggctggcagggatctttgaataggtatcttgagcttggttctgggctctttccttgtgtactgacgaccagggccagctgttctagagcgggaattagaggctagagcggctgaaatggttgtttggtgatgacactggggtccttccatctctggggcccactctcttctgtcttcccatgggaagtgccactgggatccctctgccctgtcctcctgaatacaagctgactgacattgactgtgtctgtggaaaatgggagctcttgttgtggagagcatagtaaattttcagagaacttgaagccaaaaggatttaaaaccgctgctctaaagaaaagaaaactggaggctgggcgcagtggctcacgcctataatcccagaggctgaggcaggcggatcacctgaggtcaggagttcaagatcagcctgaccaacatggagaaaccctactgaaaatacaaagttagccaggcatggtggtgcatgcctgtaatcccagctgctcaggagcctggcaacaagagcaaaactccagctcaaaaaaaaaaaagaaagaaaagaaagctggagctggtggcttaggccatcacccttcccttggctggaactactggacagacccttttgagatgtgcctgtggtgctgtggagatgtgtgtagtggtcttagctctttgttgagcttgtgtgtgtgttgtgtagtcttagctgtatgctgaaattgggcgtgtgttggagggcttcttagctctttggtgagattgtatttctatgtgtttgtatcagctgaatgttgctggaaataaaaccttggtttgtcaaggctcttttttgtgggaagtaagtaggggaaaaggtctttgagggttcctaggctcctttgtacaacaggaaaatgcctcaaagccttgcttcccagcaacctggggctggttcccagtgcctggtcctgccccttcctggttcttatctcaaggcagagcttctgaatttcaggccttcattccagagccctcttgtggccaggccttcctttgctggaggaaggtacacagggtgaagctgatgctgtacttgggggatctccttggcctgttccaccaagtgagagaaggtacttactcttgtacctcctgttcagccaggtgcattaacagacctccctacagctgtaggaactactgtcccagagctgaggcaaggggatttctcaggtcatttggagaacaagtgctttagtagtagtttaaagtagtaactgctactgtatttagtggggtggaattcagaagaaatttgaagaccagatcatgggtggtctgcatgtgaatgaacaggaatgagccggacagcctggctgtcattgctttcttcctccccatttggacccttctctgcccttacatttttgtttctccatctaccaccatccaccagtctatttattaacttagcaagaggacaagtaaagggccctcttggcttgattttgcttctttctttctgtggaggatatactaagtgcgactttgccctatcctatttggaaatccctaacagaattgagttttctattaaggatccaaaaagaaaaacaaaatgctaatgaagccatcagtcaagggtcacatgccaataaacaataaattttccagaagaaatgaaatccaactagacaaataaagtagagcttatgaaatggttcagtaaagatgagtttgttgttttttgttttgttttgttttgtttttttaaagacggagtctcgctctgtcacccaggctggagtgcagtggtatgatcttggctcactgtaacctccgcctcccgggttcaagccattctcctgcctcagtctcctgagtagctgggattgcgggtgcgtgccaccatgcctggctaatttttgtgtttttagtagagacagggtttcaccatgttggtcgggctggtctcagactcctgacctcttgatccgcctgccttggcctcccaaagtgatgggattacagatgtgagccaccgtgcctagccaaggatgagatttttaaagtatgtttcagttctgtgtcatggttggaagacagagtaggaaggatatggaaaaggtcatggggaagcagaggtgattcatggctctgtgaatttgaggtgaatggttccttattgtctaggccacttgtgaagaatatgagtcagttattgccagccttggaatttacttctctagcttacaatggaccttttgaactggaaaacaccttgtctgcattcactttaaaatgtcaaaactaatttttataataaatgtttattttcacattga

SEQ ID NO: 296354 - DNA, 3924 bp, Homo sapiens
  misc_feature (156)..(156): n is a, c, g, or t
agagaccacagaaaccttaaggggctaagggttagcgatggcctcgggtgtgctgtgtatgcatatgctgccggagtagcgggctgggccgaggtacctgcgactctcggtgacaatcgtctgcagtgatgtgctgatcgccgtcagccacctggnctatggactgagtgtcacattcgtcaggtaccactctaggcctcgcacatctcgataatacctcgaaggctcagttatatgagatatgtccggctaactctcagtggtatacaccctaggcctattacagggtcgccgacacctgctgaaggagtccttcggcggctgttgtgtcagtggcctgatcgcgatggggacaaaggcgcaagtcgagaggaaactgttgtgcctcttcatattggcgatcctgttgtgctccctggcattgggcagtgttacagtgcactcttctgaacctgaagtcagaattcctgagaataatcctgtgaagttgtcctgtgcctactcgggcttttcttctccccgtgtggagtggaagtttgaccaaggagacaccaccagactcgtttgctataataacaagatcacagcttcctatgaggaccgggtgaccttcttgccaactggtatcaccttcaagtccgtgacacgggaagacactgggacatacacttgtatggtctctgaggaaggcggcaacagctatggggaggtcaaggtcaagctcatcgtgcttgtgcctccatccaagcctacagttaacatcccctcctctgccaccattgggaaccgggcagtgctgacatgctcagaacaagatggttccccaccttctgaatacacctggttcaaagatgggatagtgatgcctacgaatcccaaaagcacccgtgccttcagcaactcttcctatgtcctgaatcccacaacaggagagctggtctttgatcccctgtcagcctctgatactggagaatacagctgtgaggcacggaatgggtatgggacacccatgacttcaaatgctgtgcgcatggaagctgtggagcggaatgtgggggtcatcgtggcagccgtccttgtaaccctgattctcctgggaatcttggtttttggcatctggtttgcctatagccgaggccactttgacagaacaaagaaagggacttcgagtaagaaggtgatttacagccagcctagtgcccgaagtgaaggagaattcaaacagacctcgtcattcctggtgtgagcctggtcggctcaccgcctatcatctgcatttgccttactcaggtgctaccggactctggcccctgatgtctgtagtttcacaggatgccttatttgtcttctacaccccacagggccccctacttcttcggatgtgtttttaataatgtcagctatgtgccccatcctccttcatgccctccctccctttcctaccactgctgagtggcctggaacttgtttaaagtgtttattccccatttctttgagggatcaggaaggaatcctgggtatgccattgacttcccttctaagtagacagcaaaaatggcgggggtcgcaggaatctgcactcaactgcccacctggctggcagggatctttgaataggtatcttgagcttggttctgggctctttccttgtgtactgacgaccagggccagctgttctagagcgggaattagaggctagagcggctgaaatggttgtttggtgatgacactggggtccttccatctctggggcccactctcttctgtcttcccatgggaagtgccactgggatccctctgccctgtcctcctgaatacaagctgactgacattgactgtgtctgtggaaaatgggagctcttgttgtggagagcatagtaaattttcagagaacttgaagccaaaaggatttaaaaccgctgctctaaagaaaagaaaactggaggctgggcgcagtggctcacgcctataatcccagaggctgaggcaggcggatcacctgaggtcaggagttcaagatcagcctgaccaacatggagaaaccctactgaaaatacaaagttagccaggcatggtggtgcatgcctgtaatcccagctgctcaggagcctggcaacaagagcaaaactccagctcaaaaaaaaaaaagaaagaaaagaaagctggagctggtggcttaggccatcacccttcccttggctggaactactggacagacccttttgagatgtgcctgtggtgctgtggagatgtgtgtagtggtcttagctctttgttgagcttgtgtgtgtgttgtgtagtcttagctgtatgctgaaattgggcgtgtgttggagggcttcttagctctttggtgagattgtatttctatgtgtttgtatcagctgaatgttgctggaaataaaaccttggtttgtcaaggctcttttttgtgggaagtaagtaggggaaaaggtctttgagggttcctaggctcctttgtacaacaggaaaatgcctcaaagccttgcttcccagcaacctggggctggttcccagtgcctggtcctgccccttcctggttcttatctcaaggcagagcttctgaatttcaggccttcattccagagccctcttgtggccaggccttcctttgctggaggaaggtacacagggtgaagctgatgctgtacttgggggatctccttggcctgttccaccaagtgagagaaggtacttactcttgtacctcctgttcagccaggtgcattaacagacctccctacagctgtaggaactactgtcccagagctgaggcaaggggatttctcaggtcatttggagaacaagtgctttagtagtagtttaaagtagtaactgctactgtatttagtggggtggaattcagaagaaatttgaagaccagatcatgggtggtctgcatgtgaatgaacaggaatgagccggacagcctggctgtcattgctttcttcctccccatttggacccttctctgcccttacatttttgtttctccatctaccaccatccaccagtctatttattaacttagcaagaggacaagtaaagggccctcttggcttgattttgcttctttctttctgtggaggatatactaagtgcgactttgccctatcctatttggaaatccctaacagaattgagttttctattaaggatccaaaaagaaaaacaaaatgctaatgaagccatcagtcaagggtcacatgccaataaacaataaattttccagaagaaatgaaatccaactagacaaataaagtagagcttatgaaatggttcagtaaagatgagtttgttgttttttgttttgttttgttttgtttttttaaagacggagtctcgctctgtcacccaggctggagtgcagtggtatgatcttggctcactgtaacctccgcctcccgggttcaagccattctcctgcctcagtctcctgagtagctgggattgcgggtgcgtgccaccatgcctggctaatttttgtgtttttagtagagacagggtttcaccatgttggtcgggctggtctcagactcctgacctcttgatccgcctgccttggcctcccaaagtgatgggattacagatgtgagccaccgtgcctagccaaggatgagatttttaaagtatgtttcagttctgtgtcatggttggaagacagagtaggaaggatatggaaaaggtcatggggaagcagaggtgattcatggctctgtgaatttgaggtgaatggttccttattgtctaggccacttgtgaagaatatgagtcagttattgccagccttggaatttacttctctagcttacaatggaccttttgaactggaaaacaccttgtctgcattcactttaaaatgtcaaaactaatttttataataaatgtttattttcacattga

SEQ ID NO: 296355 - DNA, 3940 bp, Homo sapiens
aactttaggctaggtacgaggcctgggcgggccagggccgcactccggagactcgcggttgctacgcgcaccatggctggagaggcaggaccaaagtttctgcaggaccaaactgcaggtgcagttgcaccaagcaacttacattcaaacaaacacaaaaccccaagccaagccggtctccgtaaatcccacaccacgactgcctttcctacttcctccttagaggtacttctcagccctctagctccaactgagaacccagccagtcaggaagtcgctacttcgggaacaccaaccaatcagggggccgtcacctgctgaaggagtccttcggcggctgttgtgtcagtggcctgatcgcgatggggacaaaggcgcaagtcgagaggaaactgttgtgcctcttcatattggcgatcctgttgtgctccctggcattgggcagtgttacagtgcactcttctgaacctgaagtcagaattcctgagaataatcctgtgaagttgtcctgtgcctactcgggcttttcttctccccgtgtggagtggaagtttgaccaaggagacaccaccagactcgtttgctataataacaagatcacagcttcctatgaggaccgggtgaccttcttgccaactggtatcaccttcaagtccgtgacacgggaagacactgggacatacacttgtatggtctctgaggaaggcggcaacagctatggggaggtcaaggtcaagctcatcgtgcttgtgcctccatccaagcctacagttaacatcccctcctctgccaccattgggaaccgggcagtgctgacatgctcagaacaagatggttccccaccttctgaatacacctggttcaaagatgggatagtgatgcctacgaatcccaaaagcacccgtgccttcagcaactcttcctatgtcctgaatcccacaacaggagagctggtctttgatcccctgtcagcctctgatactggagaatacagctgtgaggcacggaatgggtatgggacacccatgacttcaaatgctgtgcgcatggaagctgtggagcggaatgtgggggtcatcgtggcagccgtccttgtaaccctgattctcctgggaatcttggtttttggcatctggtttgcctatagccgaggccactttgacagaacaaagaaagggacttcgagtaagaaggtgatttacagccagcctagtgcccgaagtgaaggagaattcaaacagacctcgtcattcctggtgtgagcctggtcggctcaccgcctatcatctgcatttgccttactcaggtgctaccggactctggcccctgatgtctgtagtttcacaggatgccttatttgtcttctacaccccacagggccccctacttcttcggatgtgtttttaataatgtcagctatgtgccccatcctccttcatgccctccctccctttcctaccactgctgagtggcctggaacttgtttaaagtgtttattccccatttctttgagggatcaggaaggaatcctgggtatgccattgacttcccttctaagtagacagcaaaaatggcgggggtcgcaggaatctgcactcaactgcccacctggctggcagggatctttgaataggtatcttgagcttggttctgggctctttccttgtgtactgacgaccagggccagctgttctagagcgggaattagaggctagagcggctgaaatggttgtttggtgatgacactggggtccttccatctctggggcccactctcttctgtcttcccatgggaagtgccactgggatccctctgccctgtcctcctgaatacaagctgactgacattgactgtgtctgtggaaaatgggagctcttgttgtggagagcatagtaaattttcagagaacttgaagccaaaaggatttaaaaccgctgctctaaagaaaagaaaactggaggctgggcgcagtggctcacgcctataatcccagaggctgaggcaggcggatcacctgaggtcaggagttcaagatcagcctgaccaacatggagaaaccctactgaaaatacaaagttagccaggcatggtggtgcatgcctgtaatcccagctgctcaggagcctggcaacaagagcaaaactccagctcaaaaaaaaaaaagaaagaaaagaaagctggagctggtggcttaggccatcacccttcccttggctggaactactggacagacccttttgagatgtgcctgtggtgctgtggagatgtgtgtagtggtcttagctctttgttgagcttgtgtgtgtgttgtgtagtcttagctgtatgctgaaattgggcgtgtgttggagggcttcttagctctttggtgagattgtatttctatgtgtttgtatcagctgaatgttgctggaaataaaaccttggtttgtcaaggctcttttttgtgggaagtaagtaggggaaaaggtctttgagggttcctaggctcctttgtacaacaggaaaatgcctcaaagccttgcttcccagcaacctggggctggttcccagtgcctggtcctgccccttcctggttcttatctcaaggcagagcttctgaatttcaggccttcattccagagccctcttgtggccaggccttcctttgctggaggaaggtacacagggtgaagctgatgctgtacttgggggatctccttggcctgttccaccaagtgagagaaggtacttactcttgtacctcctgttcagccaggtgcattaacagacctccctacagctgtaggaactactgtcccagagctgaggcaaggggatttctcaggtcatttggagaacaagtgctttagtagtagtttaaagtagtaactgctactgtatttagtggggtggaattcagaagaaatttgaagaccagatcatgggtggtctgcatgtgaatgaacaggaatgagccggacagcctggctgtcattgctttcttcctccccatttggacccttctctgcccttacatttttgtttctccatctaccaccatccaccagtctatttattaacttagcaagaggacaagtaaagggccctcttggcttgattttgcttctttctttctgtggaggatatactaagtgcgactttgccctatcctatttggaaatccctaacagaattgagttttctattaaggatccaaaaagaaaaacaaaatgctaatgaagccatcagtcaagggtcacatgccaataaacaataaattttccagaagaaatgaaatccaactagacaaataaagtagagcttatgaaatggttcagtaaagatgagtttgttgttttttgttttgttttgttttgtttttttaaagacggagtctcgctctgtcacccaggctggagtgcagtggtatgatcttggctcactgtaacctccgcctcccgggttcaagccattctcctgcctcagtctcctgagtagctgggattgcgggtgcgtgccaccatgcctggctaatttttgtgtttttagtagagacagggtttcaccatgttggtcgggctggtctcagactcctgacctcttgatccgcctgccttggcctcccaaagtgatgggattacagatgtgagccaccgtgcctagccaaggatgagatttttaaagtatgtttcagttctgtgtcatggttggaagacagagtaggaaggatatggaaaaggtcatggggaagcagaggtgattcatggctctgtgaatttgaggtgaatggttccttattgtctaggccacttgtgaagaatatgagtcagttattgccagccttggaatttacttctctagcttacaatggaccttttgaactggaaaacaccttgtctgcattcactttaaaatgtcaaaactaatttttataataaatgtttattttcacattga

SEQ ID NO: 296356 - DNA, 2492 bp, Homo sapiens
aactttaggctaggtacgaggcctgggcgggccagggccgcactccggagactcgcggttgctacgcgcaccatggctggagaggtacttctcagccctctagctccaactgagaacccagccagtcaggaagtcgctacttcgggaacaccaaccaatcagggggccgtcacctgctgaagggctggctctcagtcccctcgctgtagtcgcggagctgtgtctgttcccaggagtccttcggcggctgttgtgtcagtggcctgatcgcgatggggacaaaggcgcaagtcgagaggaaactgttgtgcctcttcatattggcgatcctgttgtgctccctggcattgggcagtgttacagtgcactcttctgaacctgaagtcagaattcctgagaataatcctgtgaagttgtcctgtgcctactcgggcttttcttctccccgtgtggagtggaagtttgaccaaggagacaccaccagactcgtttgctataataacaagatcacagcttcctatgaggaccgggtgaccttcttgccaactggtatcaccttcaagtccgtgacacgggaagacactgggacatacacttgtatggtctctgaggaaggcggcaacagctatggggaggtcaaggtcaagctcatcgtgcttgtgcctccatccaagcctacagttaacatcccctcctctgccaccattgggaaccgggcagtgctgacatgctcagaacaagatggttccccaccttctgaatacacctggttcaaagatgggatagtgatgcctacgaatcccaaaagcacccgtgccttcagcaactcttcctatgtcctgaatcccacaacaggagagctggtctttgatcccctgtcagcctctgatactggagaatacagctgtgaggcacggaatgggtatgggacacccatgacttcaaatgctgtgcgcatggaagctgtggagcggaatgtgggggtcatcgtggcagccgtccttgtaaccctgattctcctgggaatcttggtttttggcatctggtttgcctatagccgaggccactttgacagaacaaagaaagggacttcgagtaagaaggtgatttacagccagcctagtgcccgaagtgaaggagaattcaaacagacctcgtcattcctggtgtgagcctggtcggctcaccgcctatcatctgcatttgccttactcaggtgctaccggactctggcccctgatgtctgtagtttcacaggatgccttatttgtcttctacaccccacagggccccctacttcttcggatgtgtttttaataatgtcagctatgtgccccatcctccttcatgccctccctccctttcctaccactgctgagtggcctggaacttgtttaaagtgtttattccccatttctttgagggatcaggaaggaatcctgggtatgccattgacttcccttctaagtagacagcaaaaatggcgggggtcgcaggaatctgcactcaactgcccacctggctggcagggatctttgaataggtatcttgagcttggttctgggctctttccttgtgtactgacgaccagggccagctgttctagagcgggaattagaggctagagcggctgaaatggttgtttggtgatgacactggggtccttccatctctggggcccactctcttctgtcttcccatgggaagtgccactgggatccctctgccctgtcctcctgaatacaagctgactgacattgactgtgtctgtggaaaatgggagctcttgttgtggagagcatagtaaattttcagagaacttgaagccaaaaggatttaaaaccgctgctctaaagaaaagaaaactggaggctgggcgcagtggctcacgcctataatcccagaggctgaggcaggcggatcacctgaggtcaggagttcaagatcagcctgaccaacatggagaaaccctactgaaaatacaaagttagccaggcatggtggtgcatgcctgtaatcccagctgctcaggagcctggcaacaagagcaaaactccagctcaaaaaaaaaaaagaaagaaaagaaagctggagctggtggcttaggccatcacccttcccttggctggaactactggacagacccttttgagatgtgcctgtggtgctgtggagatgtgtgtagtggtcttagctctttgttgagcttgtgtgtgtgttgtgtagtcttagctgtatgctgaaattgggcgtgtgttggagggcttcttagctctttggtgagattgtatttctatgtgtttgtatcagctgaatgttgctggaaataaaaccttggtttgtcaaggctcttttttgtgggaagtaagtaggggaaaaggtctttgagggttcctaggctcctttggatttctatgtgtttgtatcagctgaatgttgctggaaataaaaccttggtttgtcaaggctcttttttgtcggaagtatgtagt

SEQ ID NO: 296357 - DNA, 3501 bp, Homo sapiens
cccatctcgtgtatttgctgctgttcttccttcggctcatttgaccctgtctgcagctgtgaagttgtcctgtgcctactcgggcttttcttctccccgtgtggagtggaagtttgaccaaggagacaccaccagactcgtttgctataataacaagatcacagcttcctatgaggaccgggtgaccttcttgccaactggtatcaccttcaagtccgtgacacgggaagacactgggacatacacttgtatggtctctgaggaaggcggcaacagctatggggaggtcaaggtcaagctcatcgtgcttgtgcctccatccaagcctacagttaacatcccctcctctgccaccattgggaaccgggcagtgctgacatgctcagaacaagatggttccccaccttctgaatacacctggttcaaagatgggatagtgatgcctacgaatcccaaaagcacccgtgccttcagcaactcttcctatgtcctgaatcccacaacaggagagctggtctttgatcccctgtcagcctctgatactggagaatacagctgtgaggcacggaatgggtatgggacacccatgacttcaaatgctgtgcgcatggaagctgtggagcggaatgtgggggtcatcgtggcagccgtccttgtaaccctgattctcctgggaatcttggtttttggcatctggtttgcctatagccgaggccactttgacagaacaaagaaagggacttcgagtaagaaggtgatttacagccagcctagtgcccgaagtgaaggagaattcaaacagacctcgtcattcctggtgtgagcctggtcggctcaccgcctatcatctgcatttgccttactcaggtgctaccggactctggcccctgatgtctgtagtttcacaggatgccttatttgtcttctacaccccacagggccccctacttcttcggatgtgtttttaataatgtcagctatgtgccccatcctccttcatgccctccctccctttcctaccactgctgagtggcctggaacttgtttaaagtgtttattccccatttctttgagggatcaggaaggaatcctgggtatgccattgacttcccttctaagtagacagcaaaaatggcgggggtcgcaggaatctgcactcaactgcccacctggctggcagggatctttgaataggtatcttgagcttggttctgggctctttccttgtgtactgacgaccagggccagctgttctagagcgggaattagaggctagagcggctgaaatggttgtttggtgatgacactggggtccttccatctctggggcccactctcttctgtcttcccatgggaagtgccactgggatccctctgccctgtcctcctgaatacaagctgactgacattgactgtgtctgtggaaaatgggagctcttgttgtggagagcatagtaaattttcagagaacttgaagccaaaaggatttaaaaccgctgctctaaagaaaagaaaactggaggctgggcgcagtggctcacgcctataatcccagaggctgaggcaggcggatcacctgaggtcaggagttcaagatcagcctgaccaacatggagaaaccctactgaaaatacaaagttagccaggcatggtggtgcatgcctgtaatcccagctgctcaggagcctggcaacaagagcaaaactccagctcaaaaaaaaaaaagaaagaaaagaaagctggagctggtggcttaggccatcacccttcccttggctggaactactggacagacccttttgagatgtgcctgtggtgctgtggagatgtgtgtagtggtcttagctctttgttgagcttgtgtgtgtgttgtgtagtcttagctgtatgctgaaattgggcgtgtgttggagggcttcttagctctttggtgagattgtatttctatgtgtttgtatcagctgaatgttgctggaaataaaaccttggtttgtcaaggctcttttttgtgggaagtaagtaggggaaaaggtctttgagggttcctaggctcctttgtacaacaggaaaatgcctcaaagccttgcttcccagcaacctggggctggttcccagtgcctggtcctgccccttcctggttcttatctcaaggcagagcttctgaatttcaggccttcattccagagccctcttgtggccaggccttcctttgctggaggaaggtacacagggtgaagctgatgctgtacttgggggatctccttggcctgttccaccaagtgagagaaggtacttactcttgtacctcctgttcagccaggtgcattaacagacctccctacagctgtaggaactactgtcccagagctgaggcaaggggatttctcaggtcatttggagaacaagtgctttagtagtagtttaaagtagtaactgctactgtatttagtggggtggaattcagaagaaatttgaagaccagatcatgggtggtctgcatgtgaatgaacaggaatgagccggacagcctggctgtcattgctttcttcctccccatttggacccttctctgcccttacatttttgtttctccatctaccaccatccaccagtctatttattaacttagcaagaggacaagtaaagggccctcttggcttgattttgcttctttctttctgtggaggatatactaagtgcgactttgccctatcctatttggaaatccctaacagaattgagttttctattaaggatccaaaaagaaaaacaaaatgctaatgaagccatcagtcaagggtcacatgccaataaacaataaattttccagaagaaatgaaatccaactagacaaataaagtagagcttatgaaatggttcagtaaagatgagtttgttgttttttgttttgttttgttttgtttttttaaagacggagtctcgctctgtcacccaggctggagtgcagtggtatgatcttggctcactgtaacctccgcctcccgggttcaagccattctcctgcctcagtctcctgagtagctgggattgcgggtgcgtgccaccatgcctggctaatttttgtgtttttagtagagacagggtttcaccatgttggtcgggctggtctcagactcctgacctcttgatccgcctgccttggcctcccaaagtgatgggattacagatgtgagccaccgtgcctagccaaggatgagatttttaaagtatgtttcagttctgtgtcatggttggaagacagagtaggaaggatatggaaaaggtcatggggaagcagaggtgattcatggctctgtgaatttgaggtgaatggttccttattgtctaggccacttgtgaagaatatgagtcagttattgccagccttggaatttacttctctagcttacaatggaccttttgaactggaaaacaccttgtctgcattcactttaaaatgtcaaaactaatttttataataaatgtttattttcacattga

SEQ ID NO: 296358 - DNA, 2648 bp, Homo sapiens
  misc_feature (2648)..(2648): n is a, c, g, or t
aactttaggctaggtacgaggcctgggcgggccagggccgcactccggagactcgcggttgctacgcgcaccatggctggagaggtacttctcagccctctagctccaactgagaacccagccagtcaggaagtcgctacttcgggaacaccaaccaatcagggggccgtcacctgctgaagggctggctctcagtcccctcgctgtagtcgcggagctgtgtctgttcccaggagtccttcggcggctgttgtgtcagtggcctgatcgcgatggggacaaaggcgcaagtcgagaggaaactgttgtgcctcttcatattggcgatcctgttgtgctccctggcattgggcagtgttacagtgcactcttctgaacctgaagtcagaattcctgagaataatcctgtgaagttgtcctgtgcctactcgggcttttcttctccccgtgtggagtggaagtttgaccaaggagacaccaccagactcgtttgctataataacaagatcacagcttcctatgaggaccgggtgaccttcttgccaactggtatcaccttcaagtccgtgacacgggaagacactgggacatacacttgtatggtctctgaggaaggcggcaacagctatggggaggtcaaggtcaagctcatcgtgcttgtgcctccatccaagcctacagttaacatcccctcctctgccaccattgggaaccgggcagtgctgacatgctcagaacaagatggttccccaccttctgaatacacctggttcaaagatgggatagtgatgcctacgaatcccaaaagcacccgtgccttcagcaactcttcctatgtcctgaatcccacaacaggagagctggtctttgatcccctgtcagcctctgatactggagaatacagctgtgaggcacggaatgggtatgggacacccatgacttcaaatgctgtgcgcatggaagctgtggagcggaatgtgggggtcatcgtggcagccgtccttgtaaccctgattctcctgggaatcttggtttttggcatctggtttgcctatagccgaggccactttgacagaacaaagaaagggacttcgagtaagaaggtgatttacagccagcctagtgcccgaagtgaaggagaattcaaacagacctcgtcattcctggtgtgagcctggtcggctcaccgcctatcatctgcatttgccttactcaggtgctaccggactctggcccctgatgtctgtagtttcacaggatgccttatttgtcttctacaccccacagggccccctacttcttcggatgtgtttttaataatgtcagctatgtgccccatcctccttcatgccctccctccctttcctaccactgctgagtggcctggaacttgtttaaagtgtttattccccatttctttgagggatcaggaaggaatcctgggtatgccattgacttcccttctaagtagacagcaaaaatggcgggggtcgcaggaatctgcactcaactgcccacctggctggcagggatctttgaataggtatcttgagcttggttctgggctctttccttgtgtactgacgaccagggccagctgttctagagcgggaattagaggctagagcggctgaaatggttgtttggtgatgacactggggtccttccatctctggggcccactctcttctgtcttcccatgggaagtgccactgggatccctctgccctgtcctcctgaatacaagctgactgacattgactgtgtctgtggaaaatgggagctcttgttgtggagagcatagtaaattttcagagaacttgaagccaaaaggatttaaaaccgctgctctaaagaaaagaaaactggaggctgggcgcagtggctcacgcctataatcccagaggctgaggcaggcggatcacctgaggtcaggagttcaagatcagcctgaccaacatggagaaaccctactgaaaatacaaagttagccaggcatggtggtgcatgcctgtaatcccagctgctcaggagcctggcaacaagagcaaaactccagctcaaaaaaaaaaaagaaagaaaagaaagctggagctggtggcttaggccatcacccttcccttggctggaactactggacagacccttttgagatgtgcctgtggtgctgtggagatgtgtgtagtggtcttagctctttgttgagcttgtgtgtgtgttgtgtagtcttagctgtatgctgaaattgggcgtgtgttggagggcttcttagctctttggtgagattgtatttctatgtgtttgtatcagctgaatgttgctggaaataaaaccttggtaaaaaaaaaaaaaaaaaaaaaaaaaaagggcggggagaacaaaaccaccggaggaggaccacatacatcacaccaagtctgttggaaggaagagaccaagaaagaaacacaaaacgaggcgggggccgaacaaacggtggggggaaacggtcgtgtctcggaaaaccctgctggggggcacagccaaccacacaaagagcgacgaaaaataagttggcgacaacctggcgtcaacgtccgttatatgagagtaataagaatagcaacgatgaaacacaaggcaaagagcacagacaactcacaggcagn

SEQ ID NO: 296359 - DNA, 3691 bp, Homo sapiens
gctagaccattgcgtatgtgtctcggtccccataagtccttcaacgtggttgctatgagctcgttgcctatggaatcatccatgggtcgatgacatagctgcttgtcgttcatcgaccatttatgtgactctctggatgagttgacgatccgtttttgtgactcactgcagaatggagctatctgtagagtcgatggcactgcgtatctgatcactgaggatctccaatccgcatgctcaatattcctgtgaagttgtcctgtgcctactcgggcttttcttctccccgtgtggagtggaagtttgaccaaggagacaccaccagactcgtttgctataataacaagatcacagcttcctatgaggaccgggtgaccttcttgccaactggtatcaccttcaagtccgtgacacgggaagacactgggacatacacttgtatggtctctgaggaaggcggcaacagctatggggaggtcaaggtcaagctcatcgtgcttgtgcctccatccaagcctacagttaacatcccctcctctgccaccattgggaaccgggcagtgctgacatgctcagaacaagatggttccccaccttctgaatacacctggttcaaagatgggatagtgatgcctacgaatcccaaaagcacccgtgccttcagcaactcttcctatgtcctgaatcccacaacaggagagctggtctttgatcccctgtcagcctctgatactggagaatacagctgtgaggcacggaatgggtatgggacacccatgacttcaaatgctgtgcgcatggaagctgtggagcggaatgtgggggtcatcgtggcagccgtccttgtaaccctgattctcctgggaatcttggtttttggcatctggtttgcctatagccgaggccactttgacagaacaaagaaagggacttcgagtaagaaggtgatttacagccagcctagtgcccgaagtgaaggagaattcaaacagacctcgtcattcctggtgtgagcctggtcggctcaccgcctatcatctgcatttgccttactcaggtgctaccggactctggcccctgatgtctgtagtttcacaggatgccttatttgtcttctacaccccacagggccccctacttcttcggatgtgtttttaataatgtcagctatgtgccccatcctccttcatgccctccctccctttcctaccactgctgagtggcctggaacttgtttaaagtgtttattccccatttctttgagggatcaggaaggaatcctgggtatgccattgacttcccttctaagtagacagcaaaaatggcgggggtcgcaggaatctgcactcaactgcccacctggctggcagggatctttgaataggtatcttgagcttggttctgggctctttccttgtgtactgacgaccagggccagctgttctagagcgggaattagaggctagagcggctgaaatggttgtttggtgatgacactggggtccttccatctctggggcccactctcttctgtcttcccatgggaagtgccactgggatccctctgccctgtcctcctgaatacaagctgactgacattgactgtgtctgtggaaaatgggagctcttgttgtggagagcatagtaaattttcagagaacttgaagccaaaaggatttaaaaccgctgctctaaagaaaagaaaactggaggctgggcgcagtggctcacgcctataatcccagaggctgaggcaggcggatcacctgaggtcaggagttcaagatcagcctgaccaacatggagaaaccctactgaaaatacaaagttagccaggcatggtggtgcatgcctgtaatcccagctgctcaggagcctggcaacaagagcaaaactccagctcaaaaaaaaaaaagaaagaaaagaaagctggagctggtggcttaggccatcacccttcccttggctggaactactggacagacccttttgagatgtgcctgtggtgctgtggagatgtgtgtagtggtcttagctctttgttgagcttgtgtgtgtgttgtgtagtcttagctgtatgctgaaattgggcgtgtgttggagggcttcttagctctttggtgagattgtatttctatgtgtttgtatcagctgaatgttgctggaaataaaaccttggtttgtcaaggctcttttttgtgggaagtaagtaggggaaaaggtctttgagggttcctaggctcctttgtacaacaggaaaatgcctcaaagccttgcttcccagcaacctggggctggttcccagtgcctggtcctgccccttcctggttcttatctcaaggcagagcttctgaatttcaggccttcattccagagccctcttgtggccaggccttcctttgctggaggaaggtacacagggtgaagctgatgctgtacttgggggatctccttggcctgttccaccaagtgagagaaggtacttactcttgtacctcctgttcagccaggtgcattaacagacctccctacagctgtaggaactactgtcccagagctgaggcaaggggatttctcaggtcatttggagaacaagtgctttagtagtagtttaaagtagtaactgctactgtatttagtggggtggaattcagaagaaatttgaagaccagatcatgggtggtctgcatgtgaatgaacaggaatgagccggacagcctggctgtcattgctttcttcctccccatttggacccttctctgcccttacatttttgtttctccatctaccaccatccaccagtctatttattaacttagcaagaggacaagtaaagggccctcttggcttgattttgcttctttctttctgtggaggatatactaagtgcgactttgccctatcctatttggaaatccctaacagaattgagttttctattaaggatccaaaaagaaaaacaaaatgctaatgaagccatcagtcaagggtcacatgccaataaacaataaattttccagaagaaatgaaatccaactagacaaataaagtagagcttatgaaatggttcagtaaagatgagtttgttgttttttgttttgttttgttttgtttttttaaagacggagtctcgctctgtcacccaggctggagtgcagtggtatgatcttggctcactgtaacctccgcctcccgggttcaagccattctcctgcctcagtctcctgagtagctgggattgcgggtgcgtgccaccatgcctggctaatttttgtgtttttagtagagacagggtttcaccatgttggtcgggctggtctcagactcctgacctcttgatccgcctgccttggcctcccaaagtgatgggattacagatgtgagccaccgtgcctagccaaggatgagatttttaaagtatgtttcagttctgtgtcatggttggaagacagagtaggaaggatatggaaaaggtcatggggaagcagaggtgattcatggctctgtgaatttgaggtgaatggttccttattgtctaggccacttgtgaagaatatgagtcagttattgccagccttggaatttacttctctagcttacaatggaccttttgaactggaaaacaccttgtctgcattcactttaaaatgtcaaaactaatttttataataaatgtttattttcacattga

SEQ ID NO: 296360 - DNA, 3251 bp, Homo sapiens
ctctagattggacaggcattccaccttgagtatgccagcttggctagctcatctgtgcttgtgcctccatccaagcctacagttaacatcccctcctctgccaccattgggaaccgggcagtgctgacatgctcagaacaagatggttccccaccttctgaatacacctggttcaaagatgggatagtgatgcctacgaatcccaaaagcacccgtgccttcagcaactcttcctatgtcctgaatcccacaacaggagagctggtctttgatcccctgtcagcctctgatactggagaatacagctgtgaggcacggaatgggtatgggacacccatgacttcaaatgctgtgcgcatggaagctgtggagcggaatgtgggggtcatcgtggcagccgtccttgtaaccctgattctcctgggaatcttggtttttggcatctggtttgcctatagccgaggccactttgacagaacaaagaaagggacttcgagtaagaaggtgatttacagccagcctagtgcccgaagtgaaggagaattcaaacagacctcgtcattcctggtgtgagcctggtcggctcaccgcctatcatctgcatttgccttactcaggtgctaccggactctggcccctgatgtctgtagtttcacaggatgccttatttgtcttctacaccccacagggccccctacttcttcggatgtgtttttaataatgtcagctatgtgccccatcctccttcatgccctccctccctttcctaccactgctgagtggcctggaacttgtttaaagtgtttattccccatttctttgagggatcaggaaggaatcctgggtatgccattgacttcccttctaagtagacagcaaaaatggcgggggtcgcaggaatctgcactcaactgcccacctggctggcagggatctttgaataggtatcttgagcttggttctgggctctttccttgtgtactgacgaccagggccagctgttctagagcgggaattagaggctagagcggctgaaatggttgtttggtgatgacactggggtccttccatctctggggcccactctcttctgtcttcccatgggaagtgccactgggatccctctgccctgtcctcctgaatacaagctgactgacattgactgtgtctgtggaaaatgggagctcttgttgtggagagcatagtaaattttcagagaacttgaagccaaaaggatttaaaaccgctgctctaaagaaaagaaaactggaggctgggcgcagtggctcacgcctataatcccagaggctgaggcaggcggatcacctgaggtcaggagttcaagatcagcctgaccaacatggagaaaccctactgaaaatacaaagttagccaggcatggtggtgcatgcctgtaatcccagctgctcaggagcctggcaacaagagcaaaactccagctcaaaaaaaaaaaagaaagaaaagaaagctggagctggtggcttaggccatcacccttcccttggctggaactactggacagacccttttgagatgtgcctgtggtgctgtggagatgtgtgtagtggtcttagctctttgttgagcttgtgtgtgtgttgtgtagtcttagctgtatgctgaaattgggcgtgtgttggagggcttcttagctctttggtgagattgtatttctatgtgtttgtatcagctgaatgttgctggaaataaaaccttggtttgtcaaggctcttttttgtgggaagtaagtaggggaaaaggtctttgagggttcctaggctcctttgtacaacaggaaaatgcctcaaagccttgcttcccagcaacctggggctggttcccagtgcctggtcctgccccttcctggttcttatctcaaggcagagcttctgaatttcaggccttcattccagagccctcttgtggccaggccttcctttgctggaggaaggtacacagggtgaagctgatgctgtacttgggggatctccttggcctgttccaccaagtgagagaaggtacttactcttgtacctcctgttcagccaggtgcattaacagacctccctacagctgtaggaactactgtcccagagctgaggcaaggggatttctcaggtcatttggagaacaagtgctttagtagtagtttaaagtagtaactgctactgtatttagtggggtggaattcagaagaaatttgaagaccagatcatgggtggtctgcatgtgaatgaacaggaatgagccggacagcctggctgtcattgctttcttcctccccatttggacccttctctgcccttacatttttgtttctccatctaccaccatccaccagtctatttattaacttagcaagaggacaagtaaagggccctcttggcttgattttgcttctttctttctgtggaggatatactaagtgcgactttgccctatcctatttggaaatccctaacagaattgagttttctattaaggatccaaaaagaaaaacaaaatgctaatgaagccatcagtcaagggtcacatgccaataaacaataaattttccagaagaaatgaaatccaactagacaaataaagtagagcttatgaaatggttcagtaaagatgagtttgttgttttttgttttgttttgttttgtttttttaaagacggagtctcgctctgtcacccaggctggagtgcagtggtatgatcttggctcactgtaacctccgcctcccgggttcaagccattctcctgcctcagtctcctgagtagctgggattgcgggtgcgtgccaccatgcctggctaatttttgtgtttttagtagagacagggtttcaccatgttggtcgggctggtctcagactcctgacctcttgatccgcctgccttggcctcccaaagtgatgggattacagatgtgagccaccgtgcctagccaaggatgagatttttaaagtatgtttcagttctgtgtcatggttggaagacagagtaggaaggatatggaaaaggtcatggggaagcagaggtgattcatggctctgtgaatttgaggtgaatggttccttattgtctaggccacttgtgaagaatatgagtcagttattgccagccttggaatttacttctctagcttacaatggaccttttgaactggaaaacaccttgtctgcattcactttaaaatgtcaaaactaatttttataataaatgtttattttcacattga

SEQ ID NO: 296361 - DNA, 2927 bp, Homo sapiens
  misc_feature (38)..(40): n is a, c, g, or t
tgaaggtactctagaggatcgtatgcggtgcgcatggnnnctgtggagcggaatgtgggggtcatcgtggcagccgtccttgtaaccctgattctcctgggaatcttggtttttggcatctggtttgcctatagccgaggccactttgacagaacaaagaaagggacttcgagtaagaaggtgatttacagccagcctagtgcccgaagtgaaggagaattcaaacagacctcgtcattcctggtgtgagcctggtcggctcaccgcctatcatctgcatttgccttactcaggtgctaccggactctggcccctgatgtctgtagtttcacaggatgccttatttgtcttctacaccccacagggccccctacttcttcggatgtgtttttaataatgtcagctatgtgccccatcctccttcatgccctccctccctttcctaccactgctgagtggcctggaacttgtttaaagtgtttattccccatttctttgagggatcaggaaggaatcctgggtatgccattgacttcccttctaagtagacagcaaaaatggcgggggtcgcaggaatctgcactcaactgcccacctggctggcagggatctttgaataggtatcttgagcttggttctgggctctttccttgtgtactgacgaccagggccagctgttctagagcgggaattagaggctagagcggctgaaatggttgtttggtgatgacactggggtccttccatctctggggcccactctcttctgtcttcccatgggaagtgccactgggatccctctgccctgtcctcctgaatacaagctgactgacattgactgtgtctgtggaaaatgggagctcttgttgtggagagcatagtaaattttcagagaacttgaagccaaaaggatttaaaaccgctgctctaaagaaaagaaaactggaggctgggcgcagtggctcacgcctataatcccagaggctgaggcaggcggatcacctgaggtcaggagttcaagatcagcctgaccaacatggagaaaccctactgaaaatacaaagttagccaggcatggtggtgcatgcctgtaatcccagctgctcaggagcctggcaacaagagcaaaactccagctcaaaaaaaaaaaagaaagaaaagaaagctggagctggtggcttaggccatcacccttcccttggctggaactactggacagacccttttgagatgtgcctgtggtgctgtggagatgtgtgtagtggtcttagctctttgttgagcttgtgtgtgtgttgtgtagtcttagctgtatgctgaaattgggcgtgtgttggagggcttcttagctctttggtgagattgtatttctatgtgtttgtatcagctgaatgttgctggaaataaaaccttggtttgtcaaggctcttttttgtgggaagtaagtaggggaaaaggtctttgagggttcctaggctcctttgtacaacaggaaaatgcctcaaagccttgcttcccagcaacctggggctggttcccagtgcctggtcctgccccttcctggttcttatctcaaggcagagcttctgaatttcaggccttcattccagagccctcttgtggccaggccttcctttgctggaggaaggtacacagggtgaagctgatgctgtacttgggggatctccttggcctgttccaccaagtgagagaaggtacttactcttgtacctcctgttcagccaggtgcattaacagacctccctacagctgtaggaactactgtcccagagctgaggcaaggggatttctcaggtcatttggagaacaagtgctttagtagtagtttaaagtagtaactgctactgtatttagtggggtggaattcagaagaaatttgaagaccagatcatgggtggtctgcatgtgaatgaacaggaatgagccggacagcctggctgtcattgctttcttcctccccatttggacccttctctgcccttacatttttgtttctccatctaccaccatccaccagtctatttattaacttagcaagaggacaagtaaagggccctcttggcttgattttgcttctttctttctgtggaggatatactaagtgcgactttgccctatcctatttggaaatccctaacagaattgagttttctattaaggatccaaaaagaaaaacaaaatgctaatgaagccatcagtcaagggtcacatgccaataaacaataaattttccagaagaaatgaaatccaactagacaaataaagtagagcttatgaaatggttcagtaaagatgagtttgttgttttttgttttgttttgttttgtttttttaaagacggagtctcgctctgtcacccaggctggagtgcagtggtatgatcttggctcactgtaacctccgcctcccgggttcaagccattctcctgcctcagtctcctgagtagctgggattgcgggtgcgtgccaccatgcctggctaatttttgtgtttttagtagagacagggtttcaccatgttggtcgggctggtctcagactcctgacctcttgatccgcctgccttggcctcccaaagtgatgggattacagatgtgagccaccgtgcctagccaaggatgagatttttaaagtatgtttcagttctgtgtcatggttggaagacagagtaggaaggatatggaaaaggtcatggggaagcagaggtgattcatggctctgtgaatttgaggtgaatggttccttattgtctaggccacttgtgaagaatatgagtcagttattgccagccttggaatttacttctctagcttacaatggaccttttgaactggaaaacaccttgtctgcattcactttaaaatgtcaaaactaatttttataataaatgtttattttcacattga

SEQ ID NO: 296362 - DNA, 2786 bp, Homo sapiens
aactttaggctaggtacgaggcctgggcgggccagggccgcactccggagactcgcggttgctacgcgcaccatggctggagaggtacttctcagccctctagctccaactgagaacccagccagtcaggaagtcgctacttcgggaacaccaaccaatcagggggccgtcacctgctgaagggctggctctcagtcccctcgctgtagtcgcggagctgtgtctgttcccaggagtccttcggcggctgttgtgtcagtggcctgatcgcgatggggacaaaggcgcaagtcgagaggaaactgttgtgcctcttcatattggcgatcctgttgtgctccctggcattgggcagtgttacagtgcactcttctgaacctgaagtcagaattcctgagaataatcctgtgaagttgtcctgtgcctactcgggcttttcttctccccgtgtggagtggaagtttgaccaaggagacaccaccagactcgtttgctataataacaagatcacagcttcctatgaggaccgggtgaccttcttgccaactggtatcaccttcaagtccgtgacacgggaagacactgggacatacacttgtatggtctctgaggaaggcggcaacagctatggggaggtcaaggtcaagctcatcgtgcttgtgcctccatccaagcctacagttaacatcccctcctctgccaccattgggaaccgggcagtgctgacatgctcagaacaagatggttccccaccttctgaatacacctggttcaaagatgggatagtgatgcctacgaatcccaaaagcacccgtgccttcagcaactcttcctatgtcctgaatcccacaacaggagagctggtctttgatcccctgtcagcctctgatactggagaatacagctgtgaggcacggaatgggtatgggacacccatgacttcaaatgctgtgcgcatggaagctgtggagcggaatgtgggggtcatcgtggcagccgtccttgtaaccctgattctcctgggaatcttggtttttggcatctggtttgcctatagccgaggccactttgacagaacaaagaaagggacttcgagtaagaaggtgatttacagccagcctagtgcccgaagtgaaggagaattcaaacagacctcgtcattcctggtgtgagcctggtcggctcaccgcctatcatctgcatttgccttactcaggtgctaccggactctggcccctgatgtctgtagtttcacaggatgccttatttgtcttctacaccccacagggccccctacttcttcggatgtgtttttaataatgtcagctatgtgccccatcctccttcatgccctccctccctttcctaccactgctgagtggcctggaacttgtttaaagtgtttattccccatttctttgagggatcaggaaggaatcctgggtatgccattgacttcccttctaagtagacagcaaaaatggcgggggtcgcaggaatctgcactcaactgcccacctggctggcagggatctttgaataggtatcttgagcttggttctgggctctttccttgtgtactgacgaccagggccagctgttctagagcgggaattagaggctagagcgctgtaggaactactgtcccagagctgaggcaaggggatttctcaggtcatttggagaacaagtgctttagtagtagtttaaagtagtaactgctactgtatttagtggggtggaattcagaagaaatttgaagaccagatcatgggtggtctgcatgtgaatgaacaggaatgagccggacagcctggctgtcattgctttcttcctccccatttggacccttctctgcccttacatttttgtttctccatctaccaccatccaccagtctatttattaacttagcaagaggacaagtaaagggccctcttggcttgattttgcttctttctttctgtggaggatatactaagtgcgactttgccctatcctatttggaaatccctaacagaattgagttttctattaaggatccaaaaagaaaaacaaaatgctaatgaagccatcagtcaagggtcacatgccaataaacaataaattttccagaagaaatgaaatccaactagacaaataaagtagagcttatgaaatggttcagtaaagatgagtttgttgttttttgttttgttttgttttgtttttttaaagacggagtctcgctctgtcacccaggctggagtgcagtggtatgatcttggctcactgtaacctccgcctcccgggttcaagccattctcctgcctcagtctcctgagtagctgggattgcgggtgcgtgccaccatgcctggctaatttttgtgtttttagtagagacagggtttcaccatgttggtcgggctggtctcagactcctgacctcttgatccgcctgccttggcctcccaaagtgatgggattacagatgtgagccaccgtgcctagccaaggatgagatttttaaagtatgtttcagttctgtgtcatggttggaagacagagtaggaaggatatggaaaaggtcatggggaagcagaggtgattcatggctctgtgaatttgaggtgaatggttccttattgtctaggccacttgtgaagaatatgagtcagttattgccagccttggaatttacttctctagcttacaatggaccttttgaactggaaaacaccttgtctgcattcactttaaaatgtcaaaactaatttttataataaatgtttattttcacattga

SEQ ID NO: 296363 - DNA, 2196 bp, Homo sapiens
aactttaggctaggtacgaggcctgggcgggccagggccgcactccggagactcgcggttgctacgcgcaccatggctggagaggtacttctcagccctctagctccaactgagaacccagccagtcaggaagtcgctacttcgggaacaccaaccaatcagggggccgtcacctgctgaagggctggctctcagtcccctcgctgtagtcgcggagctgtgtctgttcccaggagtccttcggcggctgttgtgtcagtggcctgatcgcgatggggacaaaggcgcaagtcgagaggaaactgttgtgcctcttcatattggcgatcctgttgtgctccctggcattgggcagtgttacagtgcactcttctgaacctgaagtcagaattcctgagaataatcctgtgaagttgtcctgtgcctactcgggcttttcttctccccgtgtggagtggaagtttgaccaaggagacaccaccagactcgtttgctataataacaagatcacagcttcctatgaggaccgggtgaccttcttgccaactggtatcaccttcaagtccgtgacacgggaagacactgggacatacacttgtatggtctctgaggaaggcggcaacagctatggggaggtcaaggtcaagctcatcgtgcttgtgcctccatccaagcctacagttaacatcccctcctctgccaccattgggaaccgggcagtgctgacatgctcagaacaagatggttccccaccttctgaatacacctggttcaaagatgggatagtgatgcctacgaatcccaaaagcacccgtgccttcagcaactcttcctatgtcctgaatcccacaacaggagagctggtctttgatcccctgtcagcctctgatactggagaatacagctgtgaggcacggaatgggtatgggacacccatgacttcaaatgctgtgcgcatggaagctgtggagcggaatgtgggggtcatcgtggcagccgtccttgtaaccctgattctcctgggaatcttggtttttggcatctggtttgcctatagccgaggccactttgacagaacaaagaaagggacttcgagtaagaaggtgatttacagccagcctagtgcccgaagtgaaggagaattcaaacagacctcgtcattcctggtgtgagcctggtcggctcaccgcctatcatctgcatttgccttactcaggtgctaccggactctggcccctgatgtctgtagtttcacaggatgccttatttgtcttctacaccccacagggccccctacttcttcggatgtgtttttaataatgtcagctatgtgccccatcctccttcatgccctccctccctttcctaccactgctgagtggcctggaacttgtttaaagtgtttattccccatttctttgagggatcaggaaggaatcctgggtatgccattgacttcccttctaagtagacagcaaaaatggcgggggtcgcaggaatctgcactcaactgcccacctggctggcagggatctttgaataggtatcttgagcttggttctgggctctttccttgtgtactgacgaccagggccagctgttctagagcgggaattagaggctagagcggctgaaatggttgtttggtgatgacactggggtccttccatctctggggcccactctcttctgtcttcccatgggaagtgccactgggatccctctgccctgtcctcctgaatacaagctgactgacattgactgtgtctgtggaaaatgggagctcttgttgtggagagcatagtaaattttcagagaacttgaagccaaaaggatttaaaaccgccgcctgccttggcctcccaaagtgatgggattacagatgtgagccaccgtgcctagccaaggatgagatttttaaagtatgtttcagttctgtgtcatggttggaagacagagtaggaaggatatggaaaaggtcatggggaagcagaggtgattcatggctctgtgaatttgaggtgaatggttccttattgtctaggccacttgtgaagaatatgagtcagttattgccagccttggaatttacttctctagcttacaatggaccttttgaactggaaaacaccttgtctgcattcactttaaaatgtcaaaactaatttttataataaatgtttattttcacattga

SEQ ID NO: 296364 - DNA, 2314 bp, Homo sapiens
aactttaggctaggtacgaggcctgggcgggccagggccgcactccggagactcgcggttgctacgcgcaccatggctggagaggtacttctcagccctctagctccaactgagaacccagccagtcaggaagtcgctacttcgggaacaccaaccaatcagggggccgtcacctgctgaagggctggctctcagtcccctcgctgtagtcgcggagctgtgtctgttcccaggagtccttcggcggctgttgtgtcagtggcctgatcgcgatggggacaaaggcgcaagtcgagaggaaactgttgtgcctcttcatattggcgatcctgttgtgctccctggcattgggcagtgttacagtgcactcttctgaacctgaagtcagaattcctgagaataatcctgtgaagttgtcctgtgcctactcgggcttttcttctccccgtgtggagtggaagtttgaccaaggagacaccaccagactcgtttgctataataacaagatcacagcttcctatgaggaccgggtgaccttcttgccaactggtatcaccttcaagtccgtgacacgggaagacactgggacatacacttgtatggtctctgaggaaggcggcaacagctatggggaggtcaaggtcaagctcatcgtgcttgtgcctccatccaagcctacagttaacatcccctcctctgccaccattgggaaccgggcagtgctgacatgctcagaacaagatggttccccaccttctgaatacacctggttcaaagatgggatagtgatgcctacgaatcccaaaagcacccgtgccttcagcaactcttcctatgtcctgaatcccacaacaggagagctggtctttgatcccctgtcagcctctgatactggagaatacagctgtgaggcacggaatgggtatgggacacccatgacttcaaatgctgtgcgcatggaagctgtggagcggaatgtgggggtcatcgtggcagccgtccttgtaaccctgattctcctgggaatcttggtttttggcatctggtttgcctatagccgaggccactttgacagaacaaagaaagggacttcgagtaagaaggtgatttacagccagcctagtgcccgaagtgaaggagaattcaaacagacctcgtcattcctggtgtgagcctggtcggctcaccgcctatcatctgcatttgccttactcaggtgctaccggactctggcccctgatgtctgtagtttcacaggatgccttatttgtcttctacaccccacagggccccctacttcttcggatgtgtttttaataatgtcagctatgtgccccatcctccttcatgccctccctccctttcctaccactgctgagtggcctggaacttgtttaaagtgtttattccccatttctttgagggatcaggaaggaatcctgggtatgccattgacttcccttctaagtagacagcaaaaatggcgggggtcgcaggaatctgcactcaactgcccacctggctggcagggatctttgaataggtatcttgagcttggttctgggctctttccttgtgtactgacgaccagggccagctgttctagagcgggaattagaggctagagcggctgaaatggttgtttggtgatgacactggggtccttccatctctggggcccactctcttctgtcttcccatgggaagtgccactgggatccctctgccctgtcctcctgaatacaagctgactgacattgactgtgtctgtggaaaatgggagctcttgttgtggagagcatagtaaattttcagagaacttgaagccaaaaggatttaaaaccgctgctctaaagaaaagaaaactggaggctgggcgcagtggctcacgcctataatcccagaggctgaggcaggcggatcacctgaggtcgggctggtctcagactcctgacctcttgatccgcctgccttggcctcccaaagtgatgggattacagatgtgagccaccgtgcctagccaaggatgagatttttaaagtatgtttcagttctgtgtcatggttggaagacagagtaggaaggatatggaaaaggtcatggggaagcagaggtgattcatggctctgtgaatttgaggtgaatggttccttattgtctaggccacttgtgaagaatatgagtcagttattgccagccttggaatttacttctctagcttacaatggaccttttgaactggaaaacaccttgtctgcattcactttaaaatgtcaaaactaatttttataataaatgtttattttcacattga

SEQ ID NO: 296365 - DNA, 2243 bp, Homo sapiens
aactttaggctaggtacgaggcctgggcgggccagggccgcactccggagactcgcggttgctacgcgcaccatggctggagaggtacttctcagccctctagctccaactgagaacccagccagtcaggaagtcgctacttcgggaacaccaaccaatcagggggccgtcacctgctgaagggctggctctcagtcccctcgctgtagtcgcggagctgtgtctgttcccaggagtccttcggcggctgttgtgtcagtggcctgatcgcgatggggacaaaggcgcaagtcgagaggaaactgttgtgcctcttcatattggcgatcctgttgtgctccctggcattgggcagtgttacagtgcactcttctgaacctgaagtcagaattcctgagaataatcctgtgaagttgtcctgtgcctactcgggcttttcttctccccgtgtggagtggaagtttgaccaaggagacaccaccagactcgtttgctataataacaagatcacagcttcctatgaggaccgggtgaccttcttgccaactggtatcaccttcaagtccgtgacacgggaagacactgggacatacacttgtatggtctctgaggaaggcggcaacagctatggggaggtcaaggtcaagctcatcgtgcttgtgcctccatccaagcctacagttaacatcccctcctctgccaccattgggaaccgggcagtgctgacatgctcagaacaagatggttccccaccttctgaatacacctggttcaaagatgggatagtgatgcctacgaatcccaaaagcacccgtgccttcagcaactcttcctatgtcctgaatcccacaacaggagagctggtctttgatcccctgtcagcctctgatactggagaatacagctgtgaggcacggaatgggtatgggacacccatgacttcaaatgctgtgcgcatggaagctgtggagcggaatgtgggggtcatcgtggcagccgtccttgtaaccctgattctcctgggaatcttggtttttggcatctggtttgcctatagccgaggccactttgacagaacaaagaaagggacttcgagtaagaaggtgatttacagccagcctagtgcccgaagtgaaggagaattcaaacagacctcgtcattcctggtgtgagcctggtcggctcaccgcctatcatctgcatttgccttactcaggtgctaccggactctggcccctgatgtctgtagtttcacaggatgccttatttgtcttctacaccccacagggccccctacttcttcggatgtgtttttaataatgtcagctatgtgccccatcctccttcatgccctccctccctttcctaccactgctgagtggcctggaacttgtttaaagtgtttattccccatttctttgagggatcaggaaggaatcctgggtatgccattgacttcccttctaagtagacagcaaaaatggcgggggtcgcaggaatctgcactcaactgcccacctggctggcagggatctttgaataggtatcttgagcttggttctgggctctttccttgtgtactgacgaccagggccagctgttctagagcgggaattagaggctagagcggctgaaatggttgtttggtgatgacactggggtccttccatctctggggcccactctcttctgtcttcccatgggaagtgccactgggatccctctgccctgtcctcctgaatacaagctgactgacattgactgtgtctgtggaaaatgggagctcttgttgtggagagcatagtaaattttcagagaacttgaagccaaaaggatttaaaaccgctgctctaaagaaaagaaaactggaggctgggcgcagtggctcacgcccgcctgccttggcctcccaaagtgatgggattacagatgtgagccaccgtgcctagccaaggatgagatttttaaagtatgtttcagttctgtgtcatggttggaagacagagtaggaaggatatggaaaaggtcatggggaagcagaggtgattcatggctctgtgaatttgaggtgaatggttccttattgtctaggccacttgtgaagaatatgagtcagttattgccagccttggaatttacttctctagcttacaatggaccttttgaactggaaaacaccttgtctgcattcactttaaaatgtcaaaactaatttttataataaatgtttattttcacattga

SEQ ID NO: 296366 - DNA, 2381 bp, Homo sapiens
aactttaggctaggtacgaggcctgggcgggccagggccgcactccggagactcgcggttgctacgcgcaccatggctggagaggtacttctcagccctctagctccaactgagaacccagccagtcaggaagtcgctacttcgggaacaccaaccaatcagggggccgtcacctgctgaagggctggctctcagtcccctcgctgtagtcgcggagctgtgtctgttcccaggagtccttcggcggctgttgtgtcagtggcctgatcgcgatggggacaaaggcgcaagtcgagaggaaactgttgtgcctcttcatattggcgatcctgttgtgctccctggcattgggcagtgttacagtgcactcttctgaacctgaagtcagaattcctgagaataatcctgtgaagttgtcctgtgcctactcgggcttttcttctccccgtgtggagtggaagtttgaccaaggagacaccaccagactcgtttgctataataacaagatcacagcttcctatgaggaccgggtgaccttcttgccaactggtatcaccttcaagtccgtgacacgggaagacactgggacatacacttgtatggtctctgaggaaggcggcaacagctatggggaggtcaaggtcaagctcatcgtgcttgtgcctccatccaagcctacagttaacatcccctcctctgccaccattgggaaccgggcagtgctgacatgctcagaacaagatggttccccaccttctgaatacacctggttcaaagatgggatagtgatgcctacgaatcccaaaagcacccgtgccttcagcaactcttcctatgtcctgaatcccacaacaggagagctggtctttgatcccctgtcagcctctgatactggagaatacagctgtgaggcacggaatgggtatgggacacccatgacttcaaatgctgtgcgcatggaagctgtggagcggaatgtgggggtcatcgtggcagccgtccttgtaaccctgattctcctgggaatcttggtttttggcatctggtttgcctatagccgaggccactttgacagaacaaagaaagggacttcgagtaagaaggtgatttacagccagcctagtgcccgaagtgaaggagaattcaaacagacctcgtcattcctggtgtgagcctggtcggctcaccgcctatcatctgcatttgccttactcaggtgctaccggactctggcccctgatgtctgtagtttcacaggatgccttatttgtcttctacaccccacagggccccctacttcttcggatgtgtttttaataatgtcagctatgtgccccatcctccttcatgccctccctccctttcctaccactgctgagtggcctggaacttgtttaaagtgtttattccccatttctttgagggatcaggaaggaatcctgggtatgccattgacttcccttctaagtagacagcaaaaatggcgggggtcgcaggaatctgcactcaactgcccacctggctggcagggatctttgaataggtatcttgagcttggttctgggctctttccttgtgtactgacgaccagggccagctgttctagagcgggaattagaggctagagcggctgaaatggttgtttggtgatgacactggggtccttccatctctggggcccactctcttctgtcttcccatgggaagtgccactgggatccctctgccctgtcctcctgaatacaagctgactgacattgactgtgtctgtggaaaatgggagctcttgttgtggagagcatagtaaattttcagagaacttgaagccaaaaggatttaaaaccgctgctctaaagaaaagaaaactggaggctgggcgcagtggctcacgcctataatcccagaggctgaggcaggcggatcacctgaggtcaggagttcaagatcagcctgaccaacatggagaaaccctactgaaaatacaaagttagccaggcatggtggtgcatgcctgtaatcccagctgctcaggagcctggcaacaagagcaaaatgatgggattacagatgtgagccaccgtgcctagccaaggatgagatttttaaagtatgtttcagttctgtgtcatggttggaagacagagtaggaaggatatggaaaaggtcatggggaagcagaggtgattcatggctctgtgaatttgaggtgaatggttccttattgtctaggccacttgtgaagaatatgagtcagttattgccagccttggaatttacttctctagcttacaatggaccttttgaactggaaaacaccttgtctgcattcactttaaaatgtcaaaactaatttttataataaatgtttattttcacattga

SEQ ID NO: 296367 - DNA, 2148 bp, Homo sapiens
aactttaggctaggtacgaggcctgggcgggccagggccgcactccggagactcgcggttgctacgcgcaccatggctggagaggtacttctcagccctctagctccaactgagaacccagccagtcaggaagtcgctacttcgggaacaccaaccaatcagggggccgtcacctgctgaagggctggctctcagtcccctcgctgtagtcgcggagctgtgtctgttcccaggagtccttcggcggctgttgtgtcagtggcctgatcgcgatggggacaaaggcgcaagtcgagaggaaactgttgtgcctcttcatattggcgatcctgttgtgctccctggcattgggcagtgttacagtgcactcttctgaacctgaagtcagaattcctgagaataatcctgtgaagttgtcctgtgcctactcgggcttttcttctccccgtgtggagtggaagtttgaccaaggagacaccaccagactcgtttgctataataacaagatcacagcttcctatgaggaccgggtgaccttcttgccaactggtatcaccttcaagtccgtgacacgggaagacactgggacatacacttgtatggtctctgaggaaggcggcaacagctatggggaggtcaaggtcaagctcatcgtgcttgtgcctccatccaagcctacagttaacatcccctcctctgccaccattgggaaccgggcagtgctgacatgctcagaacaagatggttccccaccttctgaatacacctggttcaaagatgggatagtgatgcctacgaatcccaaaagcacccgtgccttcagcaactcttcctatgtcctgaatcccacaacaggagagctggtctttgatcccctgtcagcctctgatactggagaatacagctgtgaggcacggaatgggtatgggacacccatgacttcaaatgctgtgcgcatggaagctgtggagcggaatgtgggggtcatcgtggcagccgtccttgtaaccctgattctcctgggaatcttggtttttggcatctggtttgcctatagccgaggccactttgacagaacaaagaaagggacttcgagtaagaaggtgatttacagccagcctagtgcccgaagtgaaggagaattcaaacagacctcgtcattcctggtgtgagcctggtcggctcaccgcctatcatctgcatttgccttactcaggtgctaccggactctggcccctgatgtctgtagtttcacaggatgccttatttgtcttctacaccccacagggccccctacttcttcggatgtgtttttaataatgtcagctatgtgccccatcctccttcatgccctccctccctttcctaccactgctgagtggcctggaacttgtttaaagtgtttattccccatttctttgagggatcaggaaggaatcctgggtatgccattgacttcccttctaagtagacagcaaaaatggcgggggtcgcaggaatctgcactcaactgcccacctggctggcagggatctttgaataggtatcttgagcttggttctgggctctttccttgtgtactgacgaccagggccagctgttctagagcgggaattagaggctagagcggctgaaatggttgtttggtgatgacactggggtccttccatctctggggcccactctcttctgtcttcccatgggaagtgccactgggatccctctgccctgtcctcctgaatacaagctgactgacattgactgtgtctgtggaaaatgggagctcttgttgtggagagcatagtaaattttcagagaacttgaagccaaaaggatttaaaaccgcgtgcctagccaaggatgagatttttaaagtatgtttcagttctgtgtcatggttggaagacagagtaggaaggatatggaaaaggtcatggggaagcagaggtgattcatggctctgtgaatttgaggtgaatggttccttattgtctaggccacttgtgaagaatatgagtcagttattgccagccttggaatttacttctctagcttacaatggaccttttgaactggaaaacaccttgtctgcattcactttaaaatgtcaaaactaatttttataataaatgtttattttcacattga

SEQ ID NO: 296368 - DNA, 2230 bp, Homo sapiens
  misc_feature (40)..(40): n is a, c, g, or t
acaagctgactgacattgactgtgtctgtggaaaatggangctcttgttgtggagagcatagtaaattttcagagaacttgaagcgaaaaggatttaaaaccgctgccctgtcctcctgaatacaagctgactgacattgactgtgtctgtggaaaatgggagctcttgttgtggagagcatagtaaattttcagagaacttgaagccaaaaggatttaaaaccgctgctctaaagaaaagaaaactggaggctgggcgcagtggctcacgcctataatcccagaggctgaggcaggcggatcacctgaggtcaggagttcaagatcagcctgaccaacatggagaaaccctactgaaaatacaaagttagccaggcatggtggtgcatgcctgtaatcccagctgctcaggagcctggcaacaagagcaaaactccagctcaaaaaaaaaaaagaaagaaaagaaagctggagctggtggcttaggccatcacccttcccttggctggaactactggacagacccttttgagatgtgcctgtggtgctgtggagatgtgtgtagtggtcttagctctttgttgagcttgtgtgtgtgttgtgtagtcttagctgtatgctgaaattgggcgtgtgttggagggcttcttagctctttggtgagattgtatttctatgtgtttgtatcagctgaatgttgctggaaataaaaccttggtttgtcaaggctcttttttgtgggaagtaagtaggggaaaaggtctttgagggttcctaggctcctttgtacaacaggaaaatgcctcaaagccttgcttcccagcaacctggggctggttcccagtgcctggtcctgccccttcctggttcttatctcaaggcagagcttctgaatttcaggccttcattccagagccctcttgtggccaggccttcctttgctggaggaaggtacacagggtgaagctgatgctgtacttgggggatctccttggcctgttccaccaagtgagagaaggtacttactcttgtacctcctgttcagccaggtgcattaacagacctccctacagctgtaggaactactgtcccagagctgaggcaaggggatttctcaggtcatttggagaacaagtgctttagtagtagtttaaagtagtaactgctactgtatttagtggggtggaattcagaagaaatttgaagaccagatcatgggtggtctgcatgtgaatgaacaggaatgagccggacagcctggctgtcattgctttcttcctccccatttggacccttctctgcccttacatttttgtttctccatctaccaccatccaccagtctatttattaacttagcaagaggacaagtaaagggccctcttggcttgattttgcttctttctttctgtggaggatatactaagtgcgactttgccctatcctatttggaaatccctaacagaattgagttttctattaaggatccaaaaagaaaaacaaaatgctaatgaagccatcagtcaagggtcacatgccaataaacaataaattttccagaagaaatgaaatccaactagacaaataaagtagagcttatgaaatggttcagtaaagatgagtttgttgttttttgttttgttttgttttgtttttttaaagacggagtctcgctctgtcacccaggctggagtgcagtggtatgatcttggctcactgtaacctccgcctcccgggttcaagccattctcctgcctcagtctcctgagtagctgggattgcgggtgcgtgccaccatgcctggctaatttttgtgtttttagtagagacagggtttcaccatgttggtcgggctggtctcagactcctgacctcttgatccgcctgccttggcctcccaaagtgatgggattacagatgtgagccaccgtgcctagccaaggatgagatttttaaagtatgtttcagttctgtgtcatggttggaagacagagtaggaaggatatggaaaaggtcatggggaagcagaggtgattcatggctctgtgaatttgaggtgaatggttccttattgtctaggccacttgtgaagaatatgagtcagttattgccagccttggaatttacttctctagcttacaatggaccttttgaactggaaaacaccttgtctgcattcactttaaaatgtcaaaactaatttttataataaatgtttattttcacattga

SEQ ID NO: 296369 - DNA, 1869 bp, Homo sapiens
aactttaggctaggtacgaggcctgggcgggccagggccgcactccggagactcgcggttgctacgcgcaccatggctggagaggtacttctcagccctctagctccaactgagaacccagccagtcaggaagtcgctacttcgggaacaccaaccaatcagggggccgtcacctgctgaagggctggctctcagtcccctcgctgtagtcgcggagctgtgtctgttcccaggagtccttcggcggctgttgtgtcagtggcctgatcgcgatggggacaaaggcgcaagtcgagaggaaactgttgtgcctcttcatattggcgatcctgttgtgctccctggcattgggcagtgttacagtgcactcttctgaacctgaagtcagaattcctgagaataatcctgtgaagttgtcctgtgcctactcgggcttttcttctccccgtgtggagtggaagtttgaccaaggagacaccaccagactcgtttgctataataacaagatcacagcttcctatgaggaccgggtgaccttcttgccaactggtatcaccttcaagtccgtgacacgggaagacactgggacatacacttgtatggtctctgaggaaggcggcaacagctatggggaggtcaaggtcaagctcatcgtgcttgtgcctccatccaagcctacagttaacatcccctcctctgccaccattgggaaccgggcagtgctgacatgctcagaacaagatggttccccaccttctgaatacacctggttcaaagatgggatagtgatgcctacgaatcccaaaagcacccgtgccttcagcaactcttcctatgtcctgaatcccacaacaggagagctggtctttgatcccctgtcagcctctgatactggagaatacagctgtgaggcacggaatgggtatgggacacccatgacttcaaatgctgtgcgcatggaagctgtggagcggaatgtgggggtcatcgtggcagccgtccttgtaaccctgattctcctgggaatcttggtttttggcatctggtttgcctatagccgaggccactttgacagaacaaagaaagggacttcgagtaagaaggtgatttacagccagcctagtgcccgaagtgaaggagaattcaaacagacctcgtcattcctggtgtgagcctggtcggctcaccgcctatcatctgcatttgccttactcaggtgctaccggactctggcccctgatgtctgtagtttcacaggatgccttatttgtcttctacaccccacagggccccctacttcttcggatgtgtttttaataatgtcagctatgtgccccatcctccttcatgccctccctccctttcctaccactgctgagtggcctggaacttgtttaaagtgtttattccccatttctttgagggatcaggaaggaatcctgggtatgccattgacttcccttctaagtagacagcaaaaatggcgggggtcgcaggaatctgcactcaactgcccacccgcctgccttggcctcccaaagtgatgggattacagatgtgagccaccgtgcctagccaaggatgagatttttaaagtatgtttcagttctgtgtcatggttggaagacagagtaggaaggatatggaaaaggtcatggggaagcagaggtgattcatggctctgtgaatttgaggtgaatggttccttattgtctaggccacttgtgaagaatatgagtcagttattgccagccttggaatttacttctctagcttacaatggaccttttgaactggaaaacaccttgtctgcattcactttaaaatgtcaaaactaatttttataataaatgtttattttcacattga

SEQ ID NO: 296370 - DNA, 538 bp, Homo sapiens
ggcggccgtgactcctaggccccctcttcctgaaggctgtcgcgccccttcctcagcgcccacggtctcgcttcctgaactccgttcactcctagcctccggacgggcccggctcttcgatgtgcgctctcgcgaggaggcggcagctgggaccatcccaggggcgctcaacatcccggtgtccgagttggagagtgctctgcagatggagccagctgccttccaggctttatattctgctgagaagccaaagctggaagatgagcatctcgttttcttctgtcagatgggcaagcggggcctccaggccacgcagctggcccggagtcttggatacactggggctcgcaactacgctggagcctatagagaatggttggagaaagagagttaggcaggaggcagcttactgattgccaccccctggccccttaatggccaccttaactaagggtgtgaacgggctgacttggtgaattgggcaactccttatagtgttgtgcacacaaaagcatcaaataaagaacatttaatcaaa

SEQ ID NO: 296371 - DNA, 2460 bp, Homo sapiens
  misc_feature (319)..(319): n is a, c, g, or t
  misc_feature (322)..(322): n is a, c, g, or t
gcctgtggtgctgtggagatgtgtgtagtggtcttagctctttgttgagcttgtgtgtgtgttgtgtagtcttagctgtatgctgaaattgggcgtgtgttggagggcttcttagctctttggtgagattgtatttctatgtgtttgtatcagctgaatgttgctggaaataaaaccttggtttgtcaaggctcttatgctaatgaagccatcagtcaagggtcacatgccaataaacaataaattttccagaagaaatgaaatccaactagacaaataaagtagagcttatgaaatggttcagtaaagatgagtttgntgntttttgttttgttttgttttgtttttttaaagacggagtctcgctctgtcacccaggctggagtgcagtggtatgatcttggctcactgtaacctccgcctcccgggttcaagtgattcttctgtctcagcctcccaagtagctgggactacgggcgcccgccactacgactggctaatttttgtatttttagtagagacgggggttttaccatattggtcaggagttcaagatcagcctgaccaacatggagaaaccctactgaaaatacaaagttagccaggcatggtggtgcatgcctgtaatcccagctgctcaggagcctggcaacaagagcaaaactccagctcaaaaaaaaaaaagaaagaaaagaaagctggagctggtggcttaggccatcacccttcccttggctggaactactggacagacccttttgagatgtgcctgtggtgctgtggagatgtgtgtagtggtcttagctctttgttgagcttgtgtgtgtgttgtgtagtcttagctgtatgctgaaattgggcgtgtgttggagggcttcttagctctttggtgagattgtatttctatgtgtttgtatcagctgaatgttgctggaaataaaaccttggtttgtcaaggctcttttttgtgggaagtaagtaggggaaaaggtctttgagggttcctaggctcctttgtacaacaggaaaatgcctcaaagccttgcttcccagcaacctggggctggttcccagtgcctggtcctgccccttcctggttcttatctcaaggcagagcttctgaatttcaggccttcattccagagccctcttgtggccaggccttcctttgctggaggaaggtacacagggtgaagctgatgctgtacttgggggatctccttggcctgttccaccaagtgagagaaggtacttactcttgtacctcctgttcagccaggtgcattaacagacctccctacagctgtaggaactactgtcccagagctgaggcaaggggatttctcaggtcatttggagaacaagtgctttagtagtagtttaaagtagtaactgctactgtatttagtggggtggaattcagaagaaatttgaagaccagatcatgggtggtctgcatgtgaatgaacaggaatgagccggacagcctggctgtcattgctttcttcctccccatttggacccttctctgcccttacatttttgtttctccatctaccaccatccaccagtctatttattaacttagcaagaggacaagtaaagggccctcttggcttgattttgcttctttctttctgtggaggatatactaagtgcgactttgccctatcctatttggaaatccctaacagaattgagttttctattaaggatccaaaaagaaaaacaaaatgctaatgaagccatcagtcaagggtcacatgccaataaacaataaattttccagaagaaatgaaatccaactagacaaataaagtagagcttatgaaatggttcagtaaagatgagtttgttgttttttgttttgttttgttttgtttttttaaagacggagtctcgctctgtcacccaggctggagtgcagtggtatgatcttggctcactgtaacctccgcctcccgggttcaagccattctcctgcctcagtctcctgagtagctgggattgcgggtgcgtgccaccatgcctggctaatttttgtgtttttagtagagacagggtttcaccatgttggtcgggctggtctcagactcctgacctcttgatccgcctgccttggcctcccaaagtgatgggattacagatgtgagccaccgtgcctagccaaggatgagatttttaaagtatgtttcagttctgtgtcatggttggaagacagagtaggaaggatatggaaaaggtcatggggaagcagaggtgattcatggctctgtgaatttgaggtgaatggttccttattgtctaggccacttgtgaagaatatgagtcagttattgccagccttggaatttacttctctagcttacaatggaccttttgaactggaaaacaccttgtctgcattcactttaaaatgtcaaaactaatttttataataaatgtttattttcacattga

SEQ ID NO: 296372 - DNA, 584 bp, Homo sapiens
ccggtctcagctctgggagggaacgggagatgttgcaggcgccgagagggcgggccagggccgcactccggagactcgcggttgctacgcgcaccatggctggagcgcccacggtctcgcttcctgaactccgttcactcctagcctccggacgggcccggctcttcgatgtgcgctctcgcgaggaggcggcagctgggaccatcccaggggcgctcaacatcccggtgtccgagttggagagtgctctgcagatggagccagctgccttccaggctttatattctgctgagaagccaaagctggaagatgagcatctcgttttcttctgtcagatgggcaagcggggcctccaggccacgcagctggcccggagtcttggatacactggggctcgcaactacgctggagcctatagagaatggttggagaaagagagttaggcaggaggcagcttactgattgccaccccctggccccttaatggccaccttaactaagggtgtgaacgggctgacttggtgaattgggcaactccttatagtgttgtgcacacatcgcatcggtgccgagctcgatgtacc

SEQ ID NO: 296373 - DNA, 584 bp, Homo sapiens
ccggtctcagctctgggagggaacgggagatgttgcaggcgccgagagggcgggccagggccgcactccggagactcgcggttgctacgcgcaccatggctggagcgcccacggtctcgcttcctgaactccgttcactcctagcctccggacgggcccggctcttcgatgtgcgctctcgcgaggaggcggcagctgggaccatcccaggggcgctcaacatcccggtgtccgagttggagagtgctctgcagatggagccagctgccttccaggctttatattctgctgagaagccaaagctggaagatgagcatctcgttttcttctgtcagatgggcaagcggggcctccaggccacgcagctggcccggagtcttggatacactggggctcgcaactacgctggagcctatagagaatggttggagaaagagagttaggcaggaggcagcttactgattgccaccccctggccccttaatggccaccttaactaagggtgtgaacgggctgacttggtgaattgggcaactccttatagtgttgtgcacacatcgcatacggggactcctctatgagtc

SEQ ID NO: 296374 - DNA, 1674 bp, Homo sapiens
aactttaggctaggtacgaggcctgggcgggccagggccgcactccggagactcgcggttgctacgcgcaccatggctggagaggtacttctcagccctctagctccaactgagaacccagccagtcaggaagtcgctacttcgggaacaccaaccaatcagggggccgtcacctgctgaagggctggctctcagtcccctcgctgtagtcgcggagctgtgtctgttcccaggagtccttcggcggctgttgtgtcagtggcctgatcgcgatggggacaaaggcgcaagtcgagaggaaactgttgtgcctcttcatattggcgatcctgttgtgctccctggcattgggcagtgttacagtgcactcttctgaacctgaagtcagaattcctgagaataatcctgtgaagttgtcctgtgcctactcgggcttttcttctccccgtgtggagtggaagtttgaccaaggagacaccaccagactcgtttgctataataacaagatcacagcttcctatgaggaccgggtgaccttcttgccaactggtatcaccttcaagtccgtgacacgggaagacactgggacatacacttgtatggtctctgaggaaggcggcaacagctatggggaggtcaaggtcaagctcatcgtgcttgtgcctccatccaagcctacagttaacatcccctcctctgccaccattgggaaccgggcagtgctgacatgctcagaacaagatggttccccaccttctgaatacacctggttcaaagatgggatagtgatgcctacgaatcccaaaagcacccgtgccttcagcaactcttcctatgtcctgaatcccacaacaggagagctggtctttgatcccctgtcagcctctgatactggagaatacagctgtgaggcacggaatgggtatgggacacccatgacttcaaatgctgtgcgcatggaagctgtggagcggaatgtgggggtcatcgtggcagccgtccttgtaaccctgattctcctgggaatcttggtttttggcatctggtttgcctatagccgaggccactttgacagaacaaagaaagggacttcgagtaagaaggtgatttacagccagcctagtgcccgaagtgaaggagaattcaaacagacctcgtcattcctggtgtgagcctggtcggctcaccgcctatcatctgcatttgccttactcaggtgctaccggactctggcccctgatgtctgtagtttcacaggatgccttatttgtcttctacaccccacagggccccctacttcttcggatgtgtttttaataatgtcagctatgtgccccatcctccttcatgccctccctccctttcctaccactgctgagtggcctggaacttgtttaaagttatgtttcagttctgtgtcatggttggaagacagagtaggaaggatatggaaaaggtcatggggaagcagaggtgattcatggctctgtgaatttgaggtgaatggttccttattgtctaggccacttgtgaagaatatgagtcagttattgccagccttggaatttacttctctagcttacaatggaccttttgaactggaaaacaccttgtctgcattcactttaaaatgtcaaaactaatttttataataaatgtttattttcacattga

SEQ ID NO: 296375 - DNA, 451 bp, Homo sapiens
  misc_feature (9)..(9): n is a, c, g, or t
  misc_feature (17)..(17): n is a, c, g, or t
gctgtggtngatctctnaggatccccgatgcgatgtgcgctctcgcgaggaggcggcagctgggaccatcccaggggcgctcaacatcccggtgtccgagttggagagtgctctgcagatggagccagctgccttccaggctttatattctgctgagaagccaaagctggaagatgagcatctcgttttcttctgtcagatgggcaagcggggcctccaggccacgcagctggcccggagtcttggatacactggggctcgcaactacgctggagcctatagagaatggttggagaaagagagttaggcaggaggcagcttactgattgccaccccctggccccttaatggccaccttaactaagggtgtgaacgggctgacttggtgaattgggcaactccttatagtgttgtgcacacaaaagcatcaaataaagaacatttaatcaaa

SEQ ID NO: 296376 - DNA, 2181 bp, Homo sapiens
aactttaggctaggtacgaggcctgggcgggccagggccgcactccggagactcgcggttgctacgcgcaccatggctggagaggtacttctcagccctctagctccaactgagaacccagccagtcaggaagtcgctacttcgggaacaccaaccaatcagggggccgtcacctgctgaagggctggctctcagtcccctcgctgtagtcgcggagctgtgtctgttcccaggagtccttcggcggctgttgtgtcagtggcctgatcgcgatggggacaaaggcgcaagtcgagaggaaactgttgtgcctcttcatattggcgatcctgttgtctgtgaagttgtcctgtgcctactcgggcttttcttctccccgtcttcctatgaggaccgggtgaccttcttgccaactggtatcaccttcaagtccgtgacacgggaagacactgggacatacacttgtatggtctctgaggaaggcggcaacagctatggggaggtcaaggtcaagctcatcgtgcttgtgcctccatccaagcctacagttaacatcccctcctctgccaccattgggaaccgggcagtgctgacatgctcagaacaagatggttccccaccttctgaatacacctggttcaaagatgggatagtgatgcctacgaatcccaaaagcacccgtgccttcagcaactcttcctatgtcctgaatcccacaacaggagagctggtctttgatcccctgtcagcctctgatactggagaatacagctgtgaggcacggaatgggtatgggacacccatgacttcaaatgctgtgcgcatggaagctgtggagcggaatgtgggggtcatcgtggcagccgtccttgtaaccctgattctcctgggaatcttggtttttggcatctggtttgcctatagccgaggccactttgacagaacaaagaaagggacttcgagtaagaaggtgatttacagccagcctagtgcccgaagtgaaggagaattcaaacagacctcgtcattcctggtgtgagcctggtcggctcaccgcctatcatctgcatttgccttactcaggtgctaccggactctggcccctgatgtctgtagtttcacaggatgccttatttgtcttctacaccccacagggccccctacttcttcggatgtgtttttaataatgtcagctatgtgccccatcctccttcatgccctccctccctttcctaccactgctgagtggcctggaacttgtttaaagtgtttattccccatttctttgagggatcaggaaggaatcctgggtatgccattgacttcccttctaagtagacagcaaaaatggcgggggtcgcaggaatctgcactcaactgcccacctggctggcagggatctttgaataggtatcttgagcttggttctgggctctttccttgtgtactgacgaccagggccagctgttctagagcgggaattagaggctagagcggctgaaatggttgtttggtgatgacactggggtccttccatctctggggcccactctcttctgtcttcccatgggaagtgccactgggatccctctgccctgtcctcctgaatacaagctgactgacattgactgtgtctgtggaaaatgggagctcttgttgtggagagcatagtaaattttcagagaacttgaagccaaaaggatttaaaaccgctgctctaaagaaaagaaaactggaggctgggcgcagtggctcacgcctataatcccagaggctgaggcaggcggatcacctgaggtcgggctggtctcagactcctgacctcttgatccgcctgccttggcctcccaaagtgatgggattacagatgtgagccaccgtgcctagccaaggatgagatttttaaagtatgtttcagttctgtgtcatggttggaagacagagtaggaaggatatggaaaaggtcatggggaagcagaggtgattcatggctctgtgaatttgaggtgaatggttccttattgtctaggccacttgtgaagaatatgagtcagttattgccagccttggaatttacttctctagcttacaatggaccttttgaactggaaaacaccttgtctgcattcactttaaaatgtcaaaactaatttttataataaatgtttattttcacattga

SEQ ID NO: 296377 - DNA, 1163 bp, Homo sapiens
aactttaggctaggtacgaggcctgggcgggccagggccgcactccggagactcgcggttgctacgcgcaccatggctggagaggtacttctcagccctctagctccaactgagaacccagccagtcaggaagtcgctacttcgggaacaccaaccaatcagggggccgtcacctgctgaagggctggctctcagtcccctcgctgtagtcgcggagctgtgtctgttcccaggagtccttcggcggctgttgtgtcagtggcctgatcgcgatggggacaaaggcgcaagtcgagaggaaactgttgtgcctcttcatattggcgatcctgttgtgctccctggcattgggcagtgttacagtgcactcttctgaacctgaagtcagaattcctgagaataatcctgtgaagttgtcctgtgcctactcgggcttttcttctccccgtgtggagtggaagtttgaccaaggagacaccaccagactcgtttgctataataacaagatcacagcttcctatgaggaccgggtgaccttcttgccaactggtatcaccttcaagtccgtgacacgggaagacactgggacatacacttgtatggtctctgaggaaggcggcaacagctatggggaggtcaaggtcaagctcatcgtgcttgtgcctccatccaagcctacagttaacatcccctcctctgccaccattgggaaccgggcagtgctgacatgctcagaacaagatggttccccaccttctgaatacacctggttcaaagatgggatagtgatgcctacgaatcccaaaagcacccgtgccttcagcaactcttcctatgtcctgaatcccacaacaggagagctggtctttgatcccctgtcagcctctgatactggagaatacagctgtgaggcacggaatgggtatgggacacccatgacttcaaatgctgtgcgcatggaagctgtggagcggaatgtgggggtcatcgtggcagccgtccttgtaaccctgattctcctgggaatcttggtttttggcatctggtttgcctatagccgaggccactttgacagaacaaagaaagggacttcgagtaagaaggtgatttacagccagcctagtgcccgaagtgaagtgagtatgcctcccctgggcaggggt

SEQ ID NO: 296378 - DNA, 1457 bp, Homo sapiens
ccgaattcggcacgagcctggccacaagagggctatggaatgaaggcctgaaattcagaagctctgccttgagataagaaccaggaaggggcaggaccaggcactgggaaccagccccaggttgctgggaagcaaggctttgaggcattttcctgttgtacaaagttgctggaggaaggtacacagggtgaagctgatgctgtacttgggggatctccttggcctgttccaccaagtgagagaaggtacttactcttgtacctcctgttcagccaggtgcattaacagacctccctacagctgtaggaactactgtcccagagctgaggcaaggggatttctcaggtcatttggagaacaagtgctttagtagtagtttaaagtagtaactgctactgtatttagtggggtggaattcagaagaaatttgaagaccagatcatgggtggtctgcatgtgaatgaacaggaatgagccggacagcctggctgtcattgctttcttcctccccatttggacccttctctgcccttacatttttgtttctccatctaccaccatccaccagtctatttattaacttagcaagaggacaagtaaagggccctcttggcttgattttgcttctttctttctgtggaggatatactaagtgcgactttgccctatcctatttggaaatccctaacagaattgagttttctattaaggatccaaaaagaaaaacaaaatgctaatgaagccatcagtcaagggtcacatgccaataaacaataaattttccagaagaaatgaaatccaactagacaaataaagtagagcttatgaaatggttcagtaaagatgagtttgttgttttttgttttgttttgttttgtttttttaaagacggagtctcgctctgtcacccaggctggagtgcagtggtatgatcttggctcactgtaacctccgcctcccgggttcaagccattctcctgcctcagtctcctgagtagctgggattgcgggtgcgtgccaccatgcctggctaatttttgtgtttttagtagagacagggtttcaccatgttggtcgggctggtctcagactcctgacctcttgatccgcctgccttggcctcccaaagtgatgggattacagatgtgagccaccgtgcctagccaaggatgagatttttaaagtatgtttcagttctgtgtcatggttggaagacagagtaggaaggatatggaaaaggtcatggggaagcagaggtgattcatggctctgtgaatttgaggtgaatggttccttattgtctaggccacttgtgaagaatatgagtcagttattgccagccttggaatttacttctctagcttacaatggaccttttgaactggaaaacaccttgtctgcattcactttaaaatgtcaaaactaatttttataataaatgtttattttcacattga

SEQ ID NO: 296379 - DNA, 1546 bp, Homo sapiens
aactttaggctaggtacgaggcctgggcgggccagggccgcactccggagactcgcggttgctacgcgcaccatggctggagaggtacttctcagccctctagctccaactgagaacccagccagtcaggaagtcgctacttcgggaacaccaaccaatcagggggccgtcacctgctgaagggctggctctcagtcccctcgctgtagtcgcggagctgtgtctgttcccaggagtccttcggcggctgttgtgtcagtggcctgatcgcgatggggacaaaggcgcaagtcgagaggaaactgttgtgcctcttcatattggcgatcctgttgtgctccctggcattgggcagtgttacagtgcactcttctgaacctgaagtcagaattcctgagaataatcctgtgaagttgtcctgtgcctactcgggcttttcttctccccgtgtggagtggaagtttgaccaaggagacaccaccagactcgtttgctataataacaagatcacagcttcctatgaggaccgggtgaccttcttgccaactggtatcaccttcaagtccgtgacacgggaagacactgggacatacacttgtatggtctctgaggaaggcggcaacagctatggggaggtcaaggtcaagctcatcgtgcttgtgcctccatccaagcctacagttaacatcccctcctctgccaccattgggaaccgggcagtgctgacatgctcagaacaagatggttccccaccttctgaatacacctggttcaaagatgggatagtgatgcctacgaatcccaaaagcacccgtgccttcagcaactcttcctatgtcctgaatcccacaacaggagagctggtctttgatcccctgtcagcctctgatactggagaatacagctgtgaggcacggaatgggtatgggacacccatgacttcaaatgctgtgcgcatggaagctgtggagcggaatgtgggggtcatcgtggcagccgtccttgtaaccctgattctcctgggaatcttggtttttggcatctggtttgcctatagccgaggccactttgacagaacaaagaatctgcccccagaggctctcctttgtactgcccccatcccagggcctggcatgggtgtcatctgagtactgaccctgatactgtgctcatgtgtgtgggtgttgtcccctggggaacactgatcacccatctaacaccaagagctgggggcctgcccctccatcttcccaagccatgctgtcttctgtcctgctgacactcatgatcccatttcttctctttcaggaacaaagaaagggtgagtgaggtgctgtcctggggttctccaagtttgagagcatggatgcatgtggtttgaagctgaagtgggcctaggggaatgggttgaaggcagaagcaaccagtttggagggaaggcatttggatatccagccctttctctgtggccttggccctgggtctgtcctgttaccccacccatacctgtctgctgcgcacatctgtgcttctgtagcattctcgc

SEQ ID NO: 296380 - DNA, 1167 bp, Homo sapiens
aactttaggctaggtacgaggcctgggcgggccagggccgcactccggagactcgcggttgctacgcgcaccatggctggagaggtacttctcagccctctagctccaactgagaacccagccagtcaggaagtcgctacttcgggaacaccaaccaatcagggggccgtcacctgctgaagggctggctctcagtcccctcgctgtagtcgcggagctgtgtctgttcccaggagtccttcggcggctgttgtgtcagtggcctgatcgcgatggggacaaaggcgcaagtcgagaggaaactgttgtgcctcttcatattggcgatcctgttgtgctccctggcattgggcagtgttacagtgcactcttctgaacctgaagtcagaattcctgagaataatcctgtgaagttgtcctgtgcctactcgggcttttcttctccccgtgtggagtggaagtttgaccaaggagacaccaccagactcgtttgctataataacaagatcacagcttcctatgaggaccgggtgaccttcttgccaactggtatcaccttcaagtccgtgacacgggaagacactgggacatacacttgtatggtctctgaggaaggcggcaacagctatggggaggtcaaggtcaagctcatcgtgcttgtgcctccatccaagcctacagttaacatcccctcctctgccaccattgggaaccgggcagtgctgacatgctcagaacaagatggttccccaccttctgaatacacctggttcaaagatgggatagtgatgcctacgaatcccaaaagcacccgtgccttcagcaactcttcctatgtcctgaatcccacaacaggagagctggtctttgatcccctgtcagcctctgatactggagaatacagctgtgaggcacggaatgggtatgggacacccatgacttcaaatgctgtgcgcatggaagctgtggagcggaatgtgggggtcatcgtggcagccgtccttgtaaccctgattctcctgggaatcttggtttttggcatctggtttgcctatagccgaggccactttgacagaacaaagaaaagaaagggacttcgagtaagaaggtgaccacacagccaggacaagcgacccgaagtgaagaacgacagtcagcaagaccgca

SEQ ID NO: 296381 - DNA, 589 bp, Homo sapiens
  misc_feature (51)..(51): n is a, c, g, or t
  misc_feature (56)..(56): n is a, c, g, or t
  misc_feature (59)..(59): n is a, c, g, or t
  misc_feature (61)..(61): n is a, c, g, or t
  misc_feature (65)..(65): n is a, c, g, or t
  misc_feature (77)..(77): n is a, c, g, or t
tctccaaagggtctgtcccgtagttccagcccagggaagggtgatggcctnagccnccngntccngccttcttttcnttccttttttttttgagctggagttttgctcttgttgccaggctcctgagtagctgggattgcgggtgcgtgccaccatgcctggctaatttttgtgtttttagtagagacagggtttcaccatgttggtcgggctggtctcagactcctgacctcttgatccgcctgccttggcctcccaaagtgatgggattacagatgtgagccaccgtgcctagccaaggatgagatttttaaagtatgtttcagttctgtgtcatggttggaagacagagtaggaaggatatggaaaaggtcatggggaagcagaggtgattcatggctctgtgaatttgaggtgaatggttccttattgtctaggccacttgtgaagaatatgagtcagttattgccagccttggaatttacttctctagcttacaatggaccttttgaactggaaaacaccttgtctgcattcactttaaaatgtcaaaactaatttttataataaatgtttattttcacattga

SEQ ID NO: 296382 - DNA, 1061 bp, Homo sapiens
  misc_feature (21)..(22): n is a, c, g, or t
aaataggctaggtacgaggcnnggtggtatgttgcaggcgccgagagggcgggccagggccgcactccggagactcgcggttgctacgcgcaccatggctggagcgcccacggtctcgcttcctgaactccgttcactcctagcctccggacgggcccggctcttcgatgtgcgctctcgcgaggaggcggcagctgggaccatcccaggggcgctcaacatcccgggtatagggtggagaggggacgcccaggtggtggaatagagaccgttcaggaggttctttgccaatgggacctcatttaggatggaatggggaaggcactgattatgggggtcctgcattcccgggagccagccctcagcttccgtaggaaggactgatggggggcggatcttggcatcggaactggcccatccagtttgagaagacagcaggcggagaggagaggggcagaccagcttctcttgacctccccaaatctggacgcctgagggggcatcccgccccgcctcctcacagcttagggagtggcttgcattcaaaagttgtcggtttctgttccttgaaattggggtgggggtaggggatggttatcatatgttgtttgggggcccccaggacccagcccttccaggcccagcttccgaacctgagtgccaaattgctggctttcccttctaccctctccactcctccagtgtccgagttggagagtgctctgcagatggagccagctgccttccaggctttatattctgctgagaagccaaagctggaagatgagcatctcgttttcttctgtcagatgggcaagcggggcctccaggccacgcagctggcccggagtcttggatacactggggctcgcaactacgctggagcctatagagaatggttggagaaagagagttaggcaggaggcagcttactgattgccaccccctggccccttaatggccaccttaactaagggtgtgaacgggctgacttggtgaattgggcaactccttatagtgttgtgcacacaaaagcatcaaataaagaacatttaatcaaa

SEQ ID NO: 296383 - DNA, 540 bp, Homo sapiens
  misc_feature (21)..(22): n is a, c, g, or t
aaataggctaggtacgaggcnnggtggtatgttgcaggcgccgagagggcgggccagggccgcactccggagactcgcggttgctacgcgcaccatggctggagtgtccgagttggagagtgctctgcagatggagccagctgccttccaggctttatattctgctgagaagccaaagctggaagatgagcatctcgttttcttctgtcagatgggcaagcggggcctccaggccacgcagctggcccggagtcttggatacactggggctcgcaactacgctggagcctatagagaatggttggagaaagagagttaggcaggaggcagcttactgattgccaccccctggccccttaatggccaccttaactaagggtgtgaacgggctgacttggtgaattgggcaactccttatagtgttgtgcacacaaaagcatcaaataaagaacatttaatcaaaaaaaaagagtagaaaaagagaaaaaactttggggggggcgttgggcccttggaaaaagtttttaagaccattggtgg

SEQ ID NO: 296384 - DNA, 807 bp, Homo sapiens
aactttaggctaggtacgaggcctgggcgggccagggccgcactccggagactcgcggttgctacgcgcaccatggctggagaggtacttctcagccctctagctccaactgagaacccagccagtcaggaagtcgctacttcgggaacaccaaccaatcagggggccgtcacctgctgaagggctggctctcagtcccctcgctgtagtcgcggagctgtgtctgttcccaggagtccttcggcggctgttgtgtcagtggcctgatcgcgatggggacaaaggcgcaagtcgagaggaaactgttgtgcctcttcatattggcgatcctgttgtctccctggcattgggcagtgttacagatgcccaaataaaaaatgagctattggaatctgaaatgaagaaccttaaaaagtgtgtgagtgaattggaagaagaaaagcagcagttagtcaaggaaaaaactaaggtggaatcagaaatacgaaaggaatatttggagaaaatacaaggtgctcagaaagaacccggaaataaaagccatgcaaaggaacttcaggaactgttaaaagaaaaacaacaagaagtaaagcagctacagaaggactgcatcaggtatcaagagaaaattagtgctctggagagaactgttaaagctctagaattgttcaaactgaatctcaaaaagattggaaataaccaaagaaaatctgggctcaagcagttgaacaccgcaaaaaggcacaagcagaattagctagcttcaaagtcctgctagatgacactcaaagtgaagcagcaagggtc

SEQ ID NO: 296385 - DNA, 1147 bp, Homo sapiens
  misc_feature (21)..(22): n is a, c, g, or t
aaataggctaggtacgaggcnnggtggtatgttgcaggcgccgagagggcgggccagggccgcactccggagactcgcggttgctacgcgcaccatggctggagcgcccacggtctcgcttcctgaactccgttcactcctagcctccggacgggcccggctcttcgatgtgcgctctcgcgaggaggcggcagctgggaccatcccaggggcgctcaacatcccgggtatagggtggagaggggacgcccaggtggtggaatagagaccgttcaggaggttctttgccaatgggacctcatttaggatggaatggggaaggcactgattatgggggtcctgcattcccgggagccagccctcagcttccgtaggaaggactgatggggggcggatcttggcatcggaactggcccatccagtttgagaagacagcaggcggagaggagaggggcagaccagcttctcttgacctccccaaatctggacgcctgagggggcatcccgccccgcctcctcacagcttagggagtggcttgcattcaaaagttgtcggtttctgttccttgaaattggggtgggggtaggggatggttatcatatgttgtttgggggcccccaggacccagcccttccaggcccagcttccgaacctgagtgccaaattgctggctttcccttctaccctctccactcctccagtgtccgagttggagagtgctctgcagatggagccagctgccttccaggctttatattctgctgagaagccaaagctggaagatgagcatctcgttttcttctgtcagatgggcaagcggggcctccaggccacgcagctggcccggagtcttggatacactgggtacggggaggtgtggctgctagctgggaggtgatggggactgcctgtcattcctgtcagtctctcacgcttctttgtctccacagggctcgcaactacgctggagcctatagagaatggttggagaaagagagttaggcaggaggcagcttactgattgccaccccctggccccttaatggccaccttaactaagggtgtgaacgggctgacttggtgaattgggcaactccttatagtgttgtgcacacaaaagcatcaaataaagaacatttaatcaaa

SEQ ID NO: 296386 - DNA, 1133 bp, Homo sapiens
  misc_feature (21)..(22): n is a, c, g, or t
aaataggctaggtacgaggcnnggtggtatgttgcaggcgccgagagggcgggccagggccgcactccggagactcgcggttgctacgcgcaccatggctggagcgcccacggtctcgcttcctgaactccgttcactcctagcctccggacgggcccggctcttcgatgtgcgctctcgcgaggaggcggcagctgggaccatcccaggggcgctcaacatcccgggtatagggtggagaggggacgcccaggtggtggaatagagaccgttcaggaggttctttgccaatgggacctcatttaggatggaatggggaaggcactgattatgggggtcctgcattcccgggagccagccctcagcttccgtaggaaggactgatggggggcggatcttggcatcggaactggcccatccagtttgagaagacagcaggcggagaggagaggggcagaccagcttctcttgacctccccaaatctggacgcctgagggggcatcccgccccgcctcctcacagcttagggagtggcttgcattcaaaagttgtcggtttctgttccttgaaattggggtgggggtaggggatggttatcatatgttgtttgggggcccccaggacccagcccttccaggcccagcttccgaacctgagtgccaaattgctggctttcccttctaccctctccactcctccagtgtccgagttggagagtgctctgcagatggagccagctgccttccaggctttatattctgctgagaagccaaagctggaagatgagcatctcgttttcttctgtcagatgggcaagcggggcctccaggccacgcagctggcccggagtcttggatacactgggtacggggaggtgtggctgctagctgggaggtgatggggactgcctgtcattcctgtcagtctctcacgcttctttgtctccacagggctcgcaactacgctggagcctatagagaatggttggagaaagagagttaggcaggaggcagcttactgattgccaccccctggccccttaatggccaccttaactaagggtgtgaacgggctgacgtcgctgaagctcggcactcacctcatacatgtcagctcacatcgatccggacca

SEQ ID NO: 296387 - DNA, 2556 bp, Homo sapiens
tctgcttagtcatggtgacctgcgcgcgctccgcgcctcccccacgcgcagcgatggaggcgccggggctcgggcggtggaggcggagccggagcgcggccatggcggggtccctgagtgccagaggtggtggtgttgcttatcttctggaaccccatgcagccagatcccaggcctagcggggctggggcctgctgccgattcctgcccctgcagtcacagtgccctgagggggcaggggacgcggtgatgtacgcctccactgagtgcaaggcggaggtgacgccctcccagcatggcaaccgcaccttcagctacaccctggaggatcataccaagcaggcctttggcatcatgaacgagctgcggctcagccagcagctgtgtgacgtcacactgcaggtcaagtaccaggatgcaccggccgcccagttcatggcccacaaggtggtgctggcctcatccagccctgtcttcaaggccatgttcaccaacgggctgcgggagcagggcatggaggtggtgtccattgagggtatccaccccaaggtcatggagcgcctcattgaattcgcctacacggcctccatctccatgggcgagaagtgtgtcctccacgtcatgaacggtgctgtcatgtaccagatcgacagcgttgtccgtgcctgcagtgacttcctggtgcagcagctggaccccagcaatgccatcggcatcgccaacttcgctgagcagattggctgtgtggagttgcaccagcgtgcccgggagtacatctacatgcatttggggaggtggccaagcaagaggagttcttcaacctgtcccactgccaactggtgaccctcatcagccgggacgacctgaacgtgcgctgcgagtccgaggtcttccacgcctgcatcaactgggtcaagtacgactgcgaacagcgacggttctacgtccaggcgctgctgcgggccgtgcgctgccactcgttgacgccgaacttcctgcagatgcagctgcagaagtgcgagatcctgcagtccgactcccgctgcaaggactacctggtcaagatcttcgaggagctcaccctgcacaagcccacgcaggtgatgccctgccgggcgcccaaggtgggccgcctgatctacaccgcgggcggctacttccgacagtcgctcagctacctggaggcttacaaccccagtgacggcacctggctccggttggcggacctgcaggtgccgcggagcggcctggccggctgcgtggtgggcgggctgttgtacgccgtgggcggcaggaacaactcgcccgacggcaacaccgactccagcgccctggactgttacaaccccatgaccaatcagtggtcgccctgcgcccccatgagcgtgccccgtaaccgcatcggggtgggggtcatcgatggccacatctatgccgtcggcggctcccacggctgcatccaccacaacagtgtggagaggtatgagccagagcgggatgagtggcacttggtggccccaatgctgacacgaaggatcggggtgggcgtggctgtcctcaatcgtctcctttatgccgtggggggctttgacgggacaaaccgccttaattcagctgagtgttactacccagagaggaacgagtggcgaatgatcacagcaatgaacaccatccgaagcggggcaggcgtctgcgtcctgcacaactgtatctatgctgctgggggctatgatggtcaggaccagctgaacagcgtggagcgctacgatgtggaaacagagacgtggactttcgtagcccccatgaagcaccggcgaagtgccctggggatcactgtccaccaggggagaatctacgtccttggaggctatgatggtcacacgttcctggacagtgtggagtgttacgacccagatacagacacctggagcgaggtgacccgaatgacatcgggccggagtggggtgggcgtggctgtcaccatggagccctgccggaagcagattgaccagcagaactgtacctgttgaggcacttttgtttcttgggcaaaaatacagtccaatggggagtatcattgtttttgtacaaaaaccgggactaaaagaaaagacagcactgcaaataacccatcttccgggaagggaggccaggatgcctcagtgttaaaatgacatctcaaaagaagtccaaagcgggaatcatgtgcccctcagcggagccccgggagtgtccaagacagcctggctgggaaagggggtgtggaaagagcaggcttccaggagagaggcccccaaaccctctggccgggtaataggcctgggtcccactcacccatgccggcagctgtcaccatgtgatttattcttggatacctgggagggggccaatgggggcctcagggggaggccccctctggaaatgtggttcccagggatgggcctgtacatagaagccaccggatggcacttccccaccggatggacagttattttgttgataagtaaccctgtaattttccaaggaaaataaagaacagactaactagtgtctttc

SEQ ID NO: 296388 - DNA, 2563 bp, Homo sapiens
cttttcgggcgtcccgaggccgctccccaaccgacaaccaagaccccgcaggccacgcagccctggagccgaggccccccgacggcggaggcgcccgcgggtcccctacagccaaggtccctgagtgccagaggtggtggtgttgcttatcttctggaaccccatgcagccagatcccaggcctagcggggctggggcctgctgccgattcctgcccctgcagtcacagtgccctgagggggcaggggacgcggtgatgtacgcctccactgagtgcaaggcggaggtgacgccctcccagcatggcaaccgcaccttcagctacaccctggaggatcataccaagcaggcctttggcatcatgaacgagctgcggctcagccagcagctgtgtgacgtcacactgcaggtcaagtaccaggatgcaccggccgcccagttcatggcccacaaggtggtgctggcctcatccagccctgtcttcaaggccatgttcaccaacgggctgcgggagcagggcatggaggtggtgtccattgagggtatccaccccaaggtcatggagcgcctcattgaattcgcctacacggcctccatctccatgggcgagaagtgtgtcctccacgtcatgaacggtgctgtcatgtaccagatcgacagcgttgtccgtgcctgcagtgacttcctggtgcagcagctggaccccagcaatgccatcggcatcgccaacttcgctgagcagattggctgtgtggagttgcaccagcgtgcccgggagtacatctacatgcatttggggaggtggccaagcaagaggagttcttcaacctgtcccactgccaactggtgaccctcatcagccgggacgacctgaacgtgcgctgcgagtccgaggtcttccacgcctgcatcaactgggtcaagtacgactgcgaacagcgacggttctacgtccaggcgctgctgcgggccgtgcgctgccactcgttgacgccgaacttcctgcagatgcagctgcagaagtgcgagatcctgcagtccgactcccgctgcaaggactacctggtcaagatcttcgaggagctcaccctgcacaagcccacgcaggtgatgccctgccgggcgcccaaggtgggccgcctgatctacaccgcgggcggctacttccgacagtcgctcagctacctggaggcttacaaccccagtgacggcacctggctccggttggcggacctgcaggtgccgcggagcggcctggccggctgcgtggtgggcgggctgttgtacgccgtgggcggcaggaacaactcgcccgacggcaacaccgactccagcgccctggactgttacaaccccatgaccaatcagtggtcgccctgcgcccccatgagcgtgccccgtaaccgcatcggggtgggggtcatcgatggccacatctatgccgtcggcggctcccacggctgcatccaccacaacagtgtggagaggtatgagccagagcgggatgagtggcacttggtggccccaatgctgacacgaaggatcggggtgggcgtggctgtcctcaatcgtctcctttatgccgtggggggctttgacgggacaaaccgccttaattcagctgagtgttactacccagagaggaacgagtggcgaatgatcacagcaatgaacaccatccgaagcggggcaggcgtctgcgtcctgcacaactgtatctatgctgctgggggctatgatggtcaggaccagctgaacagcgtggagcgctacgatgtggaaacagagacgtggactttcgtagcccccatgaagcaccggcgaagtgccctggggatcactgtccaccaggggagaatctacgtccttggaggctatgatggtcacacgttcctggacagtgtggagtgttacgacccagatacagacacctggagcgaggtgacccgaatgacatcgggccggagtggggtgggcgtggctgtcaccatggagccctgccggaagcagattgaccagcagaactgtacctgttgaggcacttttgtttcttgggcaaaaatacagtccaatggggagtatcattgtttttgtacaaaaaccgggactaaaagaaaagacagcactgcaaataacccatcttccgggaagggaggccaggatgcctcagtgttaaaatgacatctcaaaagaagtccaaagcgggaatcatgtgcccctcagcggagccccgggagtgtccaagacagcctggctgggaaagggggtgtggaaagagcaggcttccaggagagaggcccccaaaccctctggccgggtaataggcctgggtcccactcacccatgccggcagctgtcaccatgtgatttattcttggatacctgggagggggccaatgggggcctcagggggaggccccctctggaaatgtggttcccagggatgggcctgtacatagaagccaccggatggcacttccccaccggatggacagttattttgttgataagtaaccctgtaattttccaaggaaaataaagaacagactaactagtgtctttc

SEQ ID NO: 296389 - DNA, 2652 bp, Homo sapiens
ggcgccacggcccagggcgcctccgagttccccgccaggactcggagggccaggagggcgcgacctgggtggatatttttgttggacggcgcaactcttggggtggcccgggagcggcggaaaccgagcgagagaaccaggaggcgctgcgcagaaggaggcccgggggctccgaggcgttgaggggctcgatctgcgttctggggtccctgagtgccagaggtggtggtgttgcttatcttctggaaccccatgcagccagatcccaggcctagcggggctggggcctgctgccgattcctgcccctgcagtcacagtgccctgagggggcaggggacgcggtgatgtacgcctccactgagtgcaaggcggaggtgacgccctcccagcatggcaaccgcaccttcagctacaccctggaggatcataccaagcaggcctttggcatcatgaacgagctgcggctcagccagcagctgtgtgacgtcacactgcaggtcaagtaccaggatgcaccggccgcccagttcatggcccacaaggtggtgctggcctcatccagccctgtcttcaaggccatgttcaccaacgggctgcgggagcagggcatggaggtggtgtccattgagggtatccaccccaaggtcatggagcgcctcattgaattcgcctacacggcctccatctccatgggcgagaagtgtgtcctccacgtcatgaacggtgctgtcatgtaccagatcgacagcgttgtccgtgcctgcagtgacttcctggtgcagcagctggaccccagcaatgccatcggcatcgccaacttcgctgagcagattggctgtgtggagttgcaccagcgtgcccgggagtacatctacatgcatttggggaggtggccaagcaagaggagttcttcaacctgtcccactgccaactggtgaccctcatcagccgggacgacctgaacgtgcgctgcgagtccgaggtcttccacgcctgcatcaactgggtcaagtacgactgcgaacagcgacggttctacgtccaggcgctgctgcgggccgtgcgctgccactcgttgacgccgaacttcctgcagatgcagctgcagaagtgcgagatcctgcagtccgactcccgctgcaaggactacctggtcaagatcttcgaggagctcaccctgcacaagcccacgcaggtgatgccctgccgggcgcccaaggtgggccgcctgatctacaccgcgggcggctacttccgacagtcgctcagctacctggaggcttacaaccccagtgacggcacctggctccggttggcggacctgcaggtgccgcggagcggcctggccggctgcgtggtgggcgggctgttgtacgccgtgggcggcaggaacaactcgcccgacggcaacaccgactccagcgccctggactgttacaaccccatgaccaatcagtggtcgccctgcgcccccatgagcgtgccccgtaaccgcatcggggtgggggtcatcgatggccacatctatgccgtcggcggctcccacggctgcatccaccacaacagtgtggagaggtatgagccagagcgggatgagtggcacttggtggccccaatgctgacacgaaggatcggggtgggcgtggctgtcctcaatcgtctcctttatgccgtggggggctttgacgggacaaaccgccttaattcagctgagtgttactacccagagaggaacgagtggcgaatgatcacagcaatgaacaccatccgaagcggggcaggcgtctgcgtcctgcacaactgtatctatgctgctgggggctatgatggtcaggaccagctgaacagcgtggagcgctacgatgtggaaacagagacgtggactttcgtagcccccatgaagcaccggcgaagtgccctggggatcactgtccaccaggggagaatctacgtccttggaggctatgatggtcacacgttcctggacagtgtggagtgttacgacccagatacagacacctggagcgaggtgacccgaatgacatcgggccggagtggggtgggcgtggctgtcaccatggagccctgccggaagcagattgaccagcagaactgtacctgttgaggcacttttgtttcttgggcaaaaatacagtccaatggggagtatcattgtttttgtacaaaaaccgggactaaaagaaaagacagcactgcaaataacccatcttccgggaagggaggccaggatgcctcagtgttaaaatgacatctcaaaagaagtccaaagcgggaatcatgtgcccctcagcggagccccgggagtgtccaagacagcctggctgggaaagggggtgtggaaagagcaggcttccaggagagaggcccccaaaccctctggccgggtaataggcctgggtcccactcacccatgccggcagctgtcaccatgtgatttattcttggatacctgggagggggccaatgggggcctcagggggaggccccctctggaaatgtggttcccagggatgggcctgtacatagaagccaccggatggcacttccccaccggatggacagttattttgttgataagtaaccctgtaattttccaaggaaaataaagaacagactaactagtgtctttc

SEQ ID NO: 296390 - DNA, 2379 bp, Homo sapiens
tctgcttagtcatggtgacctgcgcgcgctccgcgcctcccccacgcgcagcgatggaggcgccggggctcgggcggtggaggcggagccggagcgcggccatggcggggtccctgagtgccagaggtggtggtgttgcttatcttctggaaccccatgcagccagatcccaggcctagcggggctggggcctgctgccgattcctgcccctgcagtcacagtgccctgagggggcaggggacgcggtgatgtacgcctccactgagtgcaaggcggaggtgacgccctcccagcatggcaaccgcaccttcagctacaccctggaggatcataccaagcaggcctttggcatcatgaacgagctgcggctcagccagcagctgtgtgacgtcacactgcaggtcaagtaccaggatgcaccggccgcccagttcatggcccacaaggtggtgctggcctcatccagccctgtcttcaaggccatgttcaccaacgggctgcgggagcagggcatggaggtggtgtccattgagggtatccaccccaaggtcatggagcgcctcattgaattcgcctacacggcctccatctccatgggcgagaagtgtgtcctccacgtcatgaacggtgctgtcatgtaccagatcgacagcgttgtccgtgcctgcagtgacttcctggtgcagcagctggaccccagcaatgccatcggcatcgccaacttcgctgagcagattggctgtgtggagttgcaccagcgtgcccgggagtacatctacatgcatttggggaggtggccaagcaagaggagttcttcaacctgtcccactgccaactggtgaccctcatcagccgggacgacctgaacgtgcgctgcgagtccgaggtcttccacgcctgcatcaactgggtcaagtacgactgcgaacagcgacggttctacgtccaggcgctgctgcgggccgtgcgctgccactcgttgacgccgaacttcctgcagatgcagctgcagaagtgcgagatcctgcagtccgactcccgctgcaaggactacctggtcaagatcttcgaggagctcaccctgcacaagcccacgcaggtgatgccctgccgggcgcccaaggtgggccgcctgatctacaccgcgggcggctacttccgacagtcgctcagctacctggaggcttacaaccccagtgacggcacctggctccggttggcggacctgcaggtgccgcggagcggcctggccggctgcgtggtgggcgggctgttgtacgccgtgggcggcaggaacaactcgcccgacggcaacaccgactccagcgccctggactgttacaaccccatgaccaatcagtggtcgccctgcgcccccatgagcgtgccccgtaaccgcatcggggtgggggtcatcgatggccacatctatgccgtcggcggctcccacggctgcatccaccacaacagtgtggagaggtatgagccagagcgggatgagtggcacttggtggccccaatgctgacacgaaggatcggggtgggcgtggctgtcctcaatcgtctcctttatgccgtggggggctttgacgggacaaaccgccttaattcagctgagtgttactacccagagaggaacgagtggcgaatgatcacagcaatgaacaccatccgaagcggggcaggaggctatgatggtcacacgttcctggacagtgtggagtgttacgacccagatacagacacctggagcgaggtgacccgaatgacatcgggccggagtggggtgggcgtggctgtcaccatggagccctgccggaagcagattgaccagcagaactgtacctgttgaggcacttttgtttcttgggcaaaaatacagtccaatggggagtatcattgtttttgtacaaaaaccgggactaaaagaaaagacagcactgcaaataacccatcttccgggaagggaggccaggatgcctcagtgttaaaatgacatctcaaaagaagtccaaagcgggaatcatgtgcccctcagcggagccccgggagtgtccaagacagcctggctgggaaagggggtgtggaaagagcaggcttccaggagagaggcccccaaaccctctggccgggtaataggcctgggtcccactcacccatgccggcagctgtcaccatgtgatttattcttggatacctgggagggggccaatgggggcctcagggggaggccccctctggaaatgtggttcccagggatgggcctgtacatagaagccaccggatggcacttccccaccggatggacagttattttgttgataagtaaccctgtaattttccaaggaaaataaagaacagactaactagtgtctttc

SEQ ID NO: 296391 - DNA, 2508 bp, Homo sapiens
tctgcttagtcatggtgacctgcgcgcgctccgcgcctcccccacgcgcagcgatggaggcgccggggctcgggcggtggaggcggagccggagcgcggccatggcggggtccctgagtgccagaggtggtggtgttgcttatcttctggaaccccatgcagccagatcccaggcctagcggggctggggcctgctgccgattcctgcccctgcagtcacagtgccctgagggggcaggggacgcggtgatgtacgcctccactgagtgcaaggcggaggtgacgccctcccagcatggcaaccgcaccttcagctacaccctggaggatcataccaagcaggcctttggcatcatgaacgagctgcggctcagccagcagctgtgtgacgtcacactgcaggtcaagtaccaggatgcaccggccgcccagttcatggcccacaaggtggtgctggcctcatccagccctgtcttcaaggccatgttcaccaacgggctgcgggagcagggcatggaggtggtgtccattgagggtatccaccccaaggtcatggagcgcctcattgaattcgcctacacggcctccatctccatgggcgagaagtgtgtcctccacgtcatgaacggtgctgtcatgtaccagatcgacagcgttgtccgtgcctgcagtgacttcctggtgcagcagctggaccccagcaatgccatcggcatcgccaacttcgctgagcagattggctgtgtggagttgcaccagcgtgcccgggagtacatctacatgcatttggggaggtggccaagcaagaggagttcttcaacctgtcccactgccaactggtgaccctcatcagccgggacgacctgaacgtgcgctgcgagtccgaggtcttccacgcctgcatcaactgggtcaagtacgactgcgaacagcgacggttctacgtccaggcgctgctgcgggccgtgcgctgccactcgttgacgccgaacttcctgcagatgcagctgcagaagtgcgagatcctgcagtccgactcccgctgcaaggactacctggtcaagatcttcgaggagctcaccctgcacaagcccacgcaggtgatgccctgccgggcgcccaaggtgggccgcctgatctacaccgcgggcggctacttccgacagtcgctcagctacctggaggcttacaaccccagtgacggcacctggctccggttggcggacctgcaggtgccgcggagcggcctggccggctgcgacggcaacaccgactccagcgccctggactgttacaaccccatgaccaatcagtggtcgccctgcgcccccatgagcgtgccccgtaaccgcatcggggtgggggtcatcgatggccacatctatgccgtcggcggctcccacggctgcatccaccacaacagtgtggagaggtatgagccagagcgggatgagtggcacttggtggccccaatgctgacacgaaggatcggggtgggcgtggctgtcctcaatcgtctcctttatgccgtggggggctttgacgggacaaaccgccttaattcagctgagtgttactacccagagaggaacgagtggcgaatgatcacagcaatgaacaccatccgaagcggggcaggcgtctgcgtcctgcacaactgtatctatgctgctgggggctatgatggtcaggaccagctgaacagcgtggagcgctacgatgtggaaacagagacgtggactttcgtagcccccatgaagcaccggcgaagtgccctggggatcactgtccaccaggggagaatctacgtccttggaggctatgatggtcacacgttcctggacagtgtggagtgttacgacccagatacagacacctggagcgaggtgacccgaatgacatcgggccggagtggggtgggcgtggctgtcaccatggagccctgccggaagcagattgaccagcagaactgtacctgttgaggcacttttgtttcttgggcaaaaatacagtccaatggggagtatcattgtttttgtacaaaaaccgggactaaaagaaaagacagcactgcaaataacccatcttccgggaagggaggccaggatgcctcagtgttaaaatgacatctcaaaagaagtccaaagcgggaatcatgtgcccctcagcggagccccgggagtgtccaagacagcctggctgggaaagggggtgtggaaagagcaggcttccaggagagaggcccccaaaccctctggccgggtaataggcctgggtcccactcacccatgccggcagctgtcaccatgtgatttattcttggatacctgggagggggccaatgggggcctcagggggaggccccctctggaaatgtggttcccagggatgggcctgtacatagaagccaccggatggcacttccccaccggatggacagttattttgttgataagtaaccctgtaattttccaaggaaaataaagaacagactaactagtgtctttc

SEQ ID NO: 296392 - DNA, 2350 bp, Homo sapiens
tctgcttagtcatggtgacctgcgcgcgctccgcgcctcccccacgcgcagcgatggaggcgccggggctcgggcggtggaggcggagccggagcgcggccatggcggggtccctgagtgccagaggtggtggtgttgcttatcttctggaaccccatgcagccagatcccaggcctagcggggctggggcctgctgccgattcctgcccctgcagtcacagtgccctgagggggcaggggacgcggtgatgtacgcctccactgagtgcaaggcggaggtgacgccctcccagcatggcaaccgcaccttcagctacaccctggaggatcataccaagcaggcctttggcatcatgaacgagctgcggctcagccagcagctgtgtgacgtcacactgcaggtcaagtaccaggatgcaccggccgcccagttcatggcccacaaggtggtgctggcctcatccagccctgtcttcaaggccatgttcaccaacgggctgcgggagcagggcatggaggtggtgtccattgagggtatccaccccaaggtcatggagcgcctcattgaattcgcctacacggcctccatctccatgggcgagaagtgtgtcctccacgtcatgaacggtgctgtcatgtaccagatcgacagcgttgtccgtgcctgcagtgacttcctggtgcagcagctggaccccagcaatgccatcggcatcgccaacttcgctgagcagattggctgtgtggagttgcaccagcgtgcccgggagtacatctacatgcatttggggaggtggccaagcaagaggagttcttcaacctgtcccactgccaactggtgaccctcatcagccgggacgacctgaacgtgcgctgcgagtccgaggtcttccacgcctgcatcaactgggtcaagtacgactgcgaacagcgacggttctacgtccaggcgctgctgcgggccgtgcgctgccactcgttgacgccgaacttcctgcagatgcagctgcagaagtgcgagatcctgcagtccgactcccgctgcaaggactacctggtcaagatcttcgaggagctcaccctgcacaagcccacgcaggtgatgccctgccgggcgcccaaggtgggccgcctgatctacaccgcgggcggctacttccgacagtcgctcagctacctggaggcttacaaccccagtgacggcacctggctccggttggcggacctgcaggtgccgcggagcggcctggccggctgcgtggtgggcgggctgttgtacgccgtgggcggcaggaacaactcgcccgacggcaacaccgactccagcgccctggactgttacaaccccatgaccaatcagtggtcgccctgcgcccccatgagcgtgccccgtaaccgcatcggggtgggggtcatcgatggccacatctatgccgtcggcggctcccacggctgcatccaccacaacagtgtggagaggcgtctgcgtcctgcacaactgtatctatgctgctgggggctatgatggtcaggaccagctgaacagcgtggagcgctacgatgtggaaacagagacgtggactttcgtagcccccatgaagcaccggcgaagtgccctggggatcactgtccaccaggggagaatctacgtccttggaggctatgatggtcacacgttcctggacagtgtggagtgttacgacccagatacagacacctggagcgaggtgacccgaatgacatcgggccggagtggggtgggcgtggctgtcaccatggagccctgccggaagcagattgaccagcagaactgtacctgttgaggcacttttgtttcttgggcaaaaatacagtccaatggggagtatcattgtttttgtacaaaaaccgggactaaaagaaaagacagcactgcaaataacccatcttccgggaagggaggccaggatgcctcagtgttaaaatgacatctcaaaagaagtccaaagcgggaatcatgtgcccctcagcggagccccgggagtgtccaagacagcctggctgggaaagggggtgtggaaagagcaggcttccaggagagaggcccccaaaccctctggccgggtaataggcctgggtcccactcacccatgccggcagctgtcaccatgtgatttattcttggatacctgggagggggccaatgggggcctcagggggaggccccctctggaaatgtggttcccagggatgggcctgtacatagaagccaccggatggcacttccccaccggatggacagttattttgttgataagtaaccctgtaattttccaaggaaaataaagaacagactaactagtgtctttc

SEQ ID NO: 296393 - DNA, 2598 bp, Homo sapiens
cttttcgggcgtcccgaggccgctccccaaccgacaaccaagaccccgcaggccacgcagccctggagccgaggccccccgacggcggaggcgcccgcgggtcccctacagccaaggtccctgagtgccagaggtggtggtgttgcttatcttctggaaccccatgcagccagatcccaggcctagcggggctggggcctgctgccgattcctgcccctgcagtcacagtgccctgagggggcaggggacgcggtgatgtacgcctccactgagtgcaaggcggaggtgacgccctcccagcatggcaaccgcaccttcagctacaccctggaggatcataccaagcaggcctttgaggcattccaatttggacaccgggagcggcctttggccggggccttccaaggaccccaggagcaaggctgtgtgacgtcacactgcaggtcaagtaccaggatgcaccggccgcccagttcatggcccacaaggtggtgctggcctcatccagccctgtcttcaaggccatgttcaccaacgggctgcgggagcagggcatggaggtggtgtccattgagggtatccaccccaaggtcatggagcgcctcattgaattcgcctacacggcctccatctccatgggcgagaagtgtgtcctccacgtcatgaacggtgctgtcatgtaccagatcgacagcgttgtccgtgcctgcagtgacttcctggtgcagcagctggaccccagcaatgccatcggcatcgccaacttcgctgagcagattggctgtgtggagttgcaccagcgtgcccgggagtacatctacatgcatttggggaggtggccaagcaagaggagttcttcaacctgtcccactgccaactggtgaccctcatcagccgggacgacctgaacgtgcgctgcgagtccgaggtcttccacgcctgcatcaactgggtcaagtacgactgcgaacagcgacggttctacgtccaggcgctgctgcgggccgtgcgctgccactcgttgacgccgaacttcctgcagatgcagctgcagaagtgcgagatcctgcagtccgactcccgctgcaaggactacctggtcaagatcttcgaggagctcaccctgcacaagcccacgcaggtgatgccctgccgggcgcccaaggtgggccgcctgatctacaccgcgggcggctacttccgacagtcgctcagctacctggaggcttacaaccccagtgacggcacctggctccggttggcggacctgcaggtgccgcggagcggcctggccggctgcgtggtgggcgggctgttgtacgccgtgggcggcaggaacaactcgcccgacggcaacaccgactccagcgccctggactgttacaaccccatgaccaatcagtggtcgccctgcgcccccatgagcgtgccccgtaaccgcatcggggtgggggtcatcgatggccacatctatgccgtcggcggctcccacggctgcatccaccacaacagtgtggagaggtatgagccagagcgggatgagtggcacttggtggccccaatgctgacacgaaggatcggggtgggcgtggctgtcctcaatcgtctcctttatgccgtggggggctttgacgggacaaaccgccttaattcagctgagtgttactacccagagaggaacgagtggcgaatgatcacagcaatgaacaccatccgaagcggggcaggcgtctgcgtcctgcacaactgtatctatgctgctgggggctatgatggtcaggaccagctgaacagcgtggagcgctacgatgtggaaacagagacgtggactttcgtagcccccatgaagcaccggcgaagtgccctggggatcactgtccaccaggggagaatctacgtccttggaggctatgatggtcacacgttcctggacagtgtggagtgttacgacccagatacagacacctggagcgaggtgacccgaatgacatcgggccggagtggggtgggcgtggctgtcaccatggagccctgccggaagcagattgaccagcagaactgtacctgttgaggcacttttgtttcttgggcaaaaatacagtccaatggggagtatcattgtttttgtacaaaaaccgggactaaaagaaaagacagcactgcaaataacccatcttccgggaagggaggccaggatgcctcagtgttaaaatgacatctcaaaagaagtccaaagcgggaatcatgtgcccctcagcggagccccgggagtgtccaagacagcctggctgggaaagggggtgtggaaagagcaggcttccaggagagaggcccccaaaccctctggccgggtaataggcctgggtcccactcacccatgccggcagctgtcaccatgtgatttattcttggatacctgggagggggccaatgggggcctcagggggaggccccctctggaaatgtggttcccagggatgggcctgtacatagaagccaccggatggcacttccccaccggatggacagttattttgttgataagtaaccctgtaattttccaaggaaaataaagaacagactaactagtgtctttc

SEQ ID NO: 296394 - DNA, 937 bp, Homo sapiens
ggaggtgatggctggggttcccaaagccagacccccagagtcaccttctctgcatggtgccctttaggcgtctgcgtcctgcacaactgtatctatgctgctgggggctatgatggtcaggaccagctgaacagcgtggagcgctacgatgtggaaacagagacgtggactttcgtagcccccatgaagcaccggcgaagtgccctggggatcactgtccaccaggggagaatctacgtccttggaggctatgatggtcacacgttcctggacagtgtggagtgttacgacccagatacagacacctggagcgaggtgacccgaatgacatcgggccggagtggggtgggcgtggctgtcaccatggagccctgccggaagcagattgaccagcagaactgtacctgttgaggcacttttgtttcttgggcaaaaatacagtccaatggggagtatcattgtttttgtacaaaaaccgggactaaaagaaaagacagcactgcaaataacccatcttccgggaagggaggccaggatgcctcagtgttaaaatgacatctcaaaagaagtccaaagcgggaatcatgtgcccctcagcggagccccgggagtgtccaagacagcctggctgggaaagggggtgtggaaagagcaggcttccaggagagaggcccccaaaccctctggccgggtaataggcctgggtcccactcacccatgccggcagctgtcaccatgtgatttattcttggatacctgggagggggccaatgggggcctcagggggaggccccctctggaaatgtggttcccagggatgggcctgtacatagaagccaccggatggcacttccccaccggatggacagttattttgttgataagtaaccctgtaattttccaaggaaaataaagaacagactaactagtgtctttc

SEQ ID NO: 296395 - DNA, 990 bp, Homo sapiens
tctgcttagtcatggtgacctgcgcgcgctccgcgcctcccccacgcgcagcgatggaggcgccggggctcgggcggtggaggcggagccggagcgcggccatggcggggtccctgagtgccagaggtggtggtgttgcttatcttctggaaccccatgcagccagatcccaggcctagcggggctggggcctgctgccgattcctgcccctgcagtcacagtgccctgagggggcaggggacgcggtgatgtacgcctccactgagtgcaaggcggaggtgacgccctcccagcatggcaaccgcaccttcagctacaccctggaggatcataccaagcaggcctttggcatcatgaacgagctgcggctcagccagcagctgtgtgacgtcacactgcaggtcaagtaccaggatgcaccggccgcccagttcatggcccacaaggtggtgctggcctcatccagccctgtcttcaaggccatgttcaccaacgggctgcgggagcagggcatggaggtggtgtccattgagggtatccaccccaaggtcatggagcgcctcattgaattcgcctacacggcctccatctccatgggcgagaagtgtgtcctccacgtcatgaacggtgctgtcatgtaccagatcgacagcgttgtccgtgcctgcagtgacttcctggtgcagcagctggaccccagcaatgccatcggcatcgccaacttcgctgagcagattggctgtgtggagttgcaccagcgtgcccgggagtacatctacatgcatttggggaggtggccaagcaagaggagttcttcaacctgtcccactgccaactggtgaccctcatcagccgggacgacctgaacgtgcgctgcgagtccgaggtcttccacgcctgcatcaactgggtcaagtacgactgtgagagcgttggccaacgctgctcacagcatgcttcccctagccaaccaaaaagaggtacaagag

SEQ ID NO: 296396 - DNA, 912 bp, Homo sapiens
tagtaagagactaaggttttgctatgttgcccaggctggcttcgaactcctggcctcaagcaatcctcctgcctcagccctgcaaagtgctaggattataggcgtgagccaccacgcccggcctgcttttgcatctcacagctgcatctctctctttctgtcccctgctcttggatgtggtgtgacaggtggtgaccatcccttctgttcttcccgcaggaggctatgatggtcacacgttcctggacagtgtggagtgttacgacccagatacagacacctggagcgaggtgacccgaatgacatcgggccggagtggggtgggcgtggctgtcaccatggagccctgccggaagcagattgaccagcagaactgtacctgttgaggcacttttgtttcttgggcaaaaatacagtccaatggggagtatcattgtttttgtacaaaaaccgggactaaaagaaaagacagcactgcaaataacccatcttccgggaagggaggccaggatgcctcagtgttaaaatgacatctcaaaagaagtccaaagcgggaatcatgtgcccctcagcggagccccgggagtgtccaagacagcctggctgggaaagggggtgtggaaagagcaggcttccaggagagaggcccccaaaccctctggccgggtaataggcctgggtcccactcacccatgccggcagctgtcaccatgtgatttattcttggatacctgggagggggccaatgggggcctcagggggaggccccctctggaaatgtggttcccagggatgggcctgtacatagaagccaccggatggcacttccccaccggatggacagttattttgttgataagtaaccctgtaattttccaaggaaaataaagaacagactaactagtgtctttc

SEQ ID NO: 296397 - DNA, 194 bp, Homo sapiens
cgacggcaacaccgactccagcgccctggactgttacaaccccatgaccaatcagtggtcgccctgcgcccccatgagcgtgccccgtaaccgcatcggggtgggggtcatcgatggccacatctatgccgtcggcggctcccacggctgcatccaccacaacagtgtggagaggtgagtggcagggcctgggg

SEQ ID NO: 296398 - DNA, 445 bp, Homo sapiens
ctagctgcaaataaatactaaattcttgttagtatgtagagggaagattagaactttctgttatttagttggaaatgcatcataaaaataaagtgaggcaggagcagtggctcacgcctgttatcacagcactttgggaggccaaggcacttgagcacagtagttcgaggccaacttgggcaacataatcagacctggtctccaaaaaaatttttttttaaattagccaggtaggcagggcgcggtggctcatgcctggaatcccagcactttgggaggctgaggcaggtggatcacctgaggtcgggagtttgagaccagcctaaccaacacggcaaaaccccgtctctattaaaaatacaaaattagctgggcattggtggcacgtgcctgtagtcccagctactcgggaggctgaggcaggagaatcgcttgaacccaggag

SEQ ID NO: 296399 - DNA, 211 bp, Homo sapiens
cccggggaatctgcctttttatatgatgcgtttttattaaacaggacccaccgggctcttttagtttcctcccaccttggtaggttgattgccgatgtgcagggttagtgtcgatcgtttctttaaattttcaccgcgagtgtttagcaagtcagaacccatacatagtccactgatcactcgactagactatcatacatgacagctcgac

SEQ ID NO: 296400 - DNA, 6636 bp, Homo sapiens
cccggggaatctgcctttttatatgatgcgtttttattaaacaggacccaccgggctcttttagtttcctcccaccttggtaggttgattgccgatgtgcagggttagtgtcgatcgtttctttaaattttcacaggcatatgatagatttgtcccacataaatgtggccctgatcgtggagtgagtcctaacaagagagcctgaccttaggctgtacacacactgtggaatttcttcaagggagctgccggccggcgcagaacccccaggagcacaggtctctccgggccgctgtcctgcgtaactgttctccagagcgccagccagccacgggcctgattccagaggagccgaactgacaggacacagcaggctggagttggtgttagattgcttcacattctgttgtcaccaccaagaactccaagtttttcgttttgttttgttttcaaagtgcttacaatgcatgtagacattgttctttgtggtctgactctatgatcgatcacagtgacttagattcaggaaagaacattaacgtcacaagttctaagtagttttcacagcaaagaatatttgataatggttgcacttatcttcagtgcaggttagaagagtcttctcaaccaagcttaactcgagttgtcttctcagccctcaaaaggctcttgtacaaaatgtagattaaaatttgggtgattgttgattgacctttgcataccctggaaagccagggtgtgagtggggtggttgggagtggtgccagttgaacagcagattctgcttcttgtcactgtttcaaaagcgtcaactctgtgttcctagtttcgatgaactccccattcatttttaacacacttcccagataaggcaatgtgctggacaggcacacggcatggccctcggctagagcagggtctgtgatggcctcacctggcagccctctggcctagttcccaccacacatgaggtggtggaatggcctgaaggtggaacagacctgtttttttcctttttaaatgcagtaaggtggcctgtttatcactggctctgtgatacatgacattctttgggaatttggtggccactgcttcagtcacctctgtttttctgaaggctgttccagcagggctgccctgttcatcagcggatgttcactctggcctgccgttccccgtggcatgcggggtgagggtggctttcttccagccccaaatgagacgagtctgtgtcatcattgaaactgcttttcgtaattgcgggtaggttcctgtaggtgagacatattctccataaagctactgtagtagaattcattctgggcaaacactgaaaaaagtgccttacagtatttctgctcatgaaagagtttcactattttggatatattctaaagtggacctgagctatttgagcaaataatgatagggcatactcagacattttagctaccttttatacctacgatttcatgtcacatttactaatagaattaagggaaatagaagcccgttctttcttactgcccctggagggagcatggcgctagggctctcagcctcctagaaggaagggactaaggagacgggcacagacttgcgtcatctcgtttccacagttgacgttttatattactttctcaaattaagttaccaaaacaaactgaagagctgaagcaggtcttccagaccctgcgatcctttctgtagcagtgattctaaagtggcgtttgctgtgtgcttgagagtaacactgcacgctgcaggggctgttgcagcagtcagtcccaggaagccacagcgcttgtaggatctgctaggaccctgcagctgtgctgccgccacctctgctccagagtgtcccagccaaccctcggaagatgggattgccagtcagccctgcctcaccatgcctgcaggaggctgtccagggagcaggtctgtgtgcccatcagcaggttcccatggctgtcactgcccactcatttccacagttagatacggatgtgttgatgtatttcgtctagtttatttggctcagtccacagctgcgttggagtggtgactttggtagcccttgagctctaattaagagagatccaaaccactcagtacccactgggcagtgggaaggcctaccgacttactttatcattgagggcttactgatacaatgaaatgagtttcatgactttttttttttttaaacactttttgaaatagagtgtgctgtgtttaaaaccaaaaatatgcatgttgtctctgaaaagtaggcattgaaacagacttttttgtagtcagtgttaataaaacggatcctgtttgggccttcattgttaaggtggacttcatggccactggaaggtctgttttggtgttacctgagtgtgacacaggccctggggtgtgcgtgtttctctaactgtctacacgtgcacataggcagactttctcatagaatgttcttgaaaggtgattgggcaaagtcatgcaggcccgccttaaagcgctgattagaacagtccaacacagtccgacctcactcaatacccacaaccatcgaaaatggattcttagtaccagacaatcccagtaatgaaggtttagtttccttgaaggaaactacagaaaaggaaagaagcagaatgagaaaggaatggtacttaggtgtttggtatgctgctcacgtgaagtcagcccacaccagccaaaccctcgtggaagatctgctgcaaccattatctttgttcttgagttcatcatgcatttaaaatgagatgcaagagcatttagcataccatgtaaatatggaccttttaaaattaaaatactattggaagtgctttcaactcagccacatcttagctattagttctttgtgttgtcttatcaaagtttaatggatacagttccacagttgttgatgtgtttgtgtgtatattcgatttttataaagatggtagtaagtcaatacatttatcctgatctgtgtattatttgttcacaaattcaagaagcttaaaggtcgtaaatatcagtatctcataaggtaaaccaatagctgattatgtggagccaagttacttcttttctttttgcattatcttgttttggttttgtgctgtaatagaagttcacttagctactttagataaccttgcattaccactggtctggccacgtttgttaaatccttatactgatattcttctaaagagtaaatctcatcatttttccagacaaattttgaggggtttctctgttttgtggacaggcagcagcctccgtaggcacccgcaccctgccttgctggaggagatgggatggggcgggaggtggcttcaccataactatttttaatatgggtcattcttagcatgatttgtaaaggtctcaggcaaacagttgttgaagcttgcttctgtggcatttctgaattgtggcagagcttagatcctgcacccaggggtctttttttcaaacagcatcttgctcagttctgtgaacagaaggctttgttactgaaggaggtggaagaggagtttagggtgaaaaggaggaagggatggacagacccaggtgaggagaggcctggggattggggaagctgtcatctcagtgttaataatcaacttgcttctaacacactggcttatcaggggaggtcatccagtccggtcggtggagttgagagcccttgggccagggtgtttggcggcacaggggcatccgctggatggcctggaggagtgggggaggggaacgtcttcactgggtggtgatcagctgggacagttcaggtagggcaggtgagggacccccgaggccctggagccttgtcctgggatgggtttgaagaactcatcactcatcacttgttttcttttggcttttgttgtttttgttttgttctgtttgttttgttttgtatttctttgttattttattgggaaggtaagcggaatgtgctcatagaccatcagacgcttgtcgaaggcaggtcctagtcatgtaattgcacaggacaaggaggtcagcgtgtgtgatggcagcatgctgtgccggcacatcgtggagtcctagaaactctctagtccctgcggctgttcccctcctctgctctctccctggagaggactgccagctcttaagaaacattcctggtgcggtgtctgcagtgccctttgtgggtgacttcaggcttcccgctttcgtggtgctcttcctgggattcgtttttttattaccctccctccctacttgtaggcctcagctatggcttgacgtaatcgcttttagacccaggttggcttcccttcattaagctatgatcctccaccccattttttttttttttaatttggagtgggagggaggggggtgggcgagagaaagctcgaaaggtattattggtttttcaaaaaattagaggtgacgattctaccagggagttgactgataggagtgtgtgcagggcaggaaaggttcggaggcacccgactaccaccactcggaaagccgctagtccagatcgactagggagaggcttagatactttagtgtatttaaagagcatttcagttaactttttcagctatttttaaagtttgtgaatggagtgttattttggacattcttaaatatgaattctccaaaggcatttagccttgacttaatattaaatcctaaggattttatgtaaggtttttttgcaacctatttaattttttttaaatgcctaacttctgaggtgcataagcccgtggtttgtgtactggaactaaagcggaactcactgattcatattggatccccaggtataccttctgctggtagcatatggctggaaaaggccgtttgcctcacacattgtaacctgccttggctagaaaatgcttttaatgtctcaactctctcttttctgtgtcatgttttggtaggaaatctttaagattggcggacggaacaggtattttagtgagacacttctgagtacttgctttttcctttgacttctaaccaactaaaagagaaggaggtcttcatgttgatattttgcttggttttattttactgattttaaaaggtatatagaaaaatgtaggcctttaaaaagaaacagcatgtagttttttattttaatatgttccatagagtggataggcagacaggtactattgtaatgtattctgtatttaataatttaatatactctagaaagtagacctcatgcattcttttagcatgattttcttttaaactgcttttcattttaagggcacccgtggcggaagctggttttgcaaggactgtgtaagctgtatgcgttctagctgtatgcgttctgtagtcttttcttaggtgggtaacattttcaataacgcgcgcacagcacacaggggtgccctgagccgaaggagcaaaaaaagccaccgctcgtttctataatccagctttgcttttcacaggcgtgggatccaggatggtgtcctctgtgaggacttgaactctggggctttaattccactgtttaattttcaggtaccacagcagcaaagcacagagtgtgacctttttcatgtctgagctgattctgtttgctccacgtgcctgcttcttgctactgttcatttagtaatgggatcacctcaccatgccatgctctgggctctccctctctgtccatttctgttttgctttcctggctaaacccatctaccattcttaacactggtagctcctgtcccattccaagactcactctctcagaccttcccatctccctggctttccatgctcctctccctccacctcctggcttcaactgggtgagggccgtattcctgccactctgctccgcctcagccttgagaactccacgtgggctgggtgggaaggtgctgacgattttcacactgtgtttaccactccatcacctctccatcacctctcaacctttgcttcgacaggtcttcactcacgatttattcctccaggtctttgattggagagagtaactttttaattctgttgttttgcagtttggctctgtaggagtgagtggcgattcaaagatgccggcgtcccgcagtgtgcggttcgtgcccttaaccacccgcttctttgtttcccgcccctctgctttcgcaggagctcttgtgcttgagttcagtgttagtggtagcgtggctcactccacttggaggtggcggccgtctgaccgtgtgttactgctttgccgacggggcctcccggccctgatgcgtgtacactctgcgggctgcaccgggtggctctggttgggggcgaagctgtgttgactgggagagcgttggaaattgagacatggagagatgacgggagtgcgtttctctgggtttgatctccatcctgttttctcccagacacaccacacctaccttgggggaatgccgttgcctgttccacccctttgttcacttcgcgttaactgctgtggtaactttttcaggatctgtgtgaagaatggtaatgacgtagttgaaaggaaaatgtactgttgtgtgtttcatttgtgtgatttcgtaccaaaaaaatgtgtttgaactatattgtatgtaatttggaagtcgtgttaataaaaccctgcagtttcca

SEQ ID NO: 296401 - DNA, 6598 bp, Homo sapiens
cccggggaatctgcctttttatatgatgcgtttttattaaacaggacccaccgggctcttttagtttcctcccaccttggtaggttgattgccgatgtgcagggttagtgtcgatcgtttctttaaattttcacaggcatatgatagatttgtcccacataaatgtggccctgatcgtggagtgagtcctaacaagagagcctgaccttaggctgtacacacactgtggaatttcttcaagggagctgccggccggcgcagaacccccaggagcacaggtctctccgggccgctgtcctgcgtaactgttctccagagcgccagccagccacgggcctgattccagaggagccgaactgacaggacacagcaggctggagttggtgttagattgcttcacattctgttgtcaccaccaagaactccaagtttttcgttttgttttgttttcaaagtgcttacaatgcatgtagacattgttctttgtggtctgactctatgatcgatcacagtgacttagattcaggaaagaacattaacgtcacaagttctaagtagttttcacagcaaagaatatttgataatggttgcacttatcttcagtgcaggttagaagagtcttctcaaccaagcttaactcgagttgtcttctcagccctcaaaaggctcttgtacaaaatgtagattaaaatttgggtgattgttgattgacctttgcataccctggaaagccagggtgtgagtggggtggttgggagtggtgccagttgaacagcagattctgcttcttgtcactgtttcaaaagcgtcaactctgtgttcctagtttcgatgaactccccattcatttttaacacacttcccagataaggcaatgtgctggacaggcacacggcatggccctcggctagagcagggtctgtgatggcctcacctggcagccctctggcctagttcccaccacacatgaggtggtggaatggcctgaaggtggaacagacctgtttttttcctttttaaatgcagtaaggtggcctgtttatcactggctctgtgatacatgacattctttgggaatttggtggccactgcttcagtcacctctgtttttctgaaggctgttccagcagggctgccctgttcatcagcggatgttcactctggcctgccgttccccgtggcatgcggggtgagggtggctttcttccagccccaaatgagacgagtctgtgtcatcattgaaactgcttttcgtaattgcgggtaggttcctgtaggtgagacatattctccataaagctactgtagtagaattcattctgggcaaacactgaaaaaagtgccttacagtatttctgctcatgaaagagtttcactattttggatatattctaaagtggacctgagctatttgagcaaataatgatagggcatactcagacattttagctaccttttatacctacgatttcatgtcacatttactaatagaattaagggaaatagaagcccgttctttcttactgcccctggagggagcatggcgctagggctctcagcctcctagaaggaagggactaaggagacgggcacagacttgcgtcatctcgtttccacagttgacgttttatattactttctcaaattaagttaccaaaacaaactgaagagctgaagcaggtcttccagaccctgcgatcctttctgtagcagtgattctaaagtggcgtttgctgtgtgcttgagagtaacactgcacgctgcaggggctgttgcagcagtcagtcccaggaagccacagcgcttgtaggatctgctaggaccctgcagctgtgctgccgccacctctgctccagagtgtcccagccaaccctcggaagatgggattgccagtcagccctgcctcaccatgcctgcaggaggctgtccagggagcaggtctgtgtgcccatcagcaggttcccatggctgtcactgcccactcatttccacagttagatacggatgtgttgatgtatttcgtctagtttatttggctcagtccacagctgcgttggagtggtgactttggtagcccttgagctctaattaagagagatccaaaccactcagtacccactgggcagtgggaaggcctaccgacttactttatcattgagggcttactgatacaatgaaatgagtttcatgactttttttttttttaaacactttttgaaatagagtgtgctgtgtttaaaaccaaaaatatgcatgttgtctctgaaaagtaggcattgaaacagacttttttgtagtcagtgttaataaaacggatcctgtttgggccttcattgttaaggtggacttcatggccactggaaggtctgttttggtgttacctgagtgtgacacaggccctggggtgtgcgtgtttctctaactgtctacacgtgcacataggcagactttctcatagaatgttcttgaaaggtgattgggcaaagtcatgcaggcccgccttaaagcgctgattagaacagtccaacacagtccgacctcactcaatacccacaaccatcgaaaatggattcttagtaccagacaatcccagtaatgaaggtttagtttccttgaaggaaactacagaaaaggaaagaagcagaatgagaaaggaatggtacttaggtgtttggtatgctgctcacgtgaagtcagcccacaccagccaaaccctcgtggaagatctgctgcaaccattatctttgttcttgagttcatcatgcatttaaaatgagatgcaagagcatttagcataccatgtaaatatggaccttttaaaattaaaatactattggaagtgctttcaactcagccacatcttagctattagttctttgtgttgtcttatcaaagtttaatggatacagttccacagttgttgatgtgtttgtgtgtatattcgatttttataaagatggtagtaagtcaatacatttatcctgatctgtgtattatttgttcacaaattcaagaagcttaaaggtcgtaaatatcagtatctcataaggtaaaccaatagctgattatgttttggttttgtgctgtaatagaagttcacttagctactttagataaccttgcattaccactggtctggccacgtttgttaaatccttatactgatattcttctaaagagtaaatctcatcatttttccagacaaattttgaggggtttctctgttttgtggacaggcagcagcctccgtaggcacccgcaccctgccttgctggaggagatgggatggggcgggaggtggcttcaccataactatttttaatatgggtcattcttagcatgatttgtaaaggtctcaggcaaacagttgttgaagcttgcttctgtggcatttctgaattgtggcagagcttagatcctgcacccaggggtctttttttcaaacagcatcttgctcagttctgtgaacagaaggctttgttactgaaggaggtggaagaggagtttagggtgaaaaggaggaagggatggacagacccaggtgaggagaggcctggggattggggaagctgtcatctcagtgttaataatcaacttgcttctaacacactggcttatcaggggaggtcatccagtccggtcggtggagttgagagcccttgggccagggtgtttggcggcacaggggcatccgctggatggcctggaggagtgggggaggggaacgtcttcactgggtggtgatcagctgggacagttcaggtagggcaggtgagggacccccgaggccctggagccttgtcctgggatgggtttgaagaactcatcactcatcacttgttttcttttggcttttgttgtttttgttttgttctgtttgttttgttttgtatttctttgttattttattgggaaggtaagcggaatgtgctcatagaccatcagacgcttgtcgaaggcaggtcctagtcatgtaattgcacaggacaaggaggtcagcgtgtgtgatggcagcatgctgtgccggcacatcgtggagtcctagaaactctctagtccctgcggctgttcccctcctctgctctctccctggagaggactgccagctcttaagaaacattcctggtgcggtgtctgcagtgccctttgtgggtgacttcaggcttcccgctttcgtggtgctcttcctgggattcgtttttttattaccctccctccctacttgtaggcctcagctatggcttgacgtaatcgcttttagacccaggttggcttcccttcattaagctatgatcctccaccccattttttttttttttaatttggagtgggagggaggggggtgggcgagagaaagctcgaaaggtattattggtttttcaaaaaattagaggtgacgattctaccagggagttgactgataggagtgtgtgcagggcaggaaaggttcggaggcacccgactaccaccactcggaaagccgctagtccagatcgactagggagaggcttagatactttagtgtatttaaagagcatttcagttaactttttcagctatttttaaagtttgtgaatggagtgttattttggacattcttaaatatgaattctccaaaggcatttagccttgacttaatattaaatcctaaggattttatgtaaggtttttttgcaacctatttaattttttttaaatgcctaacttctgaggtgcataagcccgtggtttgtgtactggaactaaagcggaactcactgattcatattggatccccaggtataccttctgctggtagcatatggctggaaaaggccgtttgcctcacacattgtaacctgccttggctagaaaatgcttttaatgtctcaactctctcttttctgtgtcatgttttggtaggaaatctttaagattggcggacggaacaggtattttagtgagacacttctgagtacttgctttttcctttgacttctaaccaactaaaagagaaggaggtcttcatgttgatattttgcttggttttattttactgattttaaaaggtatatagaaaaatgtaggcctttaaaaagaaacagcatgtagttttttattttaatatgttccatagagtggataggcagacaggtactattgtaatgtattctgtatttaataatttaatatactctagaaagtagacctcatgcattcttttagcatgattttcttttaaactgcttttcattttaagggcacccgtggcggaagctggttttgcaaggactgtgtaagctgtatgcgttctagctgtatgcgttctgtagtcttttcttaggtgggtaacattttcaataacgcgcgcacagcacacaggggtgccctgagccgaaggagcaaaaaaagccaccgctcgtttctataatccagctttgcttttcacaggcgtgggatccaggatggtgtcctctgtgaggacttgaactctggggctttaattccactgtttaattttcaggtaccacagcagcaaagcacagagtgtgacctttttcatgtctgagctgattctgtttgctccacgtgcctgcttcttgctactgttcatttagtaatgggatcacctcaccatgccatgctctgggctctccctctctgtccatttctgttttgctttcctggctaaacccatctaccattcttaacactggtagctcctgtcccattccaagactcactctctcagaccttcccatctccctggctttccatgctcctctccctccacctcctggcttcaactgggtgagggccgtattcctgccactctgctccgcctcagccttgagaactccacgtgggctgggtgggaaggtgctgacgattttcacactgtgtttaccactccatcacctctccatcacctctcaacctttgcttcgacaggtcttcactcacgatttattcctccaggtctttgattggagagagtaactttttaattctgttgttttgcagtttggctctgtaggagtgagtggcgattcaaagatgccggcgtcccgcagtgtgcggttcgtgcccttaaccacccgcttctttgtttcccgcccctctgctttcgcaggagctcttgtgcttgagttcagtgttagtggtagcgtggctcactccacttggaggtggcggccgtctgaccgtgtgttactgctttgccgacggggcctcccggccctgatgcgtgtacactctgcgggctgcaccgggtggctctggttgggggcgaagctgtgttgactgggagagcgttggaaattgagacatggagagatgacgggagtgcgtttctctgggtttgatctccatcctgttttctcccagacacaccacacctaccttgggggaatgccgttgcctgttccacccctttgttcacttcgcgttaactgctgtggtaactttttcaggatctgtgtgaagaatggtaatgacgtagttgaaaggaaaatgtactgttgtgtgtttcatttgtgtgatttcgtaccaaaaaaatgtgtttgaactatattgtatgtaatttggaagtcgtgttaataaaaccctgcagtttcca

SEQ ID NO: 296402 - DNA, 6951 bp, Homo sapiens
cccggggaatctgcctttttatatgatgcgtttttattaaacaggacccaccgggctcttttagtttcctcccaccttggtaggttgattgccgatgtgcagggttagtgtcgatcgtttctttaaattttcacaggcatatgatagatttgtcccacataaatgtggccctgatcgtggagtgagtcctaacaagagagcctgaccttaggctgtacacacactgtggaatttcttcaagggagctgccggccggcgcagaacccccaggagcacaggtctctccgggccgctgtcctgcgtaactgttctccagagcgccagccagccacgggcctgattccagaggagccgaactgacaggacacagcaggctggagttggtgttagattgcttcacattctgttgtcaccaccaagaactccaagtttttcgttttgttttgttttcaaagtgcttacaatgcatgtagacattgttctttgtggtctgactctatgatcgatcacagtgacttagattcaggaaagaacattaacgtcacaagttctaagtagttttcacagcaaagaatatttgataatggttgcacttatcttcagtgcaggttagaagagtcttctcaaccaagcttaactcgagttgtcttctcagccctcaaaaggctcttgtacaaaatgtagattaaaatttgggtgattgttgattgacctttgcataccctggaaagccagggtgtgagtggggtggttgggagtggtgccagttgaacagcagattctgcttcttgtcactgtttcaaaagcgtcaactctgtgttcctagtttcgatgaactccccattcatttttaacacacttcccagataaggcaatgtgctggacaggcacacggcatggccctcggctagagcagggtctgtgatggcctcacctggcagccctctggcctagttcccaccacacatgaggtggtggaatggcctgaaggtggaacagacctgtttttttcctttttaaatgcagtaaggtggcctgtttatcactggctctgtgatacatgacattctttgggaatttggtggccactgcttcagtcacctctgtttttctgaaggctgttccagcagggctgccctgttcatcagcggatgttcactctggcctgccgttccccgtggcatgcggggtgagggtggctttcttccagccccaaatgagacgagtctgtgtcatcattgaaactgcttttcgtaattgcgggtaggttcctgtaggtgagacatattctccataaagctactgtagtagaattcattctgggcaaacactgaaaaaagtgccttacagtatttctgctcatgaaagagtttcactattttggatatattctaaagtggacctgagctatttgagcaaataatgatagggcatactcagacattttagctaccttttatacctacgatttcatgtcacatttactaatagaattaagggaaatagaagcccgttctttcttactgcccctggagggagcatggcgctagggctctcagcctcctagaaggaagggactaaggagacgggcacagacttgcgtcatctcgtttccacagttgacgttttatattactttctcaaattaagttaccaaaacaaactgaagagctgaagcaggtcttccagaccctgcgatcctttctgtagcagtgattctaaagtggcgtttgctgtgtgcttgagagtaacactgcacgctgcaggggctgttgcagcagtcagtcccaggaagccacagcgcttgtaggatctgctaggaccctgcagctgtgctgccgccacctctgctccagagtgtcccagccaaccctcggaagatgggattgccagtcagccctgcctcaccatgcctgcaggaggctgtccagggagcaggtctgtgtgcccatcagcaggttcccatggctgtcactgcccactcatttccacagttagatacggatgtgttgatgtatttcgtctagtttatttggctcagtccacagctgcgttggagtggtgactttggtagcccttgagctctaattaagagagatccaaaccactcagtacccactgggcagtgggaaggcctaccgacttactttatcattgagggcttactgatacaatgaaatgagtttcatgactttttttttttttaaacactttttgaaatagagtgtgctgtgtttaaaaccaaaaatatgcatgttgtctctgaaaagtaggcattgaaacagacttttttgtagtcagtgttaataaaacggatcctgtttgggccttcattgttaaggtggacttcatggccactggaaggtctgttttggtgttacctgagtgtgacacaggccctggggtgtgcgtgtttctctaactgtctacacgtgcacataggcagactttctcatagaatgttcttgaaaggtgattgggcaaagtcatgcaggcccgccttaaagcgctgattagaacagtccaacacagtccgacctcactcaatacccacaaccatcgaaaatggattcttagtaccagacaatcccagtaatgaaggtttagtttccttgaaggaaactacagaaaaggaaagaagcagaatgagaaaggaatggtacttaggtgtttggtatgctgctcacgtgaagtcagcccacaccagccaaaccctcgtggaagatctgctgcaaccattatctttgttcttgagttcatcatgcatttaaaatgagatgcaagagcatttagcataccatgtaaatatggaccttttaaaattaaaatactattggaagtgctttcaactcagccacatcttagctattagttctttgtgttgtcttatcaaagtttaatggatacagttccacagttgttgatgtgtttgtgtgtatattcgatttttataaagatggtagtaagtcaatacatttatcctgatctgtgtattatttgttcacaaattcaagaagcttaaaggtcgtaaatatcagtatctcataaggtaaaccaatagctgattatgtggagccaagttacttcttttctttttgcattatcttgttttggttttgtgctgtaatagaagttcacttagctactttagataaccttgcattaccactggtctggccacgtttgttaaatccttatactgatattcttctaaagagtaaatctcatcatttttccagacaaattttgaggggtttctctgttttgtggacaggcagcagcctccgtaggcacccgcaccctgccttgctggaggagatgggatggggcgggaggtggcttcaccataactatttttaatatgggtcattcttagcatgatttgtaaaggtctcaggcaaacagttgttgaagcttgcttctgtggcatttctgaattgtggcagagcttagatcctgcacccaggggtctttttttcaaacagcatcttgctcagttctgtgaacagaaggctttgttactgaaggaggtggaagaggagtttagggtgaaaaggaggaagggatggacagacccaggtgaggagaggcctggggattggggaagctgtcatctcagtgttaataatcaacttgcttctaacacactggcttatcaggggaggtcatccagtccggtcggtggagttgagagcccttgggccagggtgtttggcggcacaggggcatccgctggatggcctggaggagtgggggaggggaacgtcttcactgggtggtgatcagctgggacagttcaggtagggcaggtgagggacccccgaggccctggagccttgtcctgggatgggtttgaagaactcatcactcatcacttgttttcttttggcttttgttgtttttgttttgttctgtttgttttgttttgtatttctttgttattttattgggaaggtaagcggaatgtgctcatagaccatcagacgcttgtcgaaggcaggtcctagtcatgtaattgcacaggacaaggaggtcagcgtgtgtgatggcagcatgctgtgccggcacatcgtggagtcctagaaactctctagtccctgcggctgttcccctcctctgctctctccctggagaggactgccagctcttaagaaacattcctggtgcggtgtctgcagtgccctttgtgggtgacttcaggcttcccgctttcgtggtgctcttcctgggattcgtttttttattaccctccctccctacttgtaggcctcagctatggcttgacgtaatcgcttttagacccaggttggcttcccttcattaagctatgatcctccaccccattttttttttttttaatttggagtgggagggaggggggtgggcgagagaaagctcgaaaggtattattggtttttcaaaaaattagaggtgacgattctaccagggagttgactgataggagtgtgtgcagggcaggaaaggttcggaggcacccgactaccaccactcggaaagccgctagtccagatcgactagggagaggcttagatactttagtgtatttaaagagcatttcagttaactttttcagctatttttaaagtttgtgaatggagtgttattttggacattcttaaatatgaattctccaaaggcatttagccttgacttaatattaaatcctaaggattttatgtaaggtttttttgcaacctatttaattttttttaaatgcctaacttctgaggtgcataagcccgtggtttgtgtactggaactaaagcggaactcactgattcatattggatccccaggtataccttctgctggtagcatatggctggaaaaggccgtttgcctcacacattgtaacctgccttggctagaaaatgcttttaatgtctcaactctctcttttctgtgtcatgttttggtaggaaatctttaagattggcggacggaacaggtattttagtgagacacttctgagtacttgctttttcctttgacttctaaccaactaaaagagaaggaggtcttcatgttgatattttgcttggttttattttactgattttaaaaggtatatagaaaaatgtaggcctttaaaaagaaacagcatgtagttttttattttaatatgttccatagagtggataggcagacaggtactattgtaatgtattctgtatttaataatttaatatactctagaaagtagacctcatgcattcttttagcatgattttcttttaaactgcttttcattttaagggcacccgtggcggaagctggttttgcaaggactgtgtaagctgtatgcgttctagctgtatgcgttctgtagtcttttcttaggtgggtaacattttcaataacgcgcgcacagcacacaggggtgccctgagccgaaggagcaaaaaaagccaccgctcgtttctataatccagctttgcttttcacaggcgtgggatccaggatggtgtcctctgtgaggacttgaactctggggctttaattccactgtttaattttcaggtaccacagcagcaaagcacagagtgtgacctttttcatgtctgagctgattctgtttgctccacgtgcctgcttcttgctactgttcatttagtaatgggatcacctcaccatgccatgctctgggctctccctctctgtccatttctgttttgctttcctggctaaacccatctaccattcttaacactggtagctcctgtcccattccaagactcactctctcagaccttcccatctccctggctttccatgctcctctccctccacctcctggcttcaactgggtgagggccgtattcctgccactctgctccgcctcagccttgagaactccacgtgggctgggtgggaaggtgctgacgattttcacactgtgtttaccactccatcacctctccatcacctctcaacctttgcttcgacaggtcttcactcacgatttattcctccaggtctttgattggagagagtaactttttaattctgttgttttgcagtttggctctgtaggagtgagtggcgattcaaagatgccggcgtcccgcagtgtgcggttcgtgcccttaaccacccgcttctttgtttcccgcccctctgctttcgcaggagctcttgtgcttgagttcagtgttagtggtagcgtggctcactccacttggaggtggcggccgtctgaccgtgtgttactgctttgccgacggggcctcccggccctgatgcgtgtacactctgcgggctgcaccgggtggctctggttgggggcgaagctgtgttgactgggagagcgttggaaattgagacatggagagatgacgggagtgcgtttctctgggtttgatctccatcctgttttctcccagacacaccacacctaccttgggggaatgccgttgcctgttccacccctttgttcacttcgcgttaactgctgtggtaactttttcaggatctgtgtgaagaatggtaatgacgtagttgaaaggaaaatgtactgttgtgtgtttcatttgtgtgatttcgtaccaaaaaaatgtgtttgaactatattgtatgtaatttggaagtcgtgttaataaaaccctgcagtttccaaaaaaaaaaaaacagcaaaaacaaaaaaagaaaaaaaaaaaaagaaaaaacaacgaaaacaaaaaaaacaaagacaaaaacaaaaaagaaaaaaaagaaaaaaggagaagaacacaacaaaaaaatgacaaagcgagaacaaaataagaagaaagaaaagaaagagagagagagagcagcacagaagaaagaagaaaaaaaaaaaaaaagaggaggagagagagagacaaccagaagagagaaaaaacaaaagcagaagaagacacaagaaaaagaaacaacaagagaggaaggaaaaaaaggaaagacaaaaaa

SEQ ID NO: 296403 - DNA, 4612 bp, Homo sapiens
  misc_feature (27)..(27): n is a, c, g, or t
tctagaggatcccgtaagtgcgagatngtcacgagtggtgactttggtagcccttgagctctaattaagagagatccaaaccactcagtacccactgggcagtgggaaggcctaccgacttactttatcattgagggcttactgatacaatgaaatgagtttcatgactttttttttttttaaacactttttgaaatagagtgtgctgtgtttaaaaccaaaaatatgcatgttgtctctgaaaagtaggcattgaaacagacttttttgtagtcagtgttaataaaacggatcctgtttgggccttcattgttaaggtggacttcatggccactggaaggtctgttttggtgttacctgagtgtgacacaggccctggggtgtgcgtgtttctctaactgtctacacgtgcacataggcagactttctcatagaatgttcttgaaaggtgattgggcaaagtcatgcaggcccgccttaaagcgctgattagaacagtccaacacagtccgacctcactcaatacccacaaccatcgaaaatggattcttagtaccagacaatcccagtaatgaaggtttagtttccttgaaggaaactacagaaaaggaaagaagcagaatgagaaaggaatggtacttaggtgtttggtatgctgctcacgtgaagtcagcccacaccagccaaaccctcgtggaagatctgctgcaaccattatctttgttcttgagttcatcatgcatttaaaatgagatgcaagagcatttagcataccatgtaaatatggaccttttaaaattaaaatactattggaagtgctttcaactcagccacatcttagctattagttctttgtgttgtcttatcaaagtttaatggatacagttccacagttgttgatgtgtttgtgtgtatattcgatttttataaagatggtagtaagtcaatacatttatcctgatctgtgtattatttgttcacaaattcaagaagcttaaaggtcgtaaatatcagtatctcataaggtaaaccaatagctgattatgtggagccaagttacttcttttctttttgcattatcttgttttggttttgtgctgtaatagaagttcacttagctactttagataaccttgcattaccactggtctggccacgtttgttaaatccttatactgatattcttctaaagagtaaatctcatcatttttccagacaaattttgaggggtttctctgttttgtggacaggcagcagcctccgtaggcacccgcaccctgccttgctggaggagatgggatggggcgggaggtggcttcaccataactatttttaatatgggtcattcttagcatgatttgtaaaggtctcaggcaaacagttgttgaagcttgcttctgtggcatttctgaattgtggcagagcttagatcctgcacccaggggtctttttttcaaacagcatcttgctcagttctgtgaacagaaggctttgttactgaaggaggtggaagaggagtttagggtgaaaaggaggaagggatggacagacccaggtgaggagaggcctggggattggggaagctgtcatctcagtgttaataatcaacttgcttctaacacactggcttatcaggggaggtcatccagtccggtcggtggagttgagagcccttgggccagggtgtttggcggcacaggggcatccgctggatggcctggaggagtgggggaggggaacgtcttcactgggtggtgatcagctgggacagttcaggtagggcaggtgagggacccccgaggccctggagccttgtcctgggatgggtttgaagaactcatcactcatcacttgttttcttttggcttttgttgtttttgttttgttctgtttgttttgttttgtatttctttgttattttattgggaaggtaagcggaatgtgctcatagaccatcagacgcttgtcgaaggcaggtcctagtcatgtaattgcacaggacaaggaggtcagcgtgtgtgatggcagcatgctgtgccggcacatcgtggagtcctagaaactctctagtccctgcggctgttcccctcctctgctctctccctggagaggactgccagctcttaagaaacattcctggtgcggtgtctgcagtgccctttgtgggtgacttcaggcttcccgctttcgtggtgctcttcctgggattcgtttttttattaccctccctccctacttgtaggcctcagctatggcttgacgtaatcgcttttagacccaggttggcttcccttcattaagctatgatcctccaccccattttttttttttttaatttggagtgggagggaggggggtgggcgagagaaagctcgaaaggtattattggtttttcaaaaaattagaggtgacgattctaccagggagttgactgataggagtgtgtgcagggcaggaaaggttcggaggcacccgactaccaccactcggaaagccgctagtccagatcgactagggagaggcttagatactttagtgtatttaaagagcatttcagttaactttttcagctatttttaaagtttgtgaatggagtgttattttggacattcttaaatatgaattctccaaaggcatttagccttgacttaatattaaatcctaaggattttatgtaaggtttttttgcaacctatttaattttttttaaatgcctaacttctgaggtgcataagcccgtggtttgtgtactggaactaaagcggaactcactgattcatattggatccccaggtataccttctgctggtagcatatggctggaaaaggccgtttgcctcacacattgtaacctgccttggctagaaaatgcttttaatgtctcaactctctcttttctgtgtcatgttttggtaggaaatctttaagattggcggacggaacaggtattttagtgagacacttctgagtacttgctttttcctttgacttctaaccaactaaaagagaaggaggtcttcatgttgatattttgcttggttttattttactgattttaaaaggtatatagaaaaatgtaggcctttaaaaagaaacagcatgtagttttttattttaatatgttccatagagtggataggcagacaggtactattgtaatgtattctgtatttaataatttaatatactctagaaagtagacctcatgcattcttttagcatgattttcttttaaactgcttttcattttaagggcacccgtggcggaagctggttttgcaaggactgtgtaagctgtatgcgttctagctgtatgcgttctgtagtcttttcttaggtgggtaacattttcaataacgcgcgcacagcacacaggggtgccctgagccgaaggagcaaaaaaagccaccgctcgtttctataatccagctttgcttttcacaggcgtgggatccaggatggtgtcctctgtgaggacttgaactctggggctttaattccactgtttaattttcaggtaccacagcagcaaagcacagagtgtgacctttttcatgtctgagctgattctgtttgctccacgtgcctgcttcttgctactgttcatttagtaatgggatcacctcaccatgccatgctctgggctctccctctctgtccatttctgttttgctttcctggctaaacccatctaccattcttaacactggtagctcctgtcccattccaagactcactctctcagaccttcccatctccctggctttccatgctcctctccctccacctcctggcttcaactgggtgagggccgtattcctgccactctgctccgcctcagccttgagaactccacgtgggctgggtgggaaggtgctgacgattttcacactgtgtttaccactccatcacctctccatcacctctcaacctttgcttcgacaggtcttcactcacgatttattcctccaggtctttgattggagagagtaactttttaattctgttgttttgcagtttggctctgtaggagtgagtggcgattcaaagatgccggcgtcccgcagtgtgcggttcgtgcccttaaccacccgcttctttgtttcccgcccctctgctttcgcaggagctcttgtgcttgagttcagtgttagtggtagcgtggctcactccacttggaggtggcggccgtctgaccgtgtgttactgctttgccgacggggcctcccggccctgatgcgtgtacactctgcgggctgcaccgggtggctctggttgggggcgaagctgtgttgactgggagagcgttggaaattgagacatggagagatgacgggagtgcgtttctctgggtttgatctccatcctgttttctcccagacacaccacacctaccttgggggaatgccgttgcctgttccacccctttgttcacttcgcgttaactgctgtggtaactttttcaggatctgtgtgaagaatggtaatgacgtagttgaaaggaaaatgtactgttgtgtgtttcatttgtgtgatttcgtaccaaaaaaatgtgtttgaactatattgtatgtaatttggaagtcgtgttaataaaaccctgcagtttcca

SEQ ID NO: 296404 - DNA, 6582 bp, Homo sapiens
cccggggaatctgcctttttatatgatgcgtttttattaaacaggacccaccgggctcttttagtttcctcccaccttggtaggttgattgccgatgtgcagggttagtgtcgatcgtttctttaaattttcacaggcatatgatagatttgtcccacataaatgtggccctgatcgtggagtgagtcctaacaagagagcctgaccttaggctgtacacacactgtggaatttcttcaagggagctgccggccggcgcagaacccccaggagcacaggtctctccgggccgctgtcctgcgtaactgttctccagagcgccagccagccacgggcctgattccagaggagccgaactgacaggacacagcaggctggagttggtgttagattgcttcacattctgttgtcaccaccaagaactccaagtttttcgttttgttttgttttcaaagtgcttacaatgcatgtagacattgttctttgtggtctgactctatgatcgatcacagtgacttagattcaggaaagaacattaacgtcacaagttctaagtagttttcacagcaaagaatatttgataatggttgcacttatcttcagtgcaggttagaagagtcttctcaaccaagcttaactcgagttgtcttctcagccctcaaaaggctcttgtacaaaatgtagattaaaatttgggtgattgttgattgacctttgcataccctggaaagccagggtgtgagtggggtggttgggagtggtgccagttgaacagcagattctgcttcttgtcactgtttcaaaagcgtcaactctgtgttcctagtttcgatgaactccccattcatttttaacacacttcccagataaggcaatgtgctggacaggcacacggcatggccctcggctagagcagggtctgtgatggcctcacctggcagccctctggcctagttcccaccacacatgaggtggtggaatggcctgaaggtggaacagacctgtttttttcctttttaaatgcagtaaggtggcctgtttatcactggctctgtgatacatgacattctttgggaatttggtggccactgcttcagtcacctctgtttttctgaaggctgttccagcagggctgccctgttcatcagcggatgttcactctggcctgccgttccccgtggcatgcggggtgagggtggctttcttccagccccaaatgagacgagtctgtgtcatcattgaaactgcttttcgtaattgcgggtaggttcctgtaggtgagacatattctccataaagctactgtagtagaattcattctgggcaaacactgaaaaaagtgccttacagtatttctgctcatgaaagagtttcactattttggatatattctaaagtggacctgagctatttgagcaaataatgatagggcatactcagacattttagctaccttttatacctacgatttcatgtcacatttactaatagaattaagggaaatagaagcccgttctttcttactgcccctggagggagcatggcgctagggctctcagcctcctagaaggaagggactaaggagacgggcacagacttgcgtcatctcgtttccacagttgacgttttatattactttctcaaattaagttaccaaaacaaactgaagagctgaagcaggtcttccagaccctgcgatcctttctgtagcagtgattctaaagtggcgtttgctgtgtgcttgagagtaacactgcacgctgcaggggctgttgcagcagtcagtcccaggaagccacagcgcttgtaggatctgctaggaccctgcagctgtgctgccgccacctctgctccagagtgtcccagccaaccctcggaagatgggattgccagtcagccctgcctcaccatgcctgcaggaggctgtccagggagcaggtctgtgtgcccatcagcaggttcccatggctgtcactgcccactcatttccacagttagatacggatgtgttgatgtatttcgtctagtttatttggctcagtccacagctgcgttggagtggtgactttggtagcccttgagctctaattaagagagatccaaaccactcagtacccactgggcagtgggaaggcctaccgacttactttatcattgagggcttactgatacaatgaaatgagtttcatgactttttttttttttaaacactttttgaaatagagtgtgctgtgtttaaaaccaaaaatatgcatgttgtctctgaaaagtaggcattgaaacagacttttttgtagtcagtgttaataaaacggatcctgtttgggccttcattgttaaggtggacttcatggccactggaaggtctgttttggtgttacctgagtgtgacacaggccctggggtgtgcgtgtttctctaactgtctacacgtgcacataggcagactttctcatagaatgttcttgaaaggtgattgggcaaagtcatgcaggcccgccttaaagcgctgattagaacagtccaacacagtccgacctcactcaatacccacaaccatcgaaaatggattcttagtaccagacaatcccagtaatgaaggtttagtttccttgaaggaaactacagctcacgtgaagtcagcccacaccagccaaaccctcgtggaagatctgctgcaaccattatctttgttcttgagttcatcatgcatttaaaatgagatgcaagagcatttagcataccatgtaaatatggaccttttaaaattaaaatactattggaagtgctttcaactcagccacatcttagctattagttctttgtgttgtcttatcaaagtttaatggatacagttccacagttgttgatgtgtttgtgtgtatattcgatttttataaagatggtagtaagtcaatacatttatcctgatctgtgtattatttgttcacaaattcaagaagcttaaaggtcgtaaatatcagtatctcataaggtaaaccaatagctgattatgtggagccaagttacttcttttctttttgcattatcttgttttggttttgtgctgtaatagaagttcacttagctactttagataaccttgcattaccactggtctggccacgtttgttaaatccttatactgatattcttctaaagagtaaatctcatcatttttccagacaaattttgaggggtttctctgttttgtggacaggcagcagcctccgtaggcacccgcaccctgccttgctggaggagatgggatggggcgggaggtggcttcaccataactatttttaatatgggtcattcttagcatgatttgtaaaggtctcaggcaaacagttgttgaagcttgcttctgtggcatttctgaattgtggcagagcttagatcctgcacccaggggtctttttttcaaacagcatcttgctcagttctgtgaacagaaggctttgttactgaaggaggtggaagaggagtttagggtgaaaaggaggaagggatggacagacccaggtgaggagaggcctggggattggggaagctgtcatctcagtgttaataatcaacttgcttctaacacactggcttatcaggggaggtcatccagtccggtcggtggagttgagagcccttgggccagggtgtttggcggcacaggggcatccgctggatggcctggaggagtgggggaggggaacgtcttcactgggtggtgatcagctgggacagttcaggtagggcaggtgagggacccccgaggccctggagccttgtcctgggatgggtttgaagaactcatcactcatcacttgttttcttttggcttttgttgtttttgttttgttctgtttgttttgttttgtatttctttgttattttattgggaaggtaagcggaatgtgctcatagaccatcagacgcttgtcgaaggcaggtcctagtcatgtaattgcacaggacaaggaggtcagcgtgtgtgatggcagcatgctgtgccggcacatcgtggagtcctagaaactctctagtccctgcggctgttcccctcctctgctctctccctggagaggactgccagctcttaagaaacattcctggtgcggtgtctgcagtgccctttgtgggtgacttcaggcttcccgctttcgtggtgctcttcctgggattcgtttttttattaccctccctccctacttgtaggcctcagctatggcttgacgtaatcgcttttagacccaggttggcttcccttcattaagctatgatcctccaccccattttttttttttttaatttggagtgggagggaggggggtgggcgagagaaagctcgaaaggtattattggtttttcaaaaaattagaggtgacgattctaccagggagttgactgataggagtgtgtgcagggcaggaaaggttcggaggcacccgactaccaccactcggaaagccgctagtccagatcgactagggagaggcttagatactttagtgtatttaaagagcatttcagttaactttttcagctatttttaaagtttgtgaatggagtgttattttggacattcttaaatatgaattctccaaaggcatttagccttgacttaatattaaatcctaaggattttatgtaaggtttttttgcaacctatttaattttttttaaatgcctaacttctgaggtgcataagcccgtggtttgtgtactggaactaaagcggaactcactgattcatattggatccccaggtataccttctgctggtagcatatggctggaaaaggccgtttgcctcacacattgtaacctgccttggctagaaaatgcttttaatgtctcaactctctcttttctgtgtcatgttttggtaggaaatctttaagattggcggacggaacaggtattttagtgagacacttctgagtacttgctttttcctttgacttctaaccaactaaaagagaaggaggtcttcatgttgatattttgcttggttttattttactgattttaaaaggtatatagaaaaatgtaggcctttaaaaagaaacagcatgtagttttttattttaatatgttccatagagtggataggcagacaggtactattgtaatgtattctgtatttaataatttaatatactctagaaagtagacctcatgcattcttttagcatgattttcttttaaactgcttttcattttaagggcacccgtggcggaagctggttttgcaaggactgtgtaagctgtatgcgttctagctgtatgcgttctgtagtcttttcttaggtgggtaacattttcaataacgcgcgcacagcacacaggggtgccctgagccgaaggagcaaaaaaagccaccgctcgtttctataatccagctttgcttttcacaggcgtgggatccaggatggtgtcctctgtgaggacttgaactctggggctttaattccactgtttaattttcaggtaccacagcagcaaagcacagagtgtgacctttttcatgtctgagctgattctgtttgctccacgtgcctgcttcttgctactgttcatttagtaatgggatcacctcaccatgccatgctctgggctctccctctctgtccatttctgttttgctttcctggctaaacccatctaccattcttaacactggtagctcctgtcccattccaagactcactctctcagaccttcccatctccctggctttccatgctcctctccctccacctcctggcttcaactgggtgagggccgtattcctgccactctgctccgcctcagccttgagaactccacgtgggctgggtgggaaggtgctgacgattttcacactgtgtttaccactccatcacctctccatcacctctcaacctttgcttcgacaggtcttcactcacgatttattcctccaggtctttgattggagagagtaactttttaattctgttgttttgcagtttggctctgtaggagtgagtggcgattcaaagatgccggcgtcccgcagtgtgcggttcgtgcccttaaccacccgcttctttgtttcccgcccctctgctttcgcaggagctcttgtgcttgagttcagtgttagtggtagcgtggctcactccacttggaggtggcggccgtctgaccgtgtgttactgctttgccgacggggcctcccggccctgatgcgtgtacactctgcgggctgcaccgggtggctctggttgggggcgaagctgtgttgactgggagagcgttggaaattgagacatggagagatgacgggagtgcgtttctctgggtttgatctccatcctgttttctcccagacacaccacacctaccttgggggaatgccgttgcctgttccacccctttgttcacttcgcgttaactgctgtggtaactttttcaggatctgtgtgaagaatggtaatgacgtagttgaaaggaaaatgtactgttgtgtgtttcatttgtgtgatttcgtaccaaaaaaatgtgtttgaactatattgtatgtaatttggaagtcgtgttaataaaaccctgcagtttcca

SEQ ID NO: 296405 - DNA, 6127 bp, Homo sapiens
cccggggaatctgcctttttatatgatgcgtttttattaaacaggacccaccgggctcttttagtttcctcccaccttggtaggttgattgccgatgtgcagggttagtgtcgatcgtttctttaaattttcacaggcatatgatagatttgtcccacataaatgtggccctgatcgtggagtgagtcctaacaagagagcctgaccttaggctgtacacacactgtggaatttcttcaagggagctgccggccggcgcagaacccccaggagcacaggtctctccgggccgctgtcctgcgtaactgttctccagagcgccagccagccacgggcctgattccagaggagccgaactgacaggacacagcaggctggagttggtgttagattgcttcacattctgttgtcaccaccaagaactccaagtttttcgttttgttttgttttcaaagtgcttacaatgcatgtagacattgttctttgtggtctgactctatgatcgatcacagtgacttagattcaggaaagaacattaacgtcacaagttctaagtagttttcacagcaaagaatatttgataatggttgcacttatcttcagtgcaggttagaagagtcttctcaaccaagcttaactcgagttgtcttctcagccctcaaaaggctcttgtacaaaatgtagattaaaatttgggtgattgttgattgacctttgcataccctggaaagccagggtgtgagtggggtggttgggagtggtgccagttgaacagcagattctgcttcttgtcactgtttcaaaagcgtcaactctgtgttcctagtttcgatgaactccccattcatttttaacacacttcccagataaggcaatgtgctggacaggcacacggcatggccctcggctagagcagggtctgtgatggcctcacctggcagccctctggcctagttcccaccacacatgaggtggtggaatggcctgaaggtggaacagacctgtttttttcctttttaaatgcagtaaggtggcctgtttatcactggctctgtgatacatgacattctttgggaatttggtggccactgcttcagtcacctctgtttttctgaaggctgttccagcagggctgccctgttcatcagcggatgttcactctggcctgccgttccccgtggcatgcggggtgagggtggctttcttccagccccaaatgagacgagtctgtgtcatcattgaaactgcttttcgtaattgcgggtaggttcctgtaggtgagacatattctccataaagctactgtagtagaattcattctgggcaaacactgaaaaaagtgccttacagtatttctgctcatgaaagagtttcactattttggatatattctaaagtggacctgagctatttgagcaaataatgatagggcatactcagacattttagctaccttttatacctacgatttcatgtcacatttactaatagaattaagggaaatagaagcccgttctttcttactgcccctggagggagcatggcgctagggctctcagcctcctagaaggaagggactaaggagacgggcacagacttgcgtcatctcgtttccacagttgacgttttatattactttctcaaattaagttaccaaaacaaactgaagagctgaagcaggtcttccagaccctgcgatcctttctgtagcagtgattctaaagtggcgtttgctgtgtgcttgagagtaacactgcacgctgcaggggctgttgcagcagtcagtcccaggaagccacagcgcttgtaggatctgctaggaccctgcagctgtgctgccgccacctctgctccagagtgtcccagccaaccctcggaagatgggattgccagtcagccctgcctcaccatgcctgcaggaggctgtccagggagcaggtctgtgtgcccatcagcaggttcccatggctgtcactgcccactcatttccacagttagatacggatgtgttgatgtatttcgtctagtttatttggctcagtccacagctgcgttggagtggtgactttggtagcccttgagctctaattaagagagatccaaaccactcagtacccactgggcagtgggaaggcctaccgacttactttatcattgagggcttactgatacaatgaaatgagtttcatgactttttttttttttaaacactttttgaaatagagtgtgctgtgtttaaaaccaaaaatatgcatgttgtctctgaaaagtaggcattgaaacagacttttttgtagtcagtgttaataaaacggatcctgtttgggccttcattgttaaggtggacttcatggccactggaaggtctgttttggtgttacctgagtgtgacacaggccctggggtgtgcgtgtttctctaactgtctacacgtgcacataggcagactttctcatagaatgttcttgaaaggtgattgggcaaagtcatgcaggcccgccttaaagcgctgattagaacagtccaacacagtccgacctcactcaatacccacaaccatcgaaaatggattcttagtaccagacaatcccagtaatgaaggtttagtttccttgaaggaaactacagaaaaggaaagaagcagaatgagaaaggaatggtacttaggtgtttggtatgctgctcacgtgaagtcagcccacaccagccaaaccctcgtggaagatctgctgcaaccattatctttgttcttgagttcatcatgcatttaaaatgagatgcaagagcatttagcataccatgtaaatatggaccttttaaaattaaaatactattggaagtgctttcaactcagccacatcttagctattagttctttgtgttgtcttatcaaagtttaatggatacagttccacagttgttgatgtgtttgtgtgtatattcgatttttataaagatggtagtaagtcaatacatttatcctgatctgtgtattatttgttcacaaattcaagaagcttaaaggtcgtaaatatcagtatctcataaggtaaaccaatagctgattatgtggagccaagttacttcttttctttttgcattatcttgttttggttttgtgctgtaatagaagttcacttagctactttagataaccttgcattaccactggtctggccacgtttgttaaatccttatactgatattcttctaaagagtaaatctcatcatttttccagacaaattttgaggggtttctctgttttgtggacaggcagcagcctccgtaggcacccgcaccctgccttgctggaggagatgggatggggcgggaggtggcttcaccataactatttttaatatgggtcattcttagcatgatttgtaaaggtctcaggcaaacagttgttgaagcttgcttctgtggcatttctgaattgtggcagagcttagatcctgcacccaggggtctttttttcaaacagcatcttgctcagttctgtgaacagaaggctttgttactgaaggaggtggaagaggagtttagggtgaaaaggaggaagggatggacagacccaggtgaggagaggcctggggattggggaagctgtcatctcagtgttaataatcaacttgcttctaacacactggcttatcaggggaggtcatccagtccggtcggtggagttgagagcccttgggccagggtgtttggcggcacaggggcatccgctggatggcctggaggagtgggggaggggaacgtcttcactgggtggtgatcagctgggacagttcaggtagggcaggtgagggacccccgaggccctggagccttgtcctgggatgggtttgaagaactcatcactcatcacttgttttcttttggcttttgttgtttttgttttgttctgtttgttttgttttgtatttctttgttattttattgggaaggtaagcggaatgtgctcatagaccatcagacgcttgtcgaaggcaggtcctagtcatgtaattgcacaggacaaggaggtcagcgtgtgtgatggcagcatgctgtgccggcacatcgtggagtcctagaaactctctagtccctgcggctgttcccctcctctgctctctccctggagaggactgccagctcttaagaaacattcctggtgcggtgtctgcagtgccctttgtgggtgacttcaggcttcccgctttcgtggtgctcttcctgggattcgtttttttattaccctccctccctacttgtaggcctcagctatggcttgacgtaatcgcttttagacccaggttggcttcccttcattaagctatgatcctccaccccattttttttttttttaatttggagtgggagggaggggggtgggcgagagaaagctcgaaaggtattattggtttttcaaaaaattagaggtgacgattctaccagggagttgactgataggagtgtgtgcagggcaggaaaggttcggaggcacccgactaccaccactcggaaagccgctagtccagatcgactagggagaggcttagatactttagtgtatttaaagagcatttcagttaactttttcagctatttttaaagtttgtgaatggagtgttattttggacattcttaaatatgaattctccaaaggcatttagccttgacttaatattaaatcctaaggattttatgtaaggtttttttgcaacctatttaattttttttaaatgcctaacttctgaggtgcataagcccgtggtttgtgtactggaactaaagcggaactcactgattcatattggatccccaggtataccttctgctggtagcatatggctggaaaaggccgtttgcctcacacattgtaacctgccttggctagaaaatgcttttaatgtctcaactctctcttttctgtgtcatgttttggtaggaaatctttaagattggcggacggaacaggtattttagtgagacacttctgagtacttgctttttcctttgacttctaaccaactaaaagagaaggaggtcttcatgttgatattttgcttggttttattttactgattttaaaaggtatatagaaaaatgtaggcctttaaaaagaaacagcatgtagttttttattttaatatgttccatagagtggataggcagacaggtactattgtaatgtattctgtatttaataatttaatatactctagaaagtagacctcatgcattcttttagcatgattttcttttaaactgcttttcattttaagggcacccgtggcggaagctggttttgcaaggactgtgtaagctgtatgcgttctagctgtatgcgttctgtagtcttttcttaggtgggtaacattttcaataacgcgcgcacagcacacaggggtgccctgagccgaaggagcaaaaaaagccaccgctcgtttctataatccagctttgcttttcacaggcgtgggatccaggatggtgtcctctgtgaggacttgaactctggggctttaattccactgtttaattttcaggtaccacagcagcaaagcacagagtgtgacctttttcatgtctgagctgattctgtttgctccacgtgcctgcttcttgctactgttcatttagtaatgggatcacctcaccatgccatgctctgggctctccctctctgtccatttctgttttgctttcctggctaaacccatctaccattcttaacactggtagctcctgtcccattccaagactcactctctcagaccttcccatctccctggctttccatgctcctctccctccacctcctggcttcaactgggtgagggccgtattcctgccactctgctccgcctcagccttgagaactccacgtgggctgggtgggaaggtgctgacgattttcacactgtgtttaccactccatcacctctccatcacctctcaacctttgcttcgacaggtcttcactcacgatttattcctccaggtctttgattggagagagtaactttttaattctgttgttttgcagtttgtgtgatttcgtaccaaaaaaatgtgtttgaactatattgtatgtaatttggaagtcgtgttaataaaaccctgcagtttcca

SEQ ID NO: 296406 - DNA, 5341 bp, Homo sapiens
cccggggaatctgcctttttatatgatgcgtttttattaaacaggacccaccgggctcttttagtttcctcccaccttggtaggttgattgccgatgtgcagggttagtgtcgatcgtttctttaaattttcacaggcatatgatagatttgtcccacataaatgtggccctgatcgtggagtgagtcctaacaagagagcctgaccttaggctgtacacacactgtggaatttcttcaagggagctgccggccggcgcagaacccccaggagcacaggtctctccgggccgctgtcctgcgtaactgttctccagagcgccagccagccacgggcctgattccagaggagccgaactgacaggacacagcaggctggagttggtgttagattgcttcacattctgttgtcaccaccaagaactccaagtttttcgttttgttttgttttcaaagtgcttacaatgcatgtagacattgttctttgtggtctgactctatgatcgatcacagtgacttagattcaggaaagaacattaacgtcacaagttctaagtagttttcacagcaaagaatatttgataatggttgcacttatcttcagtgcaggttagaagagtcttctcaaccaagcttaactcgagttgtcttctcagccctcaaaaggctcttgtacaaaatgtagattaaaatttgggtgattgttgattgacctttgcataccctggaaagccagggtgtgagtggggtggttgggagtggtgccagttgaacagcagattctgcttcttgtcactgtttcaaaagcgtcaactctgtgttcctagtttcgatgaactccccattcatttttaacacacttcccagataaggcaatgtgctggacaggcacacggcatggccctcggctagagcagggtctgtgatggcctcacctggcagccctctggcctagttcccaccacacatgaggtggtggaatggcctgaaggtggaacagacctgtttttttcctttttaaatgcagtaaggtggcctgtttatcactggctctgtgatacatgacattctttgggaatttggtggccactgcttcagtcacctctgtttttctgaaggctgttccagcagggctgccctgttcatcagcggatgttcactctggcctgccgttccccgtggcatgcggggtgagggtggctttcttccagccccaaatgagacgagtctgtgtcatcattgaaactgcttttcgtaattgcgggtaggttcctgtaggtgagacatattctccataaagctactgtagtagaattcattctgggcaaacactgaaaaaagtgccttacagtatttctgctcatgaaagagtttcactattttggatatattctaaagtggacctgagctatttgagcaaataatgatagggcatactcagacattttagctaccttttatacctacgatttcatgtcacatttactaatagaattaagggaaatagaagcccgttctttcttactgcccctggagggagcatggcgctagggctctcagcctcctagaaggaagggactaaggagacgggcacagacttgcgtcatctcgtttccacagttgacgttttatattactttctcaaattaagttaccaaaacaaactgaagagctgaagcaggtcttccagaccctgcgatcctttctgtagcagtgattctaaagtggcgtttgctgtgtgcttgagagtaacactgcacgctgcaggggctgttgcagcagtcagtcccaggaagccacagcgcttgtaggatctgctaggaccctgcagctgtgctgccgccacctctgctccagagtgtcccagccaaccctcggaagatgggattgccagtcagccctgcctcaccatgcctgcaggaggctgtccagggagcaggtctgtgtgcccatcagcaggttcccatggctgtcactgcccactcatttccacagttagatacggatgtgttgatgtatttcgtctagtttatttggctcagtccacagctgcgttggagtggtgactttggtagcccttgagctctaattaagagagatccaaaccactcagtacccactgggcagtgggaaggcctaccgacttactttatcattgagggcttactgatacaatgaaatgagtttcatgactttttttttttttaaacactttttgaaatagagtgtgctgtgtttaaaaccaaaaatatgcatgttgtctctgaaaagtaggcattgaaacagacttttttgtagtcagtgttaataaaacggatcctgtttgggccttcattgttaaggtggacttcatggccactggaaggtctgttttggtgttacctgagtgtgacacaggccctggggtgtgcgtgtttctctaactgtctacacgtgcacataggcagactttctcatagaatgttcttgaaaggtgattgggcaaagtcatgcaggcccgccttaaagcgctgattagaacagtccaacacagtccgacctcactcaatacccacaaccatcgaaaatggattcttagtaccagacaatcccagtaatgaaggtttagtttccttgaaggaaactacagaaaaggaaagaagcagaatgagaaaggaatggtacttaggtgtttggtatgctgctcacgtgaagtcagcccacaccagccaaaccctcgtggaagatctgctgcaaccattatctttgttcttgagttcatcatgcatttaaaatgagatgcaagagcatttagcataccatgtaaatatggaccttttaaaattaaaatactattggaagtgctttcaactcagccacatcttagctattagttctttgtgttgtcttatcaaagtttaatggatacagttccacagttgttgatgtgtttgtgtgtatattcgatttttataaagatggtagtaagtcaatacatttatcctgatctgtgtattatttgttcacaaattcaagaagcttaaaggtcgtaaatatcagtatctcataaggtaaaccaatagctgattatgtggagccaagttacttcttttctttttgcattatcttgttttggttttgtgctgtaatagaagttcacttagctactttagataaccttgcattaccactggtctggccacgtttgttaaatccttatactgatattcttctaaagagtaaatctcatcatttttccagacaaattttgaggggtttctctgttttgtggacaggcagcagcctccgtaggcacccgcaccctgccttgctggaggagatgggatggggcgggaggtggcttcaccataactatttttaatatgggtcattcttagcatgatttgtaaaggtctcaggcaaacagttgttgaagcttgcttctgtggcatttctgaattgtggcagagcttagatcctgcacccaggggtctttttttcaaacagcatcttgctcagttctgtgaacagaaggctttgttactgaaggaggtggaagaggagtttagggtgaaaaggaggaagggatggacagacccaggtgaggagaggcctggggattggggaagctgtcatctcagtgttaataatcaacttgcttctaacacactggcttatcaggggaggtcatccagtccggtcggtggagttgagagcccttgggccagggtgtttggcggcacaggggcatccgctggatggcctggaggagtgggggaggggaacgtcttcactgggtggtgatcagctgggacagttcaggtagggcaggtgagggacccccgaggccctggagccttgtcctgggatgggtttgaagaactcatcactcatcacttgttttcttttggcttttgttgtttttgttttgttctgtttgttttgttttgtatttctttgttattttattgggaaggtaagcggaatgtgctcatagaccatcagacgcttgtcgaaggcaggtcctagtcatgtaattgcacaggacaaggaggtcagcgtgtgtgatggcagcatgctgtgccggcacatcgtggagtcctagaaactctctagtccctgcggctgttcccctcctctgctctctccctggagaggactgccagctcttaagaaacattcctggtgcggtgtctgcagtgccctttgtgggtgacttcaggcttcccgctttcgtggtgctcttcctgggattcgtttttttattaccctccctccctacttgtaggcctcagctatggcttgacgtaatcgcttttagacccaggttggcttcccttcattaagctatgatcctccaccccattttttttttttttaatttggagtgggagggaggggggtgggcgagagaaagctcgaaaggtattattggtttttcaaaaaattagaggtgacgattctaccagggagttgactgataggagtgtgtgcagggcaggaaaggttcggaggcacccgactaccaccactcggaaagccgctagtccagatcgactagggagaggcttagatactttagtgtatttaaagagcatttcagttaactttttcagctatttttaaagtttgtgaatggagtgttattttggacattcttaaatatgaattctccaaaggcatttagccttgacttaatattaaatcctaaggattttatgtaaggtttttttgcaacctatttaattttttttaaatgcctaacttctgaggtgcataagcccgtggtttgtgtactggaactaaagcggaactcactgattcatattggatccccaggtataccttctgctggtagcatatggctggaaaaggccgtttgcctcacacattgtaacctgccttggctagaaaatgcttttaatgtctcaactctctcttttctgtgtcatgttttggtaggaaatctttaagattggcggacggaacaggtattttagtgagacacttctgagtacttgctttttcctttgacttctaaccaactaaaagagaaggaggtcttcatgttgatattttgcttggttttattttactgattttaaaaggtatatagaaaaatgtaggcctttaaaaagaaacagcatgtagttttttattttaatatgttccacccctttgttcacttcgcgttaactgctgtggtaactttttcaggatctgtgtgaagaatggtaatgacgtagttgaaaggaaaatgtactgttgtgtgtttcatttgtgtgatttcgtaccaaaaaaatgtgtttgaactatattgtatgtaatttggaagtcgtgttaataaaaccctgcagtttcca

SEQ ID NO: 296407 - DNA, 571 bp, Homo sapiens
tcgtgcccttaaccacccgcttctttgtttcccgcccctctgctttcgcaggagctcttgtgcttgagttcagtgttagtggtagcgtggctcactccacttggaggtggcggccgtctgaccgtgtgttactgctttgccgacggggcctcccggccctgatgcgtgtacactctgcgggctgcaccgggtggctctggttgggggcgaagctgtgttgactgggagagcgttggaaattgagacatggagagatgacgggagtgcgtttctctgggtttgatctccatcctgttttctcccagacacaccacacctaccttgggggaatgccgttgcctgttccacccctttgttcacttcgcgttaactgctgtggtaactttttcaggatctgtgtgaagaatggtaatgacgtagttgaaaggaaaatgtactgttgtgtgtttcatttgtgtgatttcgtaccaaaaaaatgtgtttgaactatattgtatgtaatttggaagtcgtgttaataaaaccctgcagtttccactctggttccgtagccttcattttgtctgggcgc

SEQ ID NO: 296408 - DNA, 6337 bp, Homo sapiens
  misc_feature (3026)..(3026): n is a, c, g, or t
ggagtacgcgcggctggtgatggaggcgcagccggagtggctgcgcgccgaggtgaagcggctgtcccacgagctggccgagaccacgcgtgagaagatccaggcggccgagtacgggctggcggtgctcgaggagaagcaccagctcaagctgcagttcgaggagctcgaggtggactatgaggctatccgcagcgagatggagcagctcaaggaggcctttggacaagcacacacaaaccacaagaaggtggctgctgacggagagagccgggaggagagcctgatccaggagtcggcctccaaggagcagtactacgtgcggaaggtgctagagctgcagacggagctgaagagttgcgcaatgtcctcaccaacacgcagtcggagaatgagcgcctggcctctgtggcccaggagctgaaggagatcaaccagaatgtggagatccagcgtggccgcctgcgggatgacatcaaggagtacaaattccgggaagctcgtctgctgcaggactactcggagctgcgtctgctaggagaacatcagcctgcagaagcaagtgtctgtgctcagacagaaccaggtggagtttgagggcctcaagcatgagatcaagcgtctggaggaggagaccgagtacctcaacagccagctggaggatgccatccgcctcaaggagatctcagagcggcagctggaggaggcgctggagaccctgaagacggagcgcgaacagaagaacagcctgcgcaaggagctgtcacactacatgagcatcaatgactccttctacaccagccacctgcatgtctcgctggatggcctcaagttcagtgacgatgctgccgagcccaacaacgatgccgaggccctggtcaatggctttgagcacggcggcctggccaagctgccactggacaacaagacctccacgcccaagaaggagggcctcgcaccgccctcccccagcctcgtctccgacctactcagtgagctcaacatctctgagatccagaagctgaagcagcagctgatgcagatggagcgggaaaaggcgggcctgctggcaacgctgcaggacacacagaagcagctggagcacacgcggggctccctgtcagaacagcaggagaaggtgacccgcctcacagagaatctgagtgccctgcggcgcctgcaggccagcaaggagcggcagacagccctggacaacgagaaggaccgtgacagccatgaggatggggactactacgaggtggacatcaacgggcctgagatcttggcctgcaagtaccatgtggctgtggctgaggctggcgagctccgcgagcagctcaaggcactgcgcagcacgcacgaggctcgtgaggcccagcacgccgaggagaagggccgctatgaggctgagggccaggcactcacggagaaggtctccctgctagagaaggccagccgccaggaccgcgagctgctggcccggctggagaaggagctaaagaaggtgagcgacgtcgccggcgagacacagggcagcctgagtgtggcccaggatgagctggtgaccttcagtgaggagctggccaatctctaccaccacgtgtgcatgtgcaacaatgagacacccaaccgtgtcatgctggactactaccgcgagggccagggcggggccggccgcaccagtcccgggggccgcaccagccccgaggcgcgtggccggcgctcacccatcctcctacccaaggggctgctggctcctgaggcgggccgagcagatggtgggacgggggacagcagcccctcgcctggctcctcactgccatcacccctgagtgacccacgccgggagcccatgaacatctacaacctgatcgctatcatccgtgaccagatcaagcacctgcaggcagccgtggaccgcaccacggagctgtcacgccagcgcattgcctctcaggagctgggccccgccgtggacaaggacaaggaagcgcttatggaggagatcctcaagctgaagtcgctgctcagcaccaagcgggagcagatcaccacgctgcgcactgtgctcaaggccaacaagcagacggccgaggtggcccttgccaacctgaagagcaagtatgagaatgagaaggccatggttaccgagaccatgatgaagctgcgcaatgagctcaaggccctcaaggaggacgcagccaccttctcctcgctgcgtgctatgtttgccaccaggtgtgacgagtacattacacagctggatgagatgcagcggcagctggcggctgctgaggacgagaagaagacgctgaactcgctgctgcgcatggccatccagcagaagctggcgctgacccagcggctggagctgctcgagctggaccatgagcagacccggcgtggccgtgccaaagccgccccgaagaccaagccagccacaccgagcgtaagtcacacctgtgcctgtgccagcgacagggccgagggcaccgggctggccaaccaggtgttctgcagcgagaagcacagcatttactgtgattaggggctgtggggcgccgcacgctgcagctaacatctgcttcacctcaactaacccagcagcagcgggacggcggtgctaggtcaatcttaacgtgactaatgcacagagggtaggagtctagccgaggcgccatggggcgttgcatcagcaggacacttgtgagagctttgtgtcgcttctcactcctcaaagccccctcaggagcacccagtcctcagctgctctcttaggtgggggtcagaggtggggatagagctgcacattcttgcagcagatgtgtgatgaaagcatcttctaagccctgcgcacccgtggggaaacccaagggaggagtcctggtcctgctccctcagcacccaaaaggggcagaacctgagttgagacttgcatgttcctcgcatgtgtctaatgtcagcactagaaagcagttttaggaggttccagcctgcagcataggtacgacctcagaggatggctntgcacttggcatagtttcatggaaaggagtacgttgtagtttatgcagtatctgactgcaaatcatattcaggaaagaagtgcagaatttcttccccaagcccagagaagagcagccctgagcccctgtattctgctggccagacacacatggcacagacacagctgaccataacccaggaatccagagctcggtttctcatttctgagatcaggatgcttgtatagtggcctgtgaggtgacagattggcagggcccaaggccccaggttttcatttttcatgagaaaagctttccaagtgcctggccagaccttggtccttagtgcagagcccgtccttttgtacttggggtgaccccagcagccaattatccggccttccatagggggttcagtcccaaagacatggggctttgaaaaccctagcctgaagtctgagccaccaagggcttggctgggttggacacccacaggtgtatccagagcccagcccggtgctgggaaagctttgcatagggccagggccacttgtcaggattcacaggtaggagatgtttaggtctctttatttagtgcaatctgggggatggcaacagagaaagaggaaaggtagctgtagggttctcccatttccagaggctccatccacacctgccttcccacattctgagcagaacttttctcagtacttttttcccgatcaccctgtgggaccagctggacctgaggctgcagtcttctctcctgcaggctgcttgccttgtctctcatgcggaagaggcattcgagttacctggtgagagaccgtgttgccccctcccacagctctctgccctgcgcgttcttccctttggtgccgagtatgtttcggtcccctccagactccaggacacgcccatgtatgtcccctgcgtgttcatcctgggcccagatccccctgccccagcaagactcgcagtgggatggctgctggcatgcccaccctgcatgcgctttgccctctccttgcaagcctggcatatagcttctctccatactcctaagggactttgcagacacccaagccactgggacccctgctaacacatgcaggtcttctcttctgccaactaacgtgctcgcgccctcccagcacgtggagagcttcaattgtcagataaacaggaagcgacagatgaccgctttctaacgctctcttttctcccgttttcagctgtagagtagctgccaggaggacttggccacccggccctgtcacactgcagccccttccccttccctctcgtggcccacaaggaggaaggaagggcaacctaaaagcccacttagaaactttttggatatgccactgcaattcttttcaaaatagcattccccaggtttttaatgggaggaaaaaaagctttaatgttgagcatgctgcgagctgctgcgtggaaaggcctctgtatgggccgaagacccttcttccctggctgccaggctcgccaggagcccactggaaacgcccaccacgggggctccttgttacacatgttctttttttatccgatcaacctgtgcacttttgatattttgatattatatttgcttccttaattcctcgcgtagagacggtctcaggtgccgtggtctatgctcgtggtcctgtagctgtccgcctcagctcccaccgtgtttgtctggtgtcagcacgaggcagagctgtgtgctccatagcgtgtagctttagactcggagatgagtgctttgacccagcgaggagctcagctaagtgtatccacgctgtggttcagcagcctttagatcatacggcattgtggttcatgtttgaaattacagattttaaatgccatgttcattaagaaatccagggtattcagattctggggtttttcatattgtattattattattcttaggaatagttcaatgtaacaagaagaaaacttgacctttgctctggttaaaacagtaataggcacttgaaaaaaaaagataaattattgaatgagtagtattacctacaaattccagaattttctgggttttaggacgttgtgaagcatgactgattaacagaattttatacaactgtaccaataaaattccaaattggaattgttttgttactctggttgttgtgccaaattgtggtacacttagaaaattctacagtcgtcgatttttagggtgttctctttcaacacctttttgttagtaatcattgccagtagtgccttcatcagttaagggaggtgtcccagcacagatcattctcaaaagcgagcagggaagagctagtgggcatgctgaaggccagcgtggacagcaggtgaggcaggtgctcctcacacccagacctgggcatcttcattgagggaaagaaaacagtcattgtgcaaaattctgttagtcagtgattctttacttgcaaattcaggggcttagaaaatgaaagcaaacacaaaaccttgagtgtgctttgggaaccaaatggaccttctgggacaagctgagcaagctgtatgaacgccacgtttgtgaagagctgagggtatcaggagggccgacgctgtgttggcatgcgcagtaggggatgagggttagccatagtattctttgcaaatgtgaaagcgagacattatatcttctcttgcttggtgtaactaatcactgttaatttcaggaaacagaactcattaaaactccttagcaaaccaggtctacatcctgttttgtttgctgagtgaggttagtgggagtggtcaaattggtactcttggaggaagaaaaactgtccttccttctccaaaaaaggaaaaattataataatataaatgacaaaaataaaagaattctgtttcctggaataagcatttcttattcctagttgtagggactcctatttttaccttccgttacagtgttgattcataagaaatattgttacatttgagataacttcatctgtatggggtatttatttgcaatgatgtctgagtactgtattttttctgtgcattaccttagtgtcagaatgttggtctttattttaaagtcatatgcatgttctcctgccaaggaacctttacacagacccaaacaaaaaaataataatcaaatgccttcaatttctgagaaaatgaggcagagcatggaaaaggaataggaaggagaaattaattgagattttcaggacacagacatatgatgtgaatgcctacaaagccagtgcgcataggaacagtgggcctgggtaaagagtcacattggtaggaccaataaagaataataaaaagacaaagca

SEQ ID NO: 296409 - DNA, 770 bp, Homo sapiens
gttggtctttattttaaagtcatatgcatgttctcctgccaaggaacctttacacagaaaaaatacagtactcagatattctttgcaaatgtgaaagcgagacattatatcttctcttgcttggtgtaactaatcactgttaatttcaggaaacagaactcattaaaactccttagcaaaccaggtctacatcctgttttgtttgctgagtgaggttagtgggagtggtcaaattggtactcttggaggaagaaaaactgtccttccttctccaaaaaaggaaaaattataataatataaatgacaaaaataaaagaattctgtttcctggaataagcatttcttattcctagttgtagggactcctatttttaccttccgttacagtgttgattcataagaaatattgttacatttgagataacttcatctgtatggggtatttatttgcaatgatgtctgagtactgtattttttctgtgcattaccttagtgtcagaatgttggtctttattttaaagtcatatgcatgttctcctgccaaggaacctttacacagacccaaacaaaaaaataataatcaaatgccttcaatttctgagaaaatgaggcagagcatggaaaaggaataggaaggagaaattaattgagattttcaggacacagacatatgatgtgaatgcctacaaagccagtgcgcataggaacagtgggcctgggtaaagagtcacattggtaggaccaataaagaataataaaaagacaaagca

SEQ ID NO: 296410 - DNA, 2661 bp, Homo sapiens
gaaaaaaaaaaaaaaaattggacagataggccgtggtgtaactaggagaggcaccatctggaccatgactggacctgaggctgcagtcttctctcctgcaggctgcttgccttgtctctcatgcggaagaggcattcgagttacctggtgagagaccgtgttgccccctcccacagctctctgccctgcgcgttcttccctttggtgccgagtatgtttcggtcccctccagactccaggacacgcccatgtatgtcccctgcgtgttcatcctgggcccagatccccctgccccagcaagactcgcagtgggatggctgctggcatgcccaccctgcatgcgctttgccctctccttgcaagcctggcatatagcttctctccatactcctaagggactttgcagacacccaagccactgggacccctgctaacacatgcaggtcttctcttctgccaactaacgtgctcgcgccctcccagcacgtggagagcttcaattgtcagataaacaggaagcgacagatgaccgctttctaacgctctcttttctcccgttttcagctgtagagtagctgccaggaggacttggccacccggccctgtcacactgcagccccttccccttccctctcgtggcccacaaggaggaaggaagggcaacctaaaagcccacttagaaactttttggatatgccactgcaattcttttcaaaatagcattccccaggtttttaatgggaggaaaaaaagctttaatgttgagcatgctgcgagctgctgcgtggaaaggcctctgtatgggccgaagacccttcttccctggctgccaggctcgccaggagcccactggaaacgcccaccacgggggctccttgttacacatgttctttttttatccgatcaacctgtgcacttttgatattttgatattatatttgcttccttaattcctcgcgtagagacggtctcaggtgccgtggtctatgctcgtggtcctgtagctgtccgcctcagctcccaccgtgtttgtctggtgtcagcacgaggcagagctgtgtgctccatagcgtgtagctttagactcggagatgagtgctttgacccagcgaggagctcagctaagtgtatccacgctgtggttcagcagcctttagatcatacggcattgtggttcatgtttgaaattacagattttaaatgccatgttcattaagaaatccagggtattcagattctggggtttttcatattgtattattattattcttaggaatagttcaatgtaacaagaagaaaacttgacctttgctctggttaaaacagtaataggcacttgaaaaaaaaagataaattattgaatgagtagtattacctacaaattccagaattttctgggttttaggacgttgtgaagcatgactgattaacagaattttatacaactgtaccaataaaattccaaattggaattgttttgttactctggttgttgtgccaaattgtggtacacttagaaaattctacagtcgtcgatttttagggtgttctctttcaacacctttttgttagtaatcattgccagtagtgccttcatcagttaagggaggtgtcccagcacagatcattctcaaaagcgagcagggaagagctagtgggcatgctgaaggccagcgtggacagcaggtgaggcaggtgctcctcacacccagacctgggcatcttcattgagggaaagaaaacagtcattgtgcaaaattctgttagtcagtgattctttacttgcaaattcaggggcttagaaaatgaaagcaaacacaaaaccttgagtgtgctttgggaaccaaatggaccttctgggacaagctgagcaagctgtatgaacgccacgtttgtgaagagctgagggtatcaggagggccgacgctgtgttggcatgcgcagtaggggatgagggttagccatagtattctttgcaaatgtgaaagcgagacattatatcttctcttgcttggtgtaactaatcactgttaatttcaggaaacagaactcattaaaactccttagcaaaccaggtctacatcctgttttgtttgctgagtgaggttagtgggagtggtcaaattggtactcttggaggaagaaaaactgtccttccttctccaaaaaaggaaaaattataataatataaatgacaaaaataaaagaattctgtttcctggaataagcatttcttattcctagttgtagggactcctatttttaccttccgttacagtgttgattcataagaaatattgttacatttgagataacttcatctgtatggggtatttatttgcaatgatgtctgagtactgtattttttctgtgcattaccttagtgtcagaatgttggtctttattttaaagtcatatgcatgttctcctgccaaggaacctttacacagacccaaacaaaaaaataataatcaaatgccttcaatttctgagaaaatgaggcagagcatggaaaaggaataggaaggagaaattaattgagattttcaggacacagacatatgatgtgaatgcctacaaagccagtgcgcataggaacagtgggcctgggtaaagagtcacattggtaggaccaataaagaataataaaaagacaaagca

SEQ ID NO: 296411 - DNA, 4355 bp, Homo sapiens
ctcctcagcagacgcagctcaaggaggcctttggacaagcacacacaaaccacaagaaggtggctgctgacggagagagccgggaggagagcctgatccaggagtcggcctccaaggagcagtactacgtgcggaaggtgctagagctgcagacggagctgaagagttgcgcaatgtcctcaccaacacgcagtcggagaatgagcgcctggcctctgtggcccaggagctgaaggagatcaaccagaatgtggagatccagcgtggccgcctgcgggatgacatcaaggagtacaaattccgggaagctcgtctgctgcaggactactcggagctgcgtctgctaggagaacatcagcctgcagaagcaagtgtctgtgctcagacagaaccaggtggagtttgagggcctcaagcatgagatcaagcgtctggaggaggagaccgagtacctcaacagccagctggaggatgccatccgcctcaaggagatctcagagcggcagctggaggaggcgctggagaccctgaagacggagcgcgaacagaagaacagcctgcgcaaggagctgtcacactacatgagcatcaatgactccttctacaccagccacctgcatgtctcgctggatggcctcaagttcagtgacgatgctgccgagcccaacaacgatgccgaggccctggtcaatggctttgagcacggcggcctggccaagctgccactggacaacaagacctccacgcccaagaaggagggcctcgcaccgccctcccccagcctcgtctccgacctactcagtgagctcaacatctctgagatccagaagctgaagcagcagctgatgcagatggagcgggaaaaggcgggcctgctggcaacgctgcaggacacacagaagcagctggagcacacgcggggctccctgtcagaacagcaggagaaggtgacccgcctcacagagaatctgagtgccctgcggcgcctgcaggccagcaaggagcggcagacagccctggacaacgagaaggaccgtgacagccatgaggatggggactactacgaggtggacatcaacgggcctgagatcttggcctgcaagtaccatgtggctgtggctgaggctggcgagctccgcgagcagctcaaggcactgcgcagcacgcacgaggctcgtgaggcccagcacgccgaggagaagggccgctatgaggctgagggccaggcactcacggagaaggtctccctgctagagaaggccagccgccaggaccgcgagctgctggcccggctggagaaggagctaaagaaggtgagcgacgtcgccggcgagacacagggcagcctgagtgtggcccaggatgagctggtgaccttcagtgaggagctggccaatctctaccaccacgtgtgcatgtgcaacaatgagacacccaaccgtgtcatgctggactactaccgcgagggccagggcggggccggccgcaccagtcccgggggccgcaccagccccgaggcgcgtggccggcgctcacccatcctcctacccaaggggctgctggctcctgaggcgggccgagcagatggtgggacgggggacagcagcccctcgcctggctcctcactgccatcacccctgagtgacccacgccgggagcccatgaacatctacaacctgatcgctatcatccgtgaccagatcaagcacctgcaggcagccgtggaccgcaccacggagctgtcacgccagcgcattgcctctcaggagctgggccccgccgtggacaaggacaaggaagcgcttatggaggagatcctcaagctgaagtcgctgctcagcaccaagcgggagcagatcaccacgctgcgcactgtgctcaaggccaacaagcagacggccgaggtggcccttgccaacctgaagagcaagtatgagaatgagaaggccatggttaccgagaccatgatgaagctgcgcaatgagctcaaggccctcaaggaggacgcagccaccttctcctcgctgcgtgctatgtttgccaccaggtgtgacgagtacattacacagctggatgagatgcagcggcagctggcggctgctgaggacgagaagaagacgctgaactcgctgctgcgcatggccatccagcagaagctggcgctgacccagcggctggagctgctcgagctggaccatgagcagacccggcgtggccgtgccaaagccgccccgaagaccaagccagccacaccgagcctgtagagtagctgccaggaggacttggccacccggccctgtcacactgcagccccttccccttccctctcgtggcccacaaggaggaaggaagggcaacctaaaagcccacttagaaactttttggatatgccactgcaattcttttcaaaatagcattccccaggtttttaatgggaggaaaaaaagctttaatgttgagcatgctgcgagctgctgcgtggaaaggcctctgtatgggccgaagacccttcttccctggctgccaggctcgccaggagcccactggaaacgcccaccacgggggctccttgttacacatgttctttttttatccgatcaacctgtgcacttttgatattttgatattatatttgcttccttaattcctcgcgtagagacggtctcaggtgccgtggtctatgctcgtggtcctgtagctgtccgcctcagctcccaccgtgtttgtctggtgtcagcacgaggcagagctgtgtgctccatagcgtgtagctttagactcggagatgagtgctttgacccagcgaggagctcagctaagtgtatccacgctgtggttcagcagcctttagatcatacggcattgtggttcatgtttgaaattacagattttaaatgccatgttcattaagaaatccagggtattcagattctggggtttttcatattgtattattattattcttaggaatagttcaatgtaacaagaagaaaacttgacctttgctctggttaaaacagtaataggcacttgaaaaaaaaagataaattattgaatgagtagtattacctacaaattccagaattttctgggttttaggacgttgtgaagcatgactgattaacagaattttatacaactgtaccaataaaattccaaattggaattgttttgttactctggttgttgtgccaaattgtggtacacttagaaaattctacagtcgtcgatttttagggtgttctctttcaacacctttttgttagtaatcattgccagtagtgccttcatcagttaagggaggtgtcccagcacagatcattctcaaaagcgagcagggaagagctagtgggcatgctgaaggccagcgtggacagcaggtgaggcaggtgctcctcacacccagacctgggcatcttcattgagggaaagaaaacagtcattgtgcaaaattctgttagtcagtgattctttacttgcaaattcaggggcttagaaaatgaaagcaaacacaaaaccttgagtgtgctttgggaaccaaatggaccttctgggacaagctgagcaagctgtatgaacgccacgtttgtgaagagctgagggtatcaggagggccgacgctgtgttggcatgcgcagtaggggatgagggttagccatagtattctttgcaaatgtgaaagcgagacattatatcttctcttgcttggtgtaactaatcactgttaatttcaggaaacagaactcattaaaactccttagcaaaccaggtctacatcctgttttgtttgctgagtgaggttagtgggagtggtcaaattggtactcttggaggaagaaaaactgtccttccttctccaaaaaaggaaaaattataataatataaatgacaaaaataaaagaattctgtttcctggaataagcatttcttattcctagttgtagggactcctatttttaccttccgttacagtgttgattcataagaaatattgttacatttgagataacttcatctgtatggggtatttatttgcaatgatgtctgagtactgtattttttctgtgcattaccttagtgtcagaatgttggtctttattttaaagtcatatgcatgttctcctgccaaggaacctttacacagacccaaacaaaaaaataataatcaaatgccttcaatttctgagaaaatgaggcagagcatggaaaaggaataggaaggagaaattaattgagattttcaggacacagacatatgatgtgaatgcctacaaagccagtgcgcataggaacagtgggcctgggtaaagagtcacattggtaggaccaataaagaataataaaaagacaaagca

SEQ ID NO: 296412 - DNA, 4274 bp, Homo sapiens
ctcctcagcagacgcagctcaaggaggcctttggacaagcacacacaaaccacaagaaggtggctgctgacggagagagccgggaggagagcctgatccaggagtcggcctccaaggagcagtactacgtgcggaaggtgctagagctgcagacggagctgaagagttgcgcaatgtcctcaccaacacgcagtcggagaatgagcgcctggcctctgtggcccaggagctgaaggagatcaaccagaatgtggagatccagcgtggccgcctgcgggatgacatcaaggagtacaaattccgggaagctcgtctgctgcaggactactcggagctgcgtctgctaggagaacatcagcctgcagaagcaagtgtctgtgctcagacagaaccaggtggagtttgagggcctcaagcatgagatcaagcgtctggaggaggagaccgagtacctcaacagccagctggaggatgccatccgcctcaaggagatctcagagcggcagctggaggaggcgctggagaccctgaagacggagcgcgaacagaagaacagcctgcgcaaggagctgtcacactacatgagcatcaatgactccttctacaccagccacctgcatgtctcgctggatggcctcaagttcagtgacgatgctgccgagcccaacaacgatgccgaggccctggtcaatggctttgagcacggcggcctggccaagctgccactggacaacaagacctccacgcccaagaaggagggcctcgcaccgccctcccccagcctcgtctccgacctactcagtgagctcaacatctctgagatccagaagctgaagcagcagctgatgcagatggagcgggaaaaggcgggcctgctggcaacgctgcaggacacacagaagcagctggagcacacgcggggctccctgtcagaacagcaggagaaggtgacccgcctcacagagaatctgagtgccctgcggcgcctgcaggccagcaaggagcggcagacagccctggacaacgagaaggaccgtgacagccatgaggatggggactactacgaggtggacatcaacgggcctgagatcttggcctgcaagtaccatgtggctgtggctgaggctggcgagctccgcgagcagctcaaggcactgcgcagcacgcacgaggctcgtgaggcccagcacgccgaggagaagggccgctatgaggctgagggccaggcactcacggagaaggtctccctgctagagaaggccagccgccaggaccgcgagctgctggcccggctggagaaggagctaaagaaggtgagcgacgtcgccggcgagacacagggcagcctgagtgtggcccaggatgagctggtgaccttcagtgaggagctggccaatctctaccaccacgtgtgcatgtgcaacaatgagacacccaaccgtgtcatgctggactactaccgcgagggccagggcggggccggccgcaccagtcccgggggccgcaccagccccgaggcgcgtggccggcgctcacccatcctcctacccaaggggctgctggctcctgaggcgggccgagcagatggtgggacgggggacagcagcccctcgcctggctcctcactgccatcacccctgagtgacccacgccgggagcccatgaacatctacaacctgatcgctatcatccgtgaccagatcaagcacctgcaggcagccgtggaccgcaccacggagctgtcacgccagcgcattgcctctcaggagctgggccccgccgtggacaaggacaaggaagcgcttatggaggagatcctcaagctgaagtcgctgctcagcaccaagcgggagcagatcaccacgctgcgcactgtgctcaaggccaacaagcagacggccgaggtggcccttgccaacctgaagagcaagtatgagaatgagaaggccatggttaccgagaccatgatgaagctgcgcaatgagctcaaggccctcaaggaggacgcagccaccttctcctcgctgcgtgctatgtttgccaccaggtgtgacgagtacattacacagctggatgagatgcagcggcagctggcggctgctgaggacgagaagaagacgctgaactcgctgctgcgcatggccatccagcagaagctggcgctgacccagcggctggagctgctcgagctggaccatgagcagacccggcgtggccgtgccaaagccgccccgaagaccaagccagccacaccgagcctgtagagtagctgccaggaggacttggccacccggccctgtcacactgcagccccttccccttccctctcgtggcccacaaggaggaaggaagggcaacctaaaagcccacttagaaactttttggatatgccactgcaattcttttcaaaatagcattccccaggtttttaatgggaggaaaaaaagctttaatgttgagcatgctgcgagctgctgcgtggaaaggcctctgtatgggccgaagacccttcttccctggctgccaggctcgccaggagcccactggaaacgcccaccacgggggctccttgttacacatgttctttttttatccgatcaacctgtgcacttttgatattttgatattatatttgcttccttaattcctcgcgtagagacggtctcaggtgccgtggtctatgctcgtggtcctgtagctgtccgcctcagctcccaccgtgtttgtctggtgtcagcacgaggcagagctgtgtgctccatagcgtgtagctttagactcggagatgagtgctttgacccagcgaggagctcagctaagtgtatccacgctgtggttcagcagcctttagatcatacggcattgtggttcatgtttgaaattacagattttaaatgccatgttcattaagaaatccagggtattcagattctggggtttttcatattgtattattattattcttaggaatagttcaatgtaacaagaagaaaacttgacctttgctctggttaaaacagtaataggcacttgaaaaaaaaagataaattattgaatgagtagtattacctacaaattccagaattttctgggttttaggacgttgtgaagcatgactgattaacagaattttatacaactgtaccaataaaattccaaattggaattgttttgttactctggttgttgtgccaaattgtggtacacttagaaaattctacagtcgtcgatttttagggtgttctctttcaacacctttttgttagtaatcattgccagtagtgccttcatcagttaagggaggtgtcccagcacagatcattctcaaaagcgagcagggaagagctagtgggcatgctgaaggccagcgtggacagcaggtgaggcaggtgctcctcacacccagacctgggcatcttcattgagggaaagaaaacagtcattgtgcaaaattctgttagtcagtgattctttacttgcaaattcaggggcttagaaaatgaaagcaaacacaaaaccttgagtgtgctttgggaaccaaatggaccttctgggacaagctgagcaagctgtatgaacgccacgtttgtgaagagctgagggtatcaggagggccgacgctgtgttggcatgcgcagtaggggatgagggttagccatagtattctttgcaaatgtgaaagcgagacattatatcttctcttgcttggtgtaactaatcactgttaatttcaggaaacagaactcattaaaactccttagcaaaccaggtctacatcctgttttgtttgctgagtgaggttagtgggagtggtcaaattggtactcttggaggaagaaaaactgtccttccttctccaaaaaaggaaaaattataataatataaatgacaaaaataaaagaattctgtttcctggaataagcatttcttattcctagttgtagggactcctatttttaccttccgttacagtgttgattcataagaaatattgttacatttgagataacttcatctgtatggggtatttatttgcaatgatgtctgagtactgtattttttctgtgcattaccttagtgtcagaatgttggtctttattttaaagtcatatgcatgttctcctgccaaggaataggaaggagaaattaattgagattttcaggacacagacatatgatgtgaatgcctacaaagccagtgcgcataggaacagtgggcctgggtaaagagtcacattggtaggaccaataaagaataataaaaagacaaagca

SEQ ID NO: 296413 - DNA, 631 bp, Homo sapiens
tcctaccttgccccttcaaagaacactgcggctgttgtcgaccccagcgtctgctgttgaagctgcacacccactctgtgcatgaagctggaactggactctgtttttttgtttgtttgtttgtttttcaagacaggatcttggtctatcactggactggagtgcagtggcatgatcacagctcactgcagcctccacctcctaggctcaagtgatcctcccacctcagcctccccaatagctaaaattccaggtgcatgctgccatgcctggctaatttttattttttttgtgtggagacagggtgtctctgtgttgcctaggttggtcttgaactcctgggctcaagtgatcctcccacctcggtctcccaaagtgttgggagtgcacgtgagccactacagcttgtcttggactccgcttcttgtatatggtcattcaagatgtcctgtcattgaaaagaaagggaatgatgattgaaatatcggtccctcacttaaggatggcaggactgacgaccagcagatctgtcctaattgttgttgctgtgttcagtttatgaactttcactgcacttacacctagatattgcttggaatggttaattggcttcttaggccctggaatttgg

SEQ ID NO: 296414 - DNA, 739 bp, Homo sapiens
gctccgggaaggcgtcaggacccccaggggccccattgcgttgctccgcccagaagtgccaaaggaagcttcgtgccgaattggaaatcaagctattcgatacctaaagttttattggaacacagcaacacccattcctttctgcattgccttgtgctctggggctgcaggtgaagagtagctgccacaaaccacctggcccataaagctcaaaatagttgccatctggccctttacagacagctagctgactcctaatctagggcaaacgcaggtgcctaaaaaggaccagaaaggagaccagaatgaagggcaggggggtggcagggcctgtggcaactggagagtaggcgtcctgtgccacgggaatgttgccaggtccgtttttctagggaaagcagaaatctggatttttatgtggaatctcactgtaggggtggggaaatctcattttaaaaatgtaatcaggccaggcacagtggctcacacctgtaatcccagcgctttgggaggccaagataggaggatgagttgagcccatgagttggagaccagcctgggcaacatagtgagaccccatctctactaaaaagtattaaaaagtagcagggtgaccaggcatggtggctcacacctgtaatcccagcactttgggaggctgaggcaggcagatcacaaggtcaagagatcgagactatcctggcaaacatggtgaaaccctgtctctactaaaaataca

SEQ ID NO: 296415 - DNA, 463 bp, Homo sapiens
gcggccgccaccccggggcgccccctcgggaattccagagcccagcggggtgagggggggctgatccgggacgagtgaggggggtggacagtggattcagctggaactttggcccccgccggccccactaaggaccaacccgaccccctctcccgcagcactacgccccatcggtgttcgagaagtacacggccagcgtgaccgttggcagcaaggaggtgaccctgaacctctacgacacggccggtgagtgcgcctgcgcgccggggggcccgagggtccgcccgcccgaagggtttcccctcccgggcgtcccccactgggtgtccccgccctgcagccttggcagggccttggccggctcttcactcctggaggccgctcaggggcgctggctgcggggccctagaggccaagccctatacgtaagtggaaggtgtttggaggaggaggtgaactctgg

SEQ ID NO: 296416 - DNA, 3337 bp, Homo sapiens
atcaggggcacctggagtcgctgggcagccacgatcgggtctcgccggcgaggggcgcgacgtgacgcgcggagggtggcggtgggttgggggtgggagctttgctcgcagctgagccccgtttttccggtgctgcagtatccctgggactgagagctgaatacccacacccagggctgagaccttagcagaaaggaaactgaggctgggaggtcggccgggaggctgcctggcggaggcggcgctgctccgagtgggcggggctggttccggccccgccccgcccccgacctcttggctccgctagtgcccagcgcgccgccgccagtgctgcgggctccgggcaatggatgcccccggggccctggcccagaccgccgcccccggtccgggcaggaaggagctgaagatcgtgatcgtgggcgacggcggctgcggcaagacctcgctgctcatggtgtacagccagggctccttccccgagcactacgccccatcggtgttcgagaagtacacggccagcgtgaccgttggcagcaaggaggtgaccctgaacctctacgacacggccgggcaagaagactatgaccggctgcggcccctgtcctaccagaacacccacctcgtgctcatctgctatgacgtcatgaatcccaccagctacgacaacgtcctcatcaagtggttccctgaggtcacgcatttctgccgcgggatccccatggtgctcatcggctgcaagacagacctgaggaaggacaaggagcagctgcggaagctccgggccgcccagctggagcccatcacctacatgcagggcctgagcgcctgcgaacagatccgagctgctctctacctggaatgttccgccaagtttcgggagaatgtggaggacgtcttccgggaggccgccaaggtggctctcagcgctctgaagaaggcgcaacggcagaagaagcgccggctctgcctgctgctctgacccagggcagacagacctcacgacagcactgacagggcccgggggcccaggtgccgattgcaccagggaggctgccccatcccgaccctccagctcatggtgtctggggcctgcggctagactcttggaacattctggaactctctcctttcctggctggggctctgaccacaaactcccctccaggctgcccctgggacatggtggtgatgtgggtgcaggagccagtgtctgttgtcgggactcgcaagtgccctcatcacagccacccccaccacgagtgtctccccagtgcagactcaagttatgcttgaaatgaaaaagtctatctggtagtgggtaaacgtagacctggcactgttccacgcgggcgccccaagcctgccactcctgtgtccctgcctccctgggctcccgagataggcaccactgtatcctccagctccttccttccttcccccaggaacacggaggccaccgagggggctgggcctatcaggaggacacaggctgcagcctggcacccacccctcccatctccaccccacatggaagacttgtcttcaacttggccactgtctttgcagagctgggcacatgtgcccagggggcagaaaaaatggcttctcagttgttaaaagtataccctggaccacccatctgaccatctccttaaggtttcacccaaagcccccagtgtcagagacttgggatgggaagaacagtcggctcccagtgtggtcatgagcaagttttctgtggactgttccccccactgtggtaggacaggactggcccacttagtcctcaagctcccaacctgctgtccctcaagccccgcttctaccagcctgtggagttcaggaggcgagacatcctggcctcctttgagaactgatgggatctaccccctgtccacgcgggacagtttctcagaactggttcatagaccacctgtgtcaccaacagccagatacctaatccctgagcctcctttgggaaggtctggggccgagggtctgggaatttttttttttttttttttttgggacagagtctcattctgtcactcaggctagagtgcagtggcatgatcttggctcactgcaagctccacctcctgggttcaagcgattctcttgcctcagcctcctgagtagctgggactacatgcgcacaccaccacgtccggctaatttttgtatttttagtagagacagggtttcaccatgttggccaggctggtcttgaactcctgacctcgtgatccacccgccttagcctcccaaagtgctgggattacaggcgtgagccaccgtgcccggcccaggacttttaaaacaagcatcccaggggattccggtgcctaccagaagtcgcaagctgcttggctctggagggcgcctaggagtcggtgtcgcctaagatgggataatggcttcaggcaactcctagccttccccatatctcctgcctcagcccccctggcccagtgctggggcgtcagctaaacctgagcttccaagaagtcaggttgccaaaggaaggagccttctgagaccctccccaacccacccaggttcccaaggccctgccgtaccctggggaatcaaccaaggagttcttgttctcgaagaaccccaggcctcatgatggtctacggtagaggtccaacaactacagcctgtgggccacatctggccacagcctgatttgtaaataaagttttattggaacacagcaacacccattcctttctgcattgccttgtgctctggggctgcaggtgaagagtagctgccacaaaccacctggcccataaagctcaaaatagttgccatctggccctttacagacagctagctgactcctaatctagggcaaacgcaggtgcctaaaaaggaccagaaaggagaccagaatgaagggcaggggggtggcagggcctgtggcaactggagagtaggcgtcctgtgccacgggaatgttgccaggtccgtttttctagggaaagcagaaatctggatttttatgtggaatctcactgtaggggtggggaaatctcattttaaaaatgtaatcaggccaggcacagtggctcacacctgtaatcccagcgctttgggaggccaagataggaggatgagttgagcccatgagttggagaccagcctgggcaacatagtgagaccccatctctactaaaaagtattaaaaagtagcagggtgaccaggcatggtggctcacacctgtaatcccagcactttgggaggctgaggcaggcagatcacaaggtcaagagatcgagactatcctggcaaacatggtgaaaccctgtctctactaaaaataca

SEQ ID NO: 296417 - DNA, 3322 bp, Homo sapiens
ggcgattgcccggcagagggcgtcagacgtccaccctgcagcccagggtcggggtgcgggtaagcggagcccagtccctcaccccgaacccgcgtgcacgctggcgtccctggcccaggcgagtatccctgggactgagagctgaatacccacacccagggctgagaccttagcagaaaggaaactgaggctgggaggtcggccgggaggctgcctggcggaggcggcgctgctccgagtgggcggggctggttccggccccgccccgcccccgacctcttggctccgctagtgcccagcgcgccgccgccagtgctgcgggctccgggcaatggatgcccccggggccctggcccagaccgccgcccccggtccgggcaggaaggagctgaagatcgtgatcgtgggcgacggcggctgcggcaagacctcgctgctcatggtgtacagccagggctccttccccgagcactacgccccatcggtgttcgagaagtacacggccagcgtgaccgttggcagcaaggaggtgaccctgaacctctacgacacggccgggcaagaagactatgaccggctgcggcccctgtcctaccagaacacccacctcgtgctcatctgctatgacgtcatgaatcccaccagctacgacaacgtcctcatcaagtggttccctgaggtcacgcatttctgccgcgggatccccatggtgctcatcggctgcaagacagacctgaggaaggacaaggagcagctgcggaagctccgggccgcccagctggagcccatcacctacatgcagggcctgagcgcctgcgaacagatccgagctgctctctacctggaatgttccgccaagtttcgggagaatgtggaggacgtcttccgggaggccgccaaggtggctctcagcgctctgaagaaggcgcaacggcagaagaagcgccggctctgcctgctgctctgacccagggcagacagacctcacgacagcactgacagggcccgggggcccaggtgccgattgcaccagggaggctgccccatcccgaccctccagctcatggtgtctggggcctgcggctagactcttggaacattctggaactctctcctttcctggctggggctctgaccacaaactcccctccaggctgcccctgggacatggtggtgatgtgggtgcaggagccagtgtctgttgtcgggactcgcaagtgccctcatcacagccacccccaccacgagtgtctccccagtgcagactcaagttatgcttgaaatgaaaaagtctatctggtagtgggtaaacgtagacctggcactgttccacgcgggcgccccaagcctgccactcctgtgtccctgcctccctgggctcccgagataggcaccactgtatcctccagctccttccttccttcccccaggaacacggaggccaccgagggggctgggcctatcaggaggacacaggctgcagcctggcacccacccctcccatctccaccccacatggaagacttgtcttcaacttggccactgtctttgcagagctgggcacatgtgcccagggggcagaaaaaatggcttctcagttgttaaaagtataccctggaccacccatctgaccatctccttaaggtttcacccaaagcccccagtgtcagagacttgggatgggaagaacagtcggctcccagtgtggtcatgagcaagttttctgtggactgttccccccactgtggtaggacaggactggcccacttagtcctcaagctcccaacctgctgtccctcaagccccgcttctaccagcctgtggagttcaggaggcgagacatcctggcctcctttgagaactgatgggatctaccccctgtccacgcgggacagtttctcagaactggttcatagaccacctgtgtcaccaacagccagatacctaatccctgagcctcctttgggaaggtctggggccgagggtctgggaatttttttttttttttttttttgggacagagtctcattctgtcactcaggctagagtgcagtggcatgatcttggctcactgcaagctccacctcctgggttcaagcgattctcttgcctcagcctcctgagtagctgggactacatgcgcacaccaccacgtccggctaatttttgtatttttagtagagacagggtttcaccatgttggccaggctggtcttgaactcctgacctcgtgatccacccgccttagcctcccaaagtgctgggattacaggcgtgagccaccgtgcccggcccaggacttttaaaacaagcatcccaggggattccggtgcctaccagaagtcgcaagctgcttggctctggagggcgcctaggagtcggtgtcgcctaagatgggataatggcttcaggcaactcctagccttccccatatctcctgcctcagcccccctggcccagtgctggggcgtcagctaaacctgagcttccaagaagtcaggttgccaaaggaaggagccttctgagaccctccccaacccacccaggttcccaaggccctgccgtaccctggggaatcaaccaaggagttcttgttctcgaagaaccccaggcctcatgatggtctacggtagaggtccaacaactacagcctgtgggccacatctggccacagcctgatttgtaaataaagttttattggaacacagcaacacccattcctttctgcattgccttgtgctctggggctgcaggtgaagagtagctgccacaaaccacctggcccataaagctcaaaatagttgccatctggccctttacagacagctagctgactcctaatctagggcaaacgcaggtgcctaaaaaggaccagaaaggagaccagaatgaagggcaggggggtggcagggcctgtggcaactggagagtaggcgtcctgtgccacgggaatgttgccaggtccgtttttctagggaaagcagaaatctggatttttatgtggaatctcactgtaggggtggggaaatctcattttaaaaatgtaatcaggccaggcacagtggctcacacctgtaatcccagcgctttgggaggccaagataggaggatgagttgagcccatgagttggagaccagcctgggcaacatagtgagaccccatctctactaaaaagtattaaaaagtagcagggtgaccaggcatggtggctcacacctgtaatcccagcactttgggaggctgaggcaggcagatcacaaggtcaagagatcgagactatcctggcaaacatggtgaaaccctgtctctactaaaaataca

SEQ ID NO: 296418 - DNA, 3163 bp, Homo sapiens
atcaggggcacctggagtcgctgggcagccacgatcgggtctcgccggcgaggggcgcgacgtgacgcgcggagggtggcggtgggttgggggtgggagctttgctcgcagctgagccccgtttttccggtgctgcagtatccctgggactgagagctgaatacccacacccagggctgagaccttagcagaaaggaaactgaggctgggaggtcggccgggaggctgcctggcggaggcggcgctgctccgagtgggcggggctggttccggccccgccccgcccccgacctcttggctccgctagtgcccagcgcgccgccgccagtgctgcgggctccgggcaatggatgcccccggggccctggcccagaccgccgcccccggtccgggcaggaaggagctgaagatcgtgatcgtgggcgacggcggctgcggcaagacctcgctgctcatggtgtacagccagggctccttccccgagcactacgccccatcggtgttcgagaagtacacggccagcgtgaccgttggcagcaaggaggtgaccctgaacctctacgacacggccgggcaagaagactatgaccggctgcggcccctgtcctaccagaacacccacctcgtgctcatctgctatgacgtcatgaatcccaccagctacgacaacgtcctcatcaagtggttccctgaggtcacgcatttctgccgcgggatccccatggtgctcatcggctgcaagacagacctgaggaaggacaaggagcagctgcggaagctccgggccgcccagctggagcccatcacctacatgcagggcctgagcgcctgcgaacagatccgagctgctctctacctggaatgttccgccaagtttcgggagaatgtggaggacgtcttccgggaggccgccaaggtggctctcagcgctctgaagaaggcgcaacggcagaagaagcgccggctctgcctgctgctctgacccagggcagacagacctcacgacagcactgacagggcccgggggcccaggtgccgattgcaccagggaggctgccccatcccgaccctccagctcatggtgtctggggcctgcggctagactcttggaacattctggaactctctcctttcctggctggggctctgaccacaaactcccctccaggctgcccctgggacatggtggtgatgtgggtgcaggagccagtgtctgttgtcgggactcgcaagtgccctcatcacagccacccccaccacgagtgtctccccagtgcagactcaagttatgcttgaaatgaaaaagtctatctggtagtgggtaaacgtagacctggcactgttccacgcgggcgccccaagcctgccactcctgtgtccctgcctccctgggctcccgagataggcaccactgtatcctccagctccttccttccttcccccaggaacacggaggccaccgagggggctgggcctatcaggaggacacaggctgcagcctggcacccacccctcccatctccaccccacatggaagacttgtcttcaacttggccactgtctttgcagagctgggcacatgtgcccagggggcagaaaaaatggcttctcagttgttaaaagtataccctggaccacccatctgaccatctccttaaggtttcacccaaagcccccagtgtcagagacttgggatgggaagaacagtcggctcccagtgtggtcatgagcaagttttctgtggactgttccccccactgtggtaggacaggactggcccacttagtcctcaagctcccaacctgctgtccctcaagccccgcttctaccagcctgtggagttcaggaggcgagacatcctggcctcctttgagaactgatgggatctaccccctgtccacgcgggacagtttctcagaactggttcatagaccacctgtgtcaccaacagccagatacctaatccctgagcctcctttgggaaggtctggggccgagggtctgggaatttttttttttttttttttttgggacagagtctcattctgtcactcaggctagagtgcagtggcatgatcttggctcactgcaagctccacctcctgggttcaagcgattctcttgcctcagcctcctgagtagctgggactacatgcgcacaccaccacgtccggctaatttttgtatttttagtagagacagggtttcaccatgttggccaggctggtcttgaactcctgacctcgtgatccacccgccttagcctcccaaagtgctgggattacaggcgtgagccaccgtgcccggcccaggacttttaaaacaagcatcccaggggattccggtgcctaccagaagtcgcaagctgcttggctctggagggcgcctaggagtcggtgtcgcctaagatgggataatggcttcaggcaactcctagccttccccatatctcctgcctcagcccccctggcccagtgctggggcgtcagctaaacctgagcttccaagaagtcaggttgccaaaggaaggagccttctgagaccctccccaacccacccaggttcccaaggccctgccgtaccctggggaatcaaccaaggagttcttgttctcgaagaaccccaggcctcatgatggtctacggtagaggtccaacaactacagcctgtgggccacatctggccacagcctgatttgtaaataaagttttattggaacacagcaacacccattcctttctgcattgccttgtgctctggggctgcaggtgaagagtagctgccacaaaccacctggcccataaagctcaaaatagttgccatctggccctttacagacagctagctgactcctaatctagggcaaacgcaggtgcctaaaaaggaccagaaaggagaccagaatgaagggcaggggggtggcagggcctgtggcaactggagagtaggcgtcctgtgccacgggaatgttgccaggtccgtttttctagggaaagcagaaatctggatttttatgtggaatctcactgtaggggtggggaaatctcattttaaaaatgtaatcaggccaggcacagtggctcacacctgtaatcccagcgctttgtagaggcacagcattgcagatcggggtaccggagcatcgaattcggtaactcatggg

SEQ ID NO: 296419 - DNA, 2313 bp, Homo sapiens
atcaggggcacctggagtcgctgggcagccacgatcgggtctcgccggcgaggggcgcgacgtgacgcgcggagggtggcggtgggttgggggtgggagctttgctcgcagctgagccccgtttttccggtgctgcagtatccctgggactgagagctgaatacccacacccagggctgagaccttagcagaaaggaaactgaggctgggaggtcggccgggaggctgcctggcggaggcggcgctgctccgagtgggcggggctggttccggccccgccccgcccccgacctcttggctccgctagtgcccagcgcgccgccgccagtgctgcgggctccgggcaatggatgcccccggggccctggcccagaccgccgcccccggtccgggcaggaaggagctgaagatcgtgatcgtgggcgacggcggctgcggcaagacctcgctgctcatggtgtacagccagggctccttccccgagcactacgccccatcggtgttcgagaagtacacggccagcgtgaccgttggcagcaaggaggtgaccctgaacctctacgacacggccgggcaagaagactatgaccggctgcggcccctgtcctaccagaacacccacctcgtgctcatctgctatgacgtcatgaatcccaccagctacgacaacgtcctcatcaagtggttccctgaggtcacgcatttctgccgcgggatccccatggtgctcatcggctgcaagacagacctgaggaaggacaaggagcagctgcggaagctccgggccgcccagctggagcccatcacctacatgcagggcctgagcgcctgcgaacagatccgagctgctctctacctggaatgttccgccaagtttcgggagaatgtggaggacgtcttccgggaggccgccaaggtggctctcagcgctctgaagaaggcgcaacggcagaagaagcgccggctctgcctgctgctctgacccagggcagacagacctcacgacagcactgacagggcccgggggcccaggtgccgattgcaccagggaggctgccccatcccgaccctccagctcatggtgtctggggcctgcggctagactcttggaacattctggaactctctcctttcctggctggggctctgaccacaaactcccctccaggctgcccctgggacatggtggtgatgtgggtgcaggagccagtgtctgttgtcgggactcgcaagtgccctcatcacagccacccccaccacgagtgtctccccagtgcagactcaagttatgcttgaaatgaaaaagtctatctggtagtgggtaaacgtagacctggcactgttccacgcgggcgccccaagcctgccactcctgtgtccctgcctccctgggctcccgagataggcaccactgtatcctccagctccttccttccttccccctggcccagtgctggggcgtcagctaaacctgagcttccaagaagtcaggttgccaaaggaaggagccttctgagaccctccccaacccacccaggttcccaaggccctgccgtaccctggggaatcaaccaaggagttcttgttctcgaagaaccccaggcctcatgatggtctacggtagaggtccaacaactacagcctgtgggccacatctggccacagcctgatttgtaaataaagttttattggaacacagcaacacccattcctttctgcattgccttgtgctctggggctgcaggtgaagagtagctgccacaaaccacctggcccataaagctcaaaatagttgccatctggccctttacagacagctagctgactcctaatctagggcaaacgcaggtgcctaaaaaggaccagaaaggagaccagaatgaagggcaggggggtggcagggcctgtggcaactggagagtaggcgtcctgtgccacgggaatgttgccaggtccgtttttctagggaaagcagaaatctggatttttatgtggaatctcactgtaggggtggggaaatctcattttaaaaatgtaatcaggccaggcacagtggctcacacctgtaatcccagcgctttgggaggccaagataggaggatgagttgagcccatgagttggagaccagcctgggcaacatagtgagaccccatctctactaaaaagtattaaaaagtagcagggtgaccaggcatggtggctcacacctgtaatcccagcactttgggaggctgaggcaggcagatcacaaggtcaagagatcgagactatcctggcaaacatggtgaaaccctgtctctactaaaaataca

SEQ ID NO: 296420 - DNA, 2392 bp, Homo sapiens
atcaggggcacctggagtcgctgggcagccacgatcgggtctcgccggcgaggggcgcgacgtgacgcgcggagggtggcggtgggttgggggtgggagctttgctcgcagctgagccccgtttttccggtgctgcagtatccctgggactgagagctgaatacccacacccagggctgagaccttagcagaaaggaaactgaggctgggaggtcggccgggaggctgcctggcggaggcggcgctgctccgagtgggcggggctggttccggccccgccccgcccccgacctcttggctccgctagtgcccagcgcgccgccgccagtgctgcgggctccgggcaatggatgcccccggggccctggcccagaccgccgcccccggtccgggcaggaaggagctgaagatcgtgatcgtgggcgacggcggctgcggcaagacctcgctgctcatggtgtacagccagggctccttccccgagcactacgccccatcggtgttcgagaagtacacggccagcgtgaccgttggcagcaaggaggtgaccctgaacctctacgacacggccgggcaagaagactatgaccggctgcggcccctgtcctaccagaacacccacctcgtgctcatctgctatgacgtcatgaatcccaccagctacgacaacgtcctcatcaagtggttccctgaggtcacgcatttctgccgcgggatccccatggtgctcatcggctgcaagacagacctgaggaaggacaaggagcagctgcggaagctccgggccgcccagctggagcccatcacctacatgcagggcctgagcgcctgcgaacagatccgagctgctctctacctggaatgttccgccaagtttcgggagaatgtggaggacgtcttccgggaggccgccaaggtggctctcagcgctctgaagaaggcgcaacggcagaagaagcgccggctctgcctgctgctctgacccagggcagacagacctcacgacagcactgacagggcccgggggcccaggtgccgattgcaccagggaggctgccccatcccgaccctccagctcatggtgtctggggcctgcggctagactcttggaacattctggaactctctcctttcctggctggggctctgaccacaaactcccctccaggctgcccctgggacatggtggtgatgtgggtgcaggagccagtgtctgttgtcgggactcgcaagtgccctcatcacagccacccccaccacgagtgtctccccagtgcagactcaagttatgcttgaaatgaaaaagtctatctggtagtgggtaaacgtagacctggcactgttccacgcgggcgccccaagcctgccactcctgtgtccctgcctccctgggctcccgagataggcaccactgtatcctccagctccttccttccttcccccaggaacacggaggccaccgagggggctgggcctatcaggaggacacaggctgcagcctggcacccacccctcccatctccaccccacatggaagacttgtcttcaacttggccactgtctttgcagagctgggcacatgtgcccagggggcagaaaaaatggcttctcagttgttaaaagtataccctggaccacccatctgaccatctccttaaggtttcacccaaagcccccagtgtcagagacttgggatgggaagaacagtcggctcccagtgtggtcatgagcaagttttctgtggactgttccccccactgtggtaggacaggactggcccacttagtcctcaagctcccaacctgctgtccctcaagccccgcttctaccagcctgtggagttcaggaggcgagacatcctggcctcctttgagaactgatgggatctaccccctgtccacgcgggacagtttctcagaactggttcatagaccacctgtgtcaccaacagccagatacctaatccctgagcctcctttgggaaggtctggggccgagggtctgggaatttttttttttttttttttttttttgtggggaccagggtctctttcgtgtcccccgggcctcaggtggccgggggcttgtattctgggcccccgtggagcccccccccctggggttcccggcgattcttcgttgcctcagcctccgtgagttgcggggcatttctatgcccccaccgtcagcggcgcggccaaattggtggtctgtgcagtaaagcacgggtttccccctgttgtgccggcctgttcttgaacctctgcacctcgtgatcccgccgctttggactccccaagtgcgtggtttcggctttgaccctcgtgcgcgcccggatttaacaggctcccggggtcccgtgccccgaattcagcgtttgctcgggcttgat

SEQ ID NO: 296421 - DNA, 1324 bp, Homo sapiens
atcaggggcacctggagtcgctgggcagccacgatcgggtctcgccggcgaggggcgcgacgtgacgcgcggagggtggcggtgggttgggggtgggagctttgctcgcagctgagccccgtttttccggtgctgcagtatccctgggactgagagctgaatacccacacccagggctgagaccttagcagaaaggaaactgaggctgggaggtcggccgggaggctgcctggcggaggcggcgctgctccgagtgggcggggctggttccggccccgccccgcccccgacctcttggctccgctagtgcccagcgcgccgccgccagtgctgcgggctccgggcaatggatgcccccggggccctggcccagaccgccgcccccggtccgggcaggaaggagctgaagatcgtgatcgtgggcgacggcggctgcggcaagacctcgctgctcatggtgtacagccagggctccttccccgagcactacgccccatcggtgttcgagaagtacacggccagcgtgaccgttggcagcaaggaggtgaccctgaacctctacgacacggccgggcaagaagactatgaccggctgcggcccctgtcctaccagaacacccacctcgtgctcatctgctatgacgtcatgaatcccaccagctacgacaacgtcctcatcaagtggttccctgaggtcacgcatttctgccgcgggatccccatggtgctcatcggctgcaagacagacctgaggaaggacaaggagcagctgcggaagctccgggccgcccagctggagcccatcacctacatgcagggcctgagcgcctgcgaacagatccgagctgctctctacctggaatgttccgccaagtttcgggagaatgtggaggacgtcttccgggaggccgccaaggtggctctcagcgctctgaagaaggcgcaacggcagaagaagcgccggctctgcctgctgctctgacccagggcagacagacctcacgacagcactgacagggcccgggggcccaggtgccgattgcaccagggaggctgccccatcccgaccctccagctcatggtgtctggggcctgcggctagactcttggaacattctggaactctctcctttcctggctggggctctgaccacaaactcccctccaggctgcccctgggacatggtggtgatgtgggtgcaggagccagtgtctgttgtcgggactcgcaagtgccctcatcacagccacccccaccacgagtgtctccccagtgcagactcaagttatgcttgaaatgaaaaagtctatctggtagtgggta

SEQ ID NO: 296422 - DNA, 3011 bp, Homo sapiens
gcggccgccaccccggggcgccccctcgggaattccagagcccagcggggtgagggggggctgatccgggacgagtgaggggggtggacagtggattcagctggaactttggcccccgccggccccactaaggaccaacccgaccccctctcccgcagcactacgccccatcggtgttcgagaagtacacggccagcgtgaccgttggcagcaaggaggtgaccctgaacctctacgacacggccgggcaagaagactatgaccggctgcggcccctgtcctaccagaacacccacctcgtgctcatctgctatgacgtcatgaatcccaccagctacgacaacgtcctcatcaagtggttccctgaggtcacgcatttctgccgcgggatccccatggtgctcatcggctgcaagacagacctgaggaaggacaaggagcagctgcggaagctccgggccgcccagctggagcccatcacctacatgcagggcctgagcgcctgcgaacagatccgagctgctctctacctggaatgttccgccaagtttcgggagaatgtggaggacgtcttccgggaggccgccaaggtggctctcagcgctctgaagaaggcgcaacggcagaagaagcgccggctctgcctgctgctctgacccagggcagacagacctcacgacagcactgacagggcccgggggcccaggtgccgattgcaccagggaggctgccccatcccgaccctccagctcatggtgtctggggcctgcggctagactcttggaacattctggaactctctcctttcctggctggggctctgaccacaaactcccctccaggctgcccctgggacatggtggtgatgtgggtgcaggagccagtgtctgttgtcgggactcgcaagtgccctcatcacagccacccccaccacgagtgtctccccagtgcagactcaagttatgcttgaaatgaaaaagtctatctggtagtgggtaaacgtagacctggcactgttccacgcgggcgccccaagcctgccactcctgtgtccctgcctccctgggctcccgagataggcaccactgtatcctccagctccttccttccttcccccaggaacacggaggccaccgagggggctgggcctatcaggaggacacaggctgcagcctggcacccacccctcccatctccaccccacatggaagacttgtcttcaacttggccactgtctttgcagagctgggcacatgtgcccagggggcagaaaaaatggcttctcagttgttaaaagtataccctggaccacccatctgaccatctccttaaggtttcacccaaagcccccagtgtcagagacttgggatgggaagaacagtcggctcccagtgtggtcatgagcaagttttctgtggactgttccccccactgtggtaggacaggactggcccacttagtcctcaagctcccaacctgctgtccctcaagccccgcttctaccagcctgtggagttcaggaggcgagacatcctggcctcctttgagaactgatgggatctaccccctgtccacgcgggacagtttctcagaactggttcatagaccacctgtgtcaccaacagccagatacctaatccctgagcctcctttgggaaggtctggggccgagggtctgggaatttttttttttttttttttttgggacagagtctcattctgtcactcaggctagagtgcagtggcatgatcttggctcactgcaagctccacctcctgggttcaagcgattctcttgcctcagcctcctgagtagctgggactacatgcgcacaccaccacgtccggctaatttttgtatttttagtagagacagggtttcaccatgttggccaggctggtcttgaactcctgacctcgtgatccacccgccttagcctcccaaagtgctgggattacaggcgtgagccaccgtgcccggcccaggacttttaaaacaagcatcccaggggattccggtgcctaccagaagtcgcaagctgcttggctctggagggcgcctaggagtcggtgtcgcctaagatgggataatggcttcaggcaactcctagccttccccatatctcctgcctcagcccccctggcccagtgctggggcgtcagctaaacctgagcttccaagaagtcaggttgccaaaggaaggagccttctgagaccctccccaacccacccaggttcccaaggccctgccgtaccctggggaatcaaccaaggagttcttgttctcgaagaaccccaggcctcatgatggtctacggtagaggtccaacaactacagcctgtgggccacatctggccacagcctgatttgtaaataaagttttattggaacacagcaacacccattcctttctgcattgccttgtgctctggggctgcaggtgaagagtagctgccacaaaccacctggcccataaagctcaaaatagttgccatctggccctttacagacagctagctgactcctaatctagggcaaacgcaggtgcctaaaaaggaccagaaaggagaccagaatgaagggcaggggggtggcagggcctgtggcaactggagagtaggcgtcctgtgccacgggaatgttgccaggtccgtttttctagggaaagcagaaatctggatttttatgtggaatctcactgtaggggtggggaaatctcattttaaaaatgtaatcaggccaggcacagtggctcacacctgtaatcccagcgctttgggaggccaagataggaggatgagttgagcccatgagttggagaccagcctgggcaacatagtgagaccccatctctactaaaaagtattaaaaagtagcagggtgaccaggcatggtggctcacacctgtaatcccagcactttgggaggctgaggcaggcagatcacaaggtcaagagatcgagactatcctggcaaacatggtgaaaccctgtctctactaaaaataca

SEQ ID NO: 296423 - DNA, 2240 bp, Homo sapiens
cagagcaatgagccaacctcaacaggttctgaaacatgagtcatctactgctaccacaaactcccctccaggctgcccctgggacatggtggtgatgtgggtgcaggagccagtgtctgttgtcgggactcgcaagtgccctcatcacagccacccccaccacgagtgtctccccagtgcagactcaagttatgcttgaaatgaaaaagtctatctggtagtgggtaaacgtagacctggcactgttccacgcgggcgccccaagcctgccactcctgtgtccctgcctccctgggctcccgagataggcaccactgtatcctccagctccttccttccttcccccaggaacacggaggccaccgagggggctgggcctatcaggaggacacaggctgcagcctggcacccacccctcccatctccaccccacatggaagacttgtcttcaacttggccactgtctttgcagagctgggcacatgtgcccagggggcagaaaaaatggcttctcagttgttaaaagtataccctggaccacccatctgaccatctccttaaggtttcacccaaagcccccagtgtcagagacttgggatgggaagaacagtcggctcccagtgtggtcatgagcaagttttctgtggactgttccccccactgtggtaggacaggactggcccacttagtcctcaagctcccaacctgctgtccctcaagccccgcttctaccagcctgtggagttcaggaggcgagacatcctggcctcctttgagaactgatgggatctaccccctgtccacgcgggacagtttctcagaactggttcatagaccacctgtgtcaccaacagccagatacctaatccctgagcctcctttgggaaggtctggggccgagggtctgggaatttttttttttttttttttttgggacagagtctcattctgtcactcaggctagagtgcagtggcatgatcttggctcactgcaagctccacctcctgggttcaagcgattctcttgcctcagcctcctgagtagctgggactacatgcgcacaccaccacgtccggctaatttttgtatttttagtagagacagggtttcaccatgttggccaggctggtcttgaactcctgacctcgtgatccacccgccttagcctcccaaagtgctgggattacaggcgtgagccaccgtgcccggcccaggacttttaaaacaagcatcccaggggattccggtgcctaccagaagtcgcaagctgcttggctctggagggcgcctaggagtcggtgtcgcctaagatgggataatggcttcaggcaactcctagccttccccatatctcctgcctcagcccccctggcccagtgctggggcgtcagctaaacctgagcttccaagaagtcaggttgccaaaggaaggagccttctgagaccctccccaacccacccaggttcccaaggccctgccgtaccctggggaatcaaccaaggagttcttgttctcgaagaaccccaggcctcatgatggtctacggtagaggtccaacaactacagcctgtgggccacatctggccacagcctgatttgtaaataaagttttattggaacacagcaacacccattcctttctgcattgccttgtgctctggggctgcaggtgaagagtagctgccacaaaccacctggcccataaagctcaaaatagttgccatctggccctttacagacagctagctgactcctaatctagggcaaacgcaggtgcctaaaaaggaccagaaaggagaccagaatgaagggcaggggggtggcagggcctgtggcaactggagagtaggcgtcctgtgccacgggaatgttgccaggtccgtttttctagggaaagcagaaatctggatttttatgtggaatctcactgtaggggtggggaaatctcattttaaaaatgtaatcaggccaggcacagtggctcacacctgtaatcccagcgctttgggaggccaagataggaggatgagttgagcccatgagttggagaccagcctgggcaacatagtgagaccccatctctactaaaaagtattaaaaagtagcagggtgaccaggcatggtggctcacacctgtaatcccagcactttgggaggctgaggcaggcagatcacaaggtcaagagatcgagactatcctggcaaacatggtgaaaccctgtctctactaaaaataca

SEQ ID NO: 296424 - DNA, 1038 bp, Homo sapiens
atcaggggcacctggagtcgctgggcagccacgatcgggtctcgccggcgaggggcgcgacgtgacgcgcggagggtggcggtgggttgggggtgggagctttgctcgcagctgagccccgtttttccggtgctgcagtatccctgggactgagagctgaatacccacacccagggctgagaccttagcagaaaggaaactgaggctgggaggtcggccgggaggctgcctggcggaggcggcgctgctccgagtgggcggggctggttccggccccgccccgcccccgacctcttggctccgctagtgcccagcgcgccgccgccagtgctgcgggctccgggcaatggatgcccccggggccctggcccagaccgccgcccccggtccgggcaggaaggagctgaagatcgtgatcgtgggcgacggcggctgcggcaagacctcgctgctcatggtgtacagccagggctccttccccgagcactacgccccatcggtgttcgagaagtacacggccagcgtgaccgttggcagcaaggaggtgaccctgaacctctacgacacggccgggcaagaagactatgaccggctgcggcccctgtcctaccagaacacccacctcgtgctcatctgctatgacgtcatgaatcccaccagctacgacaacgtcctcatcaagtggttccctgaggtcacgcatttctgccgcgggatccccatggtgctcatcggctgcaagacagacctgaggaaggacaaggagcagctgcggaagctccgggccgcccagctggagcccatcacctacatgcaggtgggccggggccaagaccctggggcacagccgtggctgtgaagcctcccggacctttggcctctgcaactggggtgccttagtggcctttcagggagctgagggaagcaagattctaagaataatttttaactattagtattgatggcctgtggacctgagcactttacacgactactcccaatccttaggactcggaggcaggcgctgttcacatcccc

SEQ ID NO: 296425 - DNA, 1636 bp, Homo sapiens
caaattctgtcttcgtgcctttgcgttgtttcggccccacacgaggtctggttcaccccacaaaagtggtccttgcactcactccggttggtgtaaccacttgcaagggcttccccctccggtagacccttcggggcttcttctgtgcgtgatcccccaggggtattctctaacggccttcgttaattgaccagcccgggcgtgtctcttcctttgtgagagcgacaaaattctttcccgttctcggtatatttttgggcggcgccccttttgtagaccgccgttcataggccggatatagagatgtcgctgggttcccacagggggtcccacagggtgttgcccgcgctttgttgcttgtgcacccacttgggattatttcacccccccccggatgatttaggtttctgaaagaaattgttggcgcgattcctgccaatatttcttgggggaaccacacccctttttggcccacattacaatttatcccaaagggtttttttcctcaggagaaatggtgtagttcttcaacatcttgctgaagaagatgtttctatctgcccctttggggcgctgtcccaagggttcaaaaccccttgggtgtccacatgtttggccacggcaatcccaccaatcccgttgtgttcaagaaaggtcaccccaagtttccaatggttcgtcctgccatcgcagctggcgcccttcgttgaattcaatcccttcaaaaatgttggtttttgagaggtcccttcccaaccaagggcccgcaagtgttttttcaagcttcccgaagtttccaggccgcgccctcctttcccgaccgaatggctgtccaagctgccccccctgagagggttgttaatcttctctgttctgaaacaaccggcgtccaccaggttttttgcccttaccaaggtgttggggcccctggtcctcccaacagccggggccacttgggggcccaaaccctggttccccccccttttttttttttttttttttaaagttttattggaacacagcaacacccattcctttctgcattgccttgtgctctggggctgcaggtgaagagtagctgccacaaaccacctggcccataaagctcaaaatagttgccatctggccctttacagacagctagctgactcctaatctagggcaaacgcaggtgcctaaaaaggaccagaaaggagaccagaatgaagggcaggggggtggcagggcctgtggcaactggagagtaggcgtcctgtgccacgggaatgttgccaggtccgtttttctagggaaagcagaaatctggatttttatgtggaatctcactgtaggggtggggaaatctcattttaaaaatgtaatcaggccaggcacagtggctcacacctgtaatcccagcgctttgggaggccaagataggaggatgagttgagcccatgagttggagaccagcctgggcaacatagtgagaccccatctctactaaaaagtattaaaaagtagcagggtgaccaggcatggtggctcacacctgtaatcccagcactttgggaggctgaggcaggcagatcacaaggtcaagagatcgagactatcctggcaaacatggtgaaaccctgtctctactaaaaataca

SEQ ID NO: 296426 - DNA, 700 bp, Homo sapiens
ccaggcgcacttctgcacccaggcgcacttctgcacccaggcgcacttctgcacccaggcgcacttctgcacccaggcgcacttctgcacccaggcgcacttctgcattgccttgtgctctggggctgcaggtgaagagtagctgccacaaaccacctggcccataaagctcaaaatagttgccatctggccctttacagacagctagctgactcctaatctagggcaaacgcaggtgcctaaaaaggaccagaaaggagaccagaatgaagggcaggggggtggcagggcctgtggcaactggagagtaggcgtcctgtgccacgggaatgttgccaggtccgtttttctagggaaagcagaaatctggatttttatgtggaatctcactgtaggggtggggaaatctcattttaaaaatgtaatcaggccaggcacagtggctcacacctgtaatcccagcgctttgggaggccaagataggaggatgagttgagcccatgagttggagaccagcctgggcaacatagtgagaccccatctctactaaaaagtattaaaaagtagcagggtgaccaggcatggtggctcacacctgtaatcccagcactttgggaggctgaggcaggcagatcacaaggtcaagagatcgagactatcctggcaaacatggtgaaaccctgtctctactaaaaataca

SEQ ID NO: 296427 - DNA, 475 bp, Homo sapiens
gaatcccaccagctacgacaacgtcctcatcaaggtgaggccggcctcctgggtggtggccccacatctgggcccggccgcacccctgatcccgcctcctccctccacagtggttccctgaggtcacgcatttctgccgcgggatccccatggtgctcatcggctgcaagacagacctgaggaaggacaaggagcagctgcggaagctccgggccgcccagctggagcccatcacctacatgcaggtgggccggggccaagaccctggggcacagccgtggctgtgaagcctcccggacctttggcctctgcaactggggtgccttagtggcctttcagggagctgagggaagcaagattctaagaataatttttaactattagtattgatggcctgtggacctgagcactttacacgactactcccaatccttaggactcggaggcaggcgctgttcacatcccccagtttaca

SEQ ID NO: 296428 - DNA, 439 bp, Homo sapiens
gcggccgcgggcggctctgaggagcccggagggaaccggcgacgaggggaccatgtaccgggacccggaggcggccagcccaggggcgccctcgcgcgacgtcctgctggtctctgccatcatcaccgtcagccttagcgtcactgtcgtcctctgcggcctctgccactggtgtcagcgcaaactgggcaaacgctacaagaattccttggagacggtgggcacgccagactcagggcgtgggcgcagtgagaagaaggctatcaatgatctagacagagacttttggaataacaatgagagcacagtgcagcagaaatggagctcctaccctcccaaggagtttattctaaacatttcaccctacgccccttatggcgacccacgactgtccctcaatggcaccctcctgtcgggcgccaaagtggccgccgcggcg

SEQ ID NO: 296429 - DNA, 4576 bp, Homo sapiens
gcggccgcgggcggctctgaggagcccggagggaaccggcgacgaggggaccatgtaccgggacccggaggcggccagcccaggggcgccctcgcgcgacgtcctgctggtctctgccatcatcaccgtcagccttagcgtcactgtcgtcctctgcggcctctgccactggtgtcagcgcaaactgggcaaacgctacaagaattccttggagacggtgggcacgccagactcagggcgtgggcgcagtgagaagaaggctatcaagttgcctgcaggagggaaggcggtgaacacagcccccgtgccaggccagacaccccacgatgagtccgaccgccggaccgagccacgttcctccgtctcagacctcgtcaactccctcaccagcgagatgctcatgctctccccaggctccgaggaggatgaggcccacgagggttgcagccgagagaacctgggccggatccagttcagtgtcggctacaacttccaggagtccacgctcaccgtgaagatcatgaaggcccaggagctgccggccaaggacttcagcggcaccagcgaccccttcgtcaaagatctacctgctgcccgacaagaagcacaagctggagaccaaggtgaagcggaagaacctgaacccccactggaacgagaccttcctctttgaaggttttccctatgagaaggtggtgcagaggatcctctacctccaagtcctggactatgaccgcttcagccgcaacgaccccattggggaggtgtccatcccccttaacaaggtggacctgacccagatgcagaccttctggaaggatctgaagccatgcagcgatgggagtgggagccgaggggagctgctcttgtctctctgctacaacccctctgccaactccatcatcgtgaacatcatcaaagcccggaacctcaaagccatggacatcgggggcacatcagacccctacgtgaaggtatggctgatgtacaaggacaagcgggtggagaagaagaagacggtgacgatgaagaggaacctgaaccccatcttcaatgagtccttcgccttcgatatccccacggagaagctgagggagacgaccatcatcatcactgtcatggacaaggacaagctcagccgcaatgacgtcatcggcaagatctacctgtcctggaagagcgggccaggggaggtgaagcactggaaggacatgattgcccgtccccggcagcccgtggcccagtggcaccagctgaaggcctgagtggggccaagggaggcccagggggccgagggcccaggtccccatcatgccctcaccactttatgcacaacgcccggcctgagccccctgccatagggaggggaggaccctgagggctcagccagggaggggtcccaggactcaactgggccccgtttctaggaagtaccagccccatcccccacagtccagctccggggaaggggctctgggaggcattttcctgctttgccccttttcttcctgacttactaatactaaagaagttgggggagctcgagagccagacggccagacaggcagacccctccagaggcccgccaggtgggcatggtcccccattttctttaaggcagcacctggagtggagagaggccactccctctccagcccccgatgtggacccggggaggggaggctgaggcgtttggccccggcctggccaggagaggcccatccccagggcagtttcaggtgccggctgggccctgaatgtcgaggatagtatatagcccgctcctgggtcctggagctgtggccctttgtactcgtgttgtgtccattgtgtgtgtgcgtggggacagaggcctggaaatgcggaggactatacagagaaggcaggttttgtgaaggccaggcagggttggaggccgggggtgtgagaggagaggcccatagggctgagtggggtcgggtgaggcagaggtcagaaacagaagagctgcagttgctggagctgggctgagaactgggctgcctcctgccatccccccgtctcctccccttctccccttggtgcccccctctgctcagaatctgaagtagttccctcctcagcaatttcatctcttgaacactgactcacaccttttaggcacctactgtgtgcatagcattccaccaggactcatctcccttccttctcagggggtcccgagccccgactagctttgccctaactccttcatcaaaagaccccccgccagcttcccacacctcatacgcagccacatctgccctattctccatgctttccagcttgcctgcccttcctcatctctccctgcctgtgcagacctccacccttctttcctccacccctccatcccccaatgcttgtagaccttccattcattccgtctcatcgtgcgtggtctctgatcgtccatcacctgaccttctccaggactgtcttctcacccttccccactccctggtccccgggagcagctccttctgcccgactcactcacagtgcagggaaaggaggcagggaaaagaccaggattctgtgagttctgaggttgccacacacaaagaagctgtggtttctctgcctcggccactgatgagactaaaactggcttccccttggagacggcagatttcaggctgatccctgcttaagccctctcatccccacgctggtcctggtattgatacaagacccagctggtgacaaagcctccaatcctgggggtccacgagcctgggcctgacattcccagaactaccgccagtggcgccaggcccccacagtctgtggccgtggtcttagcccccagttccactctggatgggcctgtgacaccccaaagagaagaaggggactctggatagggtccccacatccagggcgtggggagaccattggcatttgggaaccattttccttcgaacggcttccccttgagctgagcattctgcttgctgcagtagacgggtcgccttttgcccataccgaaattttctgaaattaaatcgcacacccccaccatttcctctccctgggatctggaggaacatcatacatagtaggtgaatcgttttgtagagtgaagaatgctaatgtaaagcaaatagtcacccacgttccttgtaaatccaaatgtttctatattgtagctttgcttaaaatggggtcggccccaactgcatcctcctctttggcgggctggggagcggcccccagccgggacgggagggcagcgaccccgaggcctcgtggacgtgggagagagtgtggtgggaagtcttgagcggaggaggggatctgcccttctccactcctctcttggatccgcctcggtttcctgtccccccaccacccgcctgccccgcggaagaccgcccagtgagccagcccccaccttccaggcgccttcgccctggggatccaaccaacttgtatcgagtgggcggggcaacggctccccatttttcccgagccccgcccacagagctcttagccaatcctatgcagagagcatctcctggcaggggtctcttcccaaccagaccccacccaggcacattagcgaccaggcttgggcttccccagcgccccaccaccaccacgtgcaggtggagctctgggatgctatgttggggcggcaagcggtgggccgagggccgggtaggctagcacgggaggtaagggtggtatgggatggggcgggggcggtctagggcaataggagagcagagaatgggggaacttgagggtggggggagggcaccggagccttgccaccatcccaggactttgggcaagtcacccgcactccctgggcctcggtttccccatctgtaaaatgatggtaataatacttcacctacctcataggggaggttgtgaggccaccatcacctgacctgggggtcaaggcaggaggactccgaaggtgctacccgtgagcaaagtgtaattaccgaatcctgactgcaaggcccacctgcccctcccccacagagcctccagagctagctgaggccaacgcaggcccatccgtctcttcactctgtcgcaggccctttcatgggcttcgtctgccatctttgtgggtgccctagacttagtccttatcttgtcctggtttcctttcttgtgaccatctccccatgaaagtgctgtacaaattccacccgccccaggacccccgcacctgccctctggcaccagatgccagggaagggacagaggaaaacagccacaaacaagccaggggggctccccggagccccaggggtggggattggtggccactgtttgtatgttcttgagtgcaagtgttttataaaaaataaaacaaaaacccaccatcacaaaaaaaaaaattttgcagcgaagagaaatgaagaaaaactgaagaaaaaaaaaaaacaggaaaaaaagaaccatacaaaatttttccaccacacataccctctaagccagcaagatttcctctttgcaaaatcatatttttgtgggaatgggccctgctttttgtggcaaggcctgttctgattaataaaggatcgtgaaaaag

SEQ ID NO: 296430 - DNA, 4763 bp, Homo sapiens
gcggccgcgggcggctctgaggagcccggagggaaccggcgacgaggggaccatgtaccgggacccggaggcggccagcccaggggcgccctcgcgcgacgtcctgctggtctctgccatcatcaccgtcagccttagcgtcactgtcgtcctctgcggcctctgccactggtgtcagcgcaaactgggcaaacgctacaagaattccttggagacggtgggcacgccagactcagggcgtgggcgcagtgagaagaaggctatcaagttgcctgcaggagggaaggcggtgaacacagcccccgtgccaggccagacaccccacgatgagtccgaccgccggaccgagccacgttcctccgtctcagacctcgtcaactccctcaccagcgagatgctcatgctctccccaggctccgaggaggatgaggcccacgagggttgcagccgagagaacctgggccggatccagttcagtgtcggctacaacttccaggagtccacgctcaccgtgaagatcatgaaggcccaggagctgccggccaaggacttcagcggcaccagcgaccccttcgtcaaagatctacctgctgcccgacaagaagcacaagctggagaccaaggtgaagcggaagaacctgaacccccactggaacgagaccttcctctttgaaggttttccctatgagaaggtggtgcagaggatcctctacctccaagtcctggactatgaccgcttcagccgcaacgaccccattggggaggtgtccatcccccttaacaaggtggacctgacccagatgcagaccttctggaaggatctgaagccatgcagcgatgggagtgggagccgaggggagctgctcttgtctctctgctacaacccctctgccaactccatcatcgtgaacatcatcaaagcccggaacctcaaagccatggacatcgggggcacatcagacccctacgtgaaggtatggctgatgtacaaggacaagcgggtggagaagaagaagacggtgacgatgaagaggaacctgaaccccatcttcaatgagtccttcgccttcgatatccccacggagaagctgagggagacgaccatcatcatcactgtcatggacaaggacaagctcagccgcaatgacgtcatcggcaagatctacctgtcctggaagagcgggccaggggaggtgaagcactggaaggacatgattgcccgtccccggcagcccgtggcccagtggcaccagctgaaggcctgagtggggccaagggaggcccagggggccgagggcccaggtccccatcatgccctcaccactttatgcacaacgcccggcctgagccccctgccatagggaggggaggaccctgagggctcagccagggaggggtcccaggactcaactgggccccgtttctaggaagtaccagccccatcccccacagtccagctccggggaaggggctctgggaggcattttcctgctttgccccttttcttcctgacttactaatactaaagaagttgggggagctcgagagccagacggccagacaggcagacccctccagaggcccgccaggtgggcatggtcccccattttctttaaggcagcacctggagtggagagaggccactccctctccagcccccgatgtggacccggggaggggaggctgaggcgtttggccccggcctggccaggagaggcccatccccagggcagtttcaggtgccggctgggccctgaatgtcgaggatagtatatagcccgctcctgggtcctggagctgtggccctttgtactcgtgttgtgtccattgtgtgtgtgcgtggggacagaggcctggaaatgcggaggactatacagagaaggcaggttttgtgaaggccaggcagggttggaggccgggggtgtgagaggagaggcccatagggctgagtggggtcgggtgaggcagaggtcagaaacagaagagctgcagttgctggagctgggctgagaactgggctgcctcctgccatccccccgtctcctccccttctccccttggtgcccccctctgctcagaatctgaagtagttccctcctcagcaatttcatctcttgaacactgactcacaccttttaggcacctactgtgtgcatagcattccaccaggactcatctcccttccttctcagggggtcccgagccccgactagctttgccctaactccttcatcaaaagaccccccgccagcttcccacacctcatacgcagccacatctgccctattctccatgctttccagcttgcctgcccttcctcatctctccctgcctgtgcagacctccacccttctttcctccacccctccatcccccaatgcttgtagaccttccattcattccgtctcatcgtgcgtggtctctgatcgtccatcacctgaccttctccaggactgtcttctcacccttccccactccctggtccccgggagcagctccttctgcccgactcactcacagtgcagggaaaggaggcagggaaaagaccaggattctgtgagttctgaggttgccacacacaaagaagctgtggtttctctgcctcggccactgatgagactaaaactggcttccccttggagacggcagatttcaggctgatccctgcttaagccctctcatccccacgctggtcctggtattgatacaagacccagctggtgacaaagcctccaatcctgggggtccacgagcctgggcctgacattcccagaactaccgccagtggcgccaggcccccacagtctgtggccgtggtcttagcccccagttccactctggatgggcctgtgacaccccaaagagaagaaggggactctggatagggtccccacatccagggcgtggggagaccattggcatttgggaaccattttccttcgaacggcttccccttgagctgagcattctgcttgctgcagtagacgggtcgccttttgcccataccgaaattttctgaaattaaatcgcacacccccaccatttcctctccctgggatctggaggaacatcatacatagtaggtgaatcgttttgtagagtgaagaatgctaatgtaaagcaaatagtcacccacgttccttgtaaatccaaatgtttctatattgtagctttgcttaaaatggggtcggccccaactgcatcctcctctttggcgggctggggagcggcccccagccgggacgggagggcagcgaccccgaggcctcgtggacgtgggagagagtgtggtgggaagtcttgagcggaggaggggatctgcccttctccactcctctcttggatccgcctcggtttcctgtccccccaccacccgcctgccccgcggaagaccgcccagtgagccagcccccaccttccaggcgccttcgccctggggatccaaccaacttgtatcgagtgggcggggcaacggctccccatttttcccgagccccgcccacagagctcttagccaatcctatgcagagagcatctcctggcaggggtctcttcccaaccagaccccacccaggcacattagcgaccaggcttgggcttccccagcgccccaccaccaccacgtgcaggtggagctctgggatgctatgttggggcggcaagcggtgggccgagggccgggtaggctagcacgggaggtaagggtggtatgggatggggcgggggcggtctagggcaataggagagcagagaatgggggaacttgagggtggggggagggcaccggagccttgccaccatcccaggactttgggcaagtcacccgcactccctgggcctcggtttccccatctgtaaaatgatggtaataatacttcacctacctcataggggaggttgtgaggccaccatcacctgacctgggggtcaaggcaggaggactccgaaggtgctacccgtgagcaaagtgtaattaccgaatcctgactgcaaggcccacctgcccctcccccacagagcctccagagctagctgaggccaacgcaggcccatccgtctcttcactctgtcgcaggccctttcatgggcttcgtctgccatctttgtgggtgccctagacttagtccttatcttgtcctggtttcctttcttgtgaccatctccccatgaaagtgctgtacaaattccacccgccccaggacccccgcacctgccctctggcaccagatgccagggaagggacagaggaaaacagccacaaacaagccaggggggctccccggagccccaggggtggggattggtggccactgtttgtatgttcttgagtgcaagtgttttataaaaaataaaacaaaaacccaccatcacaaaaaaaaaaattttgcagcgaagagaaatgaagaaaaactgaagaaaaaaaaaaaacaggaaaaaaagaaccatacaaaatttttccaccacacataccctctaagccagcaagatttcctctttgcaaaatcatatttttgtgggaatgggccctgctttttgtggcaaggcctgttctgattaataaaggatcgtgaaaaagtagggccttggctgtttcctccgtgggtcccagccctccctcacctccctgggggcagaggcagtggggtgaaggggatgggggccccggggctgagcctcccctcagtgtgtcacctttgggatttgacttcactggtgaccaggcccttcccgagtgtccagccatcctcagatctctatagaat

SEQ ID NO: 296431 - DNA, 4440 bp, Homo sapiens
gcggccgcgggcggctctgaggagcccggagggaaccggcgacgaggggaccatgtaccgggacccggaggcggccagcccaggggcgccctcgcgcgacgtcctgctggtctctgccatcatcaccgtcagccttagcgtcactgtcgtcctctgcggcctctgccactggtgtcagcgcaaactgggcaaacgctacaagaattccttggagacggtgggcacgccagactcagggcgtgggcgcagtgagaagaaggctatcaagttgcctgcaggagggaaggcggtgaacacagcccccgtgccaggccagacaccccacgatgagtccgaccgccggaccgagccacgttcctccgtctcagacctcgtcaactccctcaccagcgagatgctcatgctctccccaggctccgaggaggatgaggcccacgagggttgcagccgagagaacctgggccggatccagttcagtgtcggctacaacttccaggagtccacgctcaccgtgaagatcatgaaggcccaggagctgccggccaaggacttcagcggcaccagcgaccccttcgtcaaagatctacctgctgcccgacaagaagcacaagctggagaccaaggtgaagcggaagaacctgaacccccactggaacgagaccttcctctttgaaggttttccctatgagaaggtggtgcagaggatcctctacctccaagtcctggactatgaccgcttcagccgcaacgaccccattggggaggtgtccatcccccttaacaaggtggacctgacccagatgcagaccttctggaaggatctgaagccatgcagcgatgggagtgggagccgaggggagctgctcttgtctctctgctacaacccctctgccaactccatcatcgtgaacatcatcaaagcccggaacctcaaagccatggacatcgggggcacatcagacccctacgtgaaggtatggctgatgtacaaggacaagcgggtggagaagaagaagacggtgacgatgaagaggaacctgaaccccatcttcaatgagtccttcgccttcgatatccccacggagaagctgagggagacgaccatcatcatcactgtcatggacaaggacaagctcagccgcaatgacgtcatcggcaagatctacctgtcctggaagagcgggccaggggaggtgaagcactggaaggacatgattgcccgtccccggcagcccgtggcccagtggcaccagctgaaggcctgagtggggccaagggaggcccagggggccgagggcccaggtccccatcatgccctcaccactttatgcacaacgcccggcctgagccccctgccatagggaggggaggaccctgagggctcagccagggaggggtcccaggactcaactgggccccgtttctaggaagtaccagccccatcccccacagtccagctccggggaaggggctctgggaggcattttcctgctttgccccttttcttcctgacttactaatactaaagaagttgggggagctcgagagccagacggccagacaggcagacccctccagaggcccgccaggtgggcatggtcccccattttctttaaggcagcacctggagtggagagaggccactccctctccagcccccgatgtggacccggggaggggaggctgaggcgtttggccccggcctggccaggagaggcccatccccagggcagtttcaggtgccggctgggccctgaatgtcgaggatagtatatagcccgctcctgggtcctggagctgtggccctttgtactcgtgttgtgtccattgtgtgtgtgcgtggggacagaggcctggaaatgcggaggactatacagagaaggcaggttttgtgaaggccaggcagggttggaggccgggggtgtgagaggagaggcccatagggctgagtggggtcgggtgaggcagaggtcagaaacagaagagctgcagttgctggagctgggctgagaactgggctgcctcctgccatccccccgtctcctccccttctccccttggtgcccccctctgctcagaatctgaagtagttccctcctcagcaatttcatctcttgaacactgactcacaccttttaggcacctactgtgtgcatagcattccaccaggactcatctcccttccttctcagggggtcccgagccccgactagctttgccctaactccttcatcaaaagaccccccgccagcttcccacacctcatacgcagccacatctgccctattctccatgctttccagcttgcctgcccttcctcatctctccctgcctgtgcagacctccacccttctttcctccacccctccatcccccaatgcttgtagaccttccattcattccgtctcatcgtgcgtggtctctgatcgtccatcacctgaccttctccaggactgtcttctcacccttccccactccctggtccccgggagcagctccttctgcccgactcactcacagtgcagggaaaggaggcagggaaaagaccaggattctgtgagttctgaggttgccacacacaaagaagctgtggtttctctgcctcggccactgatgagactaaaactggcttccccttggagacggcagatttcaggctgatccctgcttaagccctctcatccccacgctggtcctggtattgatacaagacccagctggtgacaaagcctccaatcctgggggtccacgagcctgggcctgacattcccagaactaccgccagtggcgccaggcccccacagtctgtggccgtggtcttagcccccagttccactctggatgggcctgtgacaccccaaagagaagaaggggactctggatagggtccccacatccagggcgtggggagaccattggcatttgggaaccattttccttcgaacggcttccccttgagctgagcattctgcttgctgcagtagacgggtcgccttttgcccataccgaaattttctgaaattaaatcgcacacccccaccatttcctctccctgggatctggaggaacatcatacatagtaggtgaatcgttttgtagagtgaagaatgctaatgtaaagcaaatagtcacccacgttccttgtaaatccaaatgtttctatattgtagctttgcttaaaatggggtcggccccaactgcatcctcctctttggcgggctggggagcggcccccagccgggacgggagggcagcgaccccgaggcctcgtggacgtgggagagagtgtggtgggaagtcttgagcggaggaggggatctgcccttctccactcctctcttggatccgcctcggtttcctgtccccccaccacccgcctgccccgcggaagaccgcccagtgagccagcccccaccttccaggcgccttcgccctggggatccaaccaacttgtatcgagtgggcggggcaacggctccccatttttcccgagccccgcccacagagctcttagccaatcctatgcagagagcatctcctggcaggggtctcttcccaaccagaccccacccaggcacattagcgaccaggcttgggcttccccagcgccccaccaccaccacgtgcaggtggagctctgggatgctatgttggggcggcaagcggtgggccgagggccgggtaggctagcacgggaggtaagggtggtatgggatggggcgggggcggtctagggcaataggagagcagagaatgggggaacttgagggtggggggagggcaccggagccttgccaccatcccaggactttgggcaagtcacccgcactccctgggcctcggtttccccatctgtaaaatgatggtaataatacttcacctacctcataggggaggttgtgaggccaccatcacctgacctgggggtcaaggcaggaggactccgaaggtgctacccgtgagcaaagtgtaattaccgaatcctgactgcaaggcccacctgcccctcccccacagagcctccagagctagctgaggccaacgcaggcccatccgtctcttcactctgtcgcaggcccctctggcaccagatgccagggaagggacagaggaaaacagccacaaacaagccaggggggctccccggagccccaggggtggggattggtggccactgtttgtatgttcttgagtgcaagtgttttataaaaaataaaacaaaaacccaccatcacaaaaaaaaaaattttgcagcgaagagaaatgaagaaaaactgaagaaaaaaaaaaaacaggaaaaaaagaaccatacaaaatttttccaccacacataccctctaagccagcaagatttcctctttgcaaaatcatatttttgtgggaatgggccctgctttttgtggcaaggcctgttctgattaataaaggatcgtgaaaaag

SEQ ID NO: 296432 - DNA, 4323 bp, Homo sapiens
tgattgagaagaagcgcttccggcggtcttagatcactaatcaacaaaccagctttcggggtctgacgcgatccttgcctcaggcctctcgaggtccagacagccgcccagcccgctctgcgacgcagcagtgaatagtgtggtacctccttgtctcggttcaggtccagacctccccgtcttccggctgccctgaacgtcaggcgacctcaggaccctgtgattggcgcctgcgccggcggaccgtgaccgaggaaacccctggagggacttgggcattccttgggctccgtgcctgttcttcgtgctcctttcgggcaaggatctcacattatcagtctttgaccgacacagaatgcctggcatttgataaatgtttgttgaacttgaagagacatatggacaatgaatctgcaaagatactggggagagataccaatatcatcaagccagaccaacagaagttccttcgatttgctcccacgggagttccgtctggtggaagtccatgacccacccctgcaccaaccctcagccaacaagccgaagccccccactatgctggacatcccctcagagccatgtagtctcaccatccatacgattcagttgattcagcacaaccgacgtcttcgcaaccttattgccacagctcaggcccagaatcagcagcagacagaaggtgtaaaaactgaagagagtgaacctcttccctcgtgccctgggtcacctcctctccctgatgacctcctgcctttagattgtaagaatcccaatgcaccattccagatccggcacagtgacccagagagtgacttttatcgtgggaaaggggaacctgtgactgaactcagctggcactcctgtcggcagctcctctaccaggcagtggccacaatcctggcccacgcgggctttgactgtgctaatgagagtgtcctggagaccctaactgatgtggcacatgagtattgccttaagtttaccaagttgctgcgttttgctgtggaccgggaggcccggctgggacagactccttttcctgatgtgatggagcaggtattccatgaagtgggtattggcagtgtgctctccctccagaagttctggcagcaccgcatcaaggactatcacagttacatgctacagattagtaagcaactctctgaagaatatgaaaggattgtcaatcctgagaaggccacagaggacgctaaacctgtgaagatcaaggaggaacctgtgagcgacatcacttttcctgtcagtgaggagctggaggctgaccttgcttctggagaccagtcactgcctatgggagtgcttggggctcagagcgaacgcttcccatctaacctggaggttgaagcttcaccacaggcttcaagtgcagaggtaaatgcttctcctctttggaatctggcccatgtgaaaatggagcctcaagaaagtgaagaaggcaatgtctctgggcatggtgtgctgggcagtgatgtcttcgaggagcctatgtcaggcatgagtgaagctgggattcctcagagccctgatgactcagatagcagctatggttcccactccactgacagcctcatggggtcctcccctgttttcaaccagcgctgcaagaagaggatgaggaaaatataaaaggaaaagagggagatgttttgtccagacctactagacccaacagaaaaggtttttgtattagaatctgtttccttaaaaattgatttgactcctgttcttaaacacaagtggtttttcctaattccagaggaactggacgtcaccaaacaaggttgcattttacttttgcatccagtttttatagttttccacaaccaagccacccttcacagataaaatatgatgctggcatggcaatcagaccaaagcactgtccccaattgttgtcttaactatgactagacatgttatacagccatttatcttgtacaactgagaagaatcatactttgacctaccttgtagagatgtgaggatttagatgtttgctaacttcaaaactgtgcttgaatagactaataatatatgctcatatcagatgtcagttttcatttaacttgattcatttttggctcaggtcattgggaacccattactaatacctaacaggaaatagctaaacacaacacaccttatctattagtcaccttcttaaaactgtttttgctacttttgaagtgtcttatttataagatcagaggtctgacaccttttttgcttagacagctctctatctcatccatttattttcttctctagacttactccatctctcctcatccttttgcctttgttatttctgctcggactcacatactttcaccatatacatattttcaattgtttctttccttttctcctttgtgagcaaagcaaacaagtactgtccaaggacagccttgtgcatatttcatttgttgcatttgcttggtcatcagaggacagcagtccattaagcacactttgctgcttctactgtaaaggcagcctttaaaacatagcaatatgcacctttcaactttacatcatgtcctgaacaacatcactgtggttactcatccatcagactatctgtatatataagtactgaatcagtatttattaagtaaatgatgtagcactgtagtgattaggaatcattagcaaatgtgttgcttcatgccttggtgatggatgccagcatgttaaactgctgaagtttgattttctgatgcaaaatatatcttgtaaaatttagaccactcctttaatgcagaccaaaataaggcacagctttaattcattattgaatgccttaaatgtcccaggtattgagaataaatgaatatgatacaaatgaggttatagtttaacatataattttaaatttgccaattgtaactctttagcacatttctctaaaccctttctgtcacagtctttttttaaatttatttatttatttatttatttttgagatggagtcttgctctgtcacccaggctggagtgcaatggtgcaatttcgactcactgcaacctctgcctcccaggttcgggcgattctcctgcctcagccacctgagtagctgggattacacgcacatgccaccacacccagctaatttttgcatttttagtagagatgaggtttcaccgtgttggccaggctggtctcaaaactcctgacctcaagtgatctgcccgcctcgggctcccaaagtgctgggattacaggcgtgagccactgcacctggcctctgttgcagtcttatcttcattttcctttgtttataatgaaagtggcgattaggcagttagtttccataaagtggccgtatgggaatttagttcattcatccagcaaacattgagtaccaattatttgctaggtcctgtgcaaggaatacaaaaatgattaagacttcttccttacccttttggagcttgaagcataaggaagacaagttattctgtaaggaagataaagcattcaaaagtactacagagaaaaaccaagtatgcttgagttttgcgaatgttctcctcttaaagaatagcttcaaattttgagaccagtggttcccactaagtatagaacattaaaattaatactttataataaaacacttttattgctgcagaatgttaaactgcataacaggcaccagatggtcaagacgagggaaatatgagaaggcaaatgatgtgaggattagtatcttgagattcacctggtctggaattatgtcataggctactatgcatcagaatcacatggagggctttctaaaacagactgctcagcccacccccagggtttctgagttcataggttataagaggtaagttgaacaattccccagatgatgctgatgctcctggtccacaatgtgagaaccactaagttggagtactgactcatagagataaaattctttgaaagaaatgtactgttttaagatactgtaaaatgtggaggcagggcaaacgtttataagggctgttatgtatgaaatgtgcctctgacccaaatccacggactttgcgaaaatcaccaaggagactttgcattaagttcagagtacaatacaaactgggcctagctctgtatttagtcagtatgtgcacgtgggaaactttagtaaaatatcacctccttattgagacaagtttggacatctggccttaagcctctgttgaacaggagaagtgaagctgtttgcaattatataattttctaatttgaaatcatgacaagcagtcttagaacaaagttaaaattaaaaagtctttatccaagtcaccaatg

SEQ ID NO: 296433 - DNA, 2072 bp, Homo sapiens
tgattgagaagaagcgcttccggcggtcttagatcactaatcaacaaaccagctttcggggtctgacgcgatccttgcctcaggcctctcgaggtccagacagccgcccagcccgctctgcgacgcagcagtgaatagtgtggtacctccttgtctcggttcaggtccagacctccccgtcttccggctgccctgaacgtcaggcgacctcaggaccctgtgattggcgcctgcgccggcggaccgtgaccgaggaaacccctggagggacttgggcattccttgggctccgtgcctgttcttcgtgctcctttcgggcaaggatctcacattatcagtctttgaccgacacagaatgcctggcatttgataaatgtttgttgaacttgaagagacatatggacaatgaatctgcaaagatactggggagagataccaatatcatcaagccagaccaacagaagttccttcgatttgctcccacgggagttccgtctggtggaagtccatgacccacccctgcaccaaccctcagccaacaagccgaagccccccactatgctggacatcccctcagagccatgtagtctcaccatccatacgattcagttgattcagcacaaccgacgtcttcgcaaccttattgccacagctcaggcccagaatcagcagcagacagaaggtgtaaaaactgaagagagtgaacctcttccctcgtgccctgggtcacctcctctccctgatgacctcctgcctttagattgtaagaatcccaatgcaccattccagatccggcacagtgacccagagagtgacttttatcgtgggaaaggggaacctgtgactgaactcagctggcactcctgtcggcagctcctctaccaggcagtggccacaatcctggcccacgcgggctttgactgtgctaatgagagtgtcctggagaccctaactgatgtggcacatgagtattgccttaagtttaccaagttgctgcgttttgctgtggaccgggaggcccggctgggacagactccttttcctgatgtgatggagcaggtattccatgaagtgggtattggcagtgtgctctccctccagaagttctggcagcaccgcatcaaggactatcacagttacatgctacagattagtaagcaactctctgaagaatatgaaaggattgtcaatcctgagaaggccacagaggacgctaaacctgtgaagatcaaggaggaacctgtgagcgacatcacttttcctgtcagtgaggagctggaggctgaccttgcttctggagaccagtcactgcctatgggagtgcttggggctcagagcgaacgcttcccatctaacctggaggttgaagcttcaccacaggcttcaagtgcagaggtaaatgcttctcctctttggaatctggcccatgtgaaaatggagcctcaagaaagtgaagaaggcaatgtctctgggcatggtgtgctgggcagtgatgtcttcgaggagcctatgtcaggcatgagtgaagctgggattcctcagagccctgatgactcagatagcagctatggttcccactccactgacagcctcatggggtcctcccctgttttcaaccagcgctgcaagaagaggatgaggaaaatataaaaggaaaagagggagatgttttgtccagacctactagacccaacagaaaaggtttttgtattagaatctgtttccttaaaaattgatttgactcctgttcttaaacacaagtggtttttcctaattccagaggaactggacgtcaccaaacaaggttgcattttacttttgcatccagtttttatagttttccacaaccaagccacccttcacagataaaatatgatgctggcatggcaatcagaccaaagcactgtccccaattgttgtcttaactatgactagacatgttatacagccatttatcttgtacaactgagaagaatcatactttgacctaccttgtagagatgtgaggatttagatgtttgctaacttcaaaactgtgcttgaatagactaataatatatgctcatatcaga

SEQ ID NO: 296434 - DNA, 2862 bp, Homo sapiens
tgattgagaagaagcgcttccggcggtcttagatcactaatcaacaaaccagctttcggggtctgacgcgatccttgcctcaggcctctcgaggtccagacagccgcccagcccgctctgcgacgcagcagtgaatagtgtggtacctccttgtctcggttcaggtccagacctccccgtcttccggctgccctgaacgtcaggcgacctcaggaccctgtgattggcgcctgcgccggcggaccgtgaccgaggaaacccctggagggacttgggcattccttgggctccgtgcctgttcttcgtgctcctttcgggcaaggatctcacattatcagtctttgaccgacacagaatgcctggcatttgataaatgtttgttgaacttgaagagacatatggacaatgaatctgcaaaggtgagttgaaaccagattgtgaattttgttgaatggtaagccaaggaattctgactttttccaataggcaatgggaagccatttgatttaagttttaaaaagagtaagtctagcagcagtgtagagaatagatgacatacaaagagagattggaggaagggataccaattagaaggcagcagaaatctctcacgttctatatgtcaaaagttgaaagcataatgccatttagattaatggttcataaatttttccaccaggatcatgcctaagacacacagagtaagaaccacttcttattatctttaaccctactagtttttctcctattgatccagcacagatgtatcaagataccttatcatgccttgcttattgttcaggattgagcgtgatggtagttctggtaatgagttagtgagtgagatgggaaatagggatactagagctccagatgctgttgtagctattggtccactaatgacccaaattctaccctgtggttcagtgtagtaggaattgtcatagtatgacaataaccagcatctaacagttacatttctcttaatttatttagggagaacacctttggtcctacagttttgctgacactgacatttttctaagtggtcacaaatagcctactttttacataaataactggctagacctcgtatttttcactacagaagcctataatctaaagttgccaggatttaaacacattacttttaggttattgtctacatttatcctgagacctcttctcttcttattccaaaatgttgagatactggggagagataccaatatcatcaagccagaccaacagaagttccttcgatttgctcccacgggagttccgtctggtggaagtccatgacccacccctgcaccaaccctcagccaacaagccgaagccccccactatgctggacatcccctcagagccatgtagtctcaccatccatacgattcagttgattcagcacaaccgacgtcttcgcaaccttattgccacagctcaggcccagaatcagcagcagacagaaggtgtaaaaactgaagagagtgaacctcttccctcgtgccctgggtcacctcctctccctgatgacctcctgcctttagattgtaagaatcccaatgcaccattccagatccggcacagtgacccagagagtgacttttatcgtgggaaaggggaacctgtgactgaactcagctggcactcctgtcggcagctcctctaccaggcagtggccacaatcctggcccacgcgggctttgactgtgctaatgagagtgtcctggagaccctaactgatgtggcacatgagtattgccttaagtttaccaagttgctgcgttttgctgtggaccgggaggcccggctgggacagactccttttcctgatgtgatggagcaggtattccatgaagtgggtattggcagtgtgctctccctccagaagttctggcagcaccgcatcaaggactatcacagttacatgctacagattagtaagcaactctctgaagaatatgaaaggattgtcaatcctgagaaggccacagaggacgctaaacctgtgaagatcaaggaggaacctgtgagcgacatcacttttcctgtcagtgaggagctggaggctgaccttgcttctggagaccagtcactgcctatgggagtgcttggggctcagagcgaacgcttcccatctaacctggaggttgaagcttcaccacaggcttcaagtgcagaggtaaatgcttctcctctttggaatctggcccatgtgaaaatggagcctcaagaaagtgaagaaggcaatgtctctgggcatggtgtgctgggcagtgatgtcttcgaggagcctatgtcaggcatgagtgaagctgggattcctcagagccctgatgactcagatagcagctatggttcccactccactgacagcctcatggggtcctcccctgttttcaaccagcgctgcaagaagaggatgaggaaaatataaaaggaaaagagggagatgttttgtccagacctactagacccaacagaaaaggtttttgtattagaatctgtttccttaaaaattgatttgactcctgttcttaaacacaagtggtttttcctaattccagaggaactggacgtcaccaaacaaggttgcattttacttttgcatccagtttttatagttttccacaaccaagccacccttcacagataaaatatgatgctggcatggcaatcagaccaaagcactgtccccaattgttgtcttaactatgactagacatgttatacagccatttatcttgtacaactgagaagaatcatactttgacctaccttgtagagatgtgaggatttagatgtttgctaacttcaaaactgtgcttgaatagactaataatatatgctcatatcaga

SEQ ID NO: 296435 - DNA, 880 bp, Homo sapiens
tgattgagaagaagcgcttccggcggtcttagatcactaatcaacaaaccagctttcggggtctgacgcgatccttgcctcaggcctctcgaggtccagacagccgcccagcccgctctgcgacgcagcagtgaatagtgtggtacctccttgtctcggttcaggtccagacctccccgtcttccggctgccctgaacgtcaggcgacctcaggaccctgtgattggcgcctgcgccggcggaccgtgaccgaggaaacccctggagggacttgggcattccttgggctccgtgcctgttcttcgtgctcctttcgggcaaggatctcacattatcagtctttgaccgacacagaatgcctggcatttgataaatgtttgttgaacttgaagagacatatggacaatgaatctgcaaagatactggggagagataccaatatcatcaagccagaccaacagaagttccttcgatttgctcccacgggagttccgtctggtggaagtccatgacccacccctgcaccaaccctcagccaacaagccgaagccccccactatgctggacatcccctcagagccatgtagtctcaccatccatacgattcagttgattcagcacaaccgacgtcttcgcaaccttattgccacagctcaggcccagaatcagcagcagacagaaggtgtaaaaactgaagagagtgaacctcttccctcgtgccctgggtcacctcctctccctgatgacctcctgcctttagattgtaagaatcccaatgcaccattccagatccggcacagtgacccagagagtgacttttatcggtaaggcaaggctttgctgtatcttacttttctcaagtcatcttcccaacaaccct

SEQ ID NO: 296436 - DNA, 207 bp, Homo sapiens
  misc_feature (33)..(34): n is a, c, g, or t
  misc_feature (186)..(186): n is a, c, g, or t
  misc_feature (191)..(191): n is a, c, g, or t
  misc_feature (206)..(206): n is a, c, g, or t
attcctatgttcccttggctagccaaagaggcnntctgtcatttgtccaggagctgtagtgattaggaatcattagcaaatgtgttgcttcatgccttggtgatggatgccagcatgttaaactgctgaagtttgattttctgatgcaaaatatatcttgtaaaatttaaaaaaaaaaagaaaacnaacgnattcaagccgggacnc

SEQ ID NO: 296437 - DNA, 3463 bp, Homo sapiens
tgattgagaagaagcgcttccggcggtcttagatcactaatcaacaaaccagctttcggggtctgacgcgatccttgcctcaggcctctcgaggtccagacagccgcccagcccgctctgcgacgcagcagtgaatagtgtggtacctccttgtctcggttcaggtccagacctccccgtcttccggctgccctgaacgtcaggcgacctcaggaccctgtgattggcgcctgcgccggcggaccgtgaccgaggaaacccctggagggacttgggcattccttgggctccgtgcctgttcttcgtgctcctttcgggcaaggatctcacattatcagtctttgaccgacacagaatgcctggcatttgataaatgtttgttgaacttgaagagacatatggacaatgaatctgcaaagatactggggagagataccaatatcatcaagccagaccaacagaagttccttcgatttgctcccacgggagttccgtctggtggaagtccatgacccacccctgcaccaaccctcagccaacaagccgaagccccccactatgctggacatcccctcagagccatgtagtctcaccatccatacgattcagttgattcagcacaaccgacgtcttcgcaaccttattgccacagctcaggcccagaatcagcagcagacagaaggtgtaaaaactgaagagagtgaacctcttccctcgtgccctgggtcacctcctctccctgatgacctcctgcctttagattgtaagaatcccaatgcaccattccagatccggcacagtgacccagagagtgacttttatcgtgggaaaggggaacctgtgactgaactcagctggcactcctgtcggcagctcctctaccaggcagtggccacaatcctggcccacgcgggctttgactgtgctaatgagagtgtcctggagaccctaactgatgtggcacatgagtattgccttaagtttaccaagttgctgcgttttgctgtggaccgggaggcccggctgggacagactccttttcctgatgtgatggagcaggtattccatgaagtgggtattggcagtgtgctctccctccagaagttctggcagcaccgcatcaaggactatcacagttacatgctacagattagtaagcaactctctgaagaatatgaaaggattgtcaatcctgagaaggccacagaggacgctaaacctgtgaagatcaaggaggaacctgtgagcgacatcacttttcctgtcagtgaggagctggaggctgaccttgcttctggagaccagtcactgcctatgggagtgcttggggctcagagcgaacgcttcccatctaacctggaggttgaagcttcaccacaggcttcaagtgcagaggtaaatgcttctcctctttggaatctggcccatgtgaaaatggagcctcaagaaagtgaagaaggcaatgtctctgggcatggtgtgctgggcagtgatgtcttcgaggagcctatgtcaggcatgagtgaagctgggattcctcagagccctgatgactcagatagcagctatggttcccactccactgacagcctcatggggtcctcccctgttttcaaccagcgctgcaagaagaggatgaggaaaatataaaaggaaaagagggagatgttttgtccagacctactagacccaacagaaaaggtttttgtattagaatctgtttccttaaaaattgatttgactcctgttcttaaacacaagtggtttttcctaattccagaggaactggacgtcaccaaacaaggttgcattttacttttgcatccagtttttatagttttccacaaccaagccacccttcacagataaaatatgatgctggcatggcaatcagaccaaagcactgtccccaattgttgtcttaactatgactagacatgttatacagccatttatcttgtacaactgagaagaatcatactttgacctaccttgtagagatgtgaggatttagatgtttgctaacttcaaaactgtgcttgaatagactaataatatatgctcatatcagatgtcagttttcatttaacttgattcatttttggctcaggtcattgggaacccattactaatacctaacaggaaatagctaaacacaacacaccttatctattagtcaccttcttaaaactgtttttgctacttttgaagtgtcttatttataagatcagaggtctgacaccttttttgcttagacagctctctatctcatccatttattttcttctctagacttactccatctctcctcatccttttgcctttgttatttctgctcggactcacatactttcaccatatacatattttcaattgtttctttccttttctcctttgtgagcaaagcaaacaagtactgtccaaggacagccttgtgcatatttcatttgttgcatttgcttggtcatcagaggacagcagtccattaagcacactttgctgcttctactgtaaaggcagcctttaaaacatagcaatatgcacctttcaactttacatcatgtcctgaacaacatcactgtggttactcatccatcagactatctgtatatataagtactgaatcagtatttattaagtaaatgatgtagcactgtagtgattaggaatcattagcaaatgtgttgcttcatgccttggtgatggatgccagcatgttaaactgctgaagtttgattttctgatgcaaaatatatcttgtaaaatttagaccactcctttaatgcagaccaaaataaggcacagctttaattcattattgaatgccttaaatgtcccaggtattgagaataaatgaatatgatacaaatgaggttatagtttaacatataattttaaatttgccaattgtaactctttagcacatttctctaaaccctttctgtcacagtctttttttaaatttatttatttatttatttatttttgagatggagtcttgctctgtcacccaggctggagtgcaatggtgcaatttcgactcactgcaacctctgcctcccaggttcgggcgattctcctgcctcagccacctgagtagctgggattacacgcacatgccaccacacccagctaatttttgcatttttagtagagatgaggtttcaccgtgttggccaggctggtctcaaaactcctgacctcaagtgatctgcccgcctcgggctcccaaagtgctgggattacaggcgtgagccactgcacctggcctctgttgcagtcttatcttcattttcctttgtttataatgaaagtggcgattaggcagttagtttccataaagtggccgtatgggaatttagttcattcatccagcaaacattgagtaccaattatttgctaggtcctgtgcaaggaagaagtcttactcatttttgtattccttgcacaggacctgtcgagc

SEQ ID NO: 296438 - DNA, 2110 bp, Homo sapiens
  misc_feature (2082)..(2082): n is a, c, g, or t
  misc_feature (2085)..(2085): n is a, c, g, or t
tgattgagaagaagcgcttccggcggtcttagatcactaatcaacaaaccagctttcggggtctgacgcgatccttgcctcaggcctctcgaggtccagacagccgcccagcccgctctgcgacgcagcagtgaatagtgtggtacctccttgtctcggttcaggtccagacctccccgtcttccggctgccctgaacgtcaggcgacctcaggaccctgtgattggcgcctgcgccggcggaccgtgaccgaggaaacccctggagggacttgggcattccttgggctccgtgcctgttcttcgtgctcctttcgggcaaggatctcacattatcagtctttgaccgacacagaatgcctggcatttgataaatgtttgttgaacttgaagagacatatggacaatgaatctgcaaagatactggggagagataccaatatcatcaagccagaccaacagaagttccttcgatttgctcccacgggagttccgtctggtggaagtccatgacccacccctgcaccaaccctcagccaacaagccgaagccccccactatgctggacatcccctcagagccatgtagtctcaccatccatacgattcagttgattcagcacaaccgacgtcttcgcaaccttattgccacagctcaggcccagaatcagcagcagacagaaggtgtaaaaactgaagagagtgaacctcttccctcgtgccctgggtcacctcctctccctgatgacctcctgcctttagattgtaagaatcccaatgcaccattccagatccggcacagtgacccagagagtgacttttatcgtgggaaaggggaacctgtgactgaactcagctggcactcctgtcggcagctcctctaccaggcagtggccacaatcctggcccacgcgggctttgactgtgctaatgagagtgtcctggagaccctaactgatgtggcacatgagtattgccttaagtttaccaagttgctgcgttttgctgtggaccgggaggcccggctgggacagactccttttcctgatgtgatggagcaggtattccatgaagtgggtattggcagtgtgctctccctccagaagttctggcagcaccgcatcaaggactatcacagttacatgctacagattagtaagcaactctctgaagaatatgaaaggattgtcaatcctgagaaggccacagaggacgctaaacctgtgaagatcaaggaggaacctgtgagcgacatcacttttcctgtcagtgaggagctggaggctgaccttgcttctggagaccagtcactgcctatgggagtgcttggggctcagagcgaacgcttcccatctaacctggaggttgaagcttcaccacaggcttcaagtgcagaggtaaatgcttctcctctttggaatctggcccatgtgaaaatggagcctcaagaaagtgaagaaggcaatgtctctgggcatggtgtgctgggcagtgatgtcttcgaggagcctatgtcaggcatgagtgaagctgggattcctcagagccctgatgactcagatagcagctatggttcccactccactgacagcctcatggggtcctcccctgttttcaaccagcgctgcaagaagaggatgaggaaaatataaaaggaaaagagggagatgttttgtccagacctactagacccaacagaaaaggtttttgtattagaatctgtttccttaaaaattgatttgactcctgttcttaaacacaagtggtttttcctaattccagaggaactggacgtcaccaaacaaggttgcattttacttttgcatccagtttttatagttttccacaaccaagccacccttcacagataaaatatgatgctggcatggcaatcagaccaaagcactgtccccaattgttgtcttaactatgactagacatgttatacagccatttatcttgtacaactgagaagaatcatactttgacctaccttgtagagatgtgaggatttagatgtttgctaacttcaaaactgtgcttgaatagactaataatatatgctcatatcagaaaaaaaaaanaanaaagggcgccgctcgcgatctagaa

SEQ ID NO: 296439 - DNA, 2127 bp, Homo sapiens
tgattgagaagaagcgcttccggcggtcttagatcactaatcaacaaaccagctttcggggtctgacgcgatccttgcctcaggcctctcgaggtccagacagccgcccagcccgctctgcgacgcagcagtgaatagtgtggtacctccttgtctcggttcaggtccagacctccccgtcttccggctgccctgaacgtcaggcgacctcaggaccctgtgattggcgcctgcgccggcggaccgtgaccgaggaaacccctggagggacttgggcattccttgggctccgtgcctgttcttcgtgctcctttcgggcaaggatctcacattatcagtctttgaccgacacagaatgcctggcatttgataaatgtttgttgaacttgaagagacatatggacaatgaatctgcaaaggttattgtctacatttatcctgagacctcttctcttcttattccaaaatgttgagatactggggagagataccaatatcatcaagccagaccaacagaagttccttcgatttgctcccacgggagttccgtctggtggaagtccatgacccacccctgcaccaaccctcagccaacaagccgaagccccccactatgctggacatcccctcagagccatgtagtctcaccatccatacgattcagttgattcagcacaaccgacgtcttcgcaaccttattgccacagctcaggcccagaatcagcagcagacagaaggtgtaaaaactgaagagagtgaacctcttccctcgtgccctgggtcacctcctctccctgatgacctcctgcctttagattgtaagaatcccaatgcaccattccagatccggcacagtgacccagagagtgacttttatcgtgggaaaggggaacctgtgactgaactcagctggcactcctgtcggcagctcctctaccaggcagtggccacaatcctggcccacgcgggctttgactgtgctaatgagagtgtcctggagaccctaactgatgtggcacatgagtattgccttaagtttaccaagttgctgcgttttgctgtggaccgggaggcccggctgggacagactccttttcctgatgtgatggagcaggtattccatgaagtgggtattggcagtgtgctctccctccagaagttctggcagcaccgcatcaaggactatcacagttacatgctacagattagtaagcaactctctgaagaatatgaaaggattgtcaatcctgagaaggccacagaggacgctaaacctgtgaagatcaaggaggaacctgtgagcgacatcacttttcctgtcagtgaggagctggaggctgaccttgcttctggagaccagtcactgcctatgggagtgcttggggctcagagcgaacgcttcccatctaacctggaggttgaagcttcaccacaggcttcaagtgcagaggtaaatgcttctcctctttggaatctggcccatgtgaaaatggagcctcaagaaagtgaagaaggcaatgtctctgggcatggtgtgctgggcagtgatgtcttcgaggagcctatgtcaggcatgagtgaagctgggattcctcagagccctgatgactcagatagcagctatggttcccactccactgacagcctcatggggtcctcccctgttttcaaccagcgctgcaagaagaggatgaggaaaatataaaaggaaaagagggagatgttttgtccagacctactagacccaacagaaaaggtttttgtattagaatctgtttccttaaaaattgatttgactcctgttcttaaacacaagtggtttttcctaattccagaggaactggacgtcaccaaacaaggttgcattttacttttgcatccagtttttatagttttccacaaccaagccacccttcacagataaaatatgatgctggcatggcaatcagaccaaagcactgtccccaattgttgtcttaactatgactagacatgttatacagccatttatcttgtacaactgagaagaatcatactttgacctaccttgtagagatgtgaggatttagatgtttgctaacttcaaaactgtgcttgaatagactaataatatatgctcatatcaga

SEQ ID NO: 296440 - DNA, 2285 bp, Homo sapiens
tgattgagaagaagcgcttccggcggtcttagatcactaatcaacaaaccagctttcggggtctgacgcgatccttgcctcaggcctctcgaggtccagacagccgcccagcccgctctgcgacgcagcagtgaatagtgtggtacctccttgtctcggttcaggtccagacctccccgtcttccggctgccctgaacgtcaggcgacctcaggaccctgtgattggcgcctgcgccggcggaccgtgaccgaggaaacccctggagggacttgggcattccttgggctccgtgcctgttcttcgtgctcctttcgggcaaggatctcacattatcagtctttgaccgacacagaatgcctggcatttgataaatgtttgttgaacttgaagagacatatggacaatgaatctgcaaagggagaacacctttggtcctacagttttgctgacactgacatttttctaagtggtcacaaatagcctactttttacataaataactggctagacctcgtatttttcactacagaagcctataatctaaagttgccaggatttaaacacattacttttaggttattgtctacatttatcctgagacctcttctcttcttattccaaaatgttgagatactggggagagataccaatatcatcaagccagaccaacagaagttccttcgatttgctcccacgggagttccgtctggtggaagtccatgacccacccctgcaccaaccctcagccaacaagccgaagccccccactatgctggacatcccctcagagccatgtagtctcaccatccatacgattcagttgattcagcacaaccgacgtcttcgcaaccttattgccacagctcaggcccagaatcagcagcagacagaaggtgtaaaaactgaagagagtgaacctcttccctcgtgccctgggtcacctcctctccctgatgacctcctgcctttagattgtaagaatcccaatgcaccattccagatccggcacagtgacccagagagtgacttttatcgtgggaaaggggaacctgtgactgaactcagctggcactcctgtcggcagctcctctaccaggcagtggccacaatcctggcccacgcgggctttgactgtgctaatgagagtgtcctggagaccctaactgatgtggcacatgagtattgccttaagtttaccaagttgctgcgttttgctgtggaccgggaggcccggctgggacagactccttttcctgatgtgatggagcaggtattccatgaagtgggtattggcagtgtgctctccctccagaagttctggcagcaccgcatcaaggactatcacagttacatgctacagattagtaagcaactctctgaagaatatgaaaggattgtcaatcctgagaaggccacagaggacgctaaacctgtgaagatcaaggaggaacctgtgagcgacatcacttttcctgtcagtgaggagctggaggctgaccttgcttctggagaccagtcactgcctatgggagtgcttggggctcagagcgaacgcttcccatctaacctggaggttgaagcttcaccacaggcttcaagtgcagaggtaaatgcttctcctctttggaatctggcccatgtgaaaatggagcctcaagaaagtgaagaaggcaatgtctctgggcatggtgtgctgggcagtgatgtcttcgaggagcctatgtcaggcatgagtgaagctgggattcctcagagccctgatgactcagatagcagctatggttcccactccactgacagcctcatggggtcctcccctgttttcaaccagcgctgcaagaagaggatgaggaaaatataaaaggaaaagagggagatgttttgtccagacctactagacccaacagaaaaggtttttgtattagaatctgtttccttaaaaattgatttgactcctgttcttaaacacaagtggtttttcctaattccagaggaactggacgtcaccaaacaaggttgcattttacttttgcatccagtttttatagttttccacaaccaagccacccttcacagataaaatatgatgctggcatggcaatcagaccaaagcactgtccccaattgttgtcttaactatgactagacatgttatacagccatttatcttgtacaactgagaagaatcatactttgacctaccttgtagagatgtgaggatttagatgtttgctaacttcaaaactgtgcttgaatagactaataatatatgctcatatcaga

SEQ ID NO: 296441 - DNA, 1839 bp, Homo sapiens
tgattgagaagaagcgcttccggcggtcttagatcactaatcaacaaaccagctttcggggtctgacgcgatccttgcctcaggcctctcgaggtccagacagccgcccagcccgctctgcgacgcagcagtgaatagtgtggtacctccttgtctcggttcaggtccagacctccccgtcttccggctgccctgaacgtcaggcgacctcaggaccctgtgattggcgcctgcgccggcggaccgtgaccgaggaaacccctggagggacttgggcattccttgggctccgtgcctgttcttcgtgctcctttcgggcaaggatctcacattatcagtctttgaccgacacagaatgcctggcatttgataaatgtttgttgaacttgaagagacatatggacaatgaatctgcaaagctcaggcccagaatcagcagcagacagaaggtgtaaaaactgaagagagtgaacctcttccctcgtgccctgggtcacctcctctccctgatgacctcctgcctttagattgtaagaatcccaatgcaccattccagatccggcacagtgacccagagagtgacttttatcgtgggaaaggggaacctgtgactgaactcagctggcactcctgtcggcagctcctctaccaggcagtggccacaatcctggcccacgcgggctttgactgtgctaatgagagtgtcctggagaccctaactgatgtggcacatgagtattgccttaagtttaccaagttgctgcgttttgctgtggaccgggaggcccggctgggacagactccttttcctgatgtgatggagcaggtattccatgaagtgggtattggcagtgtgctctccctccagaagttctggcagcaccgcatcaaggactatcacagttacatgctacagattagtaagcaactctctgaagaatatgaaaggattgtcaatcctgagaaggccacagaggacgctaaacctgtgaagatcaaggaggaacctgtgagcgacatcacttttcctgtcagtgaggagctggaggctgaccttgcttctggagaccagtcactgcctatgggagtgcttggggctcagagcgaacgcttcccatctaacctggaggttgaagcttcaccacaggcttcaagtgcagaggtaaatgcttctcctctttggaatctggcccatgtgaaaatggagcctcaagaaagtgaagaaggcaatgtctctgggcatggtgtgctgggcagtgatgtcttcgaggagcctatgtcaggcatgagtgaagctgggattcctcagagccctgatgactcagatagcagctatggttcccactccactgacagcctcatggggtcctcccctgttttcaaccagcgctgcaagaagaggatgaggaaaatataaaaggaaaagagggagatgttttgtccagacctactagacccaacagaaaaggtttttgtattagaatctgtttccttaaaaattgatttgactcctgttcttaaacacaagtggtttttcctaattccagaggaactggacgtcaccaaacaaggttgcattttacttttgcatccagtttttatagttttccacaaccaagccacccttcacagataaaatatgatgctggcatggcaatcagaccaaagcactgtccccaattgttgtcttaactatgactagacatgttatacagccatttatcttgtacaactgagaagaatcatactttgacctaccttgtagagatgtgaggatttagatgtttgctaacttcaaaactgtgcttgaatagactaataatatatgctcatatcaga

SEQ ID NO: 296442 - DNA, 1332 bp, Homo sapiens
taagctagtacgaggctggtggtggtagaatcccaatgcaccattccagatccggcacagtgacccagagagtgacttttatcgtgggaaaggggaacctgtgactgaactcagctggcactcctgtcggcagctcctctaccaggcagtggccacaatcctggcccacgcgggctttgactgtgctaatgagagtgtcctggagaccctaactgatgtggcacatgagtattgccttaagtttaccaagttgctgcgttttgctgtggaccgggaggcccggctgggacagactccttttcctgatgtgatggagcaggtattccatgaagtgggtattggcagtgtgctctccctccagaagttctggcagcaccgcatcaaggactatcacagttacatgctacagattagtaagcaactctctgaagaatatgaaaggattgtcaatcctgagaaggccacagaggacgctaaacctgtgaagatcaaggaggaacctgtgagcgacatcacttttcctgtcagtgaggagctggaggctgaccttgcttctggagaccagtcactgcctatgggagtgcttggggctcagagcgaacgcttcccatctaacctggaggttgaagcttcaccacaggcttcaagtgcagaggtaaatgcttctcctctttggaatctggcccatgtgaaaatggagcctcaagaaagtgaagaaggcaatgtctctgggcatggtgtgctgggcagtgatgtcttcgaggagcctatgtcaggcatgagtgaagctgggattcctcagagccctgatgactcagatagcagctatggttcccactccactgacagcctcatggggtcctcccctgttttcaaccagcgctgcaagaagaggatgaggaaaatataaaaggaaaagagggagatgttttgtccagacctactagacccaacagaaaaggtttttgtattagaatctgtttccttaaaaattgatttgactcctgttcttaaacacaagtggtttttcctaattccagaggaactggacgtcaccaaacaaggttgcattttacttttgcatccagtttttatagttttccacaaccaagccacccttcacagataaaatatgatgctggcatggcaatcagaccaaagcactgtccccaattgttgtcttaactatgactagacatgttatacagccatttatcttgtacaactgagaagaatcatactttgacctaccttgtagagatgtgaggatttagatgtttgctaacttcaaaactgtgcttgaatagactaataatatatgctcatatcaga

SEQ ID NO: 296443 - DNA, 1707 bp, Homo sapiens
tgattgagaagaagcgcttccggcggtcttagatcactaatcaacaaaccagctttcggggtctgacgcgatccttgcctcaggcctctcgaggtccagacagccgcccagcccgctctgcgacgcagcagtgaatagtgtggtacctccttgtctcggttcaggtccagacctccccgtcttccggctgccctgaacgtcaggcgacctcaggaccctgtgattggcgcctgcgccggcggaccgtgaccgaggaaacccctggagggacttgggcattccttgggctccgtgcctgttcttcgtgctcctttcgggcaaggatctcacattatcagtctttgaccgacacagaatgcctggcatttgataaatgtttgttgaacttgaagagacatatggacaatgaatctgcaaagatactggggagagataccaatatcatcaagccagaccaacagaagttccttcgatttgctcccacgggagttccgtctggtggaagtccatgacccacccctgcaccaaccctcagccaacaagccgaagccccccactatgctggacatcccctcagagccatgtagtctcaccatccatacgattcagttgattcagcacaaccgacgtcttcgcaaccttattgccacagctcaggcccagaatcagcagcagacagaaggtgtaaaaactgaagagagtgaacctcttccctcgtgccctgggtcacctcctctccctgatgacctcctgcctttagattgtaagaatcccaatgcaccattccagatccggcacagtgacccagagagtgacttttatcgtgggaaaggggaacctgtgactgaactcagctggcactcctgtcggcagctcctctaccaggcagtggccacaatcctggcccacgcgggctttgactgtgctaatgagagtgtcctggagaccctaactgatgtggcacatgagtattgccttaagtttaccaagttgctgcgttttgctgtggaccgggaggcccggctgggacagactccttttcctgatgtgatggagcaggtattccatgaagtgggtattggcagtgtgctctccctccagaagttctggcagcaccgcatcaaggactatcacagttacatgctacagattagtaagcaactctctgaagaatatgaaaggattgtcaatcctgagaaggccacagaggacgctaaacctgtgaagatcaaggaggaacctgtgagcgacatcacttttcctgtcagtgaggagctggaggctgaccttgcttctggagaccagtcactgcctatgggagtgcttggggctcagagcgaacgcttcccatctaacctggaggttgaagcttcaccacaggcttcaagtgcagaggtaaatgcttctcctctttggaatctggcccatgtgaaaatggagcctcaagaaagtgaagaaggcaatgtctctgggcatggtgtgctgggcagtgatgtcttcgaggagcctatgtcaggcatgagtgaagctgggattcctcagagccctgatgactcagatagcagctatggttcccactccactgacagcctcatggggtcctcccctgttttcaaccagcgctgcagcctcgtcgccatgcctcggaaaatcgaggaaatcaaggacttcctgctcacagcccgacgaaaggatgccaaatctgtc

SEQ ID NO: 296444 - DNA, 2793 bp, Homo sapiens
agacccaacatctccctcttttccttttatattttcctcatcctcttcttgcagcgctggttgaaaacaggggaggaccccatgaggctgtcagtggagaagaggatgaggaaaatataaaaggaaaagagggagatgttttgtccagacctactagacccaacagaaaaggtttttgtattagaatctgtttccttaaaaattgatttgactcctgttcttaaacacaagtggtttttcctaattccagaggaactggacgtcaccaaacaaggttgcattttacttttgcatccagtttttatagttttccacaaccaagccacccttcacagataaaatatgatgctggcatggcaatcagaccaaagcactgtccccaattgttgtcttaactatgactagacatgttatacagccatttatcttgtacaactgagaagaatcatactttgacctaccttgtagagatgtgaggatttagatgtttgctaacttcaaaactgtgcttgaatagactaataatatatgctcatatcagatgtcagttttcatttaacttgattcatttttggctcaggtcattgggaacccattactaatacctaacaggaaatagctaaacacaacacaccttatctattagtcaccttcttaaaactgtttttgctacttttgaagtgtcttatttataagatcagaggtctgacaccttttttgcttagacagctctctatctcatccatttattttcttctctagacttactccatctctcctcatccttttgcctttgttatttctgctcggactcacatactttcaccatatacatattttcaattgtttctttccttttctcctttgtgagcaaagcaaacaagtactgtccaaggacagccttgtgcatatttcatttgttgcatttgcttggtcatcagaggacagcagtccattaagcacactttgctgcttctactgtaaaggcagcctttaaaacatagcaatatgcacctttcaactttacatcatgtcctgaacaacatcactgtggttactcatccatcagactatctgtatatataagtactgaatcagtatttattaagtaaatgatgtagcactgtagtgattaggaatcattagcaaatgtgttgcttcatgccttggtgatggatgccagcatgttaaactgctgaagtttgattttctgatgcaaaatatatcttgtaaaatttagaccactcctttaatgcagaccaaaataaggcacagctttaattcattattgaatgccttaaatgtcccaggtattgagaataaatgaatatgatacaaatgaggttatagtttaacatataattttaaatttgccaattgtaactctttagcacatttctctaaaccctttctgtcacagtctttttttaaatttatttatttatttatttatttttgagatggagtcttgctctgtcacccaggctggagtgcaatggtgcaatttcgactcactgcaacctctgcctcccaggttcgggcgattctcctgcctcagccacctgagtagctgggattacacgcacatgccaccacacccagctaatttttgcatttttagtagagatgaggtttcaccgtgttggccaggctggtctcaaaactcctgacctcaagtgatctgcccgcctcgggctcccaaagtgctgggattacaggcgtgagccactgcacctggcctctgttgcagtcttatcttcattttcctttgtttataatgaaagtggcgattaggcagttagtttccataaagtggccgtatgggaatttagttcattcatccagcaaacattgagtaccaattatttgctaggtcctgtgcaaggaatacaaaaatgattaagacttcttccttacccttttggagcttgaagcataaggaagacaagttattctgtaaggaagataaagcattcaaaagtactacagagaaaaaccaagtatgcttgagttttgcgaatgttctcctcttaaagaatagcttcaaattttgagaccagtggttcccactaagtatagaacattaaaattaatactttataataaaacacttttattgctgcagaatgttaaactgcataacaggcaccagatggtcaagacgagggaaatatgagaaggcaaatgatgtgaggattagtatcttgagattcacctggtctggaattatgtcataggctactatgcatcagaatcacatggagggctttctaaaacagactgctcagcccacccccagggtttctgagttcataggttataagaggtaagttgaacaattccccagatgatgctgatgctcctggtccacaatgtgagaaccactaagttggagtactgactcatagagataaaattctttgaaagaaatgtactgttttaagatactgtaaaatgtggaggcagggcaaacgtttataagggctgttatgtatgaaatgtgcctctgacccaaatccacggactttgcgaaaatcaccaaggagactttgcattaagttcagagtacaatacaaactgggcctagctctgtatttagtcagtatgtgcacgtgggaaactttagtaaaatatcacctccttattgagacaagtttggacatctggccttaagcctctgttgaacaggagaagtgaagctgtttgcaattatataattttctaatttgaaatcatgacaagcagtcttagaacaaagttaaaattaaaaagtctttatccaagtcaccaatg

SEQ ID NO: 296445 - DNA, 530 bp, Homo sapiens
agctttgttttgagaattaggacagtttattgtttgaccaacatgctgagtcttttccacattttacacagtttaatgtgaaatcaacatggcggctatgtcttctgagcccataacagatggaattgccaccctctgtgctcctcacagccaatcactttaaagggatgggtgaggggaaagtgaggggagaagtggacacacaccgcgagatgcaggctggccttcaatgctatggaggcttcccacctcctgaaggaaccatctaaacccctgctgcaaggatttcctgatgaaaccacacactgctgggagtgccaaccagacaggggtctggagtccaaggagtttgcacattgagatcccaaggttttggaacacctaaatagttcatgtcaaacaaaaattcaaagggtgtcctgatctgtgtgggtgcccatgacaatcaatcagagtagacttggggtacctgtgcccatctgtgtccaaggtaaaggtgaaagtcccccccccagaaattacccactcca

SEQ ID NO: 296446 - DNA, 605 bp, Homo sapiens
ctgcaggattcggcacgagcaaaagcttgttacaaacccttggagtcattcccagataatagaacttttaatgataaatcccctaatgccaagggtctagtgtgttcttagagggtatactgggaagagtgtggagatttaagtgctgctctgctgctctggatggctgcagcagacggacccaacgctgttgtcagtagtggtggcggttcttgcggtgctgctgacgctagtcttctggaagttaatccggagcagaaggagcagtcagagagctgttcttcttgttggcctttgtgattccgggaaaacgttgctctttgtcaggttgttaacaggcctttatagagacactcagacgtccattactgacagctgtgctgtatacagagtcaacaataacaggggcaatagtctgaccttgattgaccttcccggccatgagagtttgaggcttcagttcttagagcggtttaagtcttcagccagcttttgtttttgttgagaaacaaaccaagagaaacaagtttcttgtgaattctgaagggctattattggccccaaaaggccccaatctcccaataaagggggggccccgcccgccc

SEQ ID NO: 296447 - DNA, 276 bp, Homo sapiens
agctttgttttgagaattaggacagtttattgtttgaccaacatgctgagtcttttccacattttacacagtttaatgtgaaatcaacatggcggctatgtcttctgagcccataacagatggaattgccaccctctgtgctcctcacagccaatcactttaaagggatgggtgaggggaaagtgaggggagaagtggacacacaccctgggaagcagagttgccgccaaggtaatgggggttccccgccttctgcatgggccatctaaagcccca

SEQ ID NO: 296448 - DNA, 2927 bp, Homo sapiens
tgcttgagttcttcacaagtctcacgtcacttagcgacggtcgggaactcctcagtggtagtttcgggagccattcattcattttattcatttcatcattctttcaacagtcataacgtaggtgacgacgactgactcatctcttaaaagatgtgtgtgtccctcgacaaataacctgtctgcccctatcgttctgtaggaggacggagtcccagagaactacaactcccatcaagcacttgggggatcgccgcggctgagggagagactatggcttaggaaccaccattcgcgtgaggctctgctccccgcgcctgcgcagagtgcagggccacggtcgcttttgctgtaccggggaccacgcgtctcatccatggcttccgcggactcgcgccgggtggcagatggcggcggtgccgggggcaccttccagccctacctagacaccttgcggcaggagctgcagcagacggacccaacgctgttgtcagtagtggtggcggttcttgcggtgctgctgacgctagtcttctggaagttaatccggagcagaaggagcagtcagagagctgttcttcttgttggcctttgtgattccgggaaaacgttgctctttgtcaggttgttaacaggcctttatagagacactcagacgtccattactgacagctgtgctgtatacagagtcaacaataacaggggcaatagtctgaccttgattgaccttcccggccatgagagtttgaggcttcagttcttagagcggtttaagtcttcagccagggctattgtgttgttgtggatagtgcagcattccagcgagaggtgaaagatgtggctgagtttctgtatcaagtcctcattgacagtatgggtctgaagaatacaccatcattcttaatagcctgcaataagcaagatattgcaatggcaaaatcagcaaagttaattcaacagcagctggagaaagaactcaacaccttacgagttacccgttctgctgcccccagcacactggacagttccagcactgcccctgctcagctggggaagaaaggcaaagagtttgaattctcacagttgcccctcaaagtggagttcctggagtgcagtgccaagggtggaagaggggacgtgggctctgctgacatccaggacttggagaaatggctggctaaaattgcctgagaggcagctctaaagcacaagacctggatgtgtgacacacagttttggaaaaaggtctgtggtagtctggagttgatgaggaaggggtacaagatgtggttagaaacatttctttgttctggaaacaaagtactgttgaaaccagcttggaattttttttttttttttttttaagttcagttctcccttatggctgcctttcaaacaagtaccttttatctgatgcctgtatcttccctttgttaaggtgtaacttgatgtagggtcaaggtttttgtgacaacaggcagactccacacagagaggatatgatgagaatatggccatcacctgaaaagttttcttatcttctgtgcttttggtccctggaaacaaatccgcctatgtatgaagctagttgatttccagttgcactatttccagttgcctctgaagttcacaggcaatacattgtctagtcctttgcgaatttctctgatttgtgggcacagttatgaagtttccccacatgtgaagacaggtacaaaatagcagagccaagcagacagtgggtctattcttcattagctcagtgacttgtccacactcgtcttagcacttacgtttcaaaagcttgtcacaaacccttggagtcattcccagataatagaactggaaatgataaatcccctaatgccaagggtctagtgtgttcttagtggttatactgggaagtgtgtggagatttaggtgctgctctgctgctctggatggctgaaggctcctgggccatcttcatgtgctgcttgaagagctcctattttgtactcctggctagaatgctgtggaacaaatacaaagtgaaaaaagttctctgtagatttctgaagtgcatattcattgatgccaagaaaaaaaaaaagttgcctttttgaagtgatgttttttgctgtcttcttaaacacaaggcttttttgaatgattagtatatttcatggtaaagaaaacagcctgtctggctcaaagcaattaaatagaatgtaatggtgagtacaaatgagtgcacatgtcaggactcaggtctaactccttgtctcctgagcctaaagattgcaacatacacaagaacacactcctattcctaccccacacactcagggacaagcccaactaaagcttacaaggagaccagggtggctctgtccaggggagaagccagttatggaacagtgcattgagagccatggtaggagaggcccacagttctctggagcatgcagcaggggcaccccacctggccttgaggatcagggggagtcaaaggataaagcatggggctgatgacgtctgagggagtgtgatcctccatgtatggcctctgcctgctgtctcacatgtcccttctggtggtcacttgggctctaggagtatacgtcacctcagaccatctggcagaaatactccaggctcctaccccaaagcacatgtcagccttgctgctggagcacgaagacaatgtaaatgaaacatgaaatggaggagttgtgagaccctgaccctgagtccttacttgaaagctgctgctggtgttctgagtgtcttttggactcttatttcttgcccttttccttattaggcaagcagtaacttaggaagtaggtaagagcaataaatgtgacatgttatgtcatcatagtaggagctcatgggaataaaagtcagtggcttgatgcttctgttagaggcatgtgtccctctca

SEQ ID NO: 296449 - DNA, 2868 bp, Homo sapiens
tgcttgagttcttcacaagtctcacgtcacttagcgacggtcgggaactcctcagtggtagtttcgggagccattcattcattttattcatttcatcattctttcaacagtcataacgtaggtgacgacgactgactcatctcttaaaagatgtgtgtgtccctcgacaaataacctgtctgcccctatcgttctgtaggaggacggagtcccagagaactacaactcccatcaagcacttgggggatcgccgcggctgagggagagactatggcttaggaaccaccattcgcgtgaggctctgctccccgcgcctgcgcagagtgcagggccacggtcgcttttgctgtaccggggaccacgcgtctcatccatggcttccgcggactcgcgccgggtggcagatggcggcggtgccgggggcaccttccagccctacctagacaccttgcggcaggagctgcagcagacggacccaacgctgttgtcagtagtggtggcggttcttgcggtgctgctgacgctagtcttctggaagttaatccggagcagaaggagcagtcagagagctgttcttcttgttggcctttgtgattccgggaaaacgttgctctttgtcaggttgttaacaggcctttatagagacactcagacgtccattactgacagctgtgctgtatacagagtcaacaataacaggggcaatagtctgaccttgattgaccttcccggccatgagagtttgaggcttcagttcttagagcggtttaagtcttcagccagggctattgtgttgttgtggatagtgcagcattccagcgagaggtgaaagatgtggctgagtttctgtatcaagtcctcattgacagtatgggtctgaagaatacaccatcattcttaatagcctgcaataagcaagatattgcaatggcaaaatcagcaaagttaattcaacagcagctggagaaagaactcaacaccttacgagttacccgttctgctgcccccagcacactggacagttccagcactgcccctgctcagctggggaagaaaggcaaagagtttgaattctcacagttgcccctcaaagtggagttcctggagtgcagtgccaagggtggaagaggggacgtgggctctgctgacatccaggacttggagaaatggctggctaaaattgcctgagaggcagctctaaagcacaagacctggatgtgtgacacacagttttggaaaaaggtctgtggtagtctggagttgatgaggaaggggtacaagatgtggttagaaacatttctttgttctggaaacaaagtactgttgaaaccagcttggaattttttttttttttttttttaagttcagttctcccttatggctgcctttcaaacaagtaccttttatctgatgcctgtatcttccctttgttaaggtgtaacttgatgtagggtcaaggtttttgtgacaacaggcagactccacacagagaggatatgatgagaatatggccatcacctgaaaagttttcttatcttctgtgcttttggtccctggaaacaaatccgcctatgtatgaagctagttgatttccagttgcactatttccagttgcctctgaagttcacaggcaatacattgtctagtcctttgcgaatttctctgatttgtgggcacagttatgaagtttccccacatgtgaagacaggtacaaaatagcagagccaagcagacagtgggtctattcttcattagctcagtgacttgtccacactcgtcttagcacttacgtttcaaaagcttgtcacaaacccttggagtcattcccagataatagaactggaaatgataaatcccctaatgccaagggtctagtgtgttcttagtggttatactgggaagtgtgtggagatttaggtgctgctctgctgctctggatggctgaaggctcctgggccatcttcatgtgctgcttgaagagctcctattttgtactcctggctagaatgctgtggaacaaatacaaagtgaaaaaagttctctgtagatttctgaagtgcatattcattgatgccaagaaaaaaaaaaagttgcctttttgaagtgatgttttttgctgtcttcttaaacacaaggcttttttgaatgattagtatatttcatggtaaagaaaacagcctgtctggctcaaagcaattaaatagaatgtaatggtgagtacaaatgagtgcacatgtcaggactcaggtctaactccttgtctcctgagcctaaagattgcaacatacacaagaacacactcctattcctaccccacacactcagggacaagcccaactaaagcttacaaggagaccagggtggctctgtccaggggagaagccagttatggaacagtgcattgagagccatggtaggagaggcccacagttctctggagcatgcagcaggggcaccccacctggccttgaggatcagggggagtcaaaggataaagcatggggctgatgacgtctgagggagtgtgatcctccatgtatggcctctgcctgctgtctcacatgtcccttctggtggtcacttgggctctaggagtatacgtcacctcagaccatctggcagaaatactccaggctcctaccccaaagcacatgtcagccttgctgctggagcacgaagacaatgtaaatgaaacatgaaatggaggagttgtgagaccctgaccctgagtccttacttgaaagctgctgctggtgttctgagtgtcttttggactcttatttcttgcccttttccttattaggcaagcagtaacttaggaagtaggtaagagcaataaatgtgacatgttatgtcatcatagtagga

SEQ ID NO: 296450 - DNA, 2593 bp, Homo sapiens
  misc_feature (21)..(21): n is a, c, g, or t
  misc_feature (28)..(28): n is a, c, g, or t
atggcaggctggtactgtctngggttanggatctcatccatggcttccgcggactcgcgccgggtggcagatggcggcggtgccgggggcaccttccagccctacctagacaccttgcggcaggagctgcagcagacggacccaacgctgttgtcagtagtggtggcggttcttgcggtgctgctgacgctagtcttctggaagttaatccggagcagaaggagcagtcagagagctgttcttcttgttggcctttgtgattccgggaaaacgttgctctttgtcaggttgttaacaggcctttatagagacactcagacgtccattactgacagctgtgctgtatacagagtcaacaataacaggggcaatagtctgaccttgattgaccttcccggccatgagagtttgaggcttcagttcttagagcggtttaagtcttcagccagggctattgtgttgttgtggatagtgcagcattccagcgagaggtgaaagatgtggctgagtttctgtatcaagtcctcattgacagtatgggtctgaagaatacaccatcattcttaatagcctgcaataagcaagatattgcaatggcaaaatcagcaaagttaattcaacagcagctggagaaagaactcaacaccttacgagttacccgttctgctgcccccagcacactggacagttccagcactgcccctgctcagctggggaagaaaggcaaagagtttgaattctcacagttgcccctcaaagtggagttcctggagtgcagtgccaagggtggaagaggggacgtgggctctgctgacatccaggacttggagaaatggctggctaaaattgcctgagaggcagctctaaagcacaagacctggatgtgtgacacacagttttggaaaaaggtctgtggtagtctggagttgatgaggaaggggtacaagatgtggttagaaacatttctttgttctggaaacaaagtactgttgaaaccagcttggaattttttttttttttttttttaagttcagttctcccttatggctgcctttcaaacaagtaccttttatctgatgcctgtatcttccctttgttaaggtgtaacttgatgtagggtcaaggtttttgtgacaacaggcagactccacacagagaggatatgatgagaatatggccatcacctgaaaagttttcttatcttctgtgcttttggtccctggaaacaaatccgcctatgtatgaagctagttgatttccagttgcactatttccagttgcctctgaagttcacaggcaatacattgtctagtcctttgcgaatttctctgatttgtgggcacagttatgaagtttccccacatgtgaagacaggtacaaaatagcagagccaagcagacagtgggtctattcttcattagctcagtgacttgtccacactcgtcttagcacttacgtttcaaaagcttgtcacaaacccttggagtcattcccagataatagaactggaaatgataaatcccctaatgccaagggtctagtgtgttcttagtggttatactgggaagtgtgtggagatttaggtgctgctctgctgctctggatggctgaaggctcctgggccatcttcatgtgctgcttgaagagctcctattttgtactcctggctagaatgctgtggaacaaatacaaagtgaaaaaagttctctgtagatttctgaagtgcatattcattgatgccaagaaaaaaaaaaagttgcctttttgaagtgatgttttttgctgtcttcttaaacacaaggcttttttgaatgattagtatatttcatggtaaagaaaacagcctgtctggctcaaagcaattaaatagaatgtaatggtgagtacaaatgagtgcacatgtcaggactcaggtctaactccttgtctcctgagcctaaagattgcaacatacacaagaacacactcctattcctaccccacacactcagggacaagcccaactaaagcttacaaggagaccagggtggctctgtccaggggagaagccagttatggaacagtgcattgagagccatggtaggagaggcccacagttctctggagcatgcagcaggggcaccccacctggccttgaggatcagggggagtcaaaggataaagcatggggctgatgacgtctgagggagtgtgatcctccatgtatggcctctgcctgctgtctcacatgtcccttctggtggtcacttgggctctaggagtatacgtcacctcagaccatctggcagaaatactccaggctcctaccccaaagcacatgtcagccttgctgctggagcacgaagacaatgtaaatgaaacatgaaatggaggagttgtgagaccctgaccctgagtccttacttgaaagctgctgctggtgttctgagtgtcttttggactcttatttcttgcccttttccttattaggcaagcagtaacttaggaagtaggtaagagcaataaatgtgacatgttatgtcatcatagtaggagctcatgggaataaaagtcagtggcttgatgcttctgttagaggcatgtgtccctctca

SEQ ID NO: 296451 - DNA, 2593 bp, Homo sapiens
ggctagtcgaggccggtgttaatcggccgaggctcatccatggcttccgcggactcgcgccgggtggcagatggcggcggtgccgggggcaccttccagccctacctagacaccttgcggcaggagctgcagcagacggacccaacgctgttgtcagtagtggtggcggttcttgcggtgctgctgacgctagtcttctggaagttaatccggagcagaaggagcagtcagagagctgttcttcttgttggcctttgtgattccgggaaaacgttgctctttgtcaggttgttaacaggcctttatagagacactcagacgtccattactgacagctgtgctgtatacagagtcaacaataacaggggcaatagtctgaccttgattgaccttcccggccatgagagtttgaggcttcagttcttagagcggtttaagtcttcagccagggctattgtgttgttgtggatagtgcagcattccagcgagaggtgaaagatgtggctgagtttctgtatcaagtcctcattgacagtatgggtctgaagaatacaccatcattcttaatagcctgcaataagcaagatattgcaatggcaaaatcagcaaagttaattcaacagcagctggagaaagaactcaacaccttacgagttacccgttctgctgcccccagcacactggacagttccagcactgcccctgctcagctggggaagaaaggcaaagagtttgaattctcacagttgcccctcaaagtggagttcctggagtgcagtgccaagggtggaagaggggacgtgggctctgctgacatccaggacttggagaaatggctggctaaaattgcctgagaggcagctctaaagcacaagacctggatgtgtgacacacagttttggaaaaaggtctgtggtagtctggagttgatgaggaaggggtacaagatgtggttagaaacatttctttgttctggaaacaaagtactgttgaaaccagcttggaattttttttttttttttttttaagttcagttctcccttatggctgcctttcaaacaagtaccttttatctgatgcctgtatcttccctttgttaaggtgtaacttgatgtagggtcaaggtttttgtgacaacaggcagactccacacagagaggatatgatgagaatatggccatcacctgaaaagttttcttatcttctgtgcttttggtccctggaaacaaatccgcctatgtatgaagctagttgatttccagttgcactatttccagttgcctctgaagttcacaggcaatacattgtctagtcctttgcgaatttctctgatttgtgggcacagttatgaagtttccccacatgtgaagacaggtacaaaatagcagagccaagcagacagtgggtctattcttcattagctcagtgacttgtccacactcgtcttagcacttacgtttcaaaagcttgtcacaaacccttggagtcattcccagataatagaactggaaatgataaatcccctaatgccaagggtctagtgtgttcttagtggttatactgggaagtgtgtggagatttaggtgctgctctgctgctctggatggctgaaggctcctgggccatcttcatgtgctgcttgaagagctcctattttgtactcctggctagaatgctgtggaacaaatacaaagtgaaaaaagttctctgtagatttctgaagtgcatattcattgatgccaagaaaaaaaaaaagttgcctttttgaagtgatgttttttgctgtcttcttaaacacaaggcttttttgaatgattagtatatttcatggtaaagaaaacagcctgtctggctcaaagcaattaaatagaatgtaatggtgagtacaaatgagtgcacatgtcaggactcaggtctaactccttgtctcctgagcctaaagattgcaacatacacaagaacacactcctattcctaccccacacactcagggacaagcccaactaaagcttacaaggagaccagggtggctctgtccaggggagaagccagttatggaacagtgcattgagagccatggtaggagaggcccacagttctctggagcatgcagcaggggcaccccacctggccttgaggatcagggggagtcaaaggataaagcatggggctgatgacgtctgagggagtgtgatcctccatgtatggcctctgcctgctgtctcacatgtcccttctggtggtcacttgggctctaggagtatacgtcacctcagaccatctggcagaaatactccaggctcctaccccaaagcacatgtcagccttgctgctggagcacgaagacaatgtaaatgaaacatgaaatggaggagttgtgagaccctgaccctgagtccttacttgaaagctgctgctggtgttctgagtgtcttttggactcttatttcttgcccttttccttattaggcaagcagtaacttaggaagtaggtaagagcaataaatgtgacatgttatgtcatcatagtaggagctcatgggaataaaagtcagtggcttgatgcttctgttagaggcatgtgtccctctca

SEQ ID NO: 296452 - DNA, 2680 bp, Homo sapiens
tgcttgagttcttcacaagtctcacgtcacttagcgacggtcgggaactcctcagtggtagtttcgggagccattcattcattttattcatttcatcattctttcaacagtcataacgtaggtgacgacgactgactcatctcttaaaagatgtgtgtgtccctcgacaaataacctgtctgcccctatcgttctgtaggaggacggagtcccagagaactacaactcccatcaagcacttgggggatcgccgcggctgagggagagactatggcttaggaaccaccattcgcgtgaggctctgctccccgcgcctgcgcagagtgcagggccacggtcgcttttgctgtaccggggaccacgcgtctcatccatggcttccgcggactcgcgccgggtggcagatggcggcggtgccgggggcaccttccagccctacctagacaccttgcggcaggagctgcagcagacggacccaacgctgttgtcagtagtggtggcggttcttgcggtgctgctgacgctagtcttctggaagttaatccggagcagaaggagcagtcagagagctgttcttcttgttggcctttgtgattccgggaaaacgttgctctttgtcaggttgttaacaggcctttatagagacactcagacgtccattactgacagctgtgctgtatacagagtcaacaataacaggggcaatagtctgaccttgattgaccttcccggccatgagagtttgaggcttcagttcttagagcggtttaagtcttcagccagggctattgtgttgttgtggatagtgcagcattccagcgagaggtgaaagatgtggctgagtttctgtatcaagtcctcattgacagtatgggtctgaagaatacaccatcattcttaatagcctgcaataagcaagatattgcaatggcaaaatcagcaaagttaattcaacagcagctggagaaagaactcaacaccttacgagttacccgttctgctgcccccagcacactggacagttccagcactgcccctgctcagctggggaagaaaggcaaagagtttgaattctcacagttgcccctcaaagtggagttcctggagtgcagtgccaagggtggaagaggggacgtgggctctgctgacatccaggacttggagaaatggctggctaaaattgcctgagaggcagctctaaagcacaagacctggatgtgtgacacacagttttggaaaaaggtctgtggtagtctggagttgatgaggaaggggtacaagatgtggttagaaacatttctttgttctggaaacaaagtactgttgaaaccagcttggaattttttttttttttttttttaagttcagttctcccttatggctgcctttcaaacaagtaccttttatctgatgcctgtatcttccctttgttaaggtgtaacttgatgtagggtcaaggtttttgtgacaacaggcagactccacacagtgggtctattcttcattagctcagtgacttgtccacactcgtcttagcacttacgtttcaaaagcttgtcacaaacccttggagtcattcccagataatagaactggaaatgataaatcccctaatgccaagggtctagtgtgttcttagtggttatactgggaagtgtgtggagatttaggtgctgctctgctgctctggatggctgaaggctcctgggccatcttcatgtgctgcttgaagagctcctattttgtactcctggctagaatgctgtggaacaaatacaaagtgaaaaaagttctctgtagatttctgaagtgcatattcattgatgccaagaaaaaaaaaaagttgcctttttgaagtgatgttttttgctgtcttcttaaacacaaggcttttttgaatgattagtatatttcatggtaaagaaaacagcctgtctggctcaaagcaattaaatagaatgtaatggtgagtacaaatgagtgcacatgtcaggactcaggtctaactccttgtctcctgagcctaaagattgcaacatacacaagaacacactcctattcctaccccacacactcagggacaagcccaactaaagcttacaaggagaccagggtggctctgtccaggggagaagccagttatggaacagtgcattgagagccatggtaggagaggcccacagttctctggagcatgcagcaggggcaccccacctggccttgaggatcagggggagtcaaaggataaagcatggggctgatgacgtctgagggagtgtgatcctccatgtatggcctctgcctgctgtctcacatgtcccttctggtggtcacttgggctctaggagtatacgtcacctcagaccatctggcagaaatactccaggctcctaccccaaagcacatgtcagccttgctgctggagcacgaagacaatgtaaatgaaacatgaaatggaggagttgtgagaccctgaccctgagtccttacttgaaagctgctgctggtgttctgagtgtcttttggactcttatttcttgcccttttccttattaggcaagcagtaacttaggaagtaggtaagagcaataaatgtgacatgttatgtcatcatagtaggagctcatgggaataaaagtcagtggcttgatgcttctgttagaggcatgtgtccctctca

SEQ ID NO: 296453 - DNA, 2892 bp, Homo sapiens
tgcttgagttcttcacaagtctcacgtcacttagcgacggtcgggaactcctcagtggtagtttcgggagccattcattcattttattcatttcatcattctttcaacagtcataacgtaggtgacgacgactgactcatctcttaaaagatgtgtgtgtccctcgacaaataacctgtctgcccctatcgttctgtaggaggacggagtcccagagaactacaactcccatcaagcacttgggggatcgccgcggctgagggagagactatggcttaggaaccaccattcgcgtgaggctctgctccccgcgcctgcgcagagtgcagggccacggtcgcttttgctgtaccggggaccacgcgtctcatccatggcttccgcggactcgcgccgggtggcagatggcggcggtgccgggggcaccttccagccctacctagacaccttgcggcaggagctgcagcagacggacccaacgctgttgtcagtagtggtggcggttcttgcggtgctgctgacgctagtcttctggaagttaatccggagcagaaggagcagtcagagagctgttcttcttgttggcctttgtgattccgggaaaacgttgctctttgtcaggttgttaacaggcctttatagagacactcagacgtccattactgacagctgtgctgtatacagagtcaacaataacaggggcaatagtctgaccttgattgaccttcccggccatgagagtttgaggcttcagttcttagagcggtttaagtcttcagccagggctattgtgttgttgtggatagtgcagcattccagcgagaggtgaaagatgtggctgagtttctgtatcaagtcctcattgacagtatgggtctgaagaatacaccatcattcttaatagcctgcaataagcaagatattgcaatggcaaaatcagcaaagttaattcaacagcagctggagaaagaactcaacaccttacgagttacccgttctgctgcccccagcacactggacagttccagcactgcccctgctcagctggggaagaaaggcaaagagtttgaattctcacagttgcccctcaaagtggagttcctggagtgcagtgccaagggtggaagaggggacgtgggctctgctgacatccaggacttggagaaatggctggctaaaattgcctgagaggcagctctaaagcacaagacctggatgtgtgacacacagttttggaaaaaggtctgtggtagtctggagttgatgaggaaggggtacaagatgtggttagaaacatttctttgttctggaaacaaagtactgttgaaaccagcttggaattttttttttttttttttttaagttcagttctcccttatggctgcctttcaaacaagtaccttttatctgatgcctgtatcttccctttgttaaggtgtaacttgatgtagggtcaaggtttttgtgacaacaggcagactccacacagagaggatatgatgagaatatggccatcacctgaaaagttttcttatcttctgtgcttttggtccctggaaacaaatccgcctatgtatgaagctagttgatttccagttgcactatttccagttgcctctgaagttcacaggcaatacattgtctagtcctttgcgaatttctctgatttgtgggcacagttatgaagtttccccacatgtgaagacaggtacaaaatagcagagccaagcagacagtgggtctattcttcattagctcagtgacttgtccacactcgtcttagcacttacgtttcaaaagcttgtcacaaacccttggagtcattcccagataatagaactggaaatgataaatcccctaatgccaagggtctagtgtgttcttagtggttatactctctggatggctgaaggctcctgggccatcttcatgtgctgcttgaagagctcctattttgtactcctggctagaatgctgtggaacaaatacaaagtgaaaaaagttctctgtagatttctgaagtgcatattcattgatgccaagaaaaaaaaaaagttgcctttttgaagtgatgttttttgctgtcttcttaaacacaaggcttttttgaatgattagtatatttcatggtaaagaaaacagcctgtctggctcaaagcaattaaatagaatgtaatggtgagtacaaatgagtgcacatgtcaggactcaggtctaactccttgtctcctgagcctaaagattgcaacatacacaagaacacactcctattcctaccccacacactcagggacaagcccaactaaagcttacaaggagaccagggtggctctgtccaggggagaagccagttatggaacagtgcattgagagccatggtaggagaggcccacagttctctggagcatgcagcaggggcaccccacctggccttgaggatcagggggagtcaaaggataaagcatggggctgatgacgtctgagggagtgtgatcctccatgtatggcctctgcctgctgtctcacatgtcccttctggtggtcacttgggctctaggagtatacgtcacctcagaccatctggcagaaatactccaggctcctaccccaaagcacatgtcagccttgctgctggagcacgaagacaatgtaaatgaaacatgaaatggaggagttgtgagaccctgaccctgagtccttacttgaaagctgctgctggtgttctgagtgtcttttggactcttatttcttgcccttttccttattaggcaagcagtaacttaggaagtaggtaagagcaataaatgtgacatgttatgtcatcatagtaggagctcatgggaataaaagtcagtggcttgatgcttctgttagaggcatgtgtccctctca

SEQ ID NO: 296454 - DNA, 3140 bp, Homo sapiens
tgcttgagttcttcacaagtctcacgtcacttagcgacggtcgggaactcctcagtggtagtttcgggagccattcattcattttattcatttcatcattctttcaacagtcataacgtaggtgacgacgactgactcatctcttaaaagatgtgtgtgtccctcgacaaataacctgtctgcccctatcgttctgtaggaggacggagtcccagagaactacaactcccatcaagcacttgggggatcgccgcggctgagggagagactatggcttaggaaccaccattcgcgtgaggctctgctccccgcgcctgcgcagagtgcagggccacggtcgcttttgctgtaccggggaccacgcgtctcatccatggcttccgcggactcgcgccgggtggcagatggcggcggtgccgggggcaccttccagccctacctagacaccttgcggcaggagctgcagcagacggacccaacgctgttgtcagtagtggtggcggttcttgcggtgctgctgacgctagtcttctggaagttaatccggagcagaaggagcagtcagagagctgttcttcttgttggcctttgtgattccgggaaaacgttgctctttgtcaggttgttaacaggcctttatagagacactcagacgtccattactgacagctgtgctgtatacagagtcaacaataacaggggcaatagtctgaccttgattgaccttcccggccatgagagtttgaggcttcagttcttagagcggtttaagtcttcagccagggctattgtgttgttgtggatagtgcagcattccagcgagaggtgaaagatgtggctgagtttctgtatcaagtcctcattgacagtatgggtctgaagaatacaccatcattcttaatagcctgcaataagcaagatattgcaatggcaaaatcagcaaagttaattcaacagcagctggagaaagaactcaacaccttacgagttacccgttctgctgcccccagcacactggacagttccagcactgcccctgctcagctggggaagaaaggcaaagagtttgaattctcacagttgcccctcaaagtggagttcctggagtgcagtgccaagggtggaagaggggacgtgggctctgctgacatccaggacttggagaaatggctggctaaaattgcctgagaggcagctctaaagcacaagacctggatgtgtgacacacagttttggaaaaagagatactgaaactggtctggccattgctcccctcagacctgggaacatgactgaatgtttaaggatgacaagaagagagcagcgatagatagcaaggaggcctctgaccaagggaaactgctgccaacagctaccaagccaactagccttggatcacacaactgcagccatggtgctcatgattctgatgtcacaccttcatgttgatgtatgtatgatcacccagcaagttaggagtgatcagaaccaatgtgtttccacttgtaaataggctgtttgctttttccatcttacactcaactttcctgatgcctgcagaacaggagctttgttgataagcttttaagattcacccccttcactcccaccatccccaaaaaagaaggccaagaggatcctgctaatctgccaggtcacgtctagtctttggggagagggactgaattgctcaattgagaacatttcctcaaaggaatcctccaatttgccctctgctaacccatctggattcagcaaagatgcaatgctcttgctggggtgctgaggcaatgccatgacatcttcttcaagagcacctaacagtttattatggaaccttaactctgtgccaattctacctgcaagcaaggggacagggatggtgcctgctcaagacaaaaatcagggaaccaacaacttctgaaaaagaggtctggctgcctttccacaccccaggaagggaggggcggaaaccgcacgtgccgaagggagcgccatggaaccactgagatgggaggatgggaggaagccaccctcagcctcagaggccaaggggctggggagaacccaaactcaaagagaggatgttgtgtgcatgctaggaaaggcaggactcactaaggccatgtcaaaccaaatgctatcttttactgctcctctaggccaggatggaaacacagtccacggtgccttggatgtgtgtgcccctgagaagggaactgagtttctactgttttatgggatgtttttttaaaaaagctaatctttagtgccaagaaaataaaaatctaccatacgttcattcactgagacccagtgcagattcctgtaaatggggcggtctcagaggccacaggtgatggcccccgctgccaaccaggcaggacactgtcatgtggactcctgtaaattctctcgaggtaagtaagcactcttccaacaagcaccacttgggggtgtgcccatggtggggggacactggcccacacaggcatgcacacccgtgcatataaagtacatagagaaatggtggagatattcccgtgggctatgtttgcctgtagtttaacacaactatgcattattttattgatggcaagacaatcacaagttatttgacaatattaagtatttcttatttcaacacgttgcagtacttttgaatttccaaaacttatcacaatgcaagttccaacttgagagcaggagaaacaagaatatacattgagcacatgtatctccgtgaggatgtgtttgtggaaggtgtatacacaagtctatctctatatataattatgtacacacatataaaaactaaacacatgacatctgaaacacgttcaaacattggtccttgccttctgcaagaggtgctcagtgggatcctgcttcctctcttcttcacctgaagataaattccttgctagagatgagctctggcatacagcctcctaggcagagggtgtgtggcaggcccactgcacaaatatcagtcctgccagattctgctgcacttactgcctgccatttcagattaatttctgagaagtttcaaaattcattccaacgaccttgtggagttcagcccaccataccccagatggtcattcatcccatctatgacatgcccagcagcagcc

SEQ ID NO: 296455 - DNA, 1952 bp, Homo sapiens
tgcttgagttcttcacaagtctcacgtcacttagcgacggtcgggaactcctcagtggtagtttcgggagccattcattcattttattcatttcatcattctttcaacagtcataacgtaggtgacgacgactgactcatctcttaaaagatgtgtgtgtccctcgacaaataacctgtctgcccctatcgttctgtaggaggacggagtcccagagaactacaactcccatcaagcacttgggggatcgccgcggctgagggagagactatggcttaggaaccaccattcgcgtgaggctctgctccccgcgcctgcgcagagtgcagggccacggtcgcttttgctgtaccggggaccacgcgtctcatccatggcttccgcggactcgcgccgggtggcagatggcggcggtgccgggggcaccttccagccctacctagacaccttgcggcaggagctgcagcagacggacccaacgctgttgtcagtagtggtggcggttcttgcggtgctgctgacgctagtcttctggaagttaatccggagcagaaggagcagtcagagagctgttcttcttgttggcctttgtgattccgggaaaacgttgctctttgtcaggttgttaacaggcctttatagagacactcagacgtccattactgacagctgtgctgtatacagagtcaacaataacaggggcaatagtctgaccttgattgaccttcccggccatgagagtttgaggcttcagttcttagagcggtttaagtcttcagccagggctattgtgttgttgtggatagtgcagcattccagcgagaggtgaaagatgtggctgagtttctgtatcaagtcctcattgacagtatgggtctgaagaatacaccatcattcttaatagcctgcaataagcaagatattgcaatggcaaaatcagcaaagttaattcaacagcagctggagaaagaactcaacaccttacgagttacccgttctgctgcccccagcacactggacagttccagcactgcccctgctcagctggggaagaaaggcaaagagtttgaattctcacagttgcccctcaaagtggagttcctggagtgcagtgccaagggtggaagaggggacgtgggctctgctgacatccaggacttggagaaatggctggctaaaattgcctgagaggcagctctaaagcacaagacctggatgtgtgacacacagttttggaaaaaggtctgtggtagtctggagttgatgaggaaggggtacaagatgtggttagaaacatttctttgttctggaaacaaagtactgttgaaaccagcttggaattttttttttttttttttttaagttcagttctcccttatggctgcctttcaaacaagtaccttttatctgatgcctgtatcttccctttgttaaggtgtaacttgatgtagggtcaaggtttttgtgacaacaggcagactccacacagagaggatatgatgagaatatggccatcacctgaaaagttttcttatcttctgtgcttttggtccctggaaacaaatccgcctatgtatgaagctagttgatttccagttgcactatttccagttgcctctgaagttcacaggcaatacattgtctagtcctttgcgaatttctctgatttgtgggcacagttatgaagtttccccacatgtgaagacaggtacaaaatagcagagccaagcagacagtgggtctattcttcattagctcagtgacttgtccacactcgtcttagcacttacgtttcaaaagcttgtcacaaacccttggagtcattcccagataatagaactggaaatgataaatcccctaatgccaagggtctagtgtgttcttagtggttatactcacagggggggaatttaagagctgatattataatatggataagcttacgggctcaa

SEQ ID NO: 296456 - DNA, 3082 bp, Homo sapiens
  misc_feature (489)..(489): n is a, c, g, or t
aaatctgtgcaggatactgattgcctgcttctgaactgtgggtatggttggctgtggataatgtagaacatgtaagaaatgatggtctgctgcatgtaccaggccacatctaagagtcttattgttgagcacagccacgtttacactgaatataaactttattcaccattccaggccttgaccttatattcaggaatggcagcctggcatggtgaatagaacttattagggtgcatcgtagatttgctcagtaggggctcaggaattgacacaaatgctgacggagttggaacaagtaaattatatgtctggaagataaatatttaaataattagattaagggtggaaatgataaaagtgtactttgttataaagattggagatcccagtaagagtaatatgctctatgaaaaattgtaagttcttatattacattattagtttatgagtacttgttactgttttcacatttttgcttatactcatacngtactcctactttgctatactcacactggtttatctcccaagcctcaggtagatcatgcttccctgactcccccagacaggtttttcctgtaccctcaaaacatttatcagtgttctcattttatatttatgtgtaattttacattatgttcacctttctcataaattttgccagatcaggaaccgtgtctttggccactgttacatccccagaacgttgactagtgttttatgagtagaagatgctttgtgaacatttgtttggttaattaggtaccagtttggtagccaatatatgatactaaaggtttatattgtgaacgtggaactgtattgaaacgttaatgttattgctgccatccccagggcaatagtctgaccttgattgaccttcccggccatgagagtttgaggcttcagttcttagagcggtttaagtcttcagccagggctattgtgttgttgtggatagtgcagcattccagcgagaggtgaaagatgtggctgagtttctgtatcaagtcctcattgacagtatgggtctgaagaatacaccatcattcttaatagcctgcaataagcaagatattgcaatggcaaaatcagcaaagttaattcaacagcagctggagaaagaactcaacaccttacgagttacccgttctgctgcccccagcacactggacagttccagcactgcccctgctcagctggggaagaaaggcaaagagtttgaattctcacagttgcccctcaaagtggagttcctggagtgcagtgccaagggtggaagaggggacgtgggctctgctgacatccaggacttggagaaatggctggctaaaattgcctgagaggcagctctaaagcacaagacctggatgtgtgacacacagttttggaaaaaggtctgtggtagtctggagttgatgaggaaggggtacaagatgtggttagaaacatttctttgttctggaaacaaagtactgttgaaaccagcttggaattttttttttttttttttttaagttcagttctcccttatggctgcctttcaaacaagtaccttttatctgatgcctgtatcttccctttgttaaggtgtaacttgatgtagggtcaaggtttttgtgacaacaggcagactccacacagagaggatatgatgagaatatggccatcacctgaaaagttttcttatcttctgtgcttttggtccctggaaacaaatccgcctatgtatgaagctagttgatttccagttgcactatttccagttgcctctgaagttcacaggcaatacattgtctagtcctttgcgaatttctctgatttgtgggcacagttatgaagtttccccacatgtgaagacaggtacaaaatagcagagccaagcagacagtgggtctattcttcattagctcagtgacttgtccacactcgtcttagcacttacgtttcaaaagcttgtcacaaacccttggagtcattcccagataatagaactggaaatgataaatcccctaatgccaagggtctagtgtgttcttagtggttatactgggaagtgtgtggagatttaggtgctgctctgctgctctggatggctgaaggctcctgggccatcttcatgtgctgcttgaagagctcctattttgtactcctggctagaatgctgtggaacaaatacaaagtgaaaaaagttctctgtagatttctgaagtgcatattcattgatgccaagaaaaaaaaaaagttgcctttttgaagtgatgttttttgctgtcttcttaaacacaaggcttttttgaatgattagtatatttcatggtaaagaaaacagcctgtctggctcaaagcaattaaatagaatgtaatggtgagtacaaatgagtgcacatgtcaggactcaggtctaactccttgtctcctgagcctaaagattgcaacatacacaagaacacactcctattcctaccccacacactcagggacaagcccaactaaagcttacaaggagaccagggtggctctgtccaggggagaagccagttatggaacagtgcattgagagccatggtaggagaggcccacagttctctggagcatgcagcaggggcaccccacctggccttgaggatcagggggagtcaaaggataaagcatggggctgatgacgtctgagggagtgtgatcctccatgtatggcctctgcctgctgtctcacatgtcccttctggtggtcacttgggctctaggagtatacgtcacctcagaccatctggcagaaatactccaggctcctaccccaaagcacatgtcagccttgctgctggagcacgaagacaatgtaaatgaaacatgaaatggaggagttgtgagaccctgaccctgagtccttacttgaaagctgctgctggtgttctgagtgtcttttggactcttatttcttgcccttttccttattaggcaagcagtaacttaggaagtaggtaagagcaataaatgtgacatgttatgtcatcatagtaggagctcatgggaataaaagtcagtggcttgatgcttctgttagaggcatgtgtccctctca

SEQ ID NO: 296457 - DNA, 1769 bp, Homo sapiens
tgcttgagttcttcacaagtctcacgtcacttagcgacggtcgggaactcctcagtggtagtttcgggagccattcattcattttattcatttcatcattctttcaacagtcataacgtaggtgacgacgactgactcatctcttaaaagatgtgtgtgtccctcgacaaataacctgtctgcccctatcgttctgtaggaggacggagtcccagagaactacaactcccatcaagcacttgggggatcgccgcggctgagggagagactatggcttaggaaccaccattcgcgtgaggctctgctccccgcgcctgcgcagagtgcagggccacggtcgcttttgctgtaccggggaccacgcgtctcatccatggcttccgcggactcgcgccgggtggcagatggcggcggtgccgggggcaccttccagccctacctagacaccttgcggcaggagctgcagcagacggacccaacgctgttgtcagtagtggtggcggttcttgcggtgctgctgacgctagtcttctggaagttaatccggagcagaaggagcagtcagagagctgttcttcttgttggcctttgtgattccgggaaaacgttgctctttgtcaggttgttaacaggcctttatagagacactcagacgtccattactgacagctgtgctgtatacagagtcaacaataacaggggcaatagtctgaccttgattgaccttcccggccatgagagtttgaggcttcagttcttagagcggtttaagtcttcagccagggctattgtgttgttgtggatagtgcagcattccagcgagaggtgaaagatgtggctgagtttctgtatcaagtcctcattgacagtatgggtctgaagaatacaccatcattcttaatagcctgcaataagcaagatattgcaatggcaaaatcagcaaagttaattcaacagcagctggagaaagaactcaacaccttacgagttacccgttctgctgcccccagcacactggacagttccagcactgcccctgctcagctggggaagaaaggcaaagagtttgaattctcacagttgcccctcaaagtggagttcctggagtgcagtgccaagggtggaagaggggacgtgggctctgctgacatccaggacttggagaaatggctggctaaaattgcctgagaggcagctctaaagcacaagacctggatgtgtgacacacagttttggaaaaaggtctgtggtagtctggagttgatgaggaaggggtacaagatgtggttagaaacatttctttgttctggaaacaaagtactgttgaaaccagcttggaattttttttttttttttttttaagttcagttctcccttatggctgcctttcaaacaagtaccttttatctgatgcctgtatcttccctttgttaaggtgtaacttgatgtagggtcaaggtttttgtgacaacaggcagactccacacagagaggatatgatgagaatatggccatcacctgaaaagttttcttatcttctgtgcttttggtccctggaaacaaatccgcctatgtatgaagctagttgatttccagttgcactatttccagttgcctctgaagttcacaggcaatacattgtctagtcctttgcgaatttctctgatttgtgggcacagttatgaagtttccccacatgtgatagagtaaggaaacaactcactacggcgttttccccagacagaaggtaaaatcctgttcccgtgaaa

SEQ ID NO: 296458 - DNA, 3116 bp, Homo sapiens
tgcttgagttcttcacaagtctcacgtcacttagcgacggtcgggaactcctcagtggtagtttcgggagccattcattcattttattcatttcatcattctttcaacagtcataacgtaggtgacgacgactgactcatctcttaaaagatgtgtgtgtccctcgacaaataacctgtctgcccctatcgttctgtaggaggacggagtcccagagaactacaactcccatcaagcacttgggggatcgccgcggctgagggagagactatggcttaggaaccaccattcgcgtgaggctctgctccccgcgcctgcgcagagtgcagggccacggtcgcttttgctgtaccggggaccacgcgtctcatccatggcttccgcggactcgcgccgggtggcagatggcggcggtgccgggggcaccttccagccctacctagacaccttgcggcaggagctgcagcagacggacccaacgctgttgtcagtagtggtggcggttcttgcggtgctgctgacgctagtcttctggaagttaatccggagcagaaggagcagtcagagagctgttcttcttgttggcctttgtgattccgggaaaacgttgctctttgtcaggttgttaacaggcctttatagagacactcagacgtccattactgacagctgtgctgtatacagagtcaacaataacaggggcaatagtctgaccttgattgaccttcccggccatgagagtttgaggcttcagttcttagagcggtttaagtcttcagccagggctattgtgttgttgtggatagtgcagcattccagcgagaggtgaaagatgtggctgagtttctgtatcaagtcctcattgacagtatgggtctgaagaatacaccatcattcttaatagcctgcaataagcaagatattgcaatggcaaaatcagcaaagttaattcaacagcagctggagaaagaactcaacaccttacgagttacccgttctgctgcccccagcacactggacagttccagcactgcccctgctcagctggggaagaaaggcaaagagtttgaattctcacagttgcccctcaaagtggagttcctggagtgcagtgccaagggtggaagaggggacgtgggctctgctgacatccaggacttggagaaatggctggctaaaattgcctgagaggcagctctaaagcacaagacctggatgtgtgacacacagttttggaaaaagagatactgaaactggtctggccattgctcccctcagacctgggaacatgactgaatgtttaaggatgacaagaagagagcagcgatagatagcaaggaggcctctgaccaagggaaactgctgccaacagctaccaagccaactagccttggatcacacaactgcagccatggtgctcatgattctgatgtcacaccttcatgttgatgtatgtatgatcacccagcaagttaggagtgatcagaaccaatgtgtttccacttgtaaataggctgtttgctttttccatcttacactcaactttcctgatgcctgcagaacaggagctttgttgataagcttttaagattcacccccttcactcccaccatccccaaaaaagaaggccaagaggatcctgctaatctgccaggtcacgtctagtctttggggagagggactgaattgctcaattgagaacatttcctcaaaggaatcctccaatttgccctctgctaacccatctggattcagcaaagatgcaatgctcttgctggggtgctgaggcaatgccatgacatcttcttcaagagcacctaacagtttattatggaaccttaactctgtgccaattctacctgcaagcaaggggacagggatggtgcctgctcaagacaaaaatcagggaaccaacaacttctgaaaaagaggtctggctgcctttccacaccccaggaagggaggggcggaaaccgcacgtgccgaagggagcgccatggaaccactgagatgggaggatgggaggaagccaccctcagcctcagaggccaaggggctggggagaacccaaactcaaagagaggatgttgtgtgcatgctaggaaaggcaggactcactaaggccatgtcaaaccaaatgctatcttttactgctcctctaggccaggatggaaacacagtccacggtgccttggatgtgtgtgcccctgagaagggaactgagtttctactgttttatgggatgtttttttaaaaaagctaatctttagtgccaagaaaataaaaatctaccatacgttcattcactgagacccagtgcagattcctgtaaatggggcggtctcagaggccacaggtgatggcccccgctgccaaccaggcaggacactgtcatgtggactcctgtaaattctctcgaggtaagtaagcactcttccaacaagcaccacttgggggtgtgcccatggtggggggacactggcccacacaggcatgcacacccgtgcatataaagtacatagagaaatggtggagatattcccgtgggctatgtttgcctgtagtttaacacaactatgcattattttattgatggcaagacaatcacaagttatttgacaatattaagtatttcttatttcaacacgttgcagtacttttgaatttccaaaacttatcacaatgcaagttccaacttgagagcaggagaaacaagaatatacattgagcacatgtatctccgtgaggatgtgtttgtggaaggtgtatacacaagtctatatataaaaactaaacacatgacatctgaaacacgttcaaacattggtccttgccttctgcaagaggtgctcagtgggatcctgcttcctctcttcttcacctgaagataaattccttgctagagatgagctctggcatacagcctcctaggcagagggtgtgtggcaggcccactgcacaaatatcagtcctgccagattctgctgcacttactgcctgccatttcagattaatttctgagaagtttcaaaattcattccaacgaccttgtggagttcagcccaccataccccagatggtcattcatcccatctatgacatgcccagcagcagcc

SEQ ID NO: 296459 - DNA, 2310 bp, Homo sapiens
tgcttgagttcttcacaagtctcacgtcacttagcgacggtcgggaactcctcagtggtagtttcgggagccattcattcattttattcatttcatcattctttcaacagtcataacgtaggtgacgacgactgactcatctcttaaaagatgtgtgtgtccctcgacaaataacctgtctgcccctatcgttctgtaggaggacggagtcccagagaactacaactcccatcaagcacttgggggatcgccgcggctgagggagagactatggcttaggaaccaccattcgcgtgaggctctgctccccgcgcctgcgcagagtgcagggccacggtcgcttttgctgtaccggggaccacgcgtctcatccatggcttccgcggactcgcgccgggtggcagatggcggcggtgccgggggcaccttccagccctacctagacaccttgcggcaggagctgcagcagacggacccaacgctgttgtcagtagtggtggcggttcttgcggtgctgctgacgctagtcttctggaagttaatccggagcagaaggagcagtcagagagctgttcttcttgttggcctttgtgattccgggaaaacgttgctctttgtcaggttgttaacaggcctttatagagacactcagacgtccattactgacagctgtgctgtatacagagtcaacaataacaggggcaatagtctgaccttgattgaccttcccggccatgagagtttgaggcttcagttcttagagcggtttaagtcttcagccagggctattgtgttgttgtggatagtgcagcattccagcgagaggtgaaagatgtggctgagtttctgtatcaagtcctcattgacagtatgggtctgaagaatacaccatcattcttaatagcctgcaataagcaagatattgcaatggcaaaatcagcaaagttaattcaacagcagctggagaaagaactcaacaccttacgagttacccgttctgctgcccccagcacactggacagttccagcactgcccctgctcagctggggaagaaaggcaaagagtttgaattctcacagttgcccctcaaagtggagttcctggagtgcagtgccaagggtggaagaggggacgtgggctctgctgacatccaggacttggagaaatggctggctaaaattgcctgagaggcagctctaaagcacaagacctggatgtgtgacacacagttttggaaaaagagatactgaaactggtctggccattgctcccctcagacctgggaacatgactgaatgtttaaggatgacaagaagagagcagcgatagatagcaaggaggcctctgaccaagggaaactgctgccaacagctaccaagccaactagccttggatcacacaactgcagccatggtgctcatgattctgatgtcacaccttcatgttgatgtatgtatgatcacccagcaagttaggagtgatcagaaccaatgtgtttccacttgtaaataggctgtttgctttttccatcttacactcaactttcctgatgcctgcagaacaggagctttgttgataagcttttaagattcacccccttcactcccaccatccccaaaaaagaaggccaagaggatcctgctaatctgccaggtcacgtctagtctttggggagagggactgaattgctcaattgagaacatttcctcaaaggaatcctccaatttgccctctgctaacccatctggattcagcaaagatgcaatgctcttgctggggtgctgaggcaatgccatgacatcttcttcaagagcacctaacagtttattatggaaccttaactctgtgccaattctacctgcaagcaaggggacagggatggtgcctgctcaagacaaaaatcagggaaccaacaacttctgaaaaagaggtctggctgcctttccacaccccaggaagggaggggcggaaaccgcacgtgccgaagggagcgccatggaaccactgagatgggaggatgggaggaagccaccctcagcctcagaggccaaggggctggggagaacccaaactcaaagagaggatgttgtgtgcatgctaggaaaggcaggactcactaaggccatgtcaaaccaaatgctatcttttactgctcctctaggccaggatggaaacacagtccacggtgccttggatgtgtgtgcccctgagaagggaactgagtttctactgttttatgggatgtttttttaaaaaaaaaataatttgtgcagggaaaaataaaactaccaactgttaaaacataaaaa

SEQ ID NO: 296460 - DNA, 2066 bp, Homo sapiens
tgcttgagttcttcacaagtctcacgtcacttagcgacggtcgggaactcctcagtggtagtttcgggagccattcattcattttattcatttcatcattctttcaacagtcataacgtaggtgacgacgactgactcatctcttaaaagatgtgtgtgtccctcgacaaataacctgtctgcccctatcgttctgtaggaggacggagtcccagagaactacaactcccatcaagcacttgggggatcgccgcggctgagggagagactatggcttaggaaccaccattcgcgtgaggctctgctccccgcgcctgcgcagagtgcagggccacggtcgcttttgctgtaccggggaccacgcgtctcatccatggcttccgcggactcgcgccgggtggcagatggcggcggtgccgggggcaccttccagccctacctagacaccttgcggcaggagctgcagcagacggacccaacgctgttgtcagtagtggtggcggttcttgcggtgctgctgacgctagtcttctggaagttaatccggagcagaaggagcagtcagagagctgttcttcttgttggcctttgtgattccgggaaaacgttgctctttgtcaggttgttaacaggcctttatagagacactcagacgtccattactgacagctgtgctgtatacagagtcaacaataacaggggcaatagtctgaccttgattgaccttcccggccatgagagtttgaggcttcagttcttagagcggtttaagtcttcagccagggctattgtgttgttgtggatagtgcagcattccagcgagaggtgaaagatgtggctgagtttctgtatcaagtcctcattgacagtatgggtctgaagaatacaccatcattcttaatagcctgcaataagcaagatattgcaatggcaaaatcagcaaagttaattcaacagcagctggagaaagaactcaacaccttacgagttacccgttctgctgcccccagcacactggacagttccagcactgcccctgctcagctggggaagaaaggcaaagagtttgaattctcacagttgcccctcaaagtggagttcctggagtgcagtgccaagggtggaagaggggacgtgggctctgctgacatccaggacttggagaaatggctggctaaaattgcctgagaggcagctctaaagcacaagacctggatgtgtgacacacagttttggaaaaagagatactgaaactggtctggccattgctcccctcagacctgggaacatgactgaatgtttaaggatgacaagaagagagcagcgatagatagcaaggaggcctctgaccaagggaaactgctgccaacagctaccaagccaactagccttggatcacacaactgcagccatggtgctcatgattctgatgtcacaccttcatgttgatgtatgtatgatcacccagcaagttaggagtgatcagaaccaatgtgtttccacttgtaaataggctgtttgctttttccatcttacactcaactttcctgatgcctgcagaacaggagctttgttgataagcttttaagattcacccccttcactcccaccatccccaaaaaagaaggccaagaggatcctgctaatctgccaggtcacgtctagtctttggggagagggactgaattgctcaattgagaacatttcctcaaaggaatcctccaatttgccctctgctaacccatctggattcagcaaagatgcaatgctcttgctggggtgctgaggcaatgccatgacatcttcttcaagagcacctaacagtttattatggaaccttaactctgtgccaattctacctgcaagcaaggggacagggatggtgcctgctcaagacaaaaatcagggaaccaacaacttctgaaaaagaggtctggctgcctttccacaccccaggaagggaggggcggaaaccgcacgtgccgaagggagcgccatggaaccactgagatgggaggatgggagttaccaccataatcatagttaacgggggggtcctctagatc

SEQ ID NO: 296461 - DNA, 3058 bp, Homo sapiens
agctttgttttgagaattaggacagtttattgtttgaccaacatgctgagtcttttccacattttacacagtttaatgtgaaatcaacatggcggctatgtcttctgagcccataacagatggaattgccaccctctgtgctcctcacagccaatcactttaaagggatgggtgaggggaaagtgaggggagaagtggacacacaccgcgagatgcaggctggccttcaatgctatggaggcttcccacctcctgaaggaaccatctaaacccctgctgcaaggatttcctgatgaaaccacacactgctgggagtgccaaccagacaggggtctggagtccaaggagtttgcacattgagatcccaaggttttggaacacctaaatagttcatgtcaaacaaaaattcaaagggtgtcctgatctgtgtgggtgcccatgacaatcaatcagagtagacttggggactggcccttgtgcagtagaggagcccaaaataccaccaatattctcactcatatgctgggaagaacctagtgtcctaaccaaaaagagtagagatggtctgaggaacacacccacacacagcagtccttgctgtgtaataaatatggagtcacatttgttcacacacagggcagcaatggatgaaaaatggaaacttcactggttctgatcactcctaacttgctgggtgatcttaataagcaagttgcccttctccatcctggttttcctgcctgtagacaggaaaagttgtgacagctctgcttcacatagctgtaacaaggtgacaatgcctcacattctttggggagaggcagttcggaaacgagtgtgcgcacaatctgctcggttgatgcacacagacatccttctgttcagctgcccctcaagtggctcagacatgcctcactgtcctcggctacctggtcccatctcatcctgacatcctcacctgccttccatcttgtgaaggaatgaggctgctctacctgcaggatgctgaagccaggagggccatccctttattgtcacaactggtatcccagggcagggcctccccgcactggctagccaccaggatgatgcagacgttgcaccccagatgtgtctgcactcttaactaccaccatttcaatccttgtttctgttgccagagatactgaaactggtctggccattgctcccctcagacctgggaacatgactgaatgtttaaggatgacaagaagagagcagcgatagatagcaaggaggcctctgaccaagggaaactgctgccaacagctaccaagccaactagccttggatcacacaactgcagccatggtgctcatgattctgatgtcacaccttcatgttgatgtatgtatgatcacccagcaagttaggagtgatcagaaccaatgtgtttccacttgtaaataggctgtttgctttttccatcttacactcaactttcctgatgcctgcagaacaggagctttgttgataagcttttaagattcacccccttcactcccaccatccccaaaaaagaaggccaagaggatcctgctaatctgccaggtcacgtctagtctttggggagagggactgaattgctcaattgagaacatttcctcaaaggaatcctccaatttgccctctgctaacccatctggattcagcaaagatgcaatgctcttgctggggtgctgaggcaatgccatgacatcttcttcaagagcacctaacagtttattatggaaccttaactctgtgccaattctacctgcaagcaaggggacagggatggtgcctgctcaagacaaaaatcagggaaccaacaacttctgaaaaagaggtctggctgcctttccacaccccaggaagggaggggcggaaaccgcacgtgccgaagggagcgccatggaaccactgagatgggaggatgggaggaagccaccctcagcctcagaggccaaggggctggggagaacccaaactcaaagagaggatgttgtgtgcatgctaggaaaggcaggactcactaaggccatgtcaaaccaaatgctatcttttactgctcctctaggccaggatggaaacacagtccacggtgccttggatgtgtgtgcccctgagaagggaactgagtttctactgttttatgggatgtttttttaaaaaagctaatctttagtgccaagaaaataaaaatctaccatacgttcattcactgagacccagtgcagattcctgtaaatggggcggtctcagaggccacaggtgatggcccccgctgccaaccaggcaggacactgtcatgtggactcctgtaaattctctcgaggtaagtaagcactcttccaacaagcaccacttgggggtgtgcccatggtggggggacactggcccacacaggcatgcacacccgtgcatataaagtacatagagaaatggtggagatattcccgtgggctatgtttgcctgtagtttaacacaactatgcattattttattgatggcaagacaatcacaagttatttgacaatattaagtatttcttatttcaacacgttgcagtacttttgaatttccaaaacttatcacaatgcaagttccaacttgagagcaggagaaacaagaatatacattgagcacatgtatctccgtgaggatgtgtttgtggaaggtgtatacacaagtctatctctatatataattatgtacacacatataaaaactaaacacatgacatctgaaacacgttcaaacattggtccttgccttctgcaagaggtgctcagtgggatcctgcttcctctcttcttcacctgaagataaattccttgctagagatgagctctggcatacagcctcctaggcagagggtgtgtggcaggcccactgcacaaatatcagtcctgccagattctgctgcacttactgcctgccatttcagattaatttctgagaagtttcaaaattcattccaacgaccttgtggagttcagcccaccataccccagatggtcattcatcccatctatgacatgcccagcagcagcc

SEQ ID NO: 296462 - DNA, 2754 bp, Homo sapiens
agctttgttttgagaattaggacagtttattgtttgaccaacatgctgagtcttttccacattttacacagtttaatgtgaaatcaacatgtcaaacaaaaattcaaagggtgtcctgatctgtgtgggtgcccatgacaatcaatcagagtagacttggggactggcccttgtgcagtagaggagcccaaaataccaccaatattctcactcatatgctgggaagaacctagtgtcctaaccaaaaagagtagagatggtctgaggaacacacccacacacagcagtccttgctgtgtaataaatatggagtcacatttgttcacacacagggcagcaatggatgaaaaatggaaacttcactggttctgatcactcctaacttgctgggtgatcttaataagcaagttgcccttctccatcctggttttcctgcctgtagacaggaaaagttgtgacagctctgcttcacatagctgtaacaaggtgacaatgcctcacattctttggggagaggcagttcggaaacgagtgtgcgcacaatctgctcggttgatgcacacagacatccttctgttcagctgcccctcaagtggctcagacatgcctcactgtcctcggctacctggtcccatctcatcctgacatcctcacctgccttccatcttgtgaaggaatgaggctgctctacctgcaggatgctgaagccaggagggccatccctttattgtcacaactggtatcccagggcagggcctccccgcactggctagccaccaggatgatgcagacgttgcaccccagatgtgtctgcactcttaactaccaccatttcaatccttgtttctgttgccagagatactgaaactggtctggccattgctcccctcagacctgggaacatgactgaatgtttaaggatgacaagaagagagcagcgatagatagcaaggaggcctctgaccaagggaaactgctgccaacagctaccaagccaactagccttggatcacacaactgcagccatggtgctcatgattctgatgtcacaccttcatgttgatgtatgtatgatcacccagcaagttaggagtgatcagaaccaatgtgtttccacttgtaaataggctgtttgctttttccatcttacactcaactttcctgatgcctgcagaacaggagctttgttgataagcttttaagattcacccccttcactcccaccatccccaaaaaagaaggccaagaggatcctgctaatctgccaggtcacgtctagtctttggggagagggactgaattgctcaattgagaacatttcctcaaaggaatcctccaatttgccctctgctaacccatctggattcagcaaagatgcaatgctcttgctggggtgctgaggcaatgccatgacatcttcttcaagagcacctaacagtttattatggaaccttaactctgtgccaattctacctgcaagcaaggggacagggatggtgcctgctcaagacaaaaatcagggaaccaacaacttctgaaaaagaggtctggctgcctttccacaccccaggaagggaggggcggaaaccgcacgtgccgaagggagcgccatggaaccactgagatgggaggatgggaggaagccaccctcagcctcagaggccaaggggctggggagaacccaaactcaaagagaggatgttgtgtgcatgctaggaaaggcaggactcactaaggccatgtcaaaccaaatgctatcttttactgctcctctaggccaggatggaaacacagtccacggtgccttggatgtgtgtgcccctgagaagggaactgagtttctactgttttatgggatgtttttttaaaaaagctaatctttagtgccaagaaaataaaaatctaccatacgttcattcactgagacccagtgcagattcctgtaaatggggcggtctcagaggccacaggtgatggcccccgctgccaaccaggcaggacactgtcatgtggactcctgtaaattctctcgaggtaagtaagcactcttccaacaagcaccacttgggggtgtgcccatggtggggggacactggcccacacaggcatgcacacccgtgcatataaagtacatagagaaatggtggagatattcccgtgggctatgtttgcctgtagtttaacacaactatgcattattttattgatggcaagacaatcacaagttatttgacaatattaagtatttcttatttcaacacgttgcagtacttttgaatttccaaaacttatcacaatgcaagttccaacttgagagcaggagaaacaagaatatacattgagcacatgtatctccgtgaggatgtgtttgtggaaggtgtatacacaagtctatctctatatataattatgtacacacatataaaaactaaacacatgacatctgaaacacgttcaaacattggtccttgccttctgcaagaggtgctcagtgggatcctgcttcctctcttcttcacctgaagataaattccttgctagagatgagctctggcatacagcctcctaggcagagggtgtgtggcaggcccactgcacaaatatcagtcctgccagattctgctgcacttactgcctgccatttcagattaatttctgagaagtttcaaaattcattccaacgaccttgtggagttcagcccaccataccccagatggtcattcatcccatctatgacatgcccagcagcagcc

SEQ ID NO: 296463 - DNA, 2363 bp, Homo sapiens
gtgtcatcccccttcgtgtgtcatcccccttcgtggttttcctgcctgtagacaggaaaagttgtgacagctctgcttcacatagctgtaacaaggtgacaatgcctcacattctttggggagaggcagttcggaaacgagtgtgcgcacaatctgctcggttgatgcacacagacatccttctgttcagctgcccctcaagtggctcagacatgcctcactgtcctcggctacctggtcccatctcatcctgacatcctcacctgccttccatcttgtgaaggaatgaggctgctctacctgcaggatgctgaagccaggagggccatccctttattgtcacaactggtatcccagggcagggcctccccgcactggctagccaccaggatgatgcagacgttgcaccccagatgtgtctgcactcttaactaccaccatttcaatccttgtttctgttgccagagatactgaaactggtctggccattgctcccctcagacctgggaacatgactgaatgtttaaggatgacaagaagagagcagcgatagatagcaaggaggcctctgaccaagggaaactgctgccaacagctaccaagccaactagccttggatcacacaactgcagccatggtgctcatgattctgatgtcacaccttcatgttgatgtatgtatgatcacccagcaagttaggagtgatcagaaccaatgtgtttccacttgtaaataggctgtttgctttttccatcttacactcaactttcctgatgcctgcagaacaggagctttgttgataagcttttaagattcacccccttcactcccaccatccccaaaaaagaaggccaagaggatcctgctaatctgccaggtcacgtctagtctttggggagagggactgaattgctcaattgagaacatttcctcaaaggaatcctccaatttgccctctgctaacccatctggattcagcaaagatgcaatgctcttgctggggtgctgaggcaatgccatgacatcttcttcaagagcacctaacagtttattatggaaccttaactctgtgccaattctacctgcaagcaaggggacagggatggtgcctgctcaagacaaaaatcagggaaccaacaacttctgaaaaagaggtctggctgcctttccacaccccaggaagggaggggcggaaaccgcacgtgccgaagggagcgccatggaaccactgagatgggaggatgggaggaagccaccctcagcctcagaggccaaggggctggggagaacccaaactcaaagagaggatgttgtgtgcatgctaggaaaggcaggactcactaaggccatgtcaaaccaaatgctatcttttactgctcctctaggccaggatggaaacacagtccacggtgccttggatgtgtgtgcccctgagaagggaactgagtttctactgttttatgggatgtttttttaaaaaagctaatctttagtgccaagaaaataaaaatctaccatacgttcattcactgagacccagtgcagattcctgtaaatggggcggtctcagaggccacaggtgatggcccccgctgccaaccaggcaggacactgtcatgtggactcctgtaaattctctcgaggtaagtaagcactcttccaacaagcaccacttgggggtgtgcccatggtggggggacactggcccacacaggcatgcacacccgtgcatataaagtacatagagaaatggtggagatattcccgtgggctatgtttgcctgtagtttaacacaactatgcattattttattgatggcaagacaatcacaagttatttgacaatattaagtatttcttatttcaacacgttgcagtacttttgaatttccaaaacttatcacaatgcaagttccaacttgagagcaggagaaacaagaatatacattgagcacatgtatctccgtgaggatgtgtttgtggaaggtgtatacacaagtctatctctatatataattatgtacacacatataaaaactaaacacatgacatctgaaacacgttcaaacattggtccttgccttctgcaagaggtgctcagtgggatcctgcttcctctcttcttcacctgaagataaattccttgctagagatgagctctggcatacagcctcctaggcagagggtgtgtggcaggcccactgcacaaatatcagtcctgccagattctgctgcacttactgcctgccatttcagattaatttctgagaagtttcaaaattcattccaacgaccttgtggagttcagcccaccataccccagatggtcattcatcccatctatgacatgcccagcagcagcc

SEQ ID NO: 296464 - DNA, 2410 bp, Homo sapiens
aaataaaaatctaccatacgttcattcactgagacccagtgcagattcctgtaaatggggcggtctcagaggccacaggtgatggcccccgctgccaaccaggaaaagttgtgacagctctgcttcacatagctgtaacaaggtgacaatgcctcacattctttggggagaggcagttcggaaacgagtgtgcgcacaatctgctcggttgatgcacacagacatccttctgttcagctgcccctcaagtggctcagacatgcctcactgtcctcggctacctggtcccatctcatcctgacatcctcacctgccttccatcttgtgaaggaatgaggctgctctacctgcaggatgctgaagccaggagggccatccctttattgtcacaactggtatcccagggcagggcctccccgcactggctagccaccaggatgatgcagacgttgcaccccagatgtgtctgcactcttaactaccaccatttcaatccttgtttctgttgccagagatactgaaactggtctggccattgctcccctcagacctgggaacatgactgaatgtttaaggatgacaagaagagagcagcgatagatagcaaggaggcctctgaccaagggaaactgctgccaacagctaccaagccaactagccttggatcacacaactgcagccatggtgctcatgattctgatgtcacaccttcatgttgatgtatgtatgatcacccagcaagttaggagtgatcagaaccaatgtgtttccacttgtaaataggctgtttgctttttccatcttacactcaactttcctgatgcctgcagaacaggagctttgttgataagcttttaagattcacccccttcactcccaccatccccaaaaaagaaggccaagaggatcctgctaatctgccaggtcacgtctagtctttggggagagggactgaattgctcaattgagaacatttcctcaaaggaatcctccaatttgccctctgctaacccatctggattcagcaaagatgcaatgctcttgctggggtgctgaggcaatgccatgacatcttcttcaagagcacctaacagtttattatggaaccttaactctgtgccaattctacctgcaagcaaggggacagggatggtgcctgctcaagacaaaaatcagggaaccaacaacttctgaaaaagaggtctggctgcctttccacaccccaggaagggaggggcggaaaccgcacgtgccgaagggagcgccatggaaccactgagatgggaggatgggaggaagccaccctcagcctcagaggccaaggggctggggagaacccaaactcaaagagaggatgttgtgtgcatgctaggaaaggcaggactcactaaggccatgtcaaaccaaatgctatcttttactgctcctctaggccaggatggaaacacagtccacggtgccttggatgtgtgtgcccctgagaagggaactgagtttctactgttttatgggatgtttttttaaaaaagctaatctttagtgccaagaaaataaaaatctaccatacgttcattcactgagacccagtgcagattcctgtaaatggggcggtctcagaggccacaggtgatggcccccgctgccaaccaggcaggacactgtcatgtggactcctgtaaattctctcgaggtaagtaagcactcttccaacaagcaccacttgggggtgtgcccatggtggggggacactggcccacacaggcatgcacacccgtgcatataaagtacatagagaaatggtggagatattcccgtgggctatgtttgcctgtagtttaacacaactatgcattattttattgatggcaagacaatcacaagttatttgacaatattaagtatttcttatttcaacacgttgcagtacttttgaatttccaaaacttatcacaatgcaagttccaacttgagagcaggagaaacaagaatatacattgagcacatgtatctccgtgaggatgtgtttgtggaaggtgtatacacaagtctatctctatatataattatgtacacacatataaaaactaaacacatgacatctgaaacacgttcaaacattggtccttgccttctgcaagaggtgctcagtgggatcctgcttcctctcttcttcacctgaagataaattccttgctagagatgagctctggcatacagcctcctaggcagagggtgtgtggcaggcccactgcacaaatatcagtcctgccagattctgctgcacttactgcctgccatttcagattaatttctgagaagtttcaaaattcattccaacgaccttgtggagttcagcccaccataccccagatggtcattcatcccatctatgacatgcccagcagcagcc

SEQ ID NO: 296465 - DNA, 1421 bp, Homo sapiens
aaaggacggcgctcgcgatctagaacggacgcgtgggtcgacgatatcggggaatccggacgtctacataccggttctggtacaagatcgtctagtagtgtaccagttgggtctgaggtcactggttgtcaattgtctagtcctttgcgaatttctctgatttgtgggcacagttatgaagtttccccacatgtgaagacaggtacaaaatagcagagccaagcagacagtgggtctattcttcattagctcagtgacttgtccacactcgtcttagcacttacgtttcaaaagcttgtcacaaacccttggagtcattcccagataatagaactggaaatgataaatcccctaatgccaagggtctagtgtgttcttagtggttatactgggaagtgtgtggagatttaggtgctgctctgctgctctggatggctgaaggctcctgggccatcttcatgtgctgcttgaagagctcctattttgtactcctggctagaatgctgtggaacaaatacaaagtgaaaaaagttctctgtagatttctgaagtgcatattcattgatgccaagaaaaaaaaaaagttgcctttttgaagtgatgttttttgctgtcttcttaaacacaaggcttttttgaatgattagtatatttcatggtaaagaaaacagcctgtctggctcaaagcaattaaatagaatgtaatggtgagtacaaatgagtgcacatgtcaggactcaggtctaactccttgtctcctgagcctaaagattgcaacatacacaagaacacactcctattcctaccccacacactcagggacaagcccaactaaagcttacaaggagaccagggtggctctgtccaggggagaagccagttatggaacagtgcattgagagccatggtaggagaggcccacagttctctggagcatgcagcaggggcaccccacctggccttgaggatcagggggagtcaaaggataaagcatggggctgatgacgtctgagggagtgtgatcctccatgtatggcctctgcctgctgtctcacatgtcccttctggtggtcacttgggctctaggagtatacgtcacctcagaccatctggcagaaatactccaggctcctaccccaaagcacatgtcagccttgctgctggagcacgaagacaatgtaaatgaaacatgaaatggaggagttgtgagaccctgaccctgagtccttacttgaaagctgctgctggtgttctgagtgtcttttggactcttatttcttgcccttttccttattaggcaagcagtaacttaggaagtaggtaagagcaataaatgtgacatgttatgtcatcatagtaggagctcatgggaataaaagtcagtggcttgatgcttctgttagaggcatgtgtccctctca

SEQ ID NO: 296466 - DNA, 1631 bp, Homo sapiens
tctagaggagtctaggcgcacatttacactcaactttcctgatgcctgcagaacaggagctttgttgataagcttttaagattcacccccttcactcccaccatccccaaaaaagaaggccaagaggatcctgctaatctgccaggtcacgtctagtctttggggagagggactgaattgctcaattgagaacatttcctcaaaggaatcctccaatttgccctctgctaacccatctggattcagcaaagatgcaatgctcttgctggggtgctgaggcaatgccatgacatcttcttcaagagcacctaacagtttattatggaaccttaactctgtgccaattctacctgcaagcaaggggacagggatggtgcctgctcaagacaaaaatcagggaaccaacaacttctgaaaaagaggtctggctgcctttccacaccccaggaagggaggggcggaaaccgcacgtgccgaagggagcgccatggaaccactgagatgggaggatgggaggaagccaccctcagcctcagaggccaaggggctggggagaacccaaactcaaagagaggatgttgtgtgcatgctaggaaaggcaggactcactaaggccatgtcaaaccaaatgctatcttttactgctcctctaggccaggatggaaacacagtccacggtgccttggatgtgtgtgcccctgagaagggaactgagtttctactgttttatgggatgtttttttaaaaaagctaatctttagtgccaagaaaataaaaatctaccatacgttcattcactgagacccagtgcagattcctgtaaatggggcggtctcagaggccacaggtgatggcccccgctgccaaccaggcaggacactgtcatgtggactcctgtaaattctctcgaggtaagtaagcactcttccaacaagcaccacttgggggtgtgcccatggtggggggacactggcccacacaggcatgcacacccgtgcatataaagtacatagagaaatggtggagatattcccgtgggctatgtttgcctgtagtttaacacaactatgcattattttattgatggcaagacaatcacaagttatttgacaatattaagtatttcttatttcaacacgttgcagtacttttgaatttccaaaacttatcacaatgcaagttccaacttgagagcaggagaaacaagaatatacattgagcacatgtatctccgtgaggatgtgtttgtggaaggtgtatacacaagtctatctctatatataattatgtacacacatataaaaactaaacacatgacatctgaaacacgttcaaacattggtccttgccttctgcaagaggtgctcagtgggatcctgcttcctctcttcttcacctgaagataaattccttgctagagatgagctctggcatacagcctcctaggcagagggtgtgtggcaggcccactgcacaaatatcagtcctgccagattctgctgcacttactgcctgccatttcagattaatttctgagaagtttcaaaattcattccaacgaccttgtggagttcagcccaccataccccagatggtcattcatcccatctatgacatgcccagcagcagcc

SEQ ID NO: 296467 - DNA, 1523 bp, Homo sapiens
tgcttgagttcttcacaagtctcacgtcacttagcgacggtcgggaactcctcagtggtagtttcgggagccattcattcattttattcatttcatcattctttcaacagtcataacgtaggtgacgacgactgactcatctcttaaaagatgtgtgtgtccctcgacaaataacctgtctgcccctatcgttctgtaggaggacggagtcccagagaactacaactcccatcaagcacttgggggatcgccgcggctgagggagagactatggcttaggaaccaccattcgcgtgaggctctgctccccgcgcctgcgcagagtgcagggccacggtcgcttttgctgtaccggggaccacgcgtctcatccatggcttccgcggactcgcgccgggtggcagatggcggcggtgccgggggcaccttccagccctacctagacaccttgcggcaggagctgcagcagacggacccaacgctgttgtcagtagtggtggcggttcttgcggtgctgctgacgctagctctggatggctgaaggctcctgggccatcttcatgtgctgcttgaagagctcctattttgtactcctggctagaatgctgtggaacaaatacaaagtgaaaaaagttctctgtagatttctgaagtgcatattcattgatgccaagaaaaaaaaaaagttgcctttttgaagtgatgttttttgctgtcttcttaaacacaaggcttttttgaatgattagtatatttcatggtaaagaaaacagcctgtctggctcaaagcaattaaatagaatgtaatggtgagtacaaatgagtgcacatgtcaggactcaggtctaactccttgtctcctgagcctaaagattgcaacatacacaagaacacactcctattcctaccccacacactcagggacaagcccaactaaagcttacaaggagaccagggtggctctgtccaggggagaagccagttatggaacagtgcattgagagccatggtaggagaggcccacagttctctggagcatgcagcaggggcaccccacctggccttgaggatcagggggagtcaaaggataaagcatggggctgatgacgtctgagggagtgtgatcctccatgtatggcctctgcctgctgtctcacatgtcccttctggtggtcacttgggctctaggagtatacgtcacctcagaccatctggcagaaatactccaggctcctaccccaaagcacatgtcagccttgctgctggagcacgaagacaatgtaaatgaaacatgaaatggaggagttgtgagaccctgaccctgagtccttacttgaaagctgctgctggtgttctgagtgtcttttggactcttatttcttgcccttttccttattaggcaagcagtaacttaggaagtaggtaagagcaataaatgtgacatgttatgtcatcatagtaggagctcatgggaataaaagtcagtggcttgatgcttctgttagaggcatgtgtccctctca

SEQ ID NO: 296468 - DNA, 863 bp, Homo sapiens
gtcataacgtaggtgacgacgactgactcatctcttaaaagatgtgtgtgtccctcgacaaataacctgtctgcccctatcgttctgtaggaggacggagtcccagagaactacaactcccatcaagcacttgggggatcgccgcggctgagggagagactatggcttaggaaccaccattcgcgtgaggctctgctccccgcgcctgcgcagagtgcagggccacggtcgcttttgctgtaccggggaccacgcgtctcatccatggcttccgcggactcgcgccgggtggcagatggcggcggtgccgggggcaccttccagccctacctagacaccttgcggcaggagctgcagcagacggacccaacgctgttgtcagtagtggtggcggttcttgcggtgctgctgacgctaggtaaaaggcggccggtggtcatggcgggtttggggcgggcagaggtccgggctttggctgcaccgctgcaggccggggacgcggggctgagagggcgccttgagggcatcaggagggtgagacccacccagtctacaccccaccctctctcctgaagcagcggcagcagctgggcgttaagggggatgccgggcaacccccggagttaacgtcctggtccttggggcgcagattgctcttcgtcatctgccctgttacgcttgagcgcgctgttcctcgccttccgctgttctcactgcaaagactcagggtcttgacaccaactttcagcctcccgtgtttgcgtgcgggcgctgggataccaaggtagtgagatagcacctgagtcccagtcagagtaaggactgcaaagaaaagttgacagttgacagtgcctggctctcag

SEQ ID NO: 296469 - DNA, 1879 bp, Homo sapiens
accacagcgcgcttgcgcgcaggcccaagcaggcgcccacccagaggggagggaggacgccgtaccccgccctcactgaggcgcggagccggatccggaggcgccgagccgcatccggagccgcgcacgcgcaatctgcatgaacgaaggccagtgcttaaagacgtgccattcattgccagaactcggttctcattggagcggaggaagttcgtgggtggagctggttgtttggcgcctgcgtcttgcggcgagcgggctggcgtgcggcgccgttgcgggcgggagcggctgcaacgccggtgcctgaggagcgatgccgagggaaatcatcaccctacagttgggccagtgcggcaatcagattgggttcgagttctggaaacagctgtgcgccgagcatggtatcagccccgagggcatcgtggaggagttcgccaccgagggcactgaccgcaaggacgtctttttctaccaggcagacgatgagcactacatcccccgggccgtgctgctggacttggaaccccgggtgatccactccatcctcaactccccctatgccaagctctacaacccagagaacatctacctgtcggaacatggaggaggagctggcaacaactgggccagcggattctcccagggagaaaagatccatgaggacatttttgacatcatagaccgggaggcagatggtagtgacagtctagagggctttgtgctgtgtcactccattgctggggggacaggctctggactgggttcctacctcttagaacggctgaatgacaggtatcctaagaagctggtgcagacatactcagtgtttcccaaccaggacgagatgagcgatgtggtggtccagccttacaattcactcctcacactcaagaggctgacgcagaatgcagactgtgtggtggtgctggacaacacagccctgaaccggattgccacagaccgcctgcacatccagaacccatccttctcccagatcaaccagctggtgtctaccatcatgtcagccagcaccaccaccctgcgctaccctggctacatgaacaatgacctcatcggcctcatcgcctcgctcattcccaccccacggctccacttcctcatgaccggctacacccctctcactacggaccagtcagtggccagcgtgaggaagaccacggtcctggatgtcatgaggcggctgctgcagcccaagaacgtgatggtgtccacaggccgagaccgccagaccaaccactgctacatcgccatcctcaacatcatccagggagaggtggaccccacccaggtccacaagagcttgcagaggatccgggaacgcaagttggccaacttcatcccgtggggccccgccagcatccaggtggccctgtcgaggaagtctccctacctgccctcggcccaccgggtcagcgggctcatgatggccaaccacaccagcatctcctcgctcttcgagagaacctgtcgccagtatgacaagctgcgtaagcgggaggccttcctggagcagttccgcaaggaggacatgttcaaggacaactttgatgagatggacacatccagggagattgtgcagcagctcatcgatgagtaccatgcggccacacggccagactacatctcctggggcacccaggagcagtgagtcccccaggacagggaccctcatctgccttactggttggcccaagccctgcctgactgaccaccccctcagagcacagatcagggacctcacgcatctctttctcatatacatggactctctgttggcctgcaaacacatttacttctcctcttatgagactatttatctttaataaagcactggatataaatcaaaaaaaaaatc

SEQ ID NO: 296470 - DNA, 569 bp, Homo sapiens
ctggtacggtccgaaggtcctagatccgggaacgcaagttggccaacttcatcccgtggggccccgccagcatccaggtggccctgtcgaggaagtctccctacctgccctcggcccaccgggtcagcgggctcatgatggccaaccacaccagcatctcctcgctcttcgagagaacctgtcgccagtatgacaagctgcgtaagcgggaggccttcctggagcagttccgcaaggaggacatgttcaaggacaactttgatgagatggacacatccagggagattgtgcagcagctcatcgatgagtaccatgcggccacacggccagactacatctcctggggcacccaggagcagtgagtcccccaggacagggaccctcatctgccttactggttggcccaagccctgcctgactgaccaccccctcagagcacagatcagggacctcacgcatctctttctcatatacatggactctctgttggcctgcaaacacatttacttctcctcttatgagactatttatctttaataaagcactggatataaatcaaaaaaaaaatc

SEQ ID NO: 296471 - DNA, 1962 bp, Homo sapiens
accacagcgcgcttgcgcgcaggcccaagcaggcgcccacccagaggggagggaggacgccgtaccccgccctcactgaggcgcggagccggatccggaggcgccgagccgcatccggagccgcgcacgcgcaatctgcatgaacgaaggccagtgcttaaagacgtgccattcattgccagaactcggttctcattggagcggaggaagttcgtgggtggagctggttgtttggcgcctgcgtcttgcggcgagcgggctggcgtgcggcgccgttgcgggcgggagcggctgcaacgccggtgcctgaggagcgatgccgagggaaatcatcaccctacagttgggccagtgcggcaatcagattgggttcgagttctggaaacagctgtgcgccgagcatggtatcagccccgagggcatcgtggaggagttcgccaccgagggcactgaccgcaaggacgtctttttctaccaggcagacgatgagcactacatcccccgggccgtgctgctggacttggaaccccgggtgatccactccatcctcaactccccctatgccaagctctacaacccagagaacatctacctgtcggaacatggaggaggagctggcaacaactgggccagcggattctcccagggagaaaagatccatgaggacatttttgacatcatagaccgggaggcagatggtagtgacagtctagagggctttgtgctgtgtcactccattgctggggggacaggctctggactgggttcctacctcttagaacggctgaatgacaggtatcctaagaagctggtgcagacatactcagtgtttcccaaccaggacgagatgagcgatgtggtggtccagccttacaattcactcctcacactcaagaggctgacgcagaatgcagactgtgtggtggtgctggacaacacagccctgaaccggattgccacagaccgcctgcacatccagaacccatccttctcccagatcaaccagctggtgtctaccatcatgtcagccagcaccaccaccctgcgctaccctggctacatgaacaatgacctcatcggcctcatcgcctcgctcattcccaccccacggctccacttcctcatgaccggctacacccctctcactacggaccagtcagtggccagcgtgaggaagaccacggtcctggatgtcatgaggcggctgctgcagcccaagaacgtgatggtgtccacaggccgagaccgccagaccaaccactgctacatcgccatcctcaacatcatccagggagaggtggaccccacccaggtaggggaggccccttcatcccacaccctggacctgcaggggtagaggagaggccacctccactgctcctatgcccaccccaggtccacaagagcttgcagaggatccgggaacgcaagttggccaacttcatcccgtggggccccgccagcatccaggtggccctgtcgaggaagtctccctacctgccctcggcccaccgggtcagcgggctcatgatggccaaccacaccagcatctcctcgctcttcgagagaacctgtcgccagtatgacaagctgcgtaagcgggaggccttcctggagcagttccgcaaggaggacatgttcaaggacaactttgatgagatggacacatccagggagattgtgcagcagctcatcgatgagtaccatgcggccacacggccagactacatctcctggggcacccaggagcagtgagtcccccaggacagggaccctcatctgccttactggttggcccaagccctgcctgactgaccaccccctcagagcacagatcagggacctcacgcatctctttctcatatacatggactctctgttggcctgcaaacacatttacttctcctcttatgagactatttatctttaataaagcactggatataaatcaaaaaaaaaatc

SEQ ID NO: 296472 - DNA, 1814 bp, Homo sapiens
accacagcgcgcttgcgcgcaggcccaagcaggcgcccacccagaggggagggaggacgccgtaccccgccctcactgaggcgcggagccggatccggaggcgccgagccgcatccggagccgcgcacgcgcaatctgcatgaacgaaggccagtgcttaaagacgtgccattcattgccagaactcggttctcattggagcggaggaagttcgtgggtggagctggttgtttggcgcctgcgtcttgcggcgagcgggctggcgtgcggcgccgttgcgggcgggagcggctgcaacgccggtgcctgaggagcgatgccgagggaaatcatcaccctacagttgggccagtgcggcaatcagattgggttcgagttctggaaacagctgtgcgccgagcatggtatcagccccgagggcatcgtggaggagttcgccaccgagggcactgaccgcaaggacgtctttttctaccaggcagacgatgagcactacatcccccgggccgtgctgctggacttggaaccccgggtgatccactccatcctcaactccccctatgccaagctctacaacccagagaacatctacctgtcggaacatggaggaggagctggcaacaactgggccagcggattctcccagggagaaaagatccatgaggacatttttgacatcatagaccgggaggcagatggtagtgacagtctagagggctttgtgctgtgtcactccattgctggggggacaggctctggactgggttcctacctcttagaacggctgaatgacaggtatcctaagaagctggtgcagacatactcagtgtttcccaaccaggacgagatgagcgatgtggtggtccagccttacaattcactcctcacactcaagaggctgacgcagaatgcagactgtgtggtggtgctggacaacacagccctgaaccggattgccacagaccgcctgcacatccagaacccatccttctcccagatcaaccagctggtgtctaccatcatgtcagccagcaccaccaccctgcgctaccctggctacatgaacaatgacctctgtctcactgtcctatcaggtggccagcgtgaggaagaccacggtcctggatgtcatgaggcggctgctgcagcccaagaacgtgatggtgtccacaggccgagaccgccagaccaaccactgctacatcgccatcctcaacatcatccagggagaggtggaccccacccaggtccacaagagcttgcagaggatccgggaacgcaagttggccaacttcatcccgtggggccccgccagcatccaggtggccctgtcgaggaagtctccctacctgccctcggcccaccgggtcagcgggctcatgatggccaaccacaccagcatctcctcgctcttcgagagaacctgtcgccagtatgacaagctgcgtaagcgggaggccttcctggagcagttccgcaaggaggacatgttcaaggacaactttgatgagatggacacatccagggagattgtgcagcagctcatcgatgagtaccatgcggccacacggccagactacatctcctggggcacccaggagcagtgagtcccccaggacagggaccctcatctgccttactggttggcccaagccctgcctgactgaccaccccctcagagcacagatcagggacctcacgcatctctttctcatatacatggactctctgttggcctgcaaacacatttacttctcctcttatgagactatttatctttaataaagcactggatataaatcaaaaaaaaaatc

SEQ ID NO: 296473 - DNA, 1763 bp, Homo sapiens
accacagcgcgcttgcgcgcaggcccaagcaggcgcccacccagaggggagggaggacgccgtaccccgccctcactgaggcgcggagccggatccggaggcgccgagccgcatccggagccgcgcacgcgcaatctgcatgaacgaaggccagtgcttaaagacgtgccattcattgccagaactcggttctcattggagcggaggaagttcgtgggtggagctggttgtttggcgcctgcgtcttgcggcgagcgggctggcgtgcggcgccgttgcgggcgggagcggctgcaacgccggtgcctgaggagcgatgccgagggaaatcatcaccctacagttgggccagtgcggcaatcagattgggttcgagttctggaaacagctgtgcgccgagcatggtatcagccccgagggcatcgtggaggagttcgccaccgagggcactgaccgcaaggacgtctttttctaccaggcagacgatgagcactacatcccccgggccgtgctgctggacttggaaccccgggtgatccactccatcctcaactccccctatgccaagctctacaacccagagaacatctacctgtcggaacatggaggaggagctggcaacaactgggccagcggattctcccagggagaaaagatccatgaggacatttttgacatcatagaccgggaggcagatggtagtgacagtctagagggctttgtgctgtgtcactccattgctggggggacaggctctggactgggttcctacctcttagaacggctgaatgacaggtatcctaagaagctggtgcagacatactcagtgtttcccaaccaggacgagatgagcgatgtggtggtccagccttacaattcactcctcacactcaagaggctgacgcagaatgcagactgtgtggtggtgctggacaacacagccctgaaccggattgccacagaccgcctgcacatccagaacccatccttctcccagatcaaccagctggtgtctaccatcatgtcagccagcaccaccaccctgcgctaccctggctacatgaacaatgacctcatcggcctcatcgcctcgctcattcccaccccacggctccacttcctcatgaccggctacacccctctcactacggaccagtcagtggccagcgtgaggaagaccacggtcctggatgtcatgaggcggctgctgcagcccaagaacgtgatggtgtccacaggccgagaccgccagaccaaccactgctacatcgccatcctcaacatcatccagggagaggtggaccccacccaggtccacaagagcttgcagaggatccgggaacgcaagttggccaacttcatcccgtggggccccgccagcatccaggtggccctgtcgaggaagtctccctacctgccctcggcccaccgggtcagcgggctcatgatggccaaccacaccagcatctcctcgctcttcgagagaacctgtcgccagtatgacaagctgcgtaagcgggaggccttcctggagcagttccgcaaggaggacatgttcaaggacaactttgatgagatggacacatccagggagattgtgcagcagctcatcgatgagtaccatgcggccacacggccagactacatctcctggggcacccaggagcagtgagtcccccaggacagggaccctcatctgccttactggttggcccaagccgctgatctgtgctctgagggggtggtcagtcaggcagggcgtc

SEQ ID NO: 296474 - DNA, 1856 bp, Homo sapiens
accacagcgcgcttgcgcgcaggcccaagcaggcgcccacccagaggggagggaggacgccgtaccccgccctcactgaggcgcggagccggatccggaggcgccgagccgcatccggagccgcgcacgcgcaatctgcatgaacgaaggccagtgcttaaagacgtgccattcattgccagaactcggttctcattggagcggaggaagttcgtgggtggagctggttgtttggcgcctgcgtcttgcggcgagcgggctggcgtgcggcgccgttgcgggcgggagcggctgcaacgccggtgcctgaggagcgatgccgagggaaatcatcaccctacagttgggccagtgcggcaatcagattgggttcgagttctggaaacagctgtgcgccgagcatggtatcagccccgagggcatcgtggaggagttcgccaccgagggcactgaccgcaaggacgtctttttctaccaggcagacgatgagcactacatcccccgggccgtgctgctggacttggaaccccgggtgatccactccatcctcaactccccctatgccaagctctacaacccagagaacatctacctgtcggaacatggaggaggagctggcaacaactgggccagcggattctcccagggagaaaagatccatgaggacatttttgacatcatagaccgggaggcagatggtagtgacagtctagagggctttgtgctgtgtcactccattgctggggggacaggctctggactgggttcctacctcttagaacggctgaatgacaggtatcctaagaagctggtgcagacatactcagtgtttcccaaccaggacgagatgagcgatgtggtggtccagccttacaattcactcctcacactcaagaggctgacgcagaatgcagactgtgtggtggtgctggacaacacagccctgaaccggattgccacagaccgcctgcacatccagaacccatccttctcccagatcaaccagctgcaccaccaccctgcgctaccctggctacatgaacaatgacctcatcggcctcatcgcctcgctcattcccaccccacggctccacttcctcatgaccggctacacccctctcactacggaccagtcagtggccagcgtgaggaagaccacggtcctggatgtcatgaggcggctgctgcagcccaagaacgtgatggtgtccacaggccgagaccgccagaccaaccactgctacatcgccatcctcaacatcatccagggagaggtggaccccacccaggtccacaagagcttgcagaggatccgggaacgcaagttggccaacttcatcccgtggggccccgccagcatccaggtggccctgtcgaggaagtctccctacctgccctcggcccaccgggtcagcgggctcatgatggccaaccacaccagcatctcctcgctcttcgagagaacctgtcgccagtatgacaagctgcgtaagcgggaggccttcctggagcagttccgcaaggaggacatgttcaaggacaactttgatgagatggacacatccagggagattgtgcagcagctcatcgatgagtaccatgcggccacacggccagactacatctcctggggcacccaggagcagtgagtcccccaggacagggaccctcatctgccttactggttggcccaagccctgcctgactgaccaccccctcagagcacagatcagggacctcacgcatctctttctcatatacatggactctctgttggcctgcaaacacatttacttctcctcttatgagactatttatctttaataaagcactggatataaatcaaaaaaaaaatc

SEQ ID NO: 296475 - DNA, 1541 bp, Homo sapiens
cctaaagtggggcaattggggatcagattgggttcgagttctggaaacagctgtgcgccgagcatggtatcagccccgagggcatcgtggaggagttcgccaccgagggcactgaccgcaaggacgtctttttctaccaggcagacgatgagcactacatcccccgggccgtgctgctggacttggaaccccgggtgatccactccatcctcaactccccctatgccaagctctacaacccagagaacatctacctgtcggaacatggaggaggagctggcaacaactgggccagcggattctcccagggagaaaagatccatgaggacatttttgacatcatagaccgggaggcagatggtagtgacagtctagagggctttgtgctgtgtcactccattgctggggggacaggctctggactgggttcctacctcttagaacggctgaatgacaggtatcctaagaagctggtgcagacatactcagtgtttcccaaccaggacgagatgagcgatgtggtggtccagccttacaattcactcctcacactcaagaggctgacgcagaatgcagactgtgtggtggtgctggacaacacagccctgaaccggattgccacagaccgcctgcacatccagaacccatccttctcccagatcaaccagctggtgtctaccatcatgtcagccagcaccaccaccctgcgctaccctggctacatgaacaatgacctcatcggcctcatcgcctcgctcattcccaccccacggctccacttcctcatgaccggctacacccctctcactacggaccagtcagtggccagcgtgaggaagaccacggtcctggatgtcatgaggcggctgctgcagcccaagaacgtgatggtgtccacaggccgagaccgccagaccaaccactgctacatcgccatcctcaacatcatccagggagaggtggaccccacccaggtccacaagagcttgcagaggatccgggaacgcaagttggccaacttcatcccgtggggccccgccagcatccaggtggccctgtcgaggaagtctccctacctgccctcggcccaccgggtcagcgggctcatgatggccaaccacaccagcatctcctcgctcttcgagagaacctgtcgccagtatgacaagctgcgtaagcgggaggccttcctggagcagttccgcaaggaggacatgttcaaggacaactttgatgagatggacacatccagggagattgtgcagcagctcatcgatgagtaccatgcggccacacggccagactacatctcctggggcacccaggagcagtgagtcccccaggacagggaccctcatctgccttactggttggcccaagccctgcctgactgaccaccccctcagagcacagatcagggacctcacgcatctctttctcatatacatggactctctgttggcctgcaaacacatttacttctcctcttatgagactatttatctttaataaagcactggatataaatcaaaaaaaaaatc

SEQ ID NO: 296476 - DNA, 1918 bp, Homo sapiens
accacagcgcgcttgcgcgcaggcccaagcaggcgcccacccagaggggagggaggacgccgtaccccgccctcactgaggcgcggagccggatccggaggcgccgagccgcatccggagccgcgcacgcgcaatctgcatgaacgaaggccagtgcttaaagacgtgccattcattgccagaactcggttctcattggagcggaggaagttcgtgggtggagctggttgtttggcgcctgcgtcttgcggcgagcgggctggcgtgcggcgccgttgcgggcgggagcggctgcaacgccggtgcctgaggagcgatgccgagggaaatcatcaccctacagttgggccagtgcggcaatcagattgggttcgagttctggaaacagctgtgcgccgagcatggtatcagccccgagggcatcgtggaggagttcgccaccgagggcactgaccgcaaggacgtctttttctaccaggcagacgatgagcactacatcccccgggccgtgctgctggacttggaaccccgggtgatccactccatcctcaactccccctatgccaagctctacaacccagagaacatctacctgtcggaacatggaggaggagctggcaacaactgggccagcggattctcccaggtcgtttcctattccctggcagggcccacaactcgctggggagaaaagatccatgaggacatttttgacatcatagaccgggaggcagatggtagtgacagtctagagggctttgtgctgtgtcactccattgctggggggacaggctctggactgggttcctacctcttagaacggctgaatgacaggtatcctaagaagctggtgcagacatactcagtgtttcccaaccaggacgagatgagcgatgtggtggtccagccttacaattcactcctcacactcaagaggctgacgcagaatgcagactgtgtggtggtgctggacaacacagccctgaaccggattgccacagaccgcctgcacatccagaacccatccttctcccagatcaaccagctggtgtctaccatcatgtcagccagcaccaccaccctgcgctaccctggctacatgaacaatgacctcatcggcctcatcgcctcgctcattcccaccccacggctccacttcctcatgaccggctacacccctctcactacggaccagtcagtggccagcgtgaggaagaccacggtcctggatgtcatgaggcggctgctgcagcccaagaacgtgatggtgtccacaggccgagaccgccagaccaaccactgctacatcgccatcctcaacatcatccagggagaggtggaccccacccaggtccacaagagcttgcagaggatccgggaacgcaagttggccaacttcatcccgtggggccccgccagcatccaggtggccctgtcgaggaagtctccctacctgccctcggcccaccgggtcagcgggctcatgatggccaaccacaccagcatctcctcgctcttcgagagaacctgtcgccagtatgacaagctgcgtaagcgggaggccttcctggagcagttccgcaaggaggacatgttcaaggacaactttgatgagatggacacatccagggagattgtgcagcagctcatcgatgagtaccatgcggccacacggccagactacatctcctggggcacccaggagcagtgagtcccccaggacagggaccctcatctgccttactggttggcccaagccctgcctgactgaccaccccctcagagcacagatcagggacctcacgcatctctttctcatatacatggactctctgttggcctgcaaacacatttacttctcctcttatgagactatttatctttaataaagcactggatataaatcaaaaaaaaaatc

SEQ ID NO: 296477 - DNA, 1404 bp, Homo sapiens
cctgggagaatccgctggcccagttgttgccagctcctcctccatgttccgacaggtagatgttctctgggttgtagagcttggcatagggggagttgaggatggagtggatcacccggggttccaagtccagcagcacggcccgggggatgtagtgctcatcgtctgcctggagaaaagatccatgaggacatttttgacatcatagaccgggaggcagatggtagtgacagtctagagggctttgtgctgtgtcactccattgctggggggacaggctctggactgggttcctacctcttagaacggctgaatgacaggtatcctaagaagctggtgcagacatactcagtgtttcccaaccaggacgagatgagcgatgtggtggtccagccttacaattcactcctcacactcaagaggctgacgcagaatgcagactgtgtggtggtgctggacaacacagccctgaaccggattgccacagaccgcctgcacatccagaacccatccttctcccagatcaaccagctggtgtctaccatcatgtcagccagcaccaccaccctgcgctaccctggctacatgaacaatgacctcatcggcctcatcgcctcgctcattcccaccccacggctccacttcctcatgaccggctacacccctctcactacggaccagtcagtggccagcgtgaggaagaccacggtcctggatgtcatgaggcggctgctgcagcccaagaacgtgatggtgtccacaggccgagaccgccagaccaaccactgctacatcgccatcctcaacatcatccagggagaggtggaccccacccaggtccacaagagcttgcagaggatccgggaacgcaagttggccaacttcatcccgtggggccccgccagcatccaggtggccctgtcgaggaagtctccctacctgccctcggcccaccgggtcagcgggctcatgatggccaaccacaccagcatctcctcgctcttcgagagaacctgtcgccagtatgacaagctgcgtaagcgggaggccttcctggagcagttccgcaaggaggacatgttcaaggacaactttgatgagatggacacatccagggagattgtgcagcagctcatcgatgagtaccatgcggccacacggccagactacatctcctggggcacccaggagcagtgagtcccccaggacagggaccctcatctgccttactggttggcccaagccctgcctgactgaccaccccctcagagcacagatcagggacctcacgcatctctttctcatatacatggactctctgttggcctgcaaacacatttacttctcctcttatgagactatttatctttaataaagcactggatataaatcaaaaaaaaaatc

SEQ ID NO: 296478 - DNA, 1238 bp, Homo sapiens
ggcctttttaaatgaccccaggcgggggtattgacatcatagaccgggaggcagatggtagtgacagtctagagggctttgtgctgtgtcactccattgctggggggacaggctctggactgggttcctacctcttagaacggctgaatgacaggtatcctaagaagctggtgcagacatactcagtgtttcccaaccaggacgagatgagcgatgtggtggtccagccttacaattcactcctcacactcaagaggctgacgcagaatgcagactgtgtggtggtgctggacaacacagccctgaaccggattgccacagaccgcctgcacatccagaacccatccttctcccagatcaaccagctggtgtctaccatcatgtcagccagcaccaccaccctgcgctaccctggctacatgaacaatgacctcatcggcctcatcgcctcgctcattcccaccccacggctccacttcctcatgaccggctacacccctctcactacggaccagtcagtggccagcgtgaggaagaccacggtcctggatgtcatgaggcggctgctgcagcccaagaacgtgatggtgtccacaggccgagaccgccagaccaaccactgctacatcgccatcctcaacatcatccagggagaggtggaccccacccaggtccacaagagcttgcagaggatccgggaacgcaagttggccaacttcatcccgtggggccccgccagcatccaggtggccctgtcgaggaagtctccctacctgccctcggcccaccgggtcagcgggctcatgatggccaaccacaccagcatctcctcgctcttcgagagaacctgtcgccagtatgacaagctgcgtaagcgggaggccttcctggagcagttccgcaaggaggacatgttcaaggacaactttgatgagatggacacatccagggagattgtgcagcagctcatcgatgagtaccatgcggccacacggccagactacatctcctggggcacccaggagcagtgagtcccccaggacagggaccctcatctgccttactggttggcccaagccctgcctgactgaccaccccctcagagcacagatcagggacctcacgcatctctttctcatatacatggactctctgttggcctgcaaacacatttacttctcctcttatgagactatttatctttaataaagcactggatataaatcaaaaaaaaaatc

SEQ ID NO: 296479 - DNA, 1753 bp, Homo sapiens
accacagcgcgcttgcgcgcaggcccaagcaggcgcccacccagaggggagggaggacgccgtaccccgccctcactgaggcgcggagccggatccggaggcgccgagccgcatccggagccgcgcacgcgcaatctgcatgaacgaaggccagtgcttaaagacgtgccattcattgccagaactcggttctcattggagcggaggaagttcgtgggtggagctggttgtttggcgcctgcgtcttgcggcgagcgggctggcgtgcggcgccgttgcgggcgggagcggctgcaacgccggtgcctgaggagcgatgccgagggaaatcatcaccctacagttgggccagtgcggcaatcagattgggttcgagttctggaaacagctgtgcgccgagcatggtatcagccccgagggcatcgtggaggagttcgccaccgagggcactgaccgcaaggacgtctttttctaccaggcagacgatgagcactacatcccccgggccgtgctgctggacttggaaccccgggtgatccactccatcctcaactccccctatgccaagctctacaacccagagaacatctacctgtcggaacatggaggaggagctggcaacaactgggccagcggattctcccagggagaaaagatccatgaggacatttttgacatcatagaccgggaggcagatggtagtgacagtctagaggacgagatgagcgatgtggtggtccagccttacaattcactcctcacactcaagaggctgacgcagaatgcagactgtgtggtggtgctggacaacacagccctgaaccggattgccacagaccgcctgcacatccagaacccatccttctcccagatcaaccagctggtgtctaccatcatgtcagccagcaccaccaccctgcgctaccctggctacatgaacaatgacctcatcggcctcatcgcctcgctcattcccaccccacggctccacttcctcatgaccggctacacccctctcactacggaccagtcagtggccagcgtgaggaagaccacggtcctggatgtcatgaggcggctgctgcagcccaagaacgtgatggtgtccacaggccgagaccgccagaccaaccactgctacatcgccatcctcaacatcatccagggagaggtggaccccacccaggtccacaagagcttgcagaggatccgggaacgcaagttggccaacttcatcccgtggggccccgccagcatccaggtggccctgtcgaggaagtctccctacctgccctcggcccaccgggtcagcgggctcatgatggccaaccacaccagcatctcctcgctcttcgagagaacctgtcgccagtatgacaagctgcgtaagcgggaggccttcctggagcagttccgcaaggaggacatgttcaaggacaactttgatgagatggacacatccagggagattgtgcagcagctcatcgatgagtaccatgcggccacacggccagactacatctcctggggcacccaggagcagtgagtcccccaggacagggaccctcatctgccttactggttggcccaagccctgcctgactgaccaccccctcagagcacagatcagggacctcacgcatctctttctcatatacatggactctctgttggcctgcaaacacatttacttctcctcttatgagactatttatctttaataaagcactggatataaatcaaaaaaaaaatc

SEQ ID NO: 296480 - DNA, 1214 bp, Homo sapiens
cggtcccgacaaggatggggtgggaggcagatggtagtgacagtctagagggctttgtgctgtgtcactccattgctggggggacaggctctggactgggttcctacctcttagaacggctgaatgacaggtatcctaagaagctggtgcagacatactcagtgtttcccaaccaggacgagatgagcgatgtggtggtccagccttacaattcactcctcacactcaagaggctgacgcagaatgcagactgtgtggtggtgctggacaacacagccctgaaccggattgccacagaccgcctgcacatccagaacccatccttctcccagatcaaccagctggtgtctaccatcatgtcagccagcaccaccaccctgcgctaccctggctacatgaacaatgacctcatcggcctcatcgcctcgctcattcccaccccacggctccacttcctcatgaccggctacacccctctcactacggaccagtcagtggccagcgtgaggaagaccacggtcctggatgtcatgaggcggctgctgcagcccaagaacgtgatggtgtccacaggccgagaccgccagaccaaccactgctacatcgccatcctcaacatcatccagggagaggtggaccccacccaggtccacaagagcttgcagaggatccgggaacgcaagttggccaacttcatcccgtggggccccgccagcatccaggtggccctgtcgaggaagtctccctacctgccctcggcccaccgggtcagcgggctcatgatggccaaccacaccagcatctcctcgctcttcgagagaacctgtcgccagtatgacaagctgcgtaagcgggaggccttcctggagcagttccgcaaggaggacatgttcaaggacaactttgatgagatggacacatccagggagattgtgcagcagctcatcgatgagtaccatgcggccacacggccagactacatctcctggggcacccaggagcagtgagtcccccaggacagggaccctcatctgccttactggttggcccaagccctgcctgactgaccaccccctcagagcacagatcagggacctcacgcatctctttctcatatacatggactctctgttggcctgcaaacacatttacttctcctcttatgagactatttatctttaataaagcactggatataaatcaaaaaaaaaatc

SEQ ID NO: 296481 - DNA, 1388 bp, Homo sapiens
  misc_feature (1365)..(1365): n is a, c, g, or t
accacagcgcgcttgcgcgcaggcccaagcaggcgcccacccagaggggagggaggacgccgtaccccgccctcactgaggcgcggagccggatccggaggcgccgagccgcatccggagccgcgcacgcgcaatctgcatgaacgaaggccagtgcttaaagacgtgccattcattgccagaactcggttctcattggagcggaggaagttcgtgggtggagctggttgtttggcgcctgcgtcttgcggcgagcgggctggcgtgcggcgccgttgcgggcgggagcggctgcaacgccggtgcctgaggagcgatgccgagggaaatcatcaccctacagttgggccagtgcggcaatcagattgggttcgagttctggaaacagctgtgcgccgagcatggtatcagccccgagggcatcgtggaggagttcgccaccgagggcactgaccgcaaggacgtctttttctaccaggcagacgatgagcactacatcccccgggccgtgctgctggacttggaaccccgggtgatccactccatcctcaactccccctatgccaagctctacaacccagagaacatctacctgtcggaacatggaggaggagctggcaacaactgggccagcggattctcccagggagaaaagatccatgaggacatttttgacatcatagaccgggaggcagatggtagtgacagtctagagggctttgtgctgtgtcactccattgctggggggacaggctctggactgggttcctacctcttagaacggctgaatgacaggtatcctaagaagctggtgcagacatactcagtgtttcccaaccaggacgagatgagcgatgtggtggtccagccttacaattcactcctcacactcaagaggctgacgcagaatgcagactgtgtggtggtgctggacaacacagccctgaaccggattgccacagaccgcctgcacatccagaacccatccttctcccagatcaaccagctggtgtctaccatcatgtcagccagcaccaccaccctgcgctaccctggctacatgaacaatgacctcatcggcctcatcgcctcgctcattcccaccccacggctccacttcctcatgaccggctacacccctctcactacggaccagtcagtaagagcagccttcagtgtcccaggccaggccggccctgggcccaacaggccctgaacgagccaaccttgaagggagcccaaaaggatggtcagttccatgaggacagggccctcattcctcttgtgcactctgtccccagccacagcaatgaaggaacaaatgcagagaaagagagagggagggaggaaggcaggtagcgtggnttctcccagtagggatggccctg

SEQ ID NO: 296482 - DNA, 1135 bp, Homo sapiens
accacagcgcgcttgcgcgcaggcccaagcaggcgcccacccagaggggagggaggacgccgtaccccgccctcactgaggcgcggagccggatccggaggcgccgagccgcatccggagccgcgcacgcgcaatctgcatgaacgaaggccagtgcttaaagacgtgccattcattgccagaactcggttctcattggagcggaggaagttcgtgggtggagctggttgtttggcgcctgcgtcttgcggcgagcgggctggcgtgcggcgccgttgcgggcgggagcggctgcaacgccggtgcctgaggagcgatgccgagggaaatcatcaccctacagttgggccagtgcggcaatcagattgggttcgagttctggaaacagctgtgcgccgagcatggtatcagccccgagggcatcgtggaggagttcgccaccgagggcactgaccgcaaggacgtctttttctaccaggcagacgatgagcactacatcccccgggccgtgctgctggacttggaaccccgggtgatccactccatcctcaactccccctatgccaagctctacaacccagagaacatctacctgtcggaacatggaggaggagctggcaacaactgggccagcggattctcccagggagaaaagatccatgaggacatttttgacatcatagaccgggaggcagatggtagtgacagtctagagggctttgtgctgtgtcactccattgctggggggacaggctctggactgggttcctacctcttagaacggctgaatgacaggtatcctaagaagctggtgcagacatactcagtgtttcccaaccaggacgagatgagcgatgtggtggtccagccttacaattcactcctcacactcaagaggctgacgcagaatgcagactgtgtggtggtgctggacaacacagccctgaaccggattgccacagaccgcctgcacatccagaacccatccttctcccagatcaaccagctggtgtctaccatcatgtcagccagcaccaccaccctgcgctaccctggctacatgaacaatgacctcatcggcctcatcgcctcgctcattcccaccccgtacatgcaaggggtacggagctcgaat

SEQ ID NO: 296483 - DNA, 1366 bp, Homo sapiens
accacagcgcgcttgcgcgcaggcccaagcaggcgcccacccagaggggagggaggacgccgtaccccgccctcactgaggcgcggagccggatccggaggcgccgagccgcatccggagccgcgcacgcgcaatctgcatgaacgaaggccagtgcttaaagacgtgccattcattgccagaactcggttctcattggagcggaggaagttcgtgggtggagctggttgtttggcgcctgcgtcttgcggcgagcgggctggcgtgcggcgccgttgcgggcgggagcggctgcaacgccggtgcctgaggagcgatgccgagggaaatcatcaccctacagttgggccagtgcggcaatcagattgggttcgagttctggaaacagctgtgcgccgagcatggtatcagccccgagggcatcgtggaggagttcgccaccgagggcactgaccgcaaggacgtctttttctaccaggcagacgatgagcactacatcccccgggccgtgctgctggacaccaccaccctgcgctaccctggctacatgaacaatgacctcatcggcctcatcgcctcgctcattcccaccccacggctccacttcctcatgaccggctacacccctctcactacggaccagtcagtggccagcgtgaggaagaccacggtcctggatgtcatgaggcggctgctgcagcccaagaacgtgatggtgtccacaggccgagaccgccagaccaaccactgctacatcgccatcctcaacatcatccagggagaggtggaccccacccaggtccacaagagcttgcagaggatccgggaacgcaagttggccaacttcatcccgtggggccccgccagcatccaggtggccctgtcgaggaagtctccctacctgccctcggcccaccgggtcagcgggctcatgatggccaaccacaccagcatctcctcgctcttcgagagaacctgtcgccagtatgacaagctgcgtaagcgggaggccttcctggagcagttccgcaaggaggacatgttcaaggacaactttgatgagatggacacatccagggagattgtgcagcagctcatcgatgagtaccatgcggccacacggccagactacatctcctggggcacccaggagcagtgagtcccccaggacagggaccctcatctgccttactggttggcccaagccctgcctgactgaccaccccctcagagcacagatcagggacctcacgcatctctttctcatatacatggactctctgttggcctgcaaacacatttacttctcctcttatgagactatttatctttaataaagcactggatataaatcaaaaaaaaaatc

SEQ ID NO: 296484 - DNA, 1222 bp, Homo sapiens
accacagcgcgcttgcgcgcaggcccaagcaggcgcccacccagaggggagggaggacgccgtaccccgccctcactgaggcgcggagccggatccggaggcgccgagccgcatccggagccgcgcacgcgcaatctgcatgaacgaaggccagtgcttaaagacgtgccattcattgccagaactcggttctcattggagcggaggaagttcgtgggtggagctggttgtttggcgcctgcgtcttgcggcgagcgggctggcgtgcggcgccgttgcgggcgggagcggctgcaacgccggtgcctgaggagcgatgccgagggaaatcatcaccctacagttgggccagtgcggcaatcagattgggttcgagttctggaaacagctgtgcgccgagcatggtatcagccccgagggcatcgtggaggagttcgccaccgagggcactgaccgcaaggacgtctttttctaccaggcagacgatgagcactacatcccccgggccgtgctgctggacttggaaccccgggtgatccactccatcctcaactccccctatgccaagctctacaacccagagaacatctacctgtcggaacatggaggaggagctggcaacaactgggccagcggattctcccagggagaaaagatccatgaggacatttttgacatcatagaccgggaggcagatggtagtgacagtctagagggctttgtgctgtgtcactccattgctggggggacaggctctggactgggttcctacctcttagaacggctgaatgacaggtatcctaagaagctggtgcagacatactcagtgtttcccaaccagtatgacaagctgcgtaagcgggaggccttcctggagcagttccgcaaggaggacatgttcaaggacaactttgatgagatggacacatccagggagattgtgcagcagctcatcgatgagtaccatgcggccacacggccagactacatctcctggggcacccaggagcagtgagtcccccaggacagggaccctcatctgccttactggttggcccaagccctgcctgactgaccaccccctcagagcacagatcagggacctcacgcatctctttctcatatacatggactctctgttggcctgcaaacacatttacttctcctcttatgagactatttatctttaataaagcactggatataaatcaaaaaaaaaatc

SEQ ID NO: 296485 - DNA, 961 bp, Homo sapiens
accacagcgcgcttgcgcgcaggcccaagcaggcgcccacccagaggggagggaggacgccgtaccccgccctcactgaggcgcggagccggatccggaggcgccgagccgcatccggagccgcgcacgcgcaatctgcatgaacgaaggccagtgcttaaagacgtgccattcattgccagaactcggttctcattggagcggaggaagttcgtgggtggagctggttgtttggcgcctgcgtcttgcggcgagcgggctggcgtgcggcgccgttgcgggcgggagcggctgcaacgccggtgcctgaggagcgatgccgagggaaatcatcaccctacagttgggccagtgcggcaatcagattgggttcgagttctggaaacagctgtgcgccgagcatggtatcagccccgagggcatcgtggaggagttcgccaccgagggcactgaccgcaaggacgtctttttctaccaggcagacgatgagcactacatcccccgggccgtgctgctggacttggaaccccgggtgatccactccatcctcaactccccctatgccaagctctacaacccagagaacatctacctgtcggaacatggaggaggagctggcaacaactgggccagcggattctcccagggagaaaagatccatgaggacatttttgacatcatagaccgggaggcagatggtagtgacagtctagagggctttgtgctgtgtcactccattgctggggggacaggctctggactgggttcctacctcttagaacggctgaatgacaggtatcctaagaagctggtgcagacatactcagtgtttcccaaccaggacgagatgagcgatgtggtggtccagccttacaattcactcctcacactcaagaggctgacgcagaatgcagactgtgtgcaacacagcctgaaccgcgacctgcgtcttgtcccgagt

SEQ ID NO: 296486 - DNA, 1288 bp, Homo sapiens
accacagcgcgcttgcgcgcaggcccaagcaggcgcccacccagaggggagggaggacgccgtaccccgccctcactgaggcgcggagccggatccggaggcgccgagccgcatccggagccgcgcacgcgcaatctgcatgaacgaaggccagtgcttaaagacgtgccattcattgccagaactcggttctcattggagcggaggaagttcgtgggtggagctggttgtttggcgcctgcgtcttgcggcgagcgggctggcgtgcggcgccgttgcgggcgggagcggctgcaacgccggtgcctgaggagcgatgccgagggaaatcatcaccctacagttgggccagtgcggcaatcagattgggttcgagttctggaaacagctgtgcgccgagcatggtatcagccccgagggcatcgtggaggagttcgccaccgagggcactgaccgcaaggacgtctttttctaccaggcagacgatgagcactacatcccccgggccgtgctgctggacttggaaccccgggtgatccactccatcctcaactccccctatgccaagctctacaacccagagaacatctacctgtcggaacatggaggaggagctggcaacaactgggccagcggattctcccagggagaaaagatccatgaggacatttttgacatcatagaccgggaggcagatggtagtgacagtctagagggctttgtgctgtgtcactccattgctggggggacaggctctggactgggttcctacctcttagaacggctgaatgacaggtatcctaagaagctggtgcagacatactcagtgtttcccaaccaggacgagatgagcgatgtggtggtccagccttacaattcactcctcacactcaagaggctgacgcagaatgcagactgtgtgggtgagtcctggattctacctctcccaactctcaacaccccatacccactcgagtctattaaatcattttcatgtatttaaaaaaaatccattttagccaggtgcagtggctcatgactgtaatcccatcactttgggaggccaaggtcgttggatcgtttgagtttaggagttcgagaccagcctgggcaacatggcgaaaccccatctctactaaaaatacaaaaattagtcgggagtggtgatatgtgcagaaggatcacttgtgcctcagaggcaggggctgcagtgagctgagatcatgtcactgactgcactccagccggggtgacaaagtgaaaccctgtctcaaaaaacaagaacaaa

SEQ ID NO: 296487 - DNA, 733 bp, Homo sapiens
gggaaaatgggagtcctaaaaaactatgagatgggtctagtttgacatcctgccactagatacctgtacactgactgccccttccccatgcagggctttgtgctgtgtcactccattgctggggggacaggctctggactgggttcctacctcttagaacggctgaatgacaggtaagtttgtgtttggggattaggaaaggtctccaacttggcttcctaaatgactaggggacccagcagatataactccatatttgctggaacaggaaagagttcttatattccctcctatagagaggaaaatgaagttacaatgactgagaaccccatcacactcccagtagtgggaactggagcctagaacctgagccctggatgaaagtcgagggagtgtggccaggtctcaatttggaagcccagagtctaagatgtctctgcccttccccctgtagggctacagacttccaaaagtcaaggctcccttctctactgatttgaccccaccccagtttcgccatcaagatttatctgcttctggacagttgttagggagcgccatgttcaccaggccttcggtctgttgccctgatcctttccccaacccccaccaggtatcctaagaagctggtgcagacatactcagtgtttcccaaccaggacgagatgagcgatgtggtggtccagccttacaattcactcctcacactcaagaggctgacgcagaatgcaga

SEQ ID NO: 296488 - DNA, 4520 bp, Homo sapiens
acttcattcacttgcaaatcagtgtgtgcccacaagagccagctctcccgagcccgtaaccttcgcatcccaagagctgcagtttcagccgcgacagcaagaacggcagagccggcgaccgcggcggcggcggcggcggaggcaggagcagcctgggcgggtcgcagggtctccgcgggcgcaggaaggcgagcagagatatcctctgagagccaagcaaagaacattaaggaaggaaggaggaatgaggctggatacggtgcagtgaaaaaggcacttccaagagtggggcactcactacgcacagactcgacggtgccatcagcatgagaacttaccgctacttcttgctgctcttttgggtgggccagccctacccaactctctcaactccactatcaaagaggactagtggtttcccagcaaagaaaagggccctggagctctctggaaacagcaaaaatgagctgaaccgttcaaaaaggagctggatgtggaatcagttctttctcctggaggaatacacaggatccgattatcagtatgtgggcaagttacattcagaccaggatagaggagatggatcacttaaatatatcctttcaggagatggagcaggagatctcttcattattaatgaaaacacaggcgacatacaggccaccaagaggctggacagggaagaaaaacccgtttacatccttcgagctcaagctataaacagaaggacagggagacccgtggagcccgagtctgaattcatcatcaagatccatgacatcaatgacaatgaaccaatattcaccaaggaggtttacacagccactgtccctgaaatgtctgatgtcggtacatttgttgtccaagtcactgcgacggatgcagatgatccaacatatgggaacagtgctaaagttgtctacagtattctacagggacagccctatttttcagttgaatcagaaacaggtattatcaagacagctttgctcaacatggatcgagaaaacagggagcagtaccaagtggtgattcaagccaaggatatgggcggccagatgggaggattatctgggaccaccaccgtgaacatcacactgactgatgtcaacgacaaccctccccgattcccccagagtacataccagtttaaaactcctgaatcttctccaccggggacaccaattggcagaatcaaagccagcgacgctgatgtgggagaaaatgctgaaattgagtacagcatcacagacggtgaggggctggatatgtttgatgtcatcaccgaccaggaaacccaggaagggattataactgtcaaaaagctcttggactttgaaaagaagaaagtgtatacccttaaagtggaagcctccaatccttatgttgagccacgatttctctacttggggcctttcaaagattcagccacggttagaattgtggtggaggatgtagatgagccacctgtcttcagcaaactggcctacatcttacaaataagagaagatgctcagataaacaccacaataggctccgtcacagcccaagatccagatgctgccaggaatcctgtcaagtactctgtagatcgacacacagatatggacagaatattcaacattgattctggaaatggttcgatttttacatcgaaacttcttgaccgagaaacactgctatggcacaacattacagtgatagcaacagagatcaataatccaaagcaaagtagtcgagtacctctatatattaaagttctagatgtcaatgacaacgccccagaatttgctgagttctatgaaacttttgtctgtgaaaaagcaaaggcagatcagttgattcagaccctgcatgctgttgacaaggatgacccttatagtgggcaccaattttcgttttccttggcccctgaagcagccagtggctcaaactttaccattcaagacaacaaagacaacacggcgggaatcttaactcggaaaaatggctataatagacacgagatgagcacctatctcttgcctgtggtcatttcagacaacgactacccagttcaaagcagcactgggacagtgactgtccgggtctgtgcatgtgaccaccacgggaacatgcaatcctgccacgcggaggcgctcatccaccccacgggactgagcacgggggctctggttgccatccttctgtgcatcgtgatcctactagtgacagtggtgctgtttgcagctctgaggcggcagcgaaaaaaagagcctttgatcatttccaaagaggacatcagagataacattgtcagttacaacgacgaaggtggtggagaggaggacacccaggcttttgatatcggcaccctgaggaatcctgaagccatagaggacaacaaattacgaagggacattgtgcccgaagcccttttcctaccccgacggactccaacagctcgcgacaacaccgatgtcagagatttcattaaccaaaggttaaaggaaaatgacacggaccccactgccccgccatacgactccttggccacttacgcctatgaaggcactggctccgtggcggattccctgagctcgctggagtcagtgaccacggatgcagatcaagactatgattaccttagtgactggggacctcgattcaaaaagcttgcagatatgtatggaggagtggacagtgacaaagactcctaatctgttgcctttttcattttccaatacgacactgaaatatgtgaagtggctatttctttatatttatccactactccgtgaaggcttctctgttctacccgttccaaaagccaatggctgcagtccgtgtggatccaatgttagagacttttttctagtacacttttatgagcttccaaggggcaaatttttattttttagtgcatccagttaaccaagtcagcccaacaggcaggtgccggaggggaggacagggaacagtatttccacttgttctcagggcagcgtgcccgcttccgctgtcctggtgttttactacactccatgtcaggtcagccaactgccctaactgtacatttcacaggctaatgggataaaggactgtgctttaaagataaaaatatcatcatagtaaaagaaatgagggcatatcggctcacaaagagataaactacataggggtgtttatttgtgtcacaaagaatttaaaataacacttgcccatgctatttgttcttcaagaactttctctgccatcaactactattcaaaacctcaaatccacccatatgttaaaattctcattactcttaaggaatagaagcaaattaaacggtaacatccaaaagcaaccacaaacctagtacgacttcattccttccactaactcatagtttgttatatcctagactagacatgcgaaagttgcctttgtaccatataaagggggagggaaatagctaataatgttaaccaaggaaatatattttaccatacatttaaagttttggccaccacatgtatcacgggtcacttgaaattctttcagctatcagtaggctaatgtcaaaattgtttaaaaattcttgaaagaattttcctgagacaaattttaacttcttgtctatagttgtcagtattattctactatactgtacatgaaagtagcagtgtgaagtacaataattcatattcttcatatccttcttacacgactaagttgaattagtaaagttagattaaataaaacttaaatctcactctaggagttcagtggagaggttagagccagccacacttgaacctaataccctgcccttgacatctggaaacctctacatatttatataacgtgatacatttggataaacaacattgagattatgatgaaaacctacatattccatgtttggaagacccttggaagaggaaaattggattcccttaaacaaaagtgtttaagattgtaattaaaatgatagttgattttcaaaagcattaattttttttcattgtttttaactttgctttcatgaccatcctgccatccttgactttgaactaatgataaagtaatgatctcaaactatgacagaaaagtaatgtaaaatccatccaatctattatttctctaattatgcaattagcctcatagttattatccagaggacccaactgaactgaactaatccttctggcagattcaaatcgtttatttcacacgctgttctaatggcacttatcattagaatcttaccttgtgcagtcatcagaaattccagcgtactataatgaaaacatccttgttttgaaaacctaaaagacaggctctgtatatatatatacttaagaatatgctgacttcacttattagtcttagggatttattttcaattaatattaattttctacaaataattttagtgtcatttccatttggggatattgtcatatcagcacatattttctgtttggaaacacactgttgtttagttaagttttaaataggtgtattacccaagaagtaaagatggaaacgtt

SEQ ID NO: 296489 - DNA, 2612 bp, Homo sapiens
  misc_feature (2582)..(2582): n is a, c, g, or t
acttcattcacttgcaaatcagtgtgtgcccacaagagccagctctcccgagcccgtaaccttcgcatcccaagagctgcagtttcagccgcgacagcaagaacggcagagccggcgaccgcggcggcggcggcggcggaggcaggagcagcctgggcgggtcgcagggtctccgcgggcgcaggaaggcgagcagagatatcctctgagagccaagcaaagaacattaaggaaggaaggaggaatgaggctggatacggtgcagtgaaaaaggcacttccaagagtggggcactcactacgcacagactcgacggtgccatcagcatgagaacttaccgctacttcttgctgctcttttgggtgggccagccctacccaactctctcaactccactatcaaagaggactagtggtttcccagcaaagaaaagggccctggagctctctggaaacagcaaaaatgagctgaaccgttcaaaaaggagctggatgtggaatcagttctttctcctggaggaatacacaggatccgattatcagtatgtgggcaagttacattcagaccaggatagaggagatggatcacttaaatatatcctttcaggagatggagcaggagatctcttcattattaatgaaaacacaggcgacatacaggccaccaagaggctggacagggaagaaaaacccgtttacatccttcgagctcaagctataaacagaaggacagggagacccgtggagcccgagtctgaattcatcatcaagatccatgacatcaatgacaatgaaccaatattcaccaaggaggtttacacagccactgtccctgaaatgtctgatgtcggtacatttgttgtccaagtcactgcgacggatgcagatgatccaacatatgggaacagtgctaaagttgtctacagtattctacagggacagccctatttttcagttgaatcagaaacaggtattatcaagacagctttgctcaacatggatcgagaaaacagggagcagtaccaagtggtgattcaagccaaggatatgggcggccagatgggaggattatctgggaccaccaccgtgaacatcacactgactgatgtcaacgacaaccctccccgattcccccagagtacataccagtttaaaactcctgaatcttctccaccggggacaccaattggcagaatcaaagccagcgacgctgatgtgggagaaaatgctgaaattgagtacagcatcacagacggtgaggggctggatatgtttgatgtcatcaccgaccaggaaacccaggaagggattataactgtcaaaaagctcttggactttgaaaagaagaaagtgtatacccttaaagtggaagcctccaatccttatgttgagccacgatttctctacttggggcctttcaaagattcagccacggttagaattgtggtggaggatgtagatgagccacctgtcttcagcaaactggcctacatcttacaaataagagaagatgctcagataaacaccacaataggctccgtcacagcccaagatccagatgctgccaggaatcctgtcaagtactctgtagatcgacacacagatatggacagaatattcaacattgattctggaaatggttcgatttttacatcgaaacttcttgaccgagaaacactgctatggcacaacattacagtgatagcaacagagatcaataatccaaagcaaagtagtcgagtacctctatatattaaagttctagatgtcaatgacaacgccccagaatttgctgagttctatgaaacttttgtctgtgaaaaagcaaaggcagatcagttgattcagaccctgcatgctgttgacaaggatgacccttatagtgggcaccaattttcgttttccttggcccctgaagcagccagtggctcaaactttaccattcaagacaacaaagacaacacggcgggaatcttaactcggaaaaatggctataatagacacgagatgagcacctatctcttgcctgtggtcatttcagacaacgactacccagttcaaagcagcactgggacagtgactgtccgggtctgtgcatgtgaccaccacgggaacatgcaatcctgccacgcggaggcgctcatccaccccacgggactgagcacgggggctctggttgccatccttctgtgcatcgtgatcctactaggtaaactggttctccctgcctcctatctccccatggtgaggggctcacactgttactgtgacactctagatttatctgcctcccccattaaggcatacagcctgatctaggtgagtcgagttacatactgagaatctgtgctgtacgatgtgaactcatttttgcttgcaaatggctttggaaaatgaacagatgtgaaacttgctcgtgtctttgcttgcccaggaagcaaagaatctcttgtctatcagactgggaatgaatctcgggggatttcagggcaacataaatgtgcccttttcatttcattcgttgtgtaatttttttacttggaaaacgttgttaagtgtctggcatggagtgtatgatgaggnccctttctataaaggtaaagtttaaagatc

SEQ ID NO: 296490 - DNA, 2693 bp, Homo sapiens
  misc_feature (2582)..(2582): n is a, c, g, or t
acttcattcacttgcaaatcagtgtgtgcccacaagagccagctctcccgagcccgtaaccttcgcatcccaagagctgcagtttcagccgcgacagcaagaacggcagagccggcgaccgcggcggcggcggcggcggaggcaggagcagcctgggcgggtcgcagggtctccgcgggcgcaggaaggcgagcagagatatcctctgagagccaagcaaagaacattaaggaaggaaggaggaatgaggctggatacggtgcagtgaaaaaggcacttccaagagtggggcactcactacgcacagactcgacggtgccatcagcatgagaacttaccgctacttcttgctgctcttttgggtgggccagccctacccaactctctcaactccactatcaaagaggactagtggtttcccagcaaagaaaagggccctggagctctctggaaacagcaaaaatgagctgaaccgttcaaaaaggagctggatgtggaatcagttctttctcctggaggaatacacaggatccgattatcagtatgtgggcaagttacattcagaccaggatagaggagatggatcacttaaatatatcctttcaggagatggagcaggagatctcttcattattaatgaaaacacaggcgacatacaggccaccaagaggctggacagggaagaaaaacccgtttacatccttcgagctcaagctataaacagaaggacagggagacccgtggagcccgagtctgaattcatcatcaagatccatgacatcaatgacaatgaaccaatattcaccaaggaggtttacacagccactgtccctgaaatgtctgatgtcggtacatttgttgtccaagtcactgcgacggatgcagatgatccaacatatgggaacagtgctaaagttgtctacagtattctacagggacagccctatttttcagttgaatcagaaacaggtattatcaagacagctttgctcaacatggatcgagaaaacagggagcagtaccaagtggtgattcaagccaaggatatgggcggccagatgggaggattatctgggaccaccaccgtgaacatcacactgactgatgtcaacgacaaccctccccgattcccccagagtacataccagtttaaaactcctgaatcttctccaccggggacaccaattggcagaatcaaagccagcgacgctgatgtgggagaaaatgctgaaattgagtacagcatcacagacggtgaggggctggatatgtttgatgtcatcaccgaccaggaaacccaggaagggattataactgtcaaaaagctcttggactttgaaaagaagaaagtgtatacccttaaagtggaagcctccaatccttatgttgagccacgatttctctacttggggcctttcaaagattcagccacggttagaattgtggtggaggatgtagatgagccacctgtcttcagcaaactggcctacatcttacaaataagagaagatgctcagataaacaccacaataggctccgtcacagcccaagatccagatgctgccaggaatcctgtcaagtactctgtagatcgacacacagatatggacagaatattcaacattgattctggaaatggttcgatttttacatcgaaacttcttgaccgagaaacactgctatggcacaacattacagtgatagcaacagagatcaataatccaaagcaaagtagtcgagtacctctatatattaaagttctagatgtcaatgacaacgccccagaatttgctgagttctatgaaacttttgtctgtgaaaaagcaaaggcagatcagttgattcagaccctgcatgctgttgacaaggatgacccttatagtgggcaccaattttcgttttccttggcccctgaagcagccagtggctcaaactttaccattcaagacaacaaagacaacacggcgggaatcttaactcggaaaaatggctataatagacacgagatgagcacctatctcttgcctgtggtcatttcagacaacgactacccagttcaaagcagcactgggacagtgactgtccgggtctgtgcatgtgaccaccacgggaacatgcaatcctgccacgcggaggcgctcatccaccccacgggactgagcacgggggctctggttgccatccttctgtgcatcgtgatcctactaggtaaactggttctccctgcctcctatctccccatggtgaggggctcacactgttactgtgacactctagatttatctgcctcccccattaaggcatacagcctgatctaggtgagtcgagttacatactgagaatctgtgctgtacgatgtgaactcatttttgcttgcaaatggctttggaaaatgaacagatgtgaaacttgctcgtgtctttgcttgcccaggaagcaaagaatctcttgtctatcagactgggaatgaatctcgggggatttcagggcaacataaatgtgcccttttcatttcattcgttgtgtaatttttttacttggaaaacgttgttaagtgtctggcatggagtgtatgatgaggnccctttctataaaggtaaagtttaaagatctatgggaaagtgggaagaggagtatgatgacttttctctcatcctagaaaaataaaaactatgaaatttttttaacccaaa

SEQ ID NO: 296491 - DNA, 728 bp, Homo sapiens
  misc_feature (67)..(67): n is a, c, g, or t
ggattagctactctcatttacagataatggaaagggggccaatgaggaggtgagaaatcgctcaagnctgcaggtacggtggctcacacctgtaatcccaacacgttgggaggccaaggtgggcagatcacttgaggtcaggagttcaagaccagcctggccaacatggcaaaaccccatctctactaaaatccaaaaattagtcgggtatggcagtgcacgcctgtaatcccagatactcggaaggctgaggcaggagaatcatttgaacctgggaagtggaggttgcagtgagccaagatcgtgtcactgcactctagcctaggtgataaagcgagactcagtctcaaaaaataaaggaagaaaaagaaaccaggtgactgttgtgcccgtctcttgtccccgatctttctcccaatcctgaggtccatcagctggaaggacatatccatccggaggcctccccaagtgtggtgggagaaatccatcccctctctgacactccccccgcctttccctcccgacacccagtccccgggagatcaaaatttaacctggtgttatctaggctggagcctgaagagcccggtgggaagtggaggacggagaggaggggcatggacccagaaagttagcaggaagtcttcagagacccttatttttaaattatttatttttgtttgttttgttttttgtttttttgtttccctcttgttgcccaggctgga
